United States Patent 6,812,339 (POLYMORPHISMS IN KNOWN GENES ASSOCIATED WITH HUMAN DISEASE, METHODS OF DETECTION AND USES THEREOF) - sequence listing, part 36

SEQ ID NO: 13694 - DNA, 91831 bp, Human
gagcaagaaagaggagccaaactgagccctgagttttcgaccacccgggctcccacagcctggaacagacttcacctagcacgctcagtgccagccttcggcaggacgctatcaacgcccgactggtttcctgctctcatcctggcgcctgggcccagttgccatagtgtggatcccatgactcctcagggaacccctggactcaggcacgcgagaagaagacagcgctttgtggagagaattgaccagggacagttatgctcgagcacacaggacttgggcctgtatgcgtccagcatgggccccaggatgtcccttctaagcgagggtcgaggggtgctcgcccagacgggatccccgggtctctgctttgttagcagctttggtggctggttcaggaggtcagagaaataaaacgacttgtgaacacaatggaaatgacaggcgctctggccaggcgcggggaaggcagccgcctcgggaagccgacctcagccctttcctctctctccctccctccgtctcccccagagccccggagctccgaggtgcacttgaagttcatctccactgccaggagaacgcagcgcaaactgtcaaagggctcccaatccttagggcgtcctccctgtctgcaatagctttttgtagaaaggaaatcatcagaacgattctgactttctcctcctttctttattagaaaaagagaaaccgcctcctaatacgcctcagagagaaccaatctcgcgcttccgggtcacccgctaccgcgaagattctctgggggcgagggggggcattggtttgaagccccttaaaacgagggccctgcaggcgatgccttctttcctactcggatttgtaaagccgagattgcttagttggaaaccctgttctcccctcccaggcgcacacagatcccccttacacgcaagcagcgggcgcttccacgcctccgcgggccaaggtcaccaaatgccctgattccatcccccacccgccatcaatcctgccgactctggccgctctgcctcattctcttccaagaagtttccattcgttttatttttttttccccagcccgaggtcctcagtagactccagcgtggattttaattgcctcaatcagcagtcattctccccagccgtcactcagagcctggacggtgggtcccgcgatctagcccttggctacgcaggaacggtgcgcccccgggtacggcgcggttcagcaggcaggcgtcaggttctaccaaggcgctgaaatgagcccatcagcgggtaggagcccttcccccgccgtcccctccccaggctcgtgaacggcgcctgatgcccgcccggggcgcgagctctcgaggtcgcagtgacctcagcacctgcttggaggaaaacggcgcgggaaccccgcttccttcccctcagctggagccagacctcaaacaaaaccccaatcgatgcacacagaaaactcctctgggccacgcttcccgcctcgccgaggtctccccagtctgcccctcgctgacgctggcgcgcagcggctgtggcagcacccgggacagcggccgcccgcacttcccgcctctggctcgcccgaggacgcgctggcacgcctcccaccccctcactctgactccagctggcgtgcatggtctgcctcgcatcctcacgactcagctccctccctctctcgtgtttttttcctccgccgccccctcattcatccccactgggctccctttccctcaaatgctctggggctctccgcgctttcctgagtccgggctccgaggacccttaggtagtcccggtctcttttaaagctccccggcttccaaagggttgccacgtccctaaaccctgtctccagctcgcatacacacacgcacagacacgcacgttttctgttcctgcgtgacacccgccctcgccgctcggccccgccggtccccgcgcggtgccctcctcccgccacacgggcacgcacgcgcgcgcagggccaagcccgaggcagctcgcccgcagctcgcactcgcaggcgacctgctccagtctccaaagccgatggcatctccgggctctggcttttggtctttcgggtcggaagatggctctggggattccgagaatcccggcacaggtaggaaggagaacgggggcctgcggcgggcgagttttgcggtggtctggggtttgcggaactacggagaagacgaaggaggtttttccacctgcaacaggaaacttcttcgggcgcttctccctgcttttgggctaagtccttgacggcccaagagctcaagacctctacagcctcttgtaccctgggaagacgcccaaatagtctcaggcccgttccacagaaggttggaagagccccccaaagaccgcggtgtctcggggacatggaattccgtggtcctggggcgctgctaagatccgggtgtctggaccctggggtgggacggagtgaccgtgaagatagaaaaaaaaaatgggaaaggtgagagatttctttatctagaaagacagtctgcgaaaaaatggatagcttcagtgtttaggaaaactcgtccaaggtaggcagggagaggaatttgcctgagccgattggcacctggaagggcagcggtgtgggcttctcctcgggaaacagataaaggaaatgagggctggcccgggccgccagcctcccgcttgccttctgcacctgccggcctcaccgagtcctgagcggcccccaggaggaaggcggcccctcctaggaccccggactgattgattttcacatagaacgaaatttcacacgtccgtctgttgttctctttctgcctcgctgtctgcctgcctattcttccttgcagcgcgagcctggtgccaagtggctcagaagttcacgggcggcatcggaaacaaactgtgcggtgagtgcccagggaccggggcggccaaggtcggcccgcggggtccaagcagtcttctcacctccgcatcccagtcagcggagtcggggtttcctggctgcgggtaggcgggagcgagggagccgggcccggcggaggattgacgaggcccgcgttcggtgtccttacccagccctgctctacggagacgccgagaagccggcggagagcggcgggagccaacccccgcgggccgccgcccggaaggccgcctgcgcctgcgaccagaagccctgcagctgctccaaagtggatgtcaactacgcgtttctccatgcaacaggtaaagactcagcggggagccccggggcgcccctgcccctctctctgccccgcccaccgcggccggtgcgggtccggcgctgagagccggacaggggcgtcgaggtggcagcggaggcgggacctgccagaatcttcagataaaagcgagaaatgcgggacctgcccgctgggtccaagcccccgaacctggcctcggagctccaagagggctctgaggccgtggcgctcttcccccagcgcggcccttgggatggcgggtggccgacgatccaggcgctcgtgcgctcactgaatcgatgacggctggcttccctaggccgctggggcctcgggtgggactcagtttccaaataccgtgcccgagaattcagaattgcattttttttaggtctttagatcacgagagtgatttgtagctgcaattgcacaagagaacgattccattcacatgaaacccgcgcgccgagttttacccccgtgcacttacacaccgtctcccaaatgtacgcgcgcacacacacatgcagacacacatgcatacgctctctctctctctctctcacacacacacacacacacacacacacacacacacacacacacacactgactttagaaacagcgggccttcctatcagaccagagatcctaatgcacctgttccactttggtttgcccgaaggcattcgagacaaacacttctgacgtgaaatatttatgtaaacatgtaagatggtttactgagaaacacgtttaagacgaactcctgtgaactagataaacggaggtacacgctcttcaaaaaaagaaggcaaacaatataagttatgaattgaaatgcagtaattaatttggggaagagaagaaatcataatttatctcattcattcccttcacctttgaaaaatgtctcccttttaaagaaaaatgttctgcctttccaaaagctttatctaacatgaaatctctcaattcaaagaaatgttattgcctcatcaagatcttgccttgaatattttcaaagtaaaattaaaatgtggcattttaatttcattctttagacctgctgccggcgtgtgatggagaaaggcccactttggcgtttctgcaagatgttatgaacattttacttcagtatgtggtgaaaagtttcgatagatcaaccaaagtgattgatttccattatcctaatgagcttctccaagaatataattgggaattggcagaccaaccacaaaatttggaggaaattttgatgcattgccaaacaactctaaaatatgcaattaaaacaggtattgtctcatcgaaaataataaagctcttttttcgtttacaatttttattttatttttttctataaaatgttttgtttgatggagttactgatattttcaaaattgcaaagttattttcatcatgtaaaaaatagtcattattagaatgattctaatccaaagcaccttccactgctattgttcatgcttctgaagttgataatgtcagaaacatgatttaagtgtaaatcatcagattttacgttgcatgtatttggacacggaggttataccactggtatagaagcaaatattcatcagcagagaccagcagaaagaactcaaagtggagaaagagaatatggaaataaaagctcgaaaaatgcgtgatccaaacaaaagcccgaataccagtgctgtgctggtattttctttggcataaaactgatcagaaacaggactcaccaccctattaatcattgagtgggagggatgttttcacattgtgtcaaatggccaacctttcagatttgaattcagattttcacttatttttaaggaaatgtgcacaacacacaagcaggcatgatacagactagcttagcaattcagccatgttatataaggatgtgtgttcctcccagccactgtatatgtgagataaagaaaaagggggggaggggcaaatcagatatccttagggggaaatttttttaaatgtacttttgtggtctcttggcttttcacaggagtctttatattccatccatattacagcttcatttataacatttatttgggtgcattccgagctttcatgttatctacacaaagtcagccattcatctgcccaggtcttgattaccctcgctttttacgttgtctctaatcatcctgatacacgatggctgacacttcattacggcaataaaaataagtatgaatgaatttccaggggtggggaggactttgtggatcgaagttgatgtgtagcctttaaaagatttgctagcaaataaaaaatgtgaaatatgacatgaacattcatcaccatagaaacgtcatctttttagattgcaaacattttgctgatgaattagcagtattacgctaatcaataacaaacattcttaaaatgtttgctgtgagaagtttagttctttttttctttttgttcacattatttgtaccaacagagaagaaaggtaggcatacaaaaagccttgggacatagatttctatcaaagtcaggctatggaataggagttttgaaggtgtattagacatcatcctcaattaacgttcatgaagaacccacgtgatgtttataccaggcattaaaaattttcctacccctcctcagcttttcctgcattcatagtgcaatcctgggtgatgcttttaattcattttttgacccattccccataccttatatttagatacgttaatagtaaattgccacctattgtttgtattgctaccaaaccaaaaagaacctatggaaatgttttgtgtcttcatccttgaaagctagtggtgcctgaaatgcagtctacagagttaagataatgggaactgcaagtcaatgaaagtaatagttctgtctatcaacgttgcatttagtgccaggaaaagatgggctaattcaatacttacattttgccataatgcttatgaaactgttaggtgtcactgtaatgcattttatttaaagttcagataaaaatgtgatggattaagttggatttctaagcaaggcatatcaattcaatctctcaatagttttcataacatatttagtctgctggccttttccttcaaatagcatttcaaaaaattaacagcagtcattttctctattcagctggcaactttatagatttctgtgctataactgtcatacttgtcatctaatgctatttagggtatgtcaaattagttaccatccttgctactaccagacattttaatactcctcaagagattattttataaaatgcatattatcatcttgtttctactgagagaccttaacctgatttccacttgggctccaagcttagagaggagtgaagggcagtgggaaaatgaagtcttcatggattgttaaaattacctctgtaaaaagaaatgttggaacacggaaaactgagcagagaatgatagaattccagaataatttgcatttgcagagatcattagatttggtgctagtggtggtggtgctggctggggaagagtaggacttaaatgtggtcctgaatcttttaccaaaccatcagacaaagggaattaagcgtcagtagatgaggcagccctagtgtgagtgttgccaggacataaagagcagtttggaccgacttttggcctcttcccaactgatcatgagcacagggtcagagttgcctgaggctggttgttcgcagagtctgcgcatccttccgggctcatttgctagtctgcagggagcatccctgagtctgagcagccagttctcacatctcaagctcgccaccttcctggctgcataggctgtgtggccacccaatggctgacgcagtgcgctctgctcccatcacagggcctggcagggtggcgacagcagcaggaggccaagggctgcagggacacctgacctatgggggcaggtctcacaattccttggagagagccctgccttgatttgctgggcagccctaggaagcagcctgtaggggccacaggatgggagcaaatgtcactaggggaatatttctgccagaaatcgagagagcctgttgatctgacctgtcaaactatctccctccctattttcacatcatcatcagggaatgaaatttttgaggcaggagagattcaggtgaaatggcagagcaaggtcaaaatatatatagggaggaagggaaacctagcaatgaaagcgtcaaacctgttttcactgtttacggaaagttatcatcagggtgaattggccttctgatatccagaggcacaacacacccctcacaatctctctccatcttatgcacaggttttcattcccaagtttccctagagttaaatactgtctaatcatagacaccacattcatccagaaaatgaatatgaattataatccttattaatttcctcacttgaaaaaaaaagggttagggaaagagaaatgaaggagcatcgggagggaggaaatggctgtgatttcagctgcgagcataatgaaatggggagtcaatgaggcagagaggagtgaagggttgctccagacctcagtggccacagcagcaaaaaagccttctcacccttcgtggatgggtaaactgagggggtcagcatcagagatagaggggtaccacacgaggccacaaggacataaaacaatgctggagaatgtacaatagatacacaagtcctgatcccgctaaaatgggctccctcccagcttatatctttacccagtgtctgtctggccacatgcctgaggctgataagagagcactccagtgcaggagataagctagccattgacttttgtccctgctcttccccattgccttcctttatcttgttttgcctgtgctggagatgagagacaatcacatcccaggcttcagacagatgtccaggatgtggaagatacctttttatcagatgctatttccacaatggcccatcttctaaaatttttgctgctgtgcaaatcacggacctatcgatgacaggcttttgtggagcaagaggagaaaactgaatgctaatgacatatttataatcacattttaaataatagcctcaggagagtgtggatgtcaatccatttagagagttttagaggaatctagaagttaattagataagccttgcgatggactaatcagtcgattgagtatatctttctgtatcttgttgataaaacagtgatgttgactgtatgtggccttattttaaatcacaactatggaggagcgctgttgtttataattaacaaagaagaattgacaagaattagctttgtccatgccatctttagacaatcatcaccttttgaatccagggcaaatcattcagcagagtgtcctattttctcatttttgccctgtcttttgtaatcatcagccatttgtcactgatattattatgaatgttggcatgcctggcggatgtcatggtatgaccgattctcagaacgactacaaaaaaggacttctagcagcatgagtataaaggagaagttacctgtctgaatggctgtgggttgcagtagcattttagcttgcgaaaatattgaaaatagaaaagagactcatgcagattgcaaaccatatttgttatatttatagggtccgattaaaggaagatttgtagggtatgttttaagaaatatcaaaacctaaagtagtcttcgtggttagaggaaacgcttttatggtgtgtgtgtgtgtgtatgtgcatgtgtgtgtgtgtgtgtgttcttgtgcatacacacgtgtgtacatgttggatttctacttatggatttcctgttactgacagatctttcaaggtcctttagctagagaaatcatgtgtttgagaggcatttattttcactggaggcaatcctgattctggtattccattttattcagggcatcctagatacttcaatcaactttctactggtttggatatggttggattagcagcagactggctgacatcaacagcaaatactaacatgtaagtagccaaatgtgtttttatgtaatttaggataattattagtgacattccatagtctttacatcttatgtgaaaatctgttttttattaagtagccactaaaatagtgatacaaacttctgaagtgtgagtgttcactttaatgtaacagaaagtagtcctgatacatcttccatgtaatcaaactctacaaaatttttaaaatacaaaagagacttttttctcacgtttgatttattattgtgcataatgtcaaagacaaatgggaccagatattatattttaaatcatgttactctgcaatattttttatttattcaatacaataaattcccctcgtgcattatgtcagtagttggagctcttgactgtagggatatagaaaaaataaacattttggaaggcctttttgaaataattttctctctgcttaatgttataatcataacacttgtaaatgtatgttttgaaaaaggaaatagttctgtagctattgtaatgattgtaaattatttatctgagttacagaggtaaaatgtggccattactacatttcaggttcacctatgaaattgctccagtatttgtgcttttggaatatgtcacactaaagaaaatgagagaaatcattggctggccagggggctctggcgatgggatattttctcccggtacatgatatttcaactttctttgtgttttttcttctaatatgcaatgccttgttgtaaacctagggaagattaaaaatctagcctatgcctctgcttaggttaaatagactgtgtgttgatcaaaagaatgactgtgattaagtgcacatgaccattgaacatgcctccaagctaagtaacccatgcttgaacatcagttatttgtgtgcaaagtgagcataatcagagatggtacttacccagtgcttctactgtgaccctacaaacaggatgtacggataatgtggaacaaaggaatcaagattcctaatcaggaaattcactctctgatgctcttcctagaattagtgaaaggaaatgggtagcctcatttaataaagcatttgctgttcaagggtgcatagcaaggtatatctactcagtagagcatatggaccactctgtctttgaaataacaagcaccaaagtggatttacactaatttcaaggaggacagagaacgctttgggagagaatttcttagagcaaaaatagagggtgacgatttcttcaagagatttctcatcccttctcttctttatcatgccattcagtcttttccatcctgcctttttatcaccagccattgaattctaagctccattacttagacctcttccagccaagagaatcaacctgaaacaaaaagctgtgcccttggtttacagttctgtgtgtgaccttggtttgatgcagaaaagaaatagaagttaggaaggcaatgcaaagagagtcactgacccatggaaaagaaacccgatgtgcagaccatcagctaatcagtggcaggagcggatgtcattagtccactgagacaggacccacctgagagagaggccagagcaacacctgtcgttgtgtcagacagagcaaaggccaagtggttgtgctctctcttcagcaaatctacaaagacaagcaaatgatgaggcggggataggggagaaaagaaaaagtgaaaagaagaaatgataagcaagagtgaccccaaggccagggcttaagttaagcatgtttgcctgcaagctctggtcagctattttatgtgtttaaatatatagcacaatttttcaggtgctgaaggaaaaggtgttagttaaatggaagggaaaattagccttttaaaaagtcattgaacaccagctgtgatgaattttaagctagcctttattttttatggcacttagtacttagttttcctttggaaagccatccctgttgagggagcttggtcatcattgcctgatgctttgaaaacattgttcatgaggaatgaggtggggtacagagatccacatcatttctacctttcttcttcccacccttgtgtggttggttataggattgatctgtccctgagatgaatcaagaacatgctgggctctatttttttttcttttatttgcatttattttatgctgaatttattcccgtgcataagttttaatggtccccgggagtagggagaggacagatgtacctgttgaccctgaaaatttgactaatttgactaacagctaggcctaatttacctggctggtctgaaaaacctacatgccccagaaaacatacacccagagaaataattctcttaggcagttctgctaggcttagagcttaccctccaccctcactgataatgggggattttcacatggagaagacttcagcttgagcatgggaattataggcttccttggagcctaaagacccatttgctcttacgccaagatgcaagccatagatgtcacactacagtgcagtgcagacattgcaaagttgggaggagacagcagaaaaggtcattgcaacctgtttctgctctactttctacaagacatcacagacgagaagtggctcatcacatccttactggctatggatgctattcccgggagcaaccagccttgctcctgcagtaaagggtcttacaatttaaggggtggggatagagaaagccacacatcttatgcatctgggatctaaaagtctcattccctgggactcaatgtgaagagttaggtctgtgacttaaaacatactgtgtcatagctccatcaataatatccaaagccttcatgcttcatggaaagtcctttaggactcctagaagaaatctgcttttgtgatgtcacctacactgggaaccagagaaatacagagcattccttactgctcagcaggtcacaaagcacaaagactaaagaggggctaggaaagaaagcttggcttagtcaccgaccttttcctagctaacagggttttcataatgtttcagcacttgcttttattcatgtattttattttttatttttttgagacagagtctcactctgtcgccaaggctggagtgcagtggcacgatctcagctcactgcaacctccatctcctgggttcaggcaattcttatgccttagcctctagagtagctgggattacaggcatgcaccaccatgcccagccaatttttgtatgtttagtagagatggggtttcaccatgttggccaggctggtcttgaattcctgacctcaggtgatctgcccacctcagtctcccaaagtagcacttgcttttacatcctttcttagaggattcgtaggaaataagagcaggtagggctcacgcatttgtcctcatgcctctgttacacaaaacagtcttctctgcctggaggcccagaagcctctttctctcactcagagctgctgagcctttagccagaggacagctgagttgcagagtgaggtgtgggagggcagggctggaagcttcagaagaaatgcacatgaagagcactttcttaggatacgtcttcccctttctcttcttccctccttccttctccagcctctttaagaacaactaaattctcaaacaagatcattttgctccccacaagggacatttggcaatatctatagatgcttttgattgtctgggggagagggtgctatgggcatctggtgggtagaaaccagggatgctgctcaacactttacaatgcccaggtcagccctcaccagttatgttgcccaaaatgtcaggaagtgccaaaaccatgagctaggatggaatttccttctgaagcagaccctgcttccagcatcctacagccagcctttcacaccgggtgtctgctcagagcaggcgtgacctggattctacctgattctacctgtcctgtatctctagagtccagaaaggaaggaatcgccctgattttgattgaggacagaggcatgtgtctgggtgatgagtgctctgtgctgggcagcctgcttgaatcagagcccagggctcaagagacaaaggtcatacccctgcctgggccattcagcttgacatggagccctcctgctcctcagccaccaggaaggagagtaactcacaacactcacgtgacggcaggacttggggtgttccccttggtcaggaggtagaggcagtaccttcactctgccccatggcctcatgtcttccatcccagcatattaatttgcattcataacaatctgtctttcctgaattgcaaacatcctaaacttcccaacagccctgcattttctttgcttgtcaagtgagactctacttacaagacacaaatcttatggcgtggaatccctgacaacttttggatgacacagaaaacgtaacacaatatggactgaaaattctcttagttgtatgtttgtctatacttatgaaataagttttgttagctaatacaattctattatttcaatgatgtctttgagagggaagaactagtttagagggaatgaatagatgagtatgatgagatggacgtggaggtttatcctttataacaggggtccccaaccccctggtggtggatcggtacaggtctgcggtctattaggaacggggccacagagcagtaggtgagcaaggggcaagcgagcattaccgccttagctctgccttctgtcacatcagcagccacatgagattctcataggagcgtgaaccctattgtgaactgcgcatgcgagggatctaggttgcatgctccttacgagaatccaattaatgcctaatgatgtgaggtggaacagtttcatcccaaaagcattctccaccccacccccaccagcccccgaccttccatatgtggaaaaattgtcttccacgaaacgcatcactgctgccaaaaaggttggagactgctgctcagtaaaaattgttgattaggccaggcgtggtggctcacacctgtaatcctagcactttgggaggccgaggcgggtggatcatttgaggtcaggagtttgagaccagcctggccaatgtggtgaaaccccgtctctactaaaaatacacaaaaaaattagccgggtgtggtggtgcatgcctgtggtcccagcttcttgggaggctgaggcaggagaattgcttgaacccaggagatagaggtggcagtgagcggagatcgtgccactgcactccagcctgggcgacagagtgagaccctgtctcaagaaaaaaaaaaaaaagttgattagcagcttacaccagtaacagctgatttatgttaatccaaatgcaaggcactgaatgagttgaaatgaaaaaaaaaaagctttctccatccagatataaccagaattttacacacctagtgcagaatgaccatgctcacaagctgggatggaggcaaaccttttgcttttgaattaaaaacctcttcaaagggcttccagcaagagtagaatccactgcagttccccttagtgactgagatggggtgtgacagtggcacctgtcctgtccccatgtgccctctggggtagcgcctttgagtctgaggattcagtttaaagatagtcaataggtttttcttctgagtccaaggaggactcaggtcagtggaaataaggaatgttgcttgcatgtgaaatgaggttgataataaataaagtaactgcgtgttgctgtgcactttaggtggcgccatatctaacatgtatgccatgatgatcgcacgctttaagatgttcccagaagtcaaggagaaaggaatggctgctcttcccaggctcattgccttcacgtctgaacatgtatgtgtttcttttccttgcaagtttaaggttatgttccataaagcccgagtttaaggagtgatggctggaaatgcattatccccagaggccctctttctggaagacaccttgggagggaatgggggagaaagctgagtggtactatggggtgtcctccttgactctttgaaattcaggaaaaccctcaaagataaaggagcagcctgggcaatatagtgaaaccccatcttcacagaaaatttaaaaaaaattagccagatgtggtagcacctatgatcctaggacgctgaggtagcagaattacttgagttcaggaggttgagactgcagtgagccgtgattgcaccaccacactccagcctggatgaaagagcaagaccctgtctaaaagaaaaaaaaaaggaaaatatttttagctctagttcctacccttcgcttctgcgcaatcaagttgcatattaagggaaggggaagaggagggaaggggaagaggagggaaggcagagggactgtgagctcatttggaccattgatgctacgcccatgtaagcaaaactccagaggagcctttgatacagtttttctgtttgaaaactcagcccactgatctgatagatattctgccctcatggtgccttgagcctttttgtttgtttgtttgtttgtttgagacaatctcgctatgtcacccagactgtagtgcagtggtgcaatcacagctcactgcagcctgagcctcaacttcctaggttcaagcagtcctcccacatcagcctcctggatagcagggactccagatatgtatcaccatggctgactaatttttctattttttatagagacagggtcttgcagtgttggctaggctggtctcaaactcctggcctcaggtgatccttccacctcggcctcccaaagtgctgagattacaggcgtgagccaccatcatacccagcctgaaccatttaacattcatctttggctgacttgaccagaggttttgttaccataaagaaatagcaccgtaccaggcacggtggctcatgcctgtaatcccagcactttgggaggctgaggcaggtagatcatttgaggtcaggagttcaagaccagcctgaccaacatggtgaaacctcatctctactaaaaatacaaaaaaattagccagacaaggtggtaggcaactgtaatcccagctactcaggaggctgaggcaggagaatcacttgaaccgaggaggcaaaggttgcagtgagaagagatcgcatcactgcactccagcctgggcaacagagccacactccattctcaaaaaaaacaaaaacataagactgttccttcatgatctctgcctcacagtagcctgggctttggaatacagctgcctcagagacaatcaggaagccctctgatagccagggaactaggagacagggagggaggaagggcctagagggagactcagggctcctgtaaggaaatgtcactcaggagacgcagggaaccgtggtgggtctcagatccagatccaccatgaactttttctatttcctattttaagtgaggtatgtgtatctatgtgtgtgtgtctgtctctgtgtgtgtctgtaggtgtccatgacaaggaaatagattggaaatcagtggatacagttcattaccacagcagtagctgtggaattaaaggaaactagcaattccatgttaacaaattatcaaagcatcttgttttcagtcatcttttggggttttattttgtgaaatgtccttcttcaacgtataggggtcacattgggcaaaaaccacacagcctaaaattacttagtattttacctttctgttgctgctggaacaaatgatcacaaactttgtggcttacaacaatatgaatgtattaccttatagttctgggggtcaaaaatctaaaatgggaaaagcagggctgcattcttcctcgaggctctctggaagattccgtttccttgatgtttccagtttctagaggccacctacattttttggttcatcttcagaaccagcagcatagcatctttggatctctctctttctctctctctcacctctacttctaccaccacatctctttccacctgtggctctcctgcctctctcttttggatctactcagataatccagggcaatcccccgtctcaaccttaacctaatcacatctgcaaagtcccttttaccaagtaaagtaacatattcacggtgttgaagatgaggatgtgatttttgtggcagggagtatctgttattcagcccactctacctagtaccccaccaggagataactttcttttctcagcttctccaaggatagaaaaacgtgatctatttttctcctcaattactattttcctgaaatgggtttggacccctaaatagttacatgttattacattctcagcctcaaaaagtccagatgatcttttattgggcgtctttttcttttggcttccaagctgcgtccacaagttaaaatgagtttggtccagcagcaagccactctgtgctctctgccaggcatctctggtttgggcatgagcttctcagcctcatgctttatgtaaattgactgagacttgatcaggccatgtggtctgaggatctaaaaataacaattttgctctaccttcttttcctgatactgtaaactcagtctactttttttttttttttttttttttgagtcagagtctagccctgtcgcccaggctggagtgctgtggcgtgatctctggagtgcagtggtgcagtctcggctcactgcaacctccatctctggggttcaagagattcctcctgcctcagcctctggagtagagtagctgggactacaggcacgtgccgccacacctggctaatttttgtatttttagtagagacagggtttcaccatgttggccacgctggtcttaaacttctgacctcaggtgatccatccgccttcacctcccaaagtgctgggattacaggagtgagccgccacgcccagactacttcttcatttctgagaaagaaacacaattcggccgtataacaaccatttgactctcccttctccttcttgtgtctctatctatgcatacagtagtgaaggatcatttgaattacgaagctctcctaaaataccaataggctctaactttggcctatcatttgggttatcattgccttatcatttttgacaaatagtttttttaatatataacaccttatatctgactactatttgacagtttccaaaacactttgaagatatggaactttgattctcacagcaaccttatgggacaagtagaacagagattgttatctgcattttacaaatgaggaggctgaaattagctaggtaggtagagccaagatcagactgggtttactgggtccaagaccagtgagctccatgcaccgactaccactgtagaaaccagattaaaagattcagcaacagagctttgtatacagcagcttatcaattgacttaacatcttataccttccctgatcaagtttccaccaggagctgttttcttaatgtgaaaccgatgctaatttgtgactctctctttctaccaaaaaacattctcatcatctcgtagggttgggctggagggggttttcggagctcatttaaagccgtcctgcatcttcttgaacccttgaccctaaccatcctggacaggtgagctcttaaaagtgagtcctgcctttgaagctgcaggttaagaggtaatacgatccccatcgctagttccttctgggctctagacctcagacattattttcaattcatcatttagtgtagcttccttctggcttcaggccaggccacatattttcttggtcttttcagattttacaatcacactgtctccaccagctccagaaatagatctccagaggcagaaaaaagaaaattaccaagtcatttctcaaatgccttttctccggctagacaacatcaatcttggcatggaggcttctttcctcaattgcttggctggcagggagaaaggataatggaggggctgctgtgttgactcagtgaggagagggaggccatgggtcaagacagacgctgcttcgggtgttctctcttcacacattttgagaggtttccaaggcccaagactcctagaaaatcaaatgagagccttatagaacttgtgcctcagtgcctgggacacagagagctctgcataaatatcaaccaactttaaaaaacaacaacctcagccgggtgcggtggctcacgcctgtaatcccagcactttgggaggctgaggcaggaggattacttgaggtcaggagtttgagaccagcctggccaacatggtgaaaccccgtctctactgaaaatacaaaaattagccaggtatgttggttggcgcctgtaatcccagctactcgggaggctgaggcaggagaatcactggaacccgggaggcagaggttgcagtaagccaagatcgcaccactgcactccagcctgggcaacagagtgagtgagactccgtcaaaaaaaaaagacaaaaaaaaaaaaaaaatcccaccttgttttacagatgaagacaccaagccccagaggtgggggatactttgcccatggtgtcacagccagtcaatggcagagcaagattcgaagcctcagtaatttctcaataataccaacactgctctttataaactttttttgcattcagtgtattttattgaattgaaaaatcattcctttgatgtgtcatctaaggataggctctggaatcagacaaacacaggttgaaatgtttggttttatcatgtactagttgtgtgacactggacaagttacttaatctcgctatgcctcagttttctgatctgggaaaggaaagtcatattaatgctcctctcataagactgttgggagggttcaattagacaccatcactgaagagattagcatagtggccagcccaagactgctctttcaactactgggttggatgtcctaaacgcttctctctggctagctgctctaaattcacttgtagcatcctttcttaaatcccattttccccatgttgattattcttttttttttgagatggaatctctctctgttacccaggctagagtgcagtggcgccatctcagctcactgcaatctctgcctccctggttcaagcgattcttctgcctcagcctcctgagtagctgggactacaggtgcatgccaccacacctggctaattttttgtatttttagtagagacaaggtttcactatgttggccaggctggtctcgaactcctgacctcaggtgatccacctgccttggccttccaaagttctgggattacaggcgtgagccactgtgcccggccccgttagttattcttgtgctaatttcctgatctactgaaccaggtcacattactatcccttcttccaatctgagcactgagtttgtaacttggcatgtttagagccatagggatgggaacaacattgcgagactctgtggccttctgcatccaaccagaaatgttcacatattcatgaagggaagagccattttgttttctaaatgacccttcactctgtctctgttgcaccccaccaaagctacccacttcttttctggccaccaacaccgactagagctttgcttatctgatgaggagggcaacctattaaatttttctggttgtttgaatcaactgttttcttgtaaaacttgaataagactaaattaaacaactagtctttctgtggcaagcgtttaagagttccaagattacttttctctaaaatagagaatcacaaaatctcagaattgaaagtgatcttaaagatcctttggttcaacacatcctttgctggaatctcatcccgttccccaaatcttcagtcatacaaaggcttggcaaaaattaacttgatgagttttaggttctctctttaaagtaggtttagagggaagctaagatcccagctcaataattcacatctcaagctctgaatcctttgaaagcctaaaccatgagctcaattccaaattcctcttatttctttgtggcacaagctcttccagaaatatcttccgcgaaacagcataacctcatctaggaaacatattcttcctaatcataacaaacagtggctctttaggcaaatcaccgtaactaattcgctccgctcttcacatgccaagcctggcccacacccacatcccccagaaccagttgccaatgttctgctgaggccccttgtggcttcgacccacttctgtggggaggtaattctcaaaattgctctattttagtttattattttattttggagacaggatttcaccctgttacccaggctggagtacagtggcacgatcatggctcgctgaagcttcaaactcctgggctcaaacactcctcctgcctcgcctcctaagtagctgggcctacaggcttgagccaccacatcttcagaaagatgactttcttttcttttttctttttttttttttttgagatggagtctcactcttgtcgtccaggctggagtgcaatgacgcaatctcagctcactgcaacctccgcctcccgggatcaagcaatggtcctgcctcagcctcccaagtagctggaattacaggcgcccaccaccacacccggctaagttctgtatttttagtagagacggggtttcaccatgttggccaggctgggctggaacttctgacctcaggtgacctgcctgccttggcctctcaaagtgctggaattacaggcgtgagccaccgcacctggccataaagatgactttcacgtatcattattggagaggtttttagtttcaaaaatagatctcctttaaaaaattcttttaaacagtgacctgtttggaaacagggctgtttgggcaatttggaaacagatgacttccacaaaatgtattgctccccccttagtcggaactgacagtgagtgaaattgtgggctaaatctatttaccttcagcacccctgctcctgtgctgcattcctacctccttctcacctcagggccctcatcgctcccatgttattttctcctctacccagtccatccaaacctcctctcaggaaagaacctgaaagccttgctgagatgtaagcaataggtaagacctccccattgcctctcctggggatattcccatcgcactcagagaggcaaagctgtgaggtgctgagacacaactcagccactgtgcagagagatgcttcctttattccttccttcctttagtgctgcaggcgccaggcgttgcttctggcacgggggagagagcagtgggcagaacacacccagtgcccgctctcagcaagtgtcccttgttctggggaagaaagggatgggaaggggctcctgagatcccatccacgccaggtgacggatgctcccttgttcccagtgccaggtcaaaagtggctgaacagacttattgttctccaggttagtgatatatcctgtgagctttggaattgatgaaatggtgacaggccctgctctgccacctcccaaggcatgacccttcgtctcctcctcatctgtaaaatggggatgatgatacccagctcccgtagctgtggggaggatgaagcaagatgatacatgggaagggtagtgcactgcgcatggctctcggtgagcccctcacagatgacactgtcgttagaaggagctgagcccaaccaggagacgagacagagggagcagggagagcagagtcggggccagtgatttccttaagagggatgtgcccttcctcccaaagtgccaaagcaacactcaaggatccacagccttgggagagtctagatcctagattgctacttgtataattttgagatttccctacatacatatatttattttaagaagtaaagtgaattagccgggtgcagtggttcatgcctgtaatcccagcactttgggatgctgaagcaggtggatcacctgaggtcaggagtttgggaccagcctggccaacatggtgagaccccacctctacaaaaaatacaaaaattagcagggtgtaatggcggcacctgtaatcccagctacttgggaggctgaggcaggagaatcacttgaacccgggaagcaaaggttgcagtgagctgagatcgcaccactgcacttcaggtgacagggcgagactccatcacacagacacacacacacacacacacacacacacacacacacacacacaagaaaagaaagggattgacatgaattttgttcgaagatttcacaatgccacttgaggtaaggagggagacctgaggacagtatcacattaggtagaaggatgggaggataggaaaggctaccctttttggggatagcccaaaaaatgatatgtaaggcacctcacatgccacagctacacttctcacatcaattctgccaagagaggacttcatcattgcacctgagcaaatcatggctcagcatgagaaagtaatttgcctaaatagaagcaggtgtcaaaccctcatcattgtgcctcacatcacctctttccattacacactttcattcactcttcatgatccacaatcatagaaataattgttgtccacagagtgctcaaaatgactgaagacatactcactactgatgttcacatttgtcactgaagatcattcttggatctcttttcatgttaaacttaacctggtacacatcattcctttcatttgacacttatttagggtataagctcacaatggggccaccttgatctactagtcagaactgagtgtgactaataagatagcagcttcacagacgtgcctgtgtacagatccacatcacctgcgaatcacacagtctctaaaaatgtgtctgggaggtcccctcccctccagatcattataattagaaaccaatgaggtggtctcccagagcacaagcttgtttgtaaatccaatgctttagcaagagaatgttctttcgggccagctggcgagcagaagtaaggacagaggcgaccagtatttctaaggaagctgtagctatcatttccctcaaatcttagggtgtactgtataggagcaagcgaatggaggtgtcagaaggatgtgaaggaggaggatacggtgagaactgcaactgctgagggattggccccgggggatggtggggtggggggtggtcaggaagcatgaggaagggtcaaatgggcagattccagctcattgataggctgggcttcaagatctacttgttgaggacaatatataatgatccccattccccacacacccactaattccacccacaaagggtgttggaacaaaagaatcaagcctgaggacaattggtcaattgatggatctcagagctggaaggtagaatgcttgataggatgtcagaagagttaagagctaagatttcccagccagtgtgtcctttctctttatttgaggtctctgtgttgcttctttcttccctctagcagctggcttggttaggagaacacacagctgcctccagcttgggcaggaccccaccttaggccttctggagcaggtgccaagaagacccctggtcttgcttttagaataggctttagatttgaggcattggggtccacggagtccaccagagccacaccaacattgggatttgtggccagatagttaaggcaataaatagtgacatttccccggacttgttatctgaatatgtggtcaacaaattcaacaaatattttgtcaattatacgctatgacaaagtcttcgccctcatgcagcctgctgtgttctcgtagtggacacacagtgaactaatattagaaatagtgtcttgtggtgatgagattagggtggtagtcagctactttacaggatggtcataaaaatatctctgtgtggaggtgatatgtgagcagagacctacattgaatgagggagggaaccatgtaagtatttgaaggaaggttttccaggaaaatgaacggcaagtgcaaagactcagaagggagaacaagtttagcaagctcacagaagaccaggaaagccaacgcaccaggtagacagagtgaggggaacaaagacagaaaatgaggtaggggaggttgccagccactgaggactgtcttaataatctgtgtcctccaagcccagcagaggcttgtccctgaaaccctgtgatctgttaggcagtcaaatctcagtctcagttaaatatttggatgaaatcagcaatggcttgaaataattgatatggctttccagatgtcttgtcccaattctaatagaggaggagaaaccggcatgccaagattctaaactagtttgtctcagagctttctaccactcaccttactctcccaccatctctaaagggattagatttactgtccccattaaagagtgaaggagctcatgctgcaccctccagtctagggctaggagggatgggcgctgccctctccagcctgatacgctccttctcactcactcttagctgaatattctcatcccactcaaacctagaaagcctgcttatttttttaattacaaatattttataattataaaatcccttatttatttgtgcatgttttaaggataagctgaatcatgtaacctgtgtctggtttacctacatatatttttttaatagagaaattactcttccttgggaggctgaggtgggcaaatcacttgagatcaggagttcgagaccagcctggccaacacagcaaaaacccatctgtattaaaaatatgaaaattagccaggcatggtggcaggtacctgtaatcccagctactcaggacgctgagccaggggactcacttaaacccaggaggcggaggttgcagtgagctaagatcaagccactgcactccagcctgggcaacagagtgagactccatcacaaaaaaaaaaaaaaaaatgtggatgggtgcagtggctcacacctgtaatcccagcactttgggaggccgaggcggggtgggcggatcacgaggtcaggagatcgagaccatcctggctaacgcggtgaaaccccatctctactaaaaatacaaaaacaaaaaattagtcagtcatggtggcaggcgcctctagtcccagctactccggaggctgaggcagaagaatggcgtgaatccgggaagcggagcttgcagtgagctgagatcgtgccactgcactccagcctgggcgacagagtgagactccgtctcaaaaaagaaaaaaaaaagagagagtgagagaaattattcttccatcaatctttactttttcatttagtagaaaataaaattatttgggctttaatatctattgtccttaaatagaaatatgatttaatcctaaataagcactagattctattatcaaggctctactgtaatttttcgcaaatccagggaggggacgagggtattctcattagctcattcccaagccattttattaatgaacaactgatcattacaagagtcttgattattttgggacaaatttgaattcttgtagcttccaatttttgttcagaattttgtcttctgaagccattgaagagtgaaggaactcatgccacaccctcctgtctagggccaggtggagtaggatgctgtcctctccagcatgatgtgctccagagcagcctatcccctgatcccaggcttggcacagcccttcacctgaaggccacccatgtcacatatccttaatgccctctgctcatttcttttttttttttttagaactgaggtgtcttttatttcaaaaacggatctgattttcctaacaaaactttccccaacacgttacctttttctccaagtttcctctgtctgtacgtgtatgcacatgcatgagtgtgcacacacatgtatttttaggtggaagtacaaaaaattgaagtgtattgaggtattttggaaaactctataaatagcttccttgcattgaggggaagagggccttttggccctttgatgataataggttgttatcttctgaggtgtagtttgcgtcctcactcctctgggtggtctgctagtatgtgctgctgacagatgtagttgcccaactcagcattctttgctaaaacatctcccctcaattcttgttggccttgcagatactgttgaatcactggttccatttgtttgtttgtttgtttgtttgtttttgagacagagtctcactctgttgcccaggctggagtgcagtggcgtgatcttggctcactgcaagccaagctccgcctccctggttcatgccattctcctgcctcagcctccggagtagctgggactacaggcacccgccaccatgcctggctaatttttttgtatttttagtagagacagagtttcaccgtgttagccaggatggtctcgatctcctgacctcgtgatccgcctgcctcagcctcccaaagtgctgggattacaggcgtgagccaccgcgcccggccactggttcaatttttatatttgtttccagagaaccctctaggttctctctaaacacctgctttccagccttctcagcatccaggtggttgttcttcagacactcttttcctctggttcatcaacaagtacttccattcaaagtggtgctaaggaataaaaacgactgtccacatgtggtctcgccggcccagagagacatgccatttaagctatcttcactgtttctccctcattaggtagatgctttttcctctcaagttttcttcctctccatggattcctttctatttgtgaataacgttaagctatttctctgctccctttcctcaaaatataaacagactcgatgtttgctacctaattttctttttcatgcttcatctcacctttgttccctgtctttaagctttctatctgggcatgtgtttttctttaaatctgcagcatttggtaccgtgatcaattatcctgggtaattgctcctcatttaagaacccctattctttctcattaaagactagacaagaatacgtcctcccattgaccaggtgcaccagatctcttacttatccccagttcgcctttttgcagtttagtgcttaagagctcattcacagaggggtgtaatttgagtggcttgcatgtacttagttggggcagctggctgtctcttcccttctggctgtaagagacttagcttgcctctgagctccttctctttggggtcgcccagggctctgccaaatgcacaaaaaaccccccccctttttttggtgggggaggtcatgcatctttacaaaccttgatctaattaagctttctcctctagttcctaggtatcacggtaatgactgtccactttgtcattcttaggttgtaaaatgaagctaatggccctttctcattgcttctagctgcactgagcttgtcaaactccacagctccaggtctccttgattggtcatcattatttgctgctgttataaatgtgatttcttcttggtgattagacataccccctaaaaatacatgtgttaagagttcctgtgctgtgtgtttgagaattcagaagagtacaaaagtgggcattcgaagagagaggaccctcttaggatccctaacttaaaattccagtcagcagccctttggagatgtaaattgaggaagcagctcttcttttggacagcttaatgatgtgtagttaatagtaagaggctgatgggcagatgcagtacagctgggcttaggttagcctttctcagctctccaaatggcacggtgattacaaccattgagacacacagtcctacccggaatcaataaccaaaggcacaaagactttggcggtggcttggcagtgtggcctgttctgtacacgcagacaagtcattctgccccagccagtaattgatacctcttttttaaagcctgactcaggcttggcagttgcctgtgcaacaaatagcccctccagcaactggaataaagagtgctagatttagggtcacttgtcctcttacctgagtttactgagtttcactgaacctgggagaaactgagtgtaacttcttggtaacatataagcctgggagccatacaatacatagctgctggagctggttgatgtattgttaagccttgtatgtaaaattggctttgagttcctgtgtgtcaggttattggatccatttacaatttccagcatctttccagtttccctcaaaaatctcaacaagaacaaaaactaaataaacgactgtattcaaaatgggcaaagaacttgaatagacatttctccagagaagatgcacaaatggccactaagcacatgatgctaagcacaagatgttcaacctcacggatcgttagggaaatgcaaatccgaagcataatgagttgccatctctcattcattaggatgactgttatcgaaaacagaaaattatgattgttggtgaggatgtggagaaattggaaacctcgtccactgagagtgggaatgtaaaatggtaccgccatgatggagcactgtatggatgttcttccaaaagttaaaaatagaagtgctgtatgatctagtaattccacttctaagtatctactcaaagcaattgaaagcagagtcttgaagaggcagttgtacccccatatgtcacagtagcattattcgcaatagccaaaaggtagaagcaacctgtttgtataaatggatgaatagctaaacaaaatgtggtatgtacatgtaatagaatgtcattcagccttaaaaaggaaggaaattctcacacatgctacaacatggatgaaccttgaggacattatactaagttaaaccagtcacaaaaagtcaaatactgtatgttccacttatgtgaggtacttagagtagttaaattcaaagacagaaaatggaatggtggtattcaggggttgggggtggggagaatgaggagttgtttaatgggcacggaattttagttttcaagatgcaaagagttctgaagatggatggaggtgatggattgcacaacactgtgaatatatttgaaaccactgaaatgtacacttaaaaatggttaataaggctgggcacagtggctcatgcctgtaatcccagcactttgggaggttgaggcaggtggatcacctgaggtcaggagtttgagaccagcctggccaacatggtgaaaccctgtctctactaaaaataccaaaaactagctaggcatggtggtgggcacctgtaatcccagctacttgggaggctgaggcaggagaatcactggaacccgggaggcaggggttgcagtgagctgagattgcaccattgcatgccagcctgggcgacaagagcaaaactctgtctcaaaaaaaaaaaaaaaagaaaaaagaaaaaagttaataatgcacagtggtgcctgtcggggctggggttgggggtgtggggggagggagagcattaggaaaaatagctaatgcatgctgggcttaatacctaggtgatgggttgataggtgcagcaaaccaccatggcacacgtttacctatgtaacaaacctgcacatcccgcatgtaccctggaacttaaaataaaaataaaaaaaaaataaataaaaacggttaagatggcatttaagttatgttgttttaccacaattttttttttttgagacggagtttcactcttgtctcccaagttggagtgcaatggcgcaatcttggctcactgcaacctccgcctcccgaattcaagcgattctcctgcctcagcctcctgagtagctggaattataggcgcccgccaccacacccggctaatttttttttttgtattttcaatagagactgggtttgactatgttggccaggctggtctcaaactcctgaccttgtgatctgcctgcctcggcctcccaaagtgctgggattacaggcatgagccaccacgcccagctgtttcaccacagtttttaaaaaagcacaagtgaaggatgccatcttctctcagcagcccaggctttggaggaacagactagaaatgaaaggaaaaaaggaaaacagaaaacaaacagccagtggaatggatcttgtctgtatatggaactaattgcaaatatatatattttttttacagagtcatttttctctcaagaagggagctgcagccttagggattggaacagacagcgtgattctgattaaatgtgatgagaggtgagcacgcatcggcaactcttgttggttagcaatttgcaaattccacacaagtagtgccttttggtctgaaaataggagaggaccacggggcagcaagtccacctccctcccagcctctgcagccttcgtttctttttaacatgggctcctgcttctgttgctcagatgtggttccttgatgccatggagccttccacagcccttgcctgaatcaaaacctttgttaaatccatcaaaatattctacaccaagaaagtgcagaaagactttcatcacctgggcacgttagcaacagcaggcactttgagcactgatttatggaggtgtcatcactttgggcaccatagatagtgtaagcttgatggggtgattacaggaggggacgtagtatagggagcaggaagtaaataaagcaccagcaactcaacaactggaaccagaggactcaggggaaatccctgtcttaattgacacctgaacttcacagggactctgggattcagtgcggtgctttgtgggagagattttagaatgtccacgtaaagtatcactggcctgtaggcctgaagcctactaaaaattagattcagtctctaaagtttcattaagaattttcattaaatttaaaggaagccactcaattggccatttatttatttatttgtatttattagtcagatgtgtactgattgcccaccatgtcactaggctctagaaaagcaccatacgttgatcccggttccctgccaggatgtgagctaggtgggaagaggcagtgtcgtcagaaggagatagttacagggtggaactgcatggcatgaagtacacatttgaactttgagaagacctagaaagcttcatgcaacaggcaggaattgagctggatttttaaaattaggagtgagctggacaagtggagggaaaggcaagggcagttacagaagattgaataccagcagcaaagctgttacaggaaaggggtcctgatccacatcccaagagaggattcttggatctcgcgcaagaaggaattcagggtgagtccatagagtgaaatgaaagcaagtttattaggaaactaaaggaataaaagaatggctacttcatagacagagcagcctggaggctgctggttgcccatttttatagttatttcttgattatatgcttaacaaggggtggattattcatgcctcccctttttagaccatatagagtaacttcctgacattaccatggcatttgtaaactgtcatagtgctggtgagagtgtagcagtgaggaggatgaccagaagtcactctcgtggccatcttggttttggtgggttttggcaaggtctttatgacctgtatcttgtgctgacctcctatctcgtgacttagaatgccttaaccgtctgggaatgcagtccaataggtctcagcctcattttccccagctcctattcaagatggagttactcatattcacatgcctctgacaaagccacaggaggaggaatgagcacctcacggggtccagaagccaagccttagcagaggcatgggggaggggcagccacagcaaatacggtggctcacgtggaattcagaaagctctaaaaatccggctgggggcagtggctcacgtctgtaatcccagcattttgggaggccgaggcgggtggataacctgaggtcaggagttcaagaccagcctggccaacatggtgaaaccctgtctctactaaaaatacaaaaattagccgggggtggtgatgtgcgcctgtggtcccagctactcaggaggctgacacaggagaatcgcttgaacccagtaggcagaggttgcagtgagccgagatcatgccattgcactccagcctgggcaacaaagcaagactccatctcaaaaaaaaaaaaaaaaaggaaaagaaaaaaaaaaaaagaaagctctaaaaataagccatgtttacctctgttagcgaaccaaactgaggttcactcgccagcagcagtgaggccaaacatccacacacaggtttgcagcaggagaaaggaggacatttatttgcagggcaccaaccaaggtgaattgagcagctcatgcttaagactcagcctccccgatggcttgcaggtaggggtttttaaaggcagggataatttcaggaaagcagaagttacaggcaaattgcaaatcaatacatggtggttacacatcagtttggcccgaaagggtgggatatcttgaagcaggacttataggacataggcgaattcaaaggttttctgatttgcagtgggttaaggaagagcagctttgcttaaaattttgaggtcagcagaaaagaatgctagctctggcccaggggtgtgcctccctccaggcccttcaggaagaaatttagagcaaagaaaggtggtcagagttcagacctcagtttcccctcatctgaggtttacgtaccagccaatccatttggtgggagtcctggagtcctggtttgtgaaaaacagcccaaggatgtatgttaagatgttacctttagtttctacagggaatcaaatatcctgtggttctaacttcctcagaagctgatcgtttacttctcaggtcttgctagtgcctggaatttcccttgaaggaactcgtttccctttattttcacacttagaagtattgcctgaagaccactaaaagggctccctgccccactcagctctgggtgatgaggttaaagaagcttaccactttcttgtttacacctttttatattgcctgattttgtttgattgctggcagagaacatagctttgcaatcagaaaaaaaaatggtgttattttttcttttggggcaaggagagctaaagttagaatttaagctggataggtctggaaacaaggtaactggaaataattttcattaaagaacatgagtgaagccacccttcaggaggcaagataggcgagaggatctccagtcaggaaggccagtaggaggccctagcaattagacaggcattaaggataaaaggatgggagtgaggcaaacacattttggaaaagaaattgcctctttttttggcgggggaggggatggagtctcgctctgttgcccaggctggagtgcagtggtgctgtctcggctcactgcaacctctgcctcccgggttcaagcgattcttgcgcctcagcctccctagtagctgggactacaggcactcgcaacacgcctggctagtttttgtatttttagtagagacggggtttcatcatattggtcaggctggtcttgaactcctgacctgagatgatccgtccgcctcggcctctcaaagtgctgggagctgcctcatatttttaaggctaccagtgttcctcagtagccggtacttaagaactgagatttgaagagaaaactggagtttaaaaatgtgaagaataaatgtttagatgactttaaaactttcttaatctgtagttgatctgttatgggtgaggagcctggagttgagggaagaatcacctagagggccgtggcccgctggcctaggcagtcttccttgctagccttggtagctggcgttctccagtgaaccccagggggctgagaggtgactggcagagcagtaggggctcttgactctactcttcaaagcatcggcatcactgctcctactcctgtgaaaatcaggtgtgaccgcagaagtggtcttggatgagtccaccaggccagctaggcggctcatcatgggaacaaggggcctgcctgaggacatctgcccatctaaaggcaacactctgctcacaagagaagttcaggcctagaagaaggaagaccaagaagggaaaacagaggagtggtgggggaaagggaccatggacagggctgccaggacagaggcaggaggggtttgccatgcaccaccaggagggcggagaaggaggcaggagggggatgctggagagccggcgggacctacgatcagtgactggccagggggcctcaaatgtgaaagtcaaagatatttatttcaacaatttttttttttttaagacatgaggtcttgctctttacccaggctggagtgcagtagcccattccagcctggaattcctaggctcaagcaattctcccctctcagcctccttagtagatgggactacaggcccacactacgacacccagctcatttttgtttgttcgttatagagatggagtctcactatgttgaccaagatggtcttgaactcctagcctcaaacaatcctctcatctcactctcccaagtagctgggatgagtcatcacacccagcttatttcaacaattttagaagtcattagaacaactgaaatacaatactaaaaagtatgcttttttcagaaaatggctcactctctagtacccctgtctactcacatacaccccttgggagagacagagggaaatgggccactgggcagctagggctcggggctttctccctttgtgctcataagctttgtgggatgagggaagaaggaggggtcgggagaggcaggagtaagaaagaaggaagtgggaaagagcaaacagagtaagaaataaaaggtgggaaaaaataaggcctacgagaaaaaagtttgtgacggaaaatacaaagtaaagcaaggaggagagatggtgagggcaatgtgagtggaagccagaaacacagtgagagctttagaaggaataaatgaccatatttaccatttaaaaagcaatatatgctcactttttttaaaaaaaagaaaataacagaaaaatcatagttccactgtacaaagatcatcgctaataccacattggtgtctaaacctttgaaactctttttctaagcacagaaatttgttgggttttttttccttttttttttttttttttttgagacagagtcttgctctgtcgcccaggctggagtgcagtggtgtgatctcagctcactgcaagctccgcttcctggattcacgccattctcccgcctcagcctcccaagtagctgggactacaggcgtccaccaccatgcccggcattttttttttgcttttttttttttttttgtattttttagtagagatggggtttcactgttagccaggatggtcttgatctcctgatctcgtgatccacccacctcggcctcccaaagtgctaggattataggcgtgcaccaccatgcccagcctcatctttctttttctaattagacatgataacatgagtatttttccacatgattacaaacacaaacacacttaactgtataacattttacatatgaatatgtcagaaagcattacagtacatttagagagctggctttggagctggctttggagctggattatttaaattccaatctcagctccagcactagcctgggcaaatgcctctctgtgcctcagtttctttatctgaaaaaacaaaaaagtaatggcgcctgcttcataggattgttatgaagattcaatgtgttgacaaatgtaaaatgctgaaaacaatccgacaatgggataagtccaaaatatcagtcccctgctatacatttttctatttcttgtgttactgttacgaataacctttgtatccttcagtgaacgtccttatgcatccatagcttctccatttaggacaatttctttctattcttactaattgaaatgatatgaatgtttttaaggaaatggatgcatcagattaaccttgcaaaagatttcatcaatttgttctcctagcagcattgtatgagagtatgttggaaaaaaattttaactgtgctattagctatatggcatctttgactctatattgataattcacatcatctgtgtgacatgagtttaagactgagagcctggccctaatggtttaagtgacattgaagtgtttgggttcagaagccaaggagaaaggtgtggacaatcatttgtagccaccattggggtcagaatcaattaaaacactctcggcagccattttatttttattagcacgtccttgtaaaagtcagatgtacagttcagaacaccacgtaaggctgacaaggtgagagtcttcatgcttgtttcccgtaatgcgctttgtaaagttcattcagccttcccaaaacacaagcctggacctgccctctgtggctttcaattcttgtagttacccgttcctaccacacattagtctatcagtggctgggtgataggttttattatgttctgcagacagttgaaggttcacaactgagaagaaatgtcccagtgaaagagaatagtctgtgtctttctagcaataagcccaatgctgcatgtggaggaagatcctgcgaggtacatttttttttctttttttctttttgagacaaggtctcactctgtcacccaggctggaatgcagtggcacaatctcagctcactgcagcctctgcctcccaggttcaagagagtctcctgcctcagcctcccaagtagctggaattacaggtgtgtgccaccacgcccagctaatttttgtatttttagtagagacaggatcttatcatgtcaccatgttggccaggctggtcttgaactcctgacctcaggtgatccacccgccttggcctcccaaagttctgggattacaggcatgagccaccatgcccgacccggtaccccttcttttttttttgagacggaatcttgctcttgttgcccaggctgctggagtgcaatggcgcaaccttggctcactacaacctctgcctccagggttcaagcgattcacctgtctcagcctcccaagtagctgggattacaggcatgtgcaaccacacccagctaattttgtatttttagtagatatggggtttctccatgctggtcaggctgctctcggactcctgacctcaggtgatccacccgcctcgacctcccaaagtgctggggttacaggtgtgagccaccatgcctggccaaccccttcttaattagcagtcacaggggctaactttgggtgacagttcaaagtgaaacacggttctcagttaaaacaaaaaaaaaagttataataaatctttgtttgtttggactaggttcttttagagttgaaaattaaaaagcattttaattttattaaatatacttaaaaaatggaataagataaggtaatgtaaaacttcagttctcgtggctttcattttgatgtgaagcattataactaaacaggaatattctattttgtaaaaattacttattaaattcgaaagaagaaaatgtgttaggtgaatacaagatttcataagttacagcttgaggtttcctttccttgttaacaaaaagttgaatattcagtgatgaggttgatgaatttttattcatgtcattcatatttgcaaaatttgaattagtggaatctagattcatgatgtgtagctgtagctaagaatagaaaagaaaagtgcattaatatagagaggaaaataaacatttgtgaaagaaaacagagcaatatttcagaatttgcttgggccactgagcaaaaagatgtttcccaaatatccagtcaagggaagaggagagaaaatttctattgtatggatgataatttggaaggatggggagttcctatatgatggaagtgagctcctgtgagctccatcttttggctgcaggcagtggtcttgattggaacacaatggcagacatggtggatgtagtccagtctagcgtgagatgagcacaggaagggaagcaccatgatagagaaagtactggctgttattgattcacatccagttctgcaactaggggaaggattatgggagtcatccagataaagagaagaggcaaaaatgtcccaggcagacgccacagcacattctaaaccaggtccccaacctttttggcaccagggactggtctcatggaagacagtttttccacggacagggctgtgaggggcgggggtggcagatggtttcaggatgaaactgttccacctcagatcatcatcaggcattagttagattctttttcttttcttttaattgaattaattaatttatttatttttgagacggagtctcactctgtcgccaggctggagtgtcctggcacgatctcagctcactgcagcctctgcctcccaggttccagtgattcttctgcctcagcctcctgggtagctgggtttacaggctcacgccagcacgcctggctaatttttttatttttagtggagatggggtttcaccatgttggctaggctggtcttgaactcctgacctcaggtgatctgcccgcctcgacctcccaaaacattagttagattatcacaagaagcacacaacctagatccctcacatccgcagttcacagcagggttcctgctcctatgagaatctaatgccactgctgatctgacaggaggcggggctcaggcgggaatgctggctcagggctcacctcctgctgtgtgaccggttcctaacaggtcaccattagtactggtccgtggcccgggtaatggggacccctgttgtaaaccatggatgtgagagagaacctggcttgttcaaggaactgaaaagaagagaggacttggtcagaatgtccttgtcatgtgggccttatgagccatgttaagccgtttggacttctgactaaaagacatgggacatcactgaagggttttgagcaggggaacaacagcatatttttgtgttagaaagattattttaaatgcagagtgggcgggatgagagactggaagttggtggatgttgtagtcatatgaatgggagatgatgaatagcgggccgaccagatgcagagcaagggacagggagtgctggaatgaacaggaagtgttggctgattggtgtgcaggttgagacaggaggcaaggatgaatgccaggcttctggcttgccagctaagtccaggcgttgctattctctgagataagggaccctgtctgaggtgaaccattcagatttggagatactgagtttgacgaggttatgagacaccgaagtgagagtgtctggtaggcaggtggaagtatgggcctggagctcaggaggtacactagggaggccgtgcagaaggtggcctgggaaggaactctcaggagcatccacacttcagggacaggcagagtaagagcagcctacaaaggagattgaggaggagcagccagagttgtcagagaatcagaaaccggggccacgagggccatgagagtgtttccagagaaaggagtggtcagctgaatcaaatgctacaacaggtgaaatgagggccaacaactgcccatcagcatgacttctaaggaggcggctgatgagtttggcaagggcagtttcagtggaggggtgagggcagaaggcaatttgcagtgggttggggtgaggtgagtggtagatgagaaaagggagaactaatacaggcaaggtccaggaggtggagccgtgaaggggaggaggcagggctgaagctggaggggagctttgaatccagggtggcttttggctttgttgtttaaaggagaggggcttactgcccatttcgctatgaggtggaggacccactagagaggaaatgtgaattatggaaggaaagaaggaaggaaggaagggagggaggaaggaaggaaaaggggaggggagggggaaggggaaggaaagaaggaaggaagcaaggaaagaaggaatgaagaaaggaaggaaggaaggaaataaaaaatcgcaaaggtttaattttcgttattgagtttcctagtcttttgactaaaattgtgtaggatctttccctgagaagctcacacaaactctgaaattatttcaaatcctaaaattggaaggaaacagagaggagaaagcaacgggagagtgatgtgtgatggcaggtgcaaggaggactggggagggatggggaggaaggaggggaggggccagcctgggcttagcctatgttgacaagctgctaatgactttcaaatcagacacccttagagttggaaaggtgctcagaccttagctcatccaacttttttttacattgtattattaaaataatttcaaatttaaaggaaaattgcaggaatagtaaaaagaatgctcatataccttacactcagattcaccagttataaacagtctgacacatttgctttctctcaatatatgctgtatataaaatccaatattacatattgagtgtaatattgtatgtattaattatatatgtatgtatatatgcatattatatatatatagagagagagaaccatttgcaagctccttgcagacatcacgctgttttaccccttaatatctcaatgtatgtttcctaaaaacaaggatattcacttacacaatcacaggccaattatgaaaatcaggaaatgtgacatagatagaatactattattaaatgtacataccttattcgtttcttcagttgtcccaatagtatccattatagctatctttcccagtccgggatcacacgtggcatttagttgtcatgtctctttggtcccctttaatctgcaatgtttcctctgcctgcctttgtctctcatgacattgatgttttttatgagtagagaccatttagtttgcaggtgatttggattcatctggtgttttcccatgattagattcaagtgatgcatttggcttaggactttcaggaggtgaagtttggctttcttgagtgcatctcatctggaggttggtctcattatcagtaatatcaactttgattttttggtgaaggcagtgtctgccaggtcactccgctatgaaatgactattttctcctttgcagttaataagtatcttgcaggggatgctttgtgtcagcataaataccccgttgcttctgaaatgttcacccactagtttagcatctactgatgatttttccctgaattattgttgtgatggttgcagaacagtaattttctaactccgtcattccttctgtatttattagtcctttcattccactgtagggaagagattttgtctttttgttctctctcttgctgtctctcatttattatcagtatggactcaaaactatttttagaaattaatatgctcggctgggtgcggtggctcatgtctgtaatgcagcagtttaggaggctgaggcaggcatatcacctgaggtcaggagttcaagaccagcctaaccaacgtggtgaaaccccatctctaccaaaaatacaaaaattagccaggcatggtggtgggcacctgtaatcccagctacttgggaggctgaggcaggaaaatcacttgaacccgggaggcagaggttgcagtgagccaagattgcaccactgccctccagcctgggagacagagcgagattccgtctcaagaaaagaacaaattaatatgctctagcaccttcttccactcattctccctgctctcttccattcacctctttctcctcccctcagggtacccctgccattatctgaattactcataatttgttgtaaaaccttacagaaaataaatctgaccaagacgcatgatacctagtggcataggactacaagagtcattggctttcctagctcccatgtaacacaagaaatctgttagccattttgattaatacttttatacctactactagtaggtattagctactagtacatttatatacattttagcctttcttttaaacgtatcactccagctttataaattacagttagactacacttccctgtgctttttagtaccacactttatcatacaattgatttaaacaattgaaagtataaataacctggggtcattatattcttttgttaaattagctgaattgtaaccagtgcctgaggggtcgttagggatgctaattaactctttcgggtccttgggaagctgttcagcgcattgtagtgggatagacttcacagagacaccgaatcgattattcctgagcagggctgtgggaagccctctgagtggcatatttcctgtgggtgtagatgcagagaactcagggatgctagtcctgtgtgtacttcattctgccctatctcaggaaggactataataacagctgacactgattgagagtttatgccgtgccaggcacagctctagccactttacaaaattgacctaattaattcatttaattagagacacaaaatagtatattctttcacatttatctggtgctaacatagtttacaaacaacagttttaaacagtatgacaagttttctatcatagcccctcacaggggatatgtctaacatcacatggcttgtaagtgaagagtcagggtgtggactcagaagagaacccttagtgttcattagtttaaacagagctccttttttattgtgataaaatacacataacataaaatttccgatctgagccatttttaattgtgcatttcagtggtgtgaaatacacatattgtcgtgcaaccatcatcaatattcatctccagaactcttctcacattgcaaaattgaaattccgtgctcatttaacactaactccctaccaccccctccccactatccccaggaaacgtccactccactgtctctacgaattttactactatgggtacctcactcacatgaatggaatcatacaggattcgactttttgtaacttgtctatttcacaatgtcctcaaggttcatccatgttgtagcatgtgttagaatttccttcctttttaaggctgaataatattccatcgtatgtgtagatcacattttgtttatccgttcatccatttatgcgtacttacttgggttgcttccaccaatttttttttttttttctttgagacagagtctcactctgtcaccgaggctggagtgcaatggcacaatcttggcttactgcaacttttgccttccaggttcaagcgaatttcctgcctcagcctcccaagtacttagctgggactacaggtgcacgccaccatgcctagctaatttttgtatttttagtagagacagggtttcaccatattggtcaggctggtctcaaacccctgacctcaggtgatccacccacctcagcctcccaaagtgctgggattacaggcgtgagccactgtgcccagccttacttccaccattgactaataggaataacgctgcaatgaatatgggctgaaaaattacatcttcaagactctgctttcaattattttggagtagatacctaacagttgaattgctggatcacatggtaattctatctttaattttttgaggaaccatcatactttttcctcaactgtttatcattttacattcctgccagcagtacacagggttccaatttcttcacatcctcaccaccacttgttattttttgggtttttggttcgtttgcttgtttttcatagcagcctctttatgggtatgcagtggtatttcattgtggttttcatttgcatttccctgatgattagtggtgttgaggatttttttttcatgtgcttagtggacatttgtatactgtttttggagaaatgcttactcaggtcttttggattggttttgttattgttgttgttgagttttaggacttctttattctagatattaatcctttatcagatatataatttgcaaatatattctcccattctgtgagtttccttcttactctgttgatagtatcttttgttgtacaagtttttaatgctcatgaagtcaaatttttctatttttttcttttgttgcctgaacctttggtatgatgtccaagaaatcattgccaaatccaatgttatgaatgttttgtcctatgttttcttctaagagttttatagttttggttcttacatttagatctctgatgtattttgagttaatttgtattttgttgtataagagatggctgctttttaaaaataagaatgacaacataattctcctattccggaagccacacatattcattgtagaaaaataagcaaataaaagaacctagatataatctgtcatagtatttgatggcatgtagtttaaaatatatttacatatattttaacataaaagacatataagtatttacttaacataaaagacactataagtatttactgattagaaatttgttttttacatagcaaatattatggacgacttgcatgccttagaaattcttcaatacaattctcattcactatttaataatccactgtttataatttatattacttaacaaatctgttgttaaacattaagttgctttaaacttttactattaaaaaatgctattataaacattattgcgggtaaatatttgcacatatccttgtattattttcttaaaataacttccggctgggtacatggctcacccctgtaatcccagcactttggagggccgaggtgggcagatcacctgaggtcaggagttcgagaccagcctgaccaacatggtgaaaccccatctctactaaaaataaaaaattagctgggtgtgatggcgcgtggctgtattcccagctactcgggaggctgaggcaggagaatcacttgaaccccggaggcgaaggttgcagtgagccaagatcgagccactgcactccagcgtgggtgccagagcaagattccatctcaagaaaacaaaaaaaactttccagacgtagaatttctgagcccaggactgtgtctatgctgagttatgatacttgctgtcatgttgccttcagaaaagactcagccagtttacacttccccagtactataaaggggtgcctacccactatgtcctcactcaggctaggaattaaaaccttaagtgatgtgtgtcaatctgatggatggagcttttttattattcatgttttcatttacagtttgataattagcaaagctgagtatttattttatttttgtaggtcatagttggtgtatatacttatggggtacatgagatgttttgacagacacaggcatgcagcgcaaagtaagcacatcatggagaatagggtatccatcccctcaagcatttatccttgcaaagttgagtattttatacttatcagttatttatagttcaaaaagaaaaagaaaacaaaactctcttttgtcatgtatgttgcaaatgttttctaaaatgtatcacctgcttttttatttcatctgttgtatcttttaaaacatttcaatttttggtagtcagagtgatcatcaattacttattttttacctttagtgtctttagaaaatgttttccattcttagaacatgttaatattcatttgttttcccctagaaattttgtgttattatttaagtagttgacttaactgaaatgtattttggtctatggtgtttgggaagtatgtaatattttcttcttccttccctccttctttccttgtaaaatgcctttgtaaaatgagtttggaagtatttcttcgttttcaactacatggaagaagttgagaaggattattattaatccttcgttaaatgtgtgatagaactatccaggtgaagctattaggtcctgggcttttctttgatgggagatttttgttttctgattcaattcccttattcattattggtcagttagaattttctatctctttaagaagaatgttcttgtcccaaatttaatggaaatgtatttaggcttttgcatttagatacgatgttgactcttggtttgaagtagatgtttttatcgtgttaagaaagtatcttcttaatttaccaagaattcttttgtttcttctcttctcttcccaccctcttctcttcctccttctcctcatccacttccttctcttctggaatggatgttgtctttcataaaatgccttttagacatcaattgagattgacactgagataattttctaaccttgatctattgataagatgagttgtgctaaaaggatttcctagtagtacacacctttgcattcttgcaacaaatcctacttgatgcaatgcgaatcttgaatttccttcaggattataatttctaatattatatttaggattattatagctacatttgtaaaatgtatctataggtttctctgggctatctctgacacgttttgctttcagaattatctagcttcagaaaattcattctgcagctttccattgtcttctctataagagtttaaagagcattatatgttattagtaaacttgctaaaatttactatctgggcctggcattttgaggtgggggcagatttttggtaacttttctcccacttatttcttggttattagtttttttttttttcaatttttctatatattattgaatcaattcttgtaatttacctttcccagggaaaaattatttattttctcaaaaactttaagattattataaagctttacatagaatgctttaaaatattaaaatatctttattcataacatctctttcatttcaaatgttacgttttctctcttttatttattggactaatcagatatttgtgtatctgttgatattttcaatgtcccatcttttgaatttattaagtttactttttatttagttttctaattcactaaaaaaaaattccttgtttctgcttacactgttgtttccctagcttttttggattaattaatttagttctttttattctctgttatttaatttcagaagcactcagagctatacattttcctctgagaatgatttaggatgcttctcatgtttttgttttattctcatgtcattaatttttaatgttctgtaactgccatcttgatttcctcttggactccaaagttatttatttagagtagccaagcatgttttcttacatgataacttgaaccttttatcataatccttttttttttttcctctctacagatacatttagggaagagggacggtagtttggggagaaggaggagtaatgtgaggtggtcagcacaccttcttgcccatacatatacctccctgtcagctctaatactacccttcaagggcagcagtaaggaggtttcatatacaaaagaaaatatctccttaccatatcatgattggagtctcagttgcacatcacttgcattgttgtatagtcatagtatgtgtgctaagtaaatgcttttggagaaagtcaatgggaagaataaatattactagaattatacacaaaaaatcacccaaaatatccttctcttataacctgaaaataatgctaagtgattcaattgtgcacattggaaaacaaatcctaaaagagaaaaatatcattaatcattatagttaaagttctttttccaaatccaactatgtatttggattcactatttatagcaaataggaagttcactatttataattatggtaaaattctttgcaaagggcctggttttgtaatacaagtacttcttaaatggtcagttttgacttttgttagtttatttatcttaggggcctaagacaggctacccatgttggtatcagctatgtaaagacacggggagctcttttccccaggagaaatctctggtaatttttactgctcctgtgcaattcatcttcaacaattttttccccaagtcagtctatgcagtttctgtagtcactacgcagtctgtgcaatttgaaaattcacctgcatccattaactctccttgccatcttgataggatagttttgcctagcactgactagttaaaaagcaaatataaacaaacaactagcaggttttttttactgctattgcgtttgaatgctacactaggtagaacaacatcctcaaatatgttttagggtgaggttacgtgcttttattatttactagccaatgctgatagcagtaattggggtcactggaccgctcaatccagggggcttccagaaaaccacatggacattttgcatatgtcattacaatcctagaagtcaacctgaaaagtttttttgttaagtcggggtagttgtacagtgccaagaatctaggttttgttatcagacagctctagatttgaaatctgcctcctgctagctgtgtgacattctgcaagtcatataatgctaataacaacaataacaatactactgctaataacaatgtaacaatgttagactgtcaaacacacattgagtggttaccaaatgttaggcagagtttgcttaatattgtttatacttactatcttatgtaaccctcatacaaatcctctgagacaaatactattatcttataaatgagtaaaaagaagaacttaaacttcaagtacacacagttagcatatatgatctgtggcaggaacccactattccatctccagatttcaagcttttttttttttttttttgagacagagtctcgctctgtcgcccaggctggacagtggcgcgatctctactcactgcaagctctgccttcgtgttcagaccattctcctgcctcagcctccagagtagctgggactacaggtgcccaccaccacgcccggctgattttttgtatttttttagtagagacggggtttcactgtgttagccaggatggtctcgatctcctgacctggtgatctgccggcctcagcctcccaaagtgctgggataacaggcgtggagccaccatgcccggcccagatttcaagcttttaaccatagtcaactgcctctctgaacctcggtttcctaatctgcactgtaagtgcaaaataactctcttgtagggtcgggaggaggagcagggatcgcacagttactgcttctaaaactggtcatttatcgttgctgctgatagtgctgctattatgtaaacttagtcaatttctagcaggaaggatgtacgcatactttcttctttgcactcacgtttttaggaatagagctaagccctactcacttaggaaaggctgatagtatctctagtttcagcagggccaatgaacggggtcaactagtgactcaggcaccctacatgtgaccatctgcaagcctgcctagaaatacagactctccagtaacctgctttctttggtaagataatcagttcttccctttggagctatggggaattaggcatgaaactgggaccatggtccaaggtacattctgtgtctttttgcttcttcccacaaagagaagatgtttcctgctggtgattctacctgttgttcttcctgggatttttccagtcaacttaagggagttatctgatcctatagcatcatacgacttttttttttttttttttagacggagtctcactctgtcgccaggctggaatgcagtggcacaatctcggctcactgcaacctccacctcccgggttcaagcaattctcctgcctcagccacccgaagtagctgggactataggtgtgcaccaccatgcccagctaatttttgcatctttagtagagacgaggtttcaccgtgttggccaggatggtctcaatatcttgacctcgtgatccacccgcctcagcctcccaaattactgggattacaggtgcgagccaccgagtatggccagcatcatacgacttcttaaaggctactgctaaccaaggatctcaatgcaaaacaccttgtccaaagcagcagtctgtttcaatggccctgactttagtagcagtcccttcctaaacactaacaactaactgagagcagtgttataaagcatcagtggccacttaactgtaagcttaaaggctggatgtataattattaaagatatatgcttacgttatagacatacttttagaccacacaaagagtatggaacagtcgccatccaaagcctcccaggcaccaggcgatgcttgtgcagaaaggccaggactgatccaacagcttctcatctgcagaggacaatctgttggttgtcacccaattgtctctgtccccgcaacatatgggcagtcagaggatggacaaggctacatctggagctccttctgctcactgccctgcagccctgaaggctccaaaccatggcacatatgagaagtacttagtgtgttccacagttatttaaatacctcccaggctaaaatgtcccaagcagcttttcttaacatatggacccaggtctacgtgcatcagaatcacctgggtgactgatgaacatgcaaattcttgtgcatatttgtctttttatcagtttattatttgtctcccttgatagcatggaaaccctggagagtagaagctgtcttgtttaccctgctaccccagttcctgcaacactgcttggcacatagcaagtgctcaataaatatttgtgggatgaattaattcctgggccctatgctgacctactcaatcaaaatccctaagaatggggccatgtattttaaaccgggacttcaatgattattatgctcactaaattttaagaaccagcgttctaaggtaatccggccaattctaagatagagaaaaagatggtaagtttcctcccccaaggcgtccatattcactatctggtcagacattaagttaaacatattaatagccttgggttaaactttcccttctagccatattcctccaacaaatgtttatctaccacctgccatatgtcaggctctgggtcctaagtagagaaaacaaatatagttttggaaggcagagtgcccaggaaaaactagagccacccccattcctttccaatctgccagaggtgaacacttggagttcatggtttgacaagcctactccctccttctgcccaaagttcgctgatacaggaaagaaacagactatatgttcattactgttttcccggcaggtttgtatgacacctctggttcatgaaagtcagatgtgagcttaaaatatttatcttatcttaaaataatcaaacctttccaaacaggtttcctatatgtttggcacctttgagtttgttctggaagcttagattatattttgagttactccctggacttttaccagtatttgatcttgggcagtcacttctcctttcaggctgttgccttatttgaaaaatgagaaggttcgactagaatcaggcatgtcttggagccccttccaatttgaatgcactctcatctctgactcctcagtgccatcttactgccttatacttaaaaaaagttaagtatgatatgatttgatgagcaaataatgattgtcaagctagtctacccaaaattctcccaggcaaaggtgtttagcttttggtaaagttgggtaaaattcaagatttgcaaaaaaaaatttctaagagttctcactctcagttttcttgtttacctgcaaaaatactatggcaattttaatgtgctttaaactttatgtaaaagataaagataatacccacactttctcagaaatttgaactttttatttatatcagggctggagcaaggtgctttagcacagcctgatctgatcaggttgaaaatcactgctttaagggatgcccccaggcaaagttatgaagtgtaggaagatttataaggagtgagaagctctctgtgtcctttcctcaaccacatcaccctcccttccctcccctcagtctcacagaagttccccaaaggtaggctgccctaatctaagtccatagtctttgcatcaaatgtaactgtaatgcccctttttccattccagcctgacaaactaatcactggtaacttgtccattaccattgcccaggtaattgtctttctttgggaaacagcttcacttaaatcagtgattcccaatgctttgaggtttcatgtctgctttatattccaattattttgtcacgcctcctttattggcctgaaaaaaaaaaagggtcaaaaatataacttacccttctcactatataatgcccaaattatttttttaaatgaagaaatgtgatagaagtaatttgtaataaattaacttatttcaatatgtaaaagcctaagcaagacagcactagaagctgtgatgaagtccagtgcttgctgtatgtctagactcacagggagagccacaaaggtactatggagtcaatgacaaataccaaaaaccccactcactgctcactatatgccaatagcatcccacaaccactgattgtgataatcacctctaccatcagttatttttccaaaaagccttttaaaaacctagatcaatgaccctgatgcaaagttggctatgttagcaacctccagagagctattttgacttaaagaatgtttctctgggccgggcacggtggcttacgcctgtaatcccagcactttgggaggccgaggcaggcagatcacaaggtcaggagatcgagaccatcctcgctaacacggtgaaaccccgtctctactaaaaatacaaaaaattagccaggcatggtggcgggcgcctgtagtcccagctactcgggaggctgaggcaggagaatggtgtgaacccgggaggcggagcttgcagtgagccaagattgtgccactgcactccagcctgggcgacagagccagactctgtctcaaaaaaaaaaaaaaaaaatgtttctctgtctctcgtaccatgattattataatattaagcaaagcagtatctgtgtttttattttaggaaagaagcatttttagggttgaaaggatgtttgaaacttgagcccatgaatttttggccttctttacgcttttagcacttggaatgtcattaggtagctatttcacttagtatcttcatccagatatttcagaatggattttctcttcctgctgtttcattggtatgtgaaattgcaggtcggtttattcaaaggtttggaataaaaaggtttctctgaactctcctttcattgccaaacattttgctccaaatcaggcttgttttaactgaattaagaggatgacttaataagaagcttctgtgcacagcagagggtcatggtaatcgttctatagggaacaacacaatacggtcacaagtctgcaaaacgtgccagaaatgatagtcatgcctcatccaggcaagtaaatgcatccttcctggaagcagtcaaggagttgttttctccgagtattgttatcaacagtttggggttggactttaccctcctgcggccacttacgttgtaaagacgatgaagcaaattattcaaagcaaatctatatttctttttccttccagagggaaaatgattccatctgatcttgaaagaaggattcttgaagccaaacagaaagtaagtttctgccgggagctttatccagcccatatttctatttccatccaccggagaacaaaatgtgttttggttttattttaaaaagaggatccaagcctcaatctcccaggtttaatgagaacatagaattctgcatccagtcactatttatttctctgggttataggctctgctttagaaaagtttaaattgctgaataaatattatatacagagatacagtgagcgtttccaaagcatttgtcttcctaggtactgagggttggcatgaaacacccacacatttgaaagaatattttcagaggcggggaaatagcagaatgctaatgcagtatgtgagagaccctggtgcagttcttcaaaaggggccagtttttcccgtgtaggtgcatgctgttagcattggctctccagacgtcttattttgcaggaagcaatttagaactcttttcagaagtaacaagttctgaatgcctgcccaagattcccaaagctctagaaagtcatttacaacctgggatggctcacaaatcagagaatttgtttctagaattctttgtttaccatttggtagatataacctacagtttctgatttaataacatacacatgcattttatcattaggaactcagaaataatgatttacgttcatatgccctttttcgtttggttttgttttactaagtggcaggcagcaggagaaggtttccctccttgtgcaagtactagaactacttctagtaacatcaactagaagattaaacctttgctgccacctaaagactgacaccataacatcacgttctatagacaggacagagtccttatggaatgagggactatggcgatcctgtttgtggcattctcctgccttcttccagcccgttacttcaatcagttttcatttagccatggccagagagactgaggactagttagacggataaaagtcatggcgtattattttagccgctccgtgctgaaacgtgaaataaattatctgggcattttccaaataggaataatgggctggtcagagctacttctcttcattctcctgcctactcactctaggggatttatgaagttcagaggcctcgttgtgaataaggaacacttgaaagtgagcaaagggggttaaaagggccagaaagtctaccgggaatatatacatgtctcggggacgtccctgacagcctctgggttcactacagcctcttctgagaatcagaatgtctgttcttttaagacacagtcaggtccaacagcatagcctagagaactcagattccagagagtgaacatcaatttgtcccagaccccggggtgtcagtaactctgctgctgcttcctcaaattcagacgtgtctgttagggagagaatttccattgctttgaatcagctttttaaaagaacccttgactctgttttccatgatttggggctttctcgttcgcacaggggtttgttcctttcctcgtgagtgccacagctggaaccaccgtgtacggagcatttgaccccctcttagctgtcgctgacatttgcaaaaagtataagatctggatgcatgtggatgtaagtatcccttagggactggccactaaaacgtccttgcacgtttttcatgtgggacacacaaaggaaatttgttttctctttttttaacttggtcagcttattttcagagtggtgatattaaagcttttaaagctggatgaagcaaattagcacacaactcacacagtacacaccgtgcaccagaagcatcccaaggctgattataccttaatgtccccaacatggtaatatttgtatttctatgatcagtacccaagctgaccactttgttctcaattcatcgagccattgcatccatggaggaatacaacctacgcacacagtcctgctgttcctcacttaccagaatggtcagaagagtaaagaggagttgcatttatgtaggaaacccagagaattaaaaacaaacaaaagcaaaaaactgaagctcaagttagatattcctgtatttagagaggaaaataggcttgacaacttcctgggaaataaggaccaccaaagttccaatttcgtagcttggtcagctaagaagatagattatatttgaaacgttttgacttcaggccttgtcacactaaaaaataatgaaggtgttccctccagaacattttccaatgaaaaaaaatgtgttaagttttagaaggaccgaagggatttaagtttagattagtattactcaaagtgtggtttgacgattagctaccacctgcaaactgttaatgatccatatgagataaagagtttgtgccaaaccatcatcagtcacaaaccatcgctaatcacaaaccatcacaaactaagcgcaatgcttggctcagctgataattttttcattgcaagactttctcagtgaaggaacgcataagttgatgttcattcgagtgcaagatccttatgttgtcatgggccagcactgggtctaagccagggctataacaatgatctagccctggcttagatcattttggctttataataattattcagaccaaattaatgctcttttttttttctttttgagacagagtcttgctctgtcgcccaggcaggagtgcagtggcgtgatcttagctcaccgcaacctccgcctccagggttcaagcaattctcctgcctcagcttcctgagtagctgggattacagacgtgcgcacccatgcccagctaatttttgcaattttagtagagatgggatttctccatattggccaggctgctctcgaactcctgacctcaggtgatccacctgccttggcctcccaaaatgctgggattacaggcaggagccaccacacctggcctcattaatgttcttttctttaggggcagaaaatttccacaggcttagctgggtgcatttccattattccagagtattcctgcagagcaatcaccaatgttctttatcctccctgattcacagtgtgagtcgttcattaggctaccagagcccctttcattttacacatgaagacactgagaaaagactgaactatccgatatcattagtgacctgggcctcaggactggaaatcctggtagaccttgctggctgattcaggaagaggattacccggcaacttcaaaaatgagaatgtctgtgtgtcctgagccagcagaagctatgggttgttcctctgggcctcctacttaaattagaactagggaatcttttaaccagttttattagcttttctttgaaacataccaagtttaccacttactcttattagctttaacattcatacattctataaagtagaaagaatcttaaaatagtacacgtttggaaaatcataatttttcaaagtgcaaaagaactgggccaggtgcagtgtctcacgcctgtaatcccagcactttgggaggctgaggcaggtggattacctgaagtcagaagttcgagaccagcctggccagcatggtgaaacctcgtctctactaaaaatacaaaaattagccaggcatggtggtgggtgcctgtaatcccagctacttgggaggctgaggcaggagaattgcttgaacccaggaggcagaggttgcagtgagccaagatctcaccattgcactccagcctgggcaacaagagcaaaactctgtctcagaaacaaaacaaaacaaaaagagggctgaacttacaacaaaaggtggggggaagtgattatatcataaaagaattttataatccatttaaaattatcctagaattatttgtacacacagaggaaagaaagttaatatttccaaatgaatctccatcttggcattctatttttaaaggagattactacaccaattcaaatcttcaaccttgatcaagtacaaattgttaagacgtgttctaactgctcagctaattaactggtatgaatcttccctgcttgtgaattttggacacagaaattatccaaaatcacacatcagtgaaatagagttatgaagccacttcttatttctggaatcatttagacttgtcaaaagagttttccctgcaacttggaagctgtttaatggccctcctgcccatcttctctgccttacactgtggggaccacagggtttcgtattctgagaacatgacttcatgaggactaatggtgctggtgataggtttgggagagggtctttctctctcttctgcggaccaggagctatgcctccaaggtggctccttacacccatataaatgtgggatggaatctgagaccttagaagggcccttcggtgtaaactctgaaggttagtgccagaaggaggtggtcaacttcctaagtggcctggggtcaagatcattttcacctagaaagacaccagactatagaaatctaggcaatgacaaactgctaccattttcctcatatgattttttttcaggcagcttggggtgggggattactgatgtcccgaaaacacaagtggaaactgagtggcgtggagaggtatgttgcatttttcttattaacaacataaagtgttaaaagctaactgtgaaacacaaattacagtcaatttccaggaacttttggaatactgagtgaactcactctattcagtgcttgtgttccttgccttatgtggtattacactcatgaatgtgggtaaacaacagaaaaatcaaatatgtaaatattatgtgtaaacaacagaaaaatcagaatacacatcaagcgacccaggtagaatctctttcagacatagagattcctgtctagggtctattcctgggatctctgaaccaaccacaaaaattgtttaaaacctacaggcagcccacgttttactagggagaagatttatagctttcatgtttcataaaaggataatatccactgcttaaaaaaaataataatttttcaaagcaaataagcaccttgtaacttatcaatgttgaaagtttgggtttggggtctaagatggccagttcacttaaagtgaaacatactagcaatagcctcatctcatgtttcattcccgtaataacctttctctgacacagctccgactgatgctgcaaagcaccttttatttagagcctacgcagaagactgttgagaaaagctgaaaaacacaaaggcagtgatatctgattggcataaagcacattcaggtccaaagaaaagagaacaacagaatgcaaaatacaggctctggttctgaaccacatgcaaggggagcccagttctctcatcacaacatggcaggtcagacacagtggtgagctctggcactccaagtgaccaagaaagcctgaattcatcagaggctgccaaatgcccaccatcccctgccaagtcgccagatgctgcccagcaaaagcgtcacactggctctgccactagatatcttggcacagtttctgttccaggacaaggagagacgctgatggagcacagaggcacttgtgagccctgggcatgtgggaggcccaggccagagtggctgtgcagagggtgcgatctgacacccaggcccaaaatacacagagaacccgtgagtgtggaaagagaggggtatggttactgggctggagtcaagagcatcccaccaaattaatggaaagaaggcaaaaaagagttgggatacaccagctaaggcccatgtcagaagggtcactgtccctgagtctgatggctggggtcagagcctggcctgagcacagcggtgttaaggcacctggagccacccaagctctgattgcagggccccatttagatgccagtggatgagggcaggtgtgtctccctcccagggtcagccagtgccaggcctctgctcttggacccttggggcttctctcaggcctaatccctttccatcttgaagatctgcaagaaagcagaagcttaaggaagaggcaatgaagtaaacagggagagacaataaaagagagagagagaacaacttggaaggtgcctgctcacatgatcagaacaataattaaattcatgtgctttcaagagaggtggcctatgtacagtactttctcttctgtgagtttctgactggcacaaaaagtctgttactttacctttgatgccacttgcaactgtaagtgctgaaagtcctggcacatcctccacttaaaaactcactaaattacctaccctgagccttagaaaaataaacacccacacgattctgtaccaaagactattatttgagagcaaagcttagaacgttcatcagggaacacagagtttcctcttattgccgcaattcttgaaactgtactgtaactaaacttttcaaatggaataaccatatatgaagtcctaaaaatgagggggctgctggtgttccactctgagcagaatcccctttagccacccatttaactgaggatacccctctctcactgacttattagcaaaaggcatactttctaagtgaatacagttggaagaccagtggaaaccacataatgtgtatggccacaagtttaggaaagaaatgtgtctcacttagggaatgacatttttccaagctccgcaaaccaaagtttagaactcaccctaaaagtagaagaaatccgtagtcaattcttgtccccaaatccagaggatccttagtagtcacagaggatcctgaatgccattctcatacaaaatggcacaagggggccgggcacggtgcttgtaatcccaggactttgggaggcagaggtggaaggatcattgaggccagttcaagacccttctgggtaacagagtgagactccatctctacaaaaagaatttgttttttttaaattagccaggcatggtggtactcatggctgtggtcctagctactcaggagactgagtgaggcaggaggatcactggagtccaggaatttaaggctacagtgagctatgatggcaccactgcactccagcctgggcaacagagaccccatctctaaaaaaataaaaataaaaataaataaataaataaaatggcacaaacacctggagccctttctggcatccccttcaagaaccaaccaaattctcagaaaacagctctcttccttgctagcactgtcagaatgtcgagagatggtgccgctgagagggcacgccacaaaccctgagactccagagcatgactctgtgcattgtatttttatttatttttatttttatttatttatttttgagatggagtctcactctgtcacccaggctggagtgtggcagcgcaatcttgcctcactgcaacctctgcctcccgggttcaagcaattctcctgcctcaacctcctgagtagctggggttacaggtatgcgccaccatgcctggccaatttgtttgtttgtatttttagtagagatggggtttcaccattttggccaggctggtcttgaactcctgacctcaagtgatccgctcgcctcggcctcccaaaatgctagtattacaggcgtgagccaccgcgccggcttctgtgcatcagactgacgcgtctttagtctctcctgcccacaggctgctgcttaccgtaatcatcctctgatgtgttccactctcaaggctttaagtcgcagctgaaggtgctggtacagtttctgctgcatcaccagttgctctcactcctgccctgagagccaggtgttcaggatttaattcgatcattgctgaacctctgtcataggcaagccacagcacaacgcactgcatgggtgcaaagacgagtatgatataaagcctatcttcaaggagttcagaatctagtggggaagattgtcaatgaacagtggattaaaattcaaggcaaggaagtaaaggctggagagacagacgtgggagctgattggagagcacagagaaaggaatgtttccttctgtgattacagggagctttcaccaagcagggcaacattgtagctcagcatcatagcatacagggtacttcatcgggcagaaatggaaaagggcattcaggctgaagagacacacaagtgtgaaagtgcacagtgtgttggagaaagttcaaacccgtttggttggaggatgccatggtttaacagctgtggccaggtcatgggtggaaagtgcagaagtcttggccagcccagggcccgcccgcagagccaggtcagaatctgcgggggttctttccacgaaacatagatccctgagctgggagtcactgctgtgtggctgccattatgcgtggagagcattagattccttggggcgacaaaacccatggaaaacctttgctgcaggagccgtagtgggctttgagcagaagtgcaatgtgatctcacctgtgttctggcattaactctgcattagagaggagacgggagccagggacagactagaagctattaagctcttaggaacgtccaggtgcaggacaggaaagaagctgagtgtgacctaagctgtagtagcagagaaggaagtaagtggatggacctaggagagggggagagagaactgtaaggggcggtatagagacggggaagaaaagagtgaaactaaggacaacagtgaggtttggaggctggaggcctggaaggaaaatggtgccaggaacacagaatatagaggagaaagaatcaatctagaaggttgagcagtggcgattggggcctatggatttgaggcagaaataagagcacagggagatgtcttaaaatagccctgcgggattcagttctctccaacttacacaaactgcagaagccgcatgaccgaatcccacagcaaaacattttgaaatgaacctgaggctgttttttttttttaaataaattgccaacatttctgaaatcaagtccatgtcatcgaatcaatctgcagggctttttgccatctttatgcctctgagagggaggtgggacagagaattcagtgacaggtagttgggggccttggcagcttctcttctaaaaagacaaataggcccccacgtagagataaacaccacagccagacatggaagacagctgttttcctctcccatcaggcattcttactgacaaagctgagtttatccgaattagacatctagccatagaacatgatggaatgtatagaatggccatgtgtacgtgcatgcacggtgtcaccaagctcacaaatgacagagatgaaatccatagcaaaagccaaccttatttaatgcttactgcatgttaagcacagttctaagcacttcacctaaatacatattattattctccttttctagttgaggaaatctaggcacagagaggttaagtaacttgctcaaagtcacacagccaggaagtgatgaaacctgaacgcaaacccatactatctggctcctgagggcttcccccttaactattatgtctgctttatagcccagggtcctgactccagggtcattctacaaagcaaggaggtatttttttggagggaactttccaatacctcaatgctgttattactcattaagtcctttagtcttctctccaggggtagttatctgaccatgaactgcctttgcttctagttcctcaattccagtcgtaaatgtatctgacaaccagtgtcagagccagagaaagaccagaagctgagctagactattcgttggcccagatgagatccccaggccagtgagcgctctctgactgtctggctgacacctgcccttcatcaaatgaatgaatcgggtctttcccagcttctcattttttcccaaggccatcacacccgagaggtgggaactggatgagcccacgtccattgtacggccagacagggcagcaatccatggctctctggaggcagctgccacgggttattctactgtaatactttccttcctcctttatgccactcatgaaactccactgccaggacccgtcagtctctccggagacaagcgtagaggctcaccttacccagtaaatgtgtgaagtgagccatgacattcacagtgggagcagttgcttttcccagaatccaaacaggagcacggtggaagtgagggagagaagccgcagaagttaaacaaagccacagagatcatactgaaagaatctggggccttaaaaaataagcaagatttaacaaagtgaagcaaagggagatggtgttccaggaagaggaaacagcatgatgagacccaggagtatgagaatagaattctctgagaacaaaagttaatctggcctgatgaaatgggtaaagaaaagcgaagagacccaagacctaaggcgtagctggggctcaccccaggggctgcaggagccgtaccctgtatttggaatttgggctggaggcaaaagaaaactgtcagtgatttcagagaaggagagggccataaacagagatagaaaataattctggtgccaagtgaaggatgaaatgaagaccgagtcagttatgacacaattgctgaatccagattaaaataataattattattaaaggaatctgaaccaggactacagctcagacttttgaaataatgtaaatccctgagcacggaatcgctgttgtgtgatccactgttactgatgagagagcatcaaatttccccaaggcatgaggcaaaaaaagatggaactctcccctgctgtgggaaccacacacatctcacctgcagtctggaaagaaaataactctggattaggaaacagatggaagcaggggccttgccagaagctactacaaaaggacgcatctgagaaatttggacatcaattgattagaaaggaaagatcgagttaagcagtggaatgagccctctctttgagctccaggacactgcaatagcaagaaccatagaggcacaggaggcagctgccctcactggccaggtgctctggccatcactggccaaaggagggaccctggactggaggatcccaatcactctaagctgtgctctgagatcaccgtggaggcagggtgcatgctgccactggagcaggggcacaccacatggagacccacgccctcacctgctatttctgtggacaaagaaaagttgcagtgtgaactccaaaaaactgagacaggtctcagttaattttgaaagtttatctggccatggttgaggacgcacgcccgtgacacagcctcaggtggtcctgacaacatgtacccaaggtggtcagagcacagtttggttctatgcattttagagagatgtaagaaattggtcaacatatgtaagatgaacactggtttggtctggaaaggaaggacaactcgaactggggaggggccttccaggtcataggtagctaagagacaaatggttgcattcttttgagtttctgattaggctttccaaaggaggcaatcagttatgcatttatctcagtgagcagaggggtaactgaataggatgggaggcaggtttcccgtaagccgttcccagcttgacttttccctttagcttagtgattttgggggtccgagatattttcctttcacacatatttaagagtctactttgtgtttactaaatacagtatcatgggagcatgggatgggggtgagggttgaaaaattacctattgagtacagtggtcactatttgggtgctgggtacaccaaaaggccagacttcaccactacgcactatatacgtgtaataaatctacacttgtaccccctcaatctatttaatttttaaaattaaaataaataaatacatttagtgtcaatctggagtctgagaaacaataccaagaaactgaagctcagttgcgcatgccctgagcctgtcagggtggagtgccacccgcttatgtgatttctttattttagggccaactctgtgacgtggaatccacacaagatgatgggagtccctttgcagtgctctgctctcctggttagagaagaggtatgtctctcttgactctgtgtcccagtccgtgcgtgggctttgactgtctttatgcggttgactttctctggaaatgtcaagatcaccgggtcttctctatggtcctactcacattccccagagagccctttctagattcctgtctgcagggtgaaggtctggtgcctaacagggaagaaaggataagaggacctcaaatttcagaacataaactttgacctaatctccatgttttcagtatgatacccctttcctcaactgttcctgcattcctccaatccagagaccctctatgtcactctcccaaaaaattaaatttccaggttttttttctggaatctgagaggagatcatttttcctatataacaaatatacatgatataggattaagggtggtggtaggatccagatacataacatgtatatgtatgtgtgcatgttctgattacagtcagatgattaatctgtaatctctgattacagatgattacagtctatctatttaatatttaaagccatgttcaaagtgtaaggaagctgcatccttattaaccagaaaagagaagcagcatcaatgagcactttcatgaatgaaaccatcttgaaaccatcttgaaagatggttctgttcaccaggcctaggaccattctcagtaggtgagcactgttggtcaaggccactacatctgccttccgtgacgccaggccggactcatagttcctcactcccacatttattttgttgatgaaacccaaataaggagcttcagatgatccccattcaattttatcttcttagcattaataaagcaaccccagattaaaagaaattttaaatgttgatcttcatttactttttttttctttttgagacagagtctcattctgtcacccaggctggagtgcaatggtgcgatcttggcacactgcgatctctgcctcctgagttcaagcgattctcatatctcagcctcccaagtagctgggaatacaggcacccgccaccacacctggctaatttttgtggttttagtagagacagggttttcacatgttggccaggctggtcaagagctcctggcctcaagtgatccgcccacctcagcctttcaaagtgctgggatcacaggcatgagctaccatgcccagccaaatatctatcttcatttacttaaaaatattttgctttgttcctagttatacagttaatacattattttagaaagttgaggcagaacagaaaatataaataaatttagagtcacctcaaatttgtgtaacttagggataaccattattaccatttttaatattttctcccacaattttttctagaaataaatatatttaaaaagtataaataaatatatatttataataaagttgctatcatctacctcatatacctcatatatacatgttgattcttctttatattttacattatattgtgagcattatcttccaaaacctgattttaatggcctcatattattctatcacataattcaatgaacaatatctctatggttaaaatattaaccaatgttttacagagtcacttgatagaatccttaaacatatacctttgatcacattcctgattattttctcaaagtagactcctcaatgtgggattgctgggtcaaagagtgttattacttctgtggttcttaatacctcctgttgtcaacttcaaatttacacagcacgccttctgtgtcttcatcagtaataaaaatatggacacaggattgaagacagcaacttcccctcaaaatgagatgaatgcattggaaaatatccttttggactggtttttcatcagttaaaaatccagtccaatgtattatcatctgccccagctcatgcagggcatgagacctcaactataattacttcaaaggagaaaataaatttttgttatttagaattcagccagatgttttgacagtggctcccatcatgtccttacagaccaaaagggaaatgcgagccggaggaaaatagaaagatttggaactgattagatgactgcattggaaggatctactgactggcaatttgatgttacccaggatagagcctatggcttggtacctaacctgtagcattcgaaatattcacggactgtttgagtaaaacatagaagcttattaatgtttcagatgagaggagactgggaggtagagtaaatgtgtgtaggaatggaatcagaatacaagatgatttttacagactggagcagtaagccacatccaaaaagggacactgttattggagaccattgtaaggctgtgctcttaggtccatgtataccgtggctgtattttgattggacaaggaaggcttgtttctacagctaaattgttggacttgtgaaaaaggcaaaggatatcagctctacagggtcaacaacgagtcaagagaaaaatgccacacaaaatacattaatgagttacagcaagtggaatttcagcatgagaaggtggtggtctcccaccctcctctagttaaaccacacctgccatgctctgcttagcttggtaccaaattgtccatggggttccatcaagctagagcccaaactgtggggaccatttggtaaacgtggaagagggatgattgaaatagctaaagatgtttagcctagagaggaaaagaaaagaaaagggctgaagggaggatggcagccttcaccatttaaaggactctcaaatggaagagatttggaaatgattagatgactgcatcagaaggacctaccgactggcaatttgatgttaccgttgaggctgtggggagctggtttagtaacaccaggtggtagagatttgacagcaaaatcagaacatctgacttgggttcaataaaaggaatacttctaaaaattaagctgtccaacaataggaataagttaataaggggaggagattaaatagagagattggacagccacttattagtaagggtgtagaaatgattcctttattgaggaggaatagagtaaacgagctctaaattcccttacaaatccaagactttatgatgctctgacagcatttgtttattggcatccaaggaataatgctgttccataagatggtaataagagttccccaataagagagttctcagttttaaaaaggctgggatatattggtttagagttaaaaacaacttatgttatttcagggcttactggggcccttaatatgctgataattattgcagtatctaagaagaaagactagatgatatcgagtttcctaaatttatttgagcacgggaatctctttatgtacagcaactattaatgtgttttaatgtgttttaaatagtttgggacaggatggtctataactttttcatggctcagaaccaggatatcatctcactaaggccttctgtagggaaaacagcatcacttttgcttgtcatgttgtacagtaatgagactgcggctgttcagctttttttttttttttttttttttgagacggggtctctttctctgtcgcctaggctgaagtgcagtgatgtgatcttggctcactgcaacctccacctcctgggttcaagcgattctcctgcctcagccaccccagtagctggaactacaggcacccaccaccgcccagctaattttttgtatttttagtagagatggggtttcaccgtgttagccaggatggtttcaatctcctgaccttgtgatccacccgcctcggcctcccaaagtgctgggattacaggcatgagccaccgcacccggccatccaggttttttagggctcatgtgtttttgagttgttttctttatcacagtaggaataggtctgatccattcagcattccacactctctgaggtggtcttccttagtattgatggcacgaaggtgtgagcttgcatggcctgaggaataatggtacaaagtttctgtgaccatgaaaccaaataaaagtgagtgttgcaaattttcaccttattggtcttcaagtgaattttcttttttgagttcagtatatttctactgatctaatacaaatacatcgtatttaatttttcttattctgaaaaataatgaaaggattccaatatatgtgaagcctaaactacaaggtagagtccagttctgttgtctaccatttcagcactccgtctttcaaaaccaaattaaaattgtagttgcattgcattgtgttttagtgtggacagttttcagaagtgttctcagttttaacttcaactaagtgatgacactttagtcttgtcttcttttgtcgtgagtcacaaaagaaacaaaaccaaatgccaaagcttttgtaaaatcacaattagacagaagagaacaaaatagtcaaaggcttccagtgtttcatgacaaattgaaacacggggtttttagtgaagagactgtcgatactattttagtcggaaaacatgattcagtcactattctctggaataattcaatcactttgccacccatttccatagtaaggttacagtgccagggcaaatgaatggccattgacgatgaaactttccacttatctatctcaaggaactgagtatgcgaatgcaggactgaagctctgaccactcttgagagaggaatatgacatttgaaagattggttatttaaattcacctcaaaattgcaatatgtgggttttttttttttttagattttagcatataaaaatgatagcaatgagctgccttaaaagctatgatttccaaagggagctcaaactccctaacagctaaatgataaagtacttgaactagatatggatggaaatactggaagaaccacactaataatatttcacaaaaccaaagagtttccaaaatattttaatcatgacaaaaccagaatagtaggatattctcccaaagaaggggaacatttaaatataaatatatgctctggttgtgatttttatttatcagttgatttttataaatgccttctcttaaaagggagagtaaaagtataaatgtgtccttgctaacctccgtgacatttgaccctgagccattgatcccacagagttgaccattacaacaacctagacactcctgtccagaattgcccccattcttttttttaaaattgattcttactgttttctttctctaagatatgcaatgtctcttacttcttttttcttattaatttttaccaatataaatctaataagtagtcagtagaatttcctaaattttctcttctctcttgtagggattgatgcagaattgcaaccaaatgcatgcctcctacctctttcagcaagataaacattatgacctgtcctatgacactggagacaaggccttacagtgcggacgccacgttgatgtttttaaactatggctgatgtggagggcaaaggtgagtatgtatggaccagctaaatgtcaactaaaaacagaacctttatctggtgaccccattatgaaatgtcaaaaaagtgatttccaaattgaaatttccttacccaagatttgctttctttaaacttgcgtctaaataccttcatttgacatgaggaaaaatatagtcaaatccattgtttgtttcttttctagccaaattgattcaaatgctcactcatctggaaaacaaatccattttgctttatatagcagaacaccttgaattttaacaggtgtttattgttattgttgttggcttttgtctgctaacttggtttttacccagtgattgatcacctgggtaggtgaatgcaatctgaaagtataggtctggagaacaaaaaagaaaaagtaaaaagcccaccatgatagcttattttttgacatttcaagggataacctctagttacaaagctttttatttccccctaatctcccaaaatacctaatcacctccttttatgtagattctgtgtttccctctgaatttagctgtaggtgatccctccttttttcagcaaggaaaactcactaactaacagtgtgcaggacttgcttagacttaattgtagctttccaggagcctacatttatgtttaaatgtaagcaggctggataggtcaaagattttatttttaattttgaccagattcttaacttaaaggtcacaaattagtgcctgcccatccggcttcatttgtctcctgtaggagataaatagacagagccagctgtatatactatagaaactccaatgcaaaaagagagttcgaggaaacctgacataagaaagtgagaaagggggcgattaaaggtgtcaaccttaataacagagagagtctctctaagagaaaagatgttgatttggaaataaagcattgcaataggaatacatgtgccatagtaaactctatgcacattcaaaggaggtaaaggaaggcaaaagtttttaaaggaagaaatgaggaagattacataattgttttgagataaatatccttggctacaaagatcaataacaagggtgatgccagtccgaggctggataggcaattgctaggcagatgtccttgcagaagtatttttttgtatgtaaggttgtggtggcctttgagcaaggttgccatttttgcagtcttatgtgacagtttttgttatctggtatacaaggcatgagaaccctctcttcatggttttccctggctctatctatcaggattttcttagcattagtgactccattttgattctaacaacattcacaagggaaatctgggataccatgaggtcctttatgcttggtggagtggatatacatttggctctaaggtgtgtaaatagcctacttaaagaggtaacatgctcagtcccataagaaaaagcaaataacttggtcagcaggagggaagtataccaggataagaccagtgaatgggttcttccacaagtctgtgtaaaaaggtaggaaccatgtccacggcaatgcattccttatgcttttgtttataatttttttaaagtaacctaaattactttaagcagtttagatgatgggattcttaacaagaaaaagagggagttttcgagtgaagcaatgtgacccacaaatattttatggaatctcctttaagtccattctggcaaaaagatgcagtttaaacagaaagatggtcttgcttaaagaagaaataactctttagtggtttccaaggatggctggactgtacatccttcagggaagcctccttaatactgtttactccagctgaactttttacatgttgctaaatattaggcagctacaagaagctaaatatcaggagctttacatgaagtgaagctccactgtgttgcctggtaatggtggggtgacgggcccccttcctcttttgaaaattgacagcccaacaaggacaggtatctggtccccaccacctagtgggagactcattctgctagcaatgacactttcatttggaagaaaaacccaaagcagtcaagaatgtaaagtattgatgtacctccaagcagctttaaaatgagcagggttttcatttcattgattggtgggaattacaaaatgatgaatgtaaatatcaggtagcaagctgaggaaaccttgatctctgaatattgtgccaagttctctcttacttcaagtatcattctttgtggcttttttcccctgtggtgtttttattacggtaatgatcatcagtgatatttataggaaaacgtttctctcatggttcatcagtttctgctgctccctttccatctgaagcctcctctccagcaggggcagcacagtttcttagagaaataatatggagggcatcaggtgtgaatcgaacagcaggaccagatgaagcccaaaataaaagcaagagccccatgaaggcaccagggaaggggatgaaaagagcaaatcacagccactgtgttacttattcttttacttacttgtggaaacaccgcaagtatctagacatctagccgcaaaaacttccattttgtttttcaatctaaacctttgtgagtttttttttgaaaaacgaaatgataatcattattaaagtaataagctaagtcctacaatctagatcaaaggtgaggaaaattgtactctcacagcaaagctctctctctagccacactggccaaggaagaagtcatcctcttcccgcaagaagagccatgaaagagttggctatgatgttgaatcttgcctccccacaggaatgaggaaacaatctggaaaagattaaggaggagaaggaggaagaacatagcattaattcactaaaccctctgttgtcagacatgcctggagaattcggtgttttccacattttctcctaagataaaccccatgagaaatagcctaagtataaattattctttgaactaatctgctaatgactaatggagctaaatgcactgatgacagccatcatattaagtccaaattaacttgattagaaccaatttatgcaaaaaataagacccctgatttaggttgctaagcggcatactagctggttaagatatggatttttattatcatcagcaaaggcccagtgcctaccgttgactctcctcttacggagttggcctttcattttgtctgcattttattaaataatcctaggacctaatgattatttcccaatgttgacagatttctacggtggctaaaactcagtagctaacaaaaataagtaaataaacttaaaattacatctcccccccacctttttttttttttttttgaaatggagtcttgctctgttgcccaggctggagtgcagtggcgtgatctcagctcactgcagcctccatctcccaggttcaagcgattctcctacattcccttttcaggcctgcaggaataacttcatttataacaaccaaggtttcatagcaaatctctgtgtttgtatgtagtcatacaaatagtcagttttccttgtggtttttttatgattagcttttctaattaaaaatgtggataacagagggactggcaaatggctgtgaaaaaaaataccaggaaaaaaatattaaagggaaatggacatctggcatcctttgctgaaaatgaatgtttactttctctctaaaatattaatttattttaacaagtagatattcagcatctattatcgtgtctagtactgaatgggataagaaggctctcattttccagacaagataagataaatgcacagaaatccatcataaaagacagattaggactgatcacaaaagaaatccagacacatctggggaatttaaaggacggagagctcattcctggtttaagaatcaagatgattcacaaagagatgacctttgagataggacttgaacaggataggtagaagaagtaggatttcacccagcagtgctgtgagaaggccattccacggagtggttgagcaggagttcagtgcatattatgaaagtgagggaaagtctaattgactgaagggcgacttgggagctatgttccaggtgaaaagtaacagagcctgaactagggtgatagcagcaaaaattgagataacagcaagggattcggtagttatttcaaaagcactgtctctggggcctgtgaatgtttataaaagcatttcaagaagtggagaatgatcatgaccagctctcaagatgtcaaaccccaagaccacatagaggcagcagctgaacacttggatggtgagattgctgaagtatttaatgaatgaaagaattttgaagaatctcctaaaagccttcaaaaccttgaaaataaaatgtggatcttaatcccataaatattcaatatgaacgggaggcacccagggcacactagagttttctgtgtcattccccatgtatatctttagcccccaactaaaggggcagtcacatggcccatgatcatccccatagcaaggtcccagaccaggggaaccagaggtctttagtaatcccattgctgttgcagtgcaaactcttcttcatgggaaatcagagaggcatcatcattcccatctgatcagagagttggccaaagccattcatctggacagggtcagaggcaagctggtcatgccatatcctagatcagatatgcaaaagtttaaacccaactccagactggtccaaaggatccaggttggagaagagcaattagcttccctcacttctacctacagtccatcccaagtgaacccaaactgtcaggtcattccaaaccaattataatctccttagcacccatagatgcagagagctcctggtatgggtgctggccaagcatcaggcatcagcccaagctcttcttggggaggcatcaggaacccatcagcctccttgagccgattacctgggggagcagtctccaaagaagtgaatttctgaacccatttgatatctccagggcagcttgttcttaaacctgcttcagatgtcacaagtcactgggctatgttgggcccccttagctgagatgatgtgatcttgtatgaaacaggcaagtgggcccatctcatctccattacaattgctttctctaggttctctgctggagaagttactggtaggcaggttcaaagtgcttctgagatgagcactggcttttactcttaagctttctccatcagcacccagtaaacacccaaggagataagaggaaagccattttgaaaagtaactctcttgtgtgtcccgatgtcagttaaacagctccagtccaagactgttgtgttggttttcccaagtctggattcagagcttccagagccagaaactaaaagaaatcagtgataatgttcacccattacagacacgtgagtcatttatctgcccccaaaggagaactgtacagagctcgacaggctaacaaagcatctgggtgctccctaaaattcctgcatccatttgttcaatgaagtcagtgagcacctacccaattttttctgtatcaggtacactggcagacaaagatgggctctgggaatggaaaatgtgcacgttggaggggaactaagcaggcattctggggggtctctggtgatgctttttatctgcaggaagagagtagctcagccctcctgttattaatgacttccatgattattcctatgaatagcagaggcacattttcctcttgagtagtcaaactaattgcctggggaatggaggctctggaagaaaaggagttccgtgtagaaagcagtaatgaaagggaacaaaagcacctgacggggagagcattgaagagaaaatagcgctgaaaaagcctttggaaacagccttgtgttgagaaagtgccagacggggctaagacagagacggcaggatgacggtcagtctccagggaaatcgcttcctccgcactcttagcctgcttaatgagctgtgtccttctcttacctaggggactaccgggtttgaagcgcatgttgataaatgtttggagttggcagagtatttatacaacatcataaaaaaccgagaaggatatgagatggtgtttgatgggaaggtatgtatttggatttctacaatctcagaaagtttagtcaattccaaccctcatcactgatatgatgtaaatgatgtgctgtccaggtaagtgggacgattacagaggggagcagtggatgacggggtagctattccaagctggaataaagacgaaactctcaaagtggtccatataacgttgtcaaaatcatgccctccaatggcaattcctgattgaaaagtgggaattgtgttctgaacctgctgaatacatcgatttgaaatgttcttggaattttcaaaattgccagcctgggccaaatgtgaatcttcctttcctctttgtagcctcagcacacaaatgtctgcttctggtacattcctccaagcttgcgtactctggaagacaatgaagagagaatgagtcgcctctcgaaggtcagtgctccaagctcctctgatacatgtgtgtattgagcctttcatgtgcacatcttctttatgacatatgcctgtggccttaggagacagcctacctgggtacatgggcccattcccgtctgtggactcctacagagccaggacatatagagcctgatatatgcagacatttttcttctttttttttttttttttttttttgagatggagtctcactgtgtcttccaggttgcagtgcagtggcgtgatctcagctcactgcatcctccacctcccgggttcaagcgattctcctgcctcagcctcccgagtagctgggaatacaggcactcaccaccacgcccagacaatttttgtatttttagtagagatggggtttcaatatgttggccaggctggtctcgaactcctgacctcaggtgatctgcccaccttggcctcccaaagtgctgagattacaggcatgagccactgtgcccggcctatgcagacttttaacaactctatttgcttgttttctgagagtgagtttatgatgtcttgaaagaagtagtcaggcgataacctttgctggcattcacaaagcaacaaggacgttgctgaagttcattgatgttccaagtgaaactggtgctcagttacaagcacaaaagagactttaggtaccagaaatggttagcaaacaacgctgctgctgaccctcttgagctgccaaggtcaaggctaccctgggtgtgtccttagagctgtggtgacccctagaaggtaagagggcaaagagcaataataacagccactgttttgagtgtgcattgtgtcccagctcaatatcaggtgttaggtcacttaaagcctcagagcaacctgacatgggaaggattgtccacccatcttgctgatggagaaactgacccacagggagaaaatgtaactcccaaaatctcgcagaaagtctgcatccgagcctaagggcttgagctttaaatggtactgtggtaagacaccattaatctttcatcctctcctgctcccagcacttatacatgggtgaaatggggtttacagtgcacatcgaagcggggtatatgcaggacctgtcccccattcgaaactagggatggtcatgtagacttggatctcagagttgatttggttggtttgggggttcttttcatttatcataaaagagggaacctcctccagtcactgccaagagccccgcaggctgtcccctcactgctcaggagcttgggctgtctcactgacctttgggaacactttagttccttctacgtaaaatgaagaagaggattttgtgtagatataaaaccttcactaaagcttttatgtgttaacatctgtccttaagcaacccaagatcaaactcctcatcgggaggaaacttccatatggctgaggtctttaaaccaagcctcctaattagagtagtgatttgcaatcctggccatacattagaatcatccagaaacttcataaaagacactagtgaccaggtctcaccctgaaaatgtaatcagattgtgcttggatgggcctgggaatgattctggaagttatctagatgattccaatgtgcacctcagctagagaacccctgatctagaggaaaaaatggaagaaagcttctagaaccaggatccgtggtgcatgtgtctgagatggaaggggctgtggttgtgtttgatgatttcgtgaagttggttcattccaggaaatcaagcccacagggtgggagggaatgagtagaggtcgcattggataagatgatcggtgcaggcaataacaacgagaatagggggtgcgggtgtctgctgtcatttgagaggaaaaaattcttatttttcctggaatttttatggtataccttcataatgtaaaatttcttaacaatgacttatttaaccagttagaaattagatgcctccattctttttggctttcacttccttattgaactgactggccagaaagagaatccatggactagtttggctgatttcatttgttgaatcagtccattatcactgggctgagggatggagcaagatgggaatacagaataaaaacttttttttttcatcattttctgaacaaaagtcaacttggaggctcccccttttaaatatcactcttcaaatgcctcctaggtttcagcacctcatatgagctgtaatgaagaatggggatggagattatttcctggagatggcaattagaatattagtaaactgtttttatactgttgacaattcaaatatgaaaatctccggggattgcagaatgaattctcctgatttttctccaattttattactgtaatcaagagaattcagcaattcagatttggaaatgaaaatagaaccacatgaataccaagtttaacttttgttcacgtatgccaatgattttttcagactttctggaaagttctttattaagtgtgacgcccttaaagtatcatgtccaggaaccagtaaaatattcatacgcatgcacacacacacacacacacacacacacacacacacacacagtcccagagggaaaagaactgaggtgaaataatctatgctgtccagtatggtagtaatagccacatgtggctattcatatttaaatttaaatcaattaaaattaaattcaaccaaaaatttggttcttcaatcacactagccacatttcagtcactcaacttgtgcccaatggctgttttatgggacagtgcagatatagaacatctccatcactgcacagagttctgttggtccaggccgatatagactcaaaatttggggaaatgcagagtttcctgtgcagtttatgtgaaccaaaagaacaaagttaaattctggacaagacaaggcagagaaattactctgtaccatcttgcctgattcatagctgtagtgcacaataggaactcaaaaatcgtttgttgagctaaaattgtatcttagcgtggttgagctgcaaaaacagactaatatagactgggtagcttataagcacagaaatttatttctcactgttctagaggcggggaagtccaagatcaaggtgccagtagattccgtgtctgctggaacccctacttcctggttcgtcaatggcctttttctccctgtatcctcacatggcagaaagaggtcaagggagctctctggggtccctaagactgtgccttcctgaactaatcacctaccaaaggccctatctcctaatatcatcacattgaggggttaagatttcaacatataaattttgggaggacagaaaaattcagtctatagcaaataccttaggcatattccagaataaggaagggaaacaacatttaggaaacctaatagtggctcataagcctttttccagagtgcactatttggggacaaatatctggataacagaagttattaataaagcaaatacagtcatatcttcatgagggtggtaaacacgagaatccagtcagtgtgcttcctgctgctctgtcaggactatgatcttgcagatggcgctttgtccctgaggcagtgcagatgatgaatgcttggggcactatgaggatgtgacgccacacacatgccttggacacagggaggggcagcaagtgggctgtgccaatgtttaccaaacaagaatcaaaagggctggtctattgatcacctcttgtgtttctggttctttatcttcttattttaattttttttattcttgatcattatctggttctgtcagcttttatagtcctacactgattggaggacttttcaaaggttagcagtggatttaatactaaatttgtaaggaagtagcctggacttatatttaatacagactctttgaaagtctgtgttattaagtgcaatagaggatttaattggtgaaattttcgcatattagaattttttttttttaagacagggtctcactctgttgcccaggctggagtacagtggtgccatctcggctcactgcaacctccacctctcaggttcaagtgattctcccacctcagcctgccgagtagctgggattacaggcacacaccaccacacccagctaatttttatattttttggtcaggacagggttgggacggggtttcaccatgttggccaggctggtctcgaacgcctgaccttaagtgatcggctcacctcggcctcccaaagtgctgggattacaggcatgagccaccaagcctagccaacagtttagaatttctcatttaattattctgcttttacatttttcagaaatttctcgcagtcttccaaaatgtaaaaacaaagaggttttctaagacatagtgaaaaatacatttctgtgatatcttttaagtttatttcataatgctttactatgcaccctctttgaaagggacaaatgtggattccaattatggaaaagtcgcctggttattgctttctaaaggactgaaaaagctaatggcacaagagagaagacaataccctaaaattattaaggcaggcccaaagagctcttgttgactatacctttagcgaattcttcaacatgcaaccactctttctcaacttgcgttctttatttaggaaaactaggaatccaaccaaaaagtacaaaagcctagaaataagtgaaatctctatgtatttcatccaaaagaccactgggatggctagatagtagaaaggagagctttattgatgatatcagtttgcaaactgggaagagacagcctccagcatgtgtggaaggtgccctctcttccaagagaggaagggcaggttgggttttatgcctcacagggcctgtatcacacagtagagtcatacatattcagtaggttttgggggaaagctatccatatttatgaggggagctgagcacatgcagaatgagtaaacatatatgtaacatacatcccatgtttacttcggggcagggttttagtgttagaatgaggtgaaatttggctcttcatgtcaaaaggtgaactgtaggacataaacacagtttgtgcaccgcatctataagctgctaaaactggcttaaggtctgcaattgcttaccaggaaagaatgtgtgtaaggtcagtcttctgtctagtcagagttatagtggtctggttagtaaatcagggtaaggagggggtctcatagcgcctattgttagggaatttcaatcattaggaatttagtaatttgccctccagccaggccttgaaccctggacccatcttagttgatataggagtgtctattttggccccacagatcacatatattcatcagaatagtccgaatcttattttccttcttaacttgcaatgagtgaatatacaacgaagtagatgttcatgttccggctaattttagttcatcagcattttctggaagcaaccaaaagtcatatgtatttagacagctgtgatttctgccaattcagcttgcttcgggaactgaggggattcaatcttactttatgcccaaatctgtttgcttgtggctgttagcattaatcttttaacctttgatttgcattcatctgaaaagctagagatgattgtccttaataattagtgccattcttctgtatttttgcttggattacccatgaaaactaaatgagactttaatttactgagtaaagctctgtcattattttatcagttctaaagggcaagcgtgatttattatacaaataaaactaaggaatggttatgtgacttgtccttaaattcctgcagccaagtggatttggaattccttttctaatctgagatttatcttcgcaggaaccacattgacttgacacgcctcacaacacaaaggataaattccatgcccctttggctggaatatgctagtagatctattttcagaagttaatctcagatttgagatattttaattcttcttcttatttattccctgggatgagtccagtgctctgcatacattcttaatgctttaggtgaaagaaggatcaggccaagagaaacattcctccccatggaacaaggggtgggaagggatataagaactcaatgtagagtcagaagatctcaatgctggaatcatccacgttcatttttagagaaggaaattaggttcagaatgagaagtgaaggtgaagtctacctgttgaccttgtctttggtaactaacaaatgattggacccaatgggaacattgctattttatgcattggatactttgaagatgaaaacttcattataaaccaatgattatttaagagttgatatttataagtcacatgttcataacagcattccatttgaattgaactgtctatttaagataaatccagctgtgatagaaggcatggtctccattttgaaccgggtttctgaccatatgaaactcaaagaagtctaaaagtttctctgatgtctatctaccatttgcagaaatgaagatcagatattatatatttacaaactccagtggtaaatatatgtggatagactgtatgtacagttagacatgatttaagtttttgcttcttcctagatagctgtttctattatgctactctttatagcaataagaacttaggaatcccccaacatgaaccaagcactgtgctggtaaagaacaacaacaaaaacagtagaagacactgtgtctgccctccaggacctgacagttgaggtagagaaagaaaatgtatttgcttgaaagtaagaggatagtaggaaattagcatatagtcagaatctatggggaaggatcatggatgatatgtttacagcttaaaggaagagagctactgatggacactagaagtcaggaaaggcttcatagcagttgtaggactgtggtggaatcttgaagtgtgtgtaggatatgaaccagaagagaaaagggatggattctaagcacagagaacaagtatgacatagtaacactgatgacaagtgtgaagggataaaaatacatatggtaaattcaagagatatttaataaaggagtcttgtcagagttgaagattcattttggcaagtggtggaagatgaggcctcataaatggatgatgaaaggtctttgcactgaactagagtttaaacttaatttcatatacaatagagagctactgaggctataatcaaaaatctggcataaatagagtataatctcgtctgtggtatgctatcctgtctgtgatatgaaacatatgttaagtccttgtgagttcagctttttgtcccagctaattatcatcattattaaggattatctttcaaaatatcttataaagtgaggcactgcaaagagagaacgaaaagaaactagaaagctctggggtttcaagaaagttgccaaaagtctgcttatcttcatatatcacctgacactcaaacttacattttggtaacaatcctctgaactgtttatttccaatgtttttacatttactgtggggggaaaatgcccccaaacgtcttgctaacccatttagcttggggccaatactagattcatcccatcctcccaaaacactaactggaaagtcaaggacaaggtggcaggcagctgatagtctatcacttattattcctcttatcacttgcaggatcttgaatgtgttagactgttctaattctctgatcccaagaaaacttggaggtaactctttcaagagaaaacaataaggttctgactgttgagctaaaaactaaagacgctgcttgctgttgggttctttgactcaggggagagtcccaggagaaagtcaccatgctgatatggtctgtcccacaggtggctccagtgattaaagccagaatgatggagtatggaaccacaatggtcagctaccaacccttgggagacaaggtcaatttcttccgcatggtcatctcaaacccagcggcaactcaccaagacattgacttcctgattgaagaaatagaacgccttggacaagatttataataaccttgctcaccaagctgttccacttctctaggtagacaattaagttgtcacaaactgtgtgaatgtatttgtagtttgttccaaagtaaatctatttctatattgtggtgtcaaagtagagtttaaaaattaaacaaaaaagacattgctccttttaaaagtcctttcttaagtttagaatacctctctaagaattcgtgacaaaaggctatgttctaatcaataaggaaaagcttaaaattgttataaatacttcccttacttttaatatagtgtgcaaagcaaactttattttcacttcagactagtaggactgaatagtgccaaattgcccctgaatcataaaaggttctttggggtgcagtaaaaaggacaaagtaaatataaaatatatgttgacaataaaaactcttgcctttttcatagtattagaaaaaaatttctaatttacctatagcaacatttcaaatgtatttaaatacatataattttacaaaaggaaaatatatatattaaaaaagatatcctattttgtaacatatagatttttattttatataggttatacaaactgcgggggcagatataaaatctaagccagatttttttttcctttctcttaatggaggcacaataaaacacttagcaaagttattttgaaacattgacccacgaaattcttaaaaggtattattgcttctttctatacatgttatggcttatcacatctctaaagttagtatttcaagacaaacacaaaagaatactgcgagttctttaaaataattgatcccattggcagtaagattctcttcccctttaagttttccacccattttactcttagcggactcactctgcaagcgtgacaaaccaggcttcatctcagattaaattagggtaattgtctctattctgctttccagttcggcctgttttgaacagaaggttgatgctagttcttgaggcatcttccaaatagtattcttttattaggtcatttgaattaattagagaaagtaaaaataaaaccttatcagcctgagcaaagaggaatgaagcacactcccagaatgtggtgagcccagaaaattaaagttggccttgggagaagagatctctgtgggacaataatgacatcatcctggcgccatattgccactgtccaggaaagagaaatttacctccaggccagttgcgcatttccatcccctccccattcctccccacaaagtctctcccactagactccctaccactgggacccaaaatagttactttatattccatgggtggttgtttttcttccatgaaatgagcctctcaccctagattttgaggcattatcttaagattttcctttatccatctcccatcgagatccaaagtgaccagaatatgcagaaataataagatccttagaattcaaaatagtatttttaaaacatccttctttccctgtgaacctgatagaaaaacatgagctaacaaaagcttccatagatatttatggggtcacacatcgtcagattccaagtgctgattggagaacaatagattgatatgcagactgcaaatgcaaatttaggaacattctccatttctgaatggaccaggtagttcagtactcagactgcaggtatacaagggaagagagaaggccctgcccttcaacgggtagaaatgccctacaatataacatagagaaatgccctataatataaccacaggatccagccatctgaaattttcataagcttccccctacattatttctcctaggctatatgcaaaaacagtgataacttgatatgaacatggctttgggccctttctgtctagaaaaacaaatgggttcactatgacaatcagaaataaactctttcatctgtcccgcagaatttcatgaaggagtaaccttccattctaggctttgtctaatggccaagcattagacaaagcattagaaagcagttcctttctcaaaactgcctgctgagaataagcacatagctgcccgactatccggagcctcaggcccaaaggttccacttcagagacagagatgctaattgatccaacctgctgtccttcgtggagaagacagtggggcccagtgccctggtgaaccaaccctgctgtactccaggatgctttatcttttgagttacagatcctagattataaactgctgctttttaggttaatgagatggtaaaattttaaaggacaatttgtgcctatatatgaaattccagcaaaacaattctagcaacaacaatagctcttcttccccgctcccctaccccttcccagtactccttcaaattggctgagagccttgctcaggcctgtgcagggaaatccttaccaactgtagcccaaagaaggaagcaaataaaagcctagtaggtcccagtagtttaataaatcatcttgaaaggagatgtggaatcaggtcagaagagagtaagggaggaagggagggagggagggagggagggaaggagggagggaggaaggaaatgaagggagggagggagggaggaaagaagggagattatttttaatattagcccaaattcccagtgccatggtctttatgtgtgcccattctttacaaatcttagaaaagtttggttttagctttaatcagaactgacatggccattttcatttatacagcaatattgtgtttatcatttaaaatacttgaacaaacaagtgtgatatgtctttatctgagacctatacatggtatggacttcatatactgccacaggatgtgaggaaagaaaaggaaatcaattctgactgtgttgcctttattatctggataatactgtcttgtcacctcagattggggttgtgcactttagatctgaactgtacagtgttgcaaatcaacatgtgtttctgtaaaagcttgtacaatatattattgatatgtctttttctgtgtggtagctgtattgaactttgatattatgaaaactacatttgcatctgttcctgttctctctctctctctctttcctaactatatgccctccacatcggctctaatagagaacatgccctcagctaagccccctactgagaaacttcctttgagaattgtgcgacttcacaaaatgcaaggtgaacaccactttgtctctgagaacagacgttaccaattatggagtgtcaccagctgccaaaatcgtaggtgttggctctgctggtcactggagtagttgctactcttcagaatatggacaaagaaggcacaggtgtaaatatagtagcaggatgaggaacctcaaactgggtatcattttgcacgtgctcttctgttctcaaatgctaaatgcaaacactgtgtatttattagttaggtgtgccaaactaccgttcccaaattggtgtttctgaatgacatcaacattcccccaacattactccattactaaagacagaaaaaaataaaaacataaaatatacaaacatgtggcaacctgttcttcctaccaaatataaacttgtgtatgatccaagtattttatctgtgttgtctctctaaacccaaataaatgtgtaaatgtggacacatctcagcctgtggataattgttttgactttgtcttatagtggagatgattttcaacaaattgctagaatcaaaggcccttcacttgtcaaggagcttaaagtgtctttgggtcttttgtagggaaaaaaaagctcttctgcagctgcccacactgtagcttctgaaggatatctttgtcccactctgatttctccttcaatcagatctgatatttttttaaaaaatattttattatggaaaatttcacatacataagtaggtagagaagatagtataaactcctgtgtagccttcacccagattcaacatctactgattctgaacctgaatcttgtttcatccattcccccacccctctccctccccaacactaaattatttttatctgaacctctaagagattaggaatctttttttttgtttttgtttttgagccagagtgtcactctgtcacccagatgggagtgcagtggtgtaatctcggctcactgcaacctctgcctcccaggttcaagtgatactcctgcctcagcctctcaaggagctgggattacaggtgtgcacaaccacgcccagctaatttttgctttttttttttttttgagacagagtcttgctctgtcatccaggctggagtgcagtggtacaatctccactcactgcaagctccgcctcctgggttcacgccattctcccgcctcagcctcctgagtagctgggactacaggcatccgccaccatgcccggctagtttttttgtatttttagtagagacggggtctcaccatgttggccaggctgttctcgaactcctgacctcaggtgatccacctgcctcggcctcccaaagtgctgggattacacgtgtgagccaccgtgcctagcctggactcttaaaaaaaaaaagtcctcaataccattatcacagctaaaagtatagtaatattaccataacaatgtcaaatatccaactactgttcacattttgccaattcttaatttcatagcaaagcccatggcctgtggctcagaaaatctggtgaggctacgtgtttcaggacagcggagacatctacaattcaggcacacagtacaacgccatatatgccccactgtgcatatgctgtgtgtattttccagtgtgctgagtctatttctggacttctgtgagttgcaagttctggtcttgtgttcaggggctttgctccctggctctcaggagcagaggctaagaggtgtgctcaggttaaaagctagaaaaccgtaggaatttaacagatggaatagatatgcctgatgtgccttgtcgggtgccggttgcccgacaggcttgagttgcccctaatggtaaaattctggatggagtaaagagatacgattttaaacagagatgggatacaggcggacaaaaaggagagaaggctgaatttctagctaatttcgatattgattataggagaaccagtagaagatagccagataaagaggacactgcacattcctgcctttgttcacattattcccttggcctaggaagaattttccacttctccacggtttggggagcatctcttgtaggtgctaagagtgcaggctctggagtaggatcactggggatctaatcacagtcccacactgaccagctgtgagacctgagcacatcacctgacttccctgactgtttcccagtttcgcaacagcaattgtcagaggtgtttgaaccagagcaactccatcttgaataggggcaggggaaaatgaggctgagaactactgggctgctttcccagatgcttaagccattctaagtcacaggatgagagaggaggtcaagacaagacacaggtcataaagaccttgctgataaaacagtttgcagtaaagaggccagccaaaatccaccaaaaccaagatggtgatgagagtgacctctggtcgtcctcattactacactcccatctgcaccgtgacagtttacaaatgccacggcaatgtcagg

SEQ ID NO: 13695 - DNA, 19451 bp, Human
aattgcacactaataattaagcaaattattatatttccatacaataaaatactatgcgactattgaaaataatatagaccattacttatggacatatgatagctataactttttaagtgtattaataaaaacagtatcatcttatttttaaaaattgtatatttattacacatctgtgtgaggcatgtgactagagagatatatatggaaagaattttcaaaatgtttatgtagtatatgacaatttttaaatgagcatttatttaatcagttagcactatttataaacacttaatatgtgctacgcattgtgctaggtcctggagaaacgaaagagaacaatctattaatttaatctgttaatttagtccaccaaatcaacagtgtttttcagaaatacgacaataaccagtgttgatgaattagagaaggtaacctcatatactactgttgagagtatatgttggtaaaacatttctggagaacaatttagtactttgtttttttttttttttttttttgagatggagtcgcactctgtcgcccaggctggagtgcagtggcacgatctcagctcactgcaacctccgcctcccgggttcaagcgattctcctgcctcagcctcctgaggcacgccaccacgcccggctaatttttgtatttttagtagagacggggttttaccatgttggccaggatggtccgatctcctgacctcgtgatccacccgcctctgccttccaaagtgttgggattacaagcgtgagccaccgcgcccggctttttttttttttgaaacagaatctctattgcccaggcgggctggagtgcaacggcgcgaccatggctcactgcaacctcgatctccctggctcaagagatcctcccacatcagcttcccgagtggctgggaccacaggcccatgccaacatgcccagcctttttttttttttttattcttattcttattcttattcttattattattgtagcgacgaggtcccactgtattaaaataatatagtgatctcaaactcctgggttcaagcgatcctccgccctcggcctccaatagcgctgggattacaggcgtgagccaccacacccagtctcttttttacaaagaatataaatagccggtggatgtcagattggcagctgtttgcagagatgtcagactatttcgttatggaaagatgctctcaaaagacgaaatagataaatcgaaagaaagtgtccattttttctcagtggcctaatctgtcaggtaccatgcttggttctgggggcatagaaagacattagcgccctcatggagttcaaagtctggtggaagaaatcaatcataataacaatgaggggttaacgacaacagacccttgaaagataacatctccagggaataaggaagagcattccaaagtattttgccaaatggcaaaaaccgcagttacttttgcaccaaccttaatgcaaataaaagcatgtacacaaacaagatactcgaggaagaatacagctgacacacagaaacggatcgttatcttgtggctttcctgcagcctcgttcctttcagtcacataacaccccaaatctgtggacggttaatgagagctagtatcacccagagtcacggctgttgactcggacgactttagatgcagcccgccagcgggagaaactggagggaatccgccatacacaggaacctagaagggctacgtgacaggggctgccccgcagctctcagccgccggcactcccagccaggttttcccgccagtctcagttcctagatcttccgaggctccgcccgccgccgagcggtcggaaagttttaaggagggggaagtgttgcaagcctatcgatatctctggaatagactgcgctaccctgcgccgccgccgtcaaactcccgcagacttctctgtagatcgctgagcgatactttcggcagcacctccttgattctcagttttgctggaggccgcaaccaggcccgcgccgccaccatggtacgttgaatcccgatctctggaaggtttagggcagagctctggtgactgggggatgacgagccacctctcctgtcatccttagcgtcgcccggtgccacgaggtatgagagcctcggcagacggccgggctccggcagtgattcagcatctccggcctggccgggctaggggttatcggtagccagtgcggcctttccaccgctttcgcttcccggggagcctccgacacttcctcctcggtcagctagatgagttcgcccctcaggttccttcagtggagtagattctgagcggtccagaatagctcctagtgctgtgtatgggagaggagaagacagagacttgacttggaggcctacctgtaccaccagtgcggacttgacccccaggtttgtgttcctggacagcgtccgttttcctggtgggtccgtctatttatctctcgcctagacttcgattagaagaggcccttttcaatcattttgtccagtcacctagttgcggatgagtaagccgaggctgagaggggaagtgatggaatcagggttacaatatagggttctgggtttccagttctgtctgccattctagcactcaatctcactcccatgactattattataatagtcgtaatagccgtaatggttctatcgctgcagctatttgtgtccacctctaactttgtgaggacatttttgttcattcaatgtgaatatacagacagcacttgtacaggcataactacagtgaacattaaaaaataagtcatacatgtccctaatcataaaaacagaaagggacgtttagataaagagctgtgggagtatatgttagggggatttgggaagaaaaggagaagacttcaagaaatcgacatttaagctaccttaaagaaaaggaagacttttaaccatttattagggcccaataaaagggagcagcataagcaaaaataggcaagaaagttgattgtgaactttagtaattgagcctaaaggggttgatatggagggtgttagaataagagtttggaaaaataggacccatttagatctgcttctccctctcccacgagtttatggtaaatgtagaattggcttacatctgagtacagtagtaatcttccagtaagactgcatgaacagagtgccttaacattgaatggaaacacaagcatatttcttaatgaatgttaagagttgggatttgaaatgttcttctattaacaggtatttttttcttttacttttagtttcgaaatcagtatgacaatgatgtcactgtttggagcccccaggtaaaataatgtttttaaaccttttctgtgaagtggctttttgtggctgcaatatatttagaaacttgtgagagcgtaggcttggggaaaatggaatataattattttagacgttcttggaagttgcatttataattaaaataggtttcctgatggacctagaggacattatgttaagtgaaataagccagaaacagaaagaaaaatgtttcatgctctcacttatatgtggaatcttttgtttaaaagggcaaatatatatatagagagagtaaaacagtggttaccagggtagggggtggcagtggggaggaaaaaagaggagatacaaagtagcaaatatgtaggttgagcaagtggaaagatctaatgtacaacatgaagactacagttaataatgcaggtagtgttttgtattcaagatttttgttaaatgagtagtttatagcccttgccacagcagaggaaaatgggtaactatgtgagacaacggatgtgttcattctgcgatagtgaccctactatatatgtgtatcttataacatcatgttgcatacgttaaatatacacaagaaaatttattttaaaagaagctttcagccgggtgcagtggctcatgcctgtaatcccagcactttgggaggccaaggaaggtagattgcttgagtcttggagttcaagaccaccctgaacaacatgaaacccggactctacaagaaatacaaaaattagctgggcgtggtggtgcttgcctatagtcccagctactgtggacagtgaggtgagaggactgcttgagcctaggaggcagaggttgtactgagctgaagattgtgccactgcactccagcctgggtgacagagtgagaacctgtctcaaaaaaaaaaaaaggtctcttgatttaaaaaaaaatcagttgagatttaactgtgctcacctgatatttgaaaaccctaatttttaatttataaaagatcttctaagatgtgtgttttttgttttttttttctttagggcaggattcatcaaattgaatatgcaatggaagctgttaaacaaggttcagccacagttggtctgaaatcaaaaactcatgcagttttggttgcattgaaagtaagtacagtaataaatatgtcttcctctgtagaaaacaatgtaaatttcaccatagaaaataaggttgtaaacttatttttacatttgtctctttttttttttttttacatcttataatgtctctatttagagggcgcaatcagagcttgcagctcatcagaaaaaaattctccatgttgacaaccatattggtatctcaattgcggggcttactgctgatgctagactgttatggtaagtataatcatgaaaaataaacatcctttttgtttcataattgattagttttctcaaaaagatccagataaggtattttaggaagttgtctgccaaagttcttgtaaattaagattatgaataccttggtggttttgagtttgttattaaattttccattttttgatccctgtaggagtaactaataagattaaacattagcacttttcagaagtcactgagtaatgtgatgtttgttaatacaatgtatatcgtttgagaccctgttatgtctaagaagaacgtgatacttttgtctggtttctaaggacaagctgaaccacacttgttttctttgtgcttgttttcttcaatacatcagtatttattagacatttattttttgcaatgctcaatactggatactgcagggtatacataagtgactcagacatggatcttgtcttaagggaacttgaaggcaagtttatctataaactcaaatgtagtttatctataatataacagaaaaatttctgtgagagtctagaagagacagattatttatggttaaaaggcaatacataaatgaagagatagggctttgaaattgcacatattgagttctcaccttcaccacttagtatctgagatttggctaaatacctaaacactgaattttttccagtgttttctttatcaaggctatttttaaatgttatttatttatttttttgagatggagtctcactctcacccaggctggagtgcagtggtgtgatctcagctcactgcaacctctacctcccaggttcaagcgattctcctgcctcagcctcccgagtagctgggattacaggcacccgccaccacgcctggctaatttttgtatttttagtagagacggggtttcgccatgttggccaggctagtcttgaactcctgacctcaggtaatctgcccacctcagcctcccaaagtgctgggattataggtgtgagccactgcacccagcctatttttaaatattttaaattgcctactgtaaaccactaacacagagcctttcaggtattatgtgagtatgtgtgttgtggatggcaggtagttagctaaaactaatcttgtaaatttgtgatttgattaggaaagaaagaatataaattataagggtgggcctggcacagtggctcctacctataattctagctctttgagaagcttaaggtcaagaatttgagaccagggcaacatagtgaatccccatctctacaaaaaattttaaaacttagctgggtgtggtggcacacacctgttgtcctagctactcaaaaggctgaggtgggaggattgcttgagcctaggatttcaaggttgcagtgagctatgatagtgccactgtactctagcgtaggcaacagagtgagaccctattcttttttttttttttgagacggagtctcgcgctgtcgcccaggctagagtgcagtggtatgatctcggctcactgcaacctccgcctccagagttcaaggaattcttctgcctcagcctcccgagtagctgggactacaagcatgtgccaccacacccggctaatttttgcatttttagtagagacgaggtttcaccatattggccaggctggtctagagctcctgacctcgtgatccacctgcctcggcctcccaaagtgctgggattacaggcgtgagccacagcacctagccgagtgagaccctattcttaaaacaacagcagcagcaaaaacagtgtaaatagtaatgctatggtttaagaatttcaggctgagcatggtgtctcatgcctgtaatcccagcactctgggaggctgaagcgggtggatcacctgaggtccggagttcaagaccagcctggccaacatggtgaaaccctgtctctactaaaaataaaaaaattagctgagcgtggtggcaggcacctgtaatcccagctacttgggaggctgaggcaagagaatcgcttgaacccaggaggcagaggttgcagtgagctgagatcatgccattgcactccagcctgggcaacaagagcgaaactcagtattaaaaaaaaaaaaaaagaatttcaatttactcagccagtcccttgctctaagtcagcaatataatgacagccttaagggtttccacctactcttcaaaatggaaaatgtattatattatcaaacattttatttaacccaatctataaaatattgccatgccaacacataatcaatataaaaactttattaatgagttattgcacgtttttaggtactaagtctttgaaatttggtatgttattttgtacttggtgtacatctcaattcagtctagctacttttcaagagctccatagccacatgtgattattgcctgccatattgggcagtatacttttaggcagcattgggaaatggacttaaatataagtactgaacaaatagcttggttcctgtagtcaaccatgtgatgatcagatgtgacatacgcatatactggacaaagcaacattgagaaaaaggagcatatccatttcttgtttatcttatttataggcataaattctcttctccccaatgttaaccttgcttgaatttcatcagatttaacagtgagactcagcggctagtgtccagtatctcctctagagtgcttcttatgaatagaagtaacagtggcagaaacacgtaaagatcccccctgctgtgttttccatttcttatatttgctcttttggagaaatgttagtctgctttcaagaaaaaaggacagagtagataatctttttgctggttcgagatctagaattacgacaagcttgctgacagtgggaaggataagagaagagaggttgctgtttttcttttgttcagccttctcttctctgttccataagtgctctgatacaaagattttctagagctaaaaaatgtttcagtcttttttaaaaaccttatgtggctccagagtttagcacaaaaacgcacccttgcaggcatgtctttcttaccttctgtttttcttatatggatgttatccatgtaaacgcttggaagaatttgaagtgaaatcaaacaatttagattggaatagttgtctataatttgaaattactaaactttttttgtttcttttttagtaattttatgcgtcaggagtgtttggattccagatttgtattcgatagaccactgcctgtgtctcgtcttgtatctctaattggaagcagtatcctttttatgttagcatttatggatatgaactttgaagggttttgatacttgtgttaattattaggaatataataataatatgacataggtaagattgtgaaaactttaaaacaacaaattggattgctctttcattagcctttataagcaatttatatttgctagacacaaataagcccaacttcaggaaaatcatctaagcatctttttagaggggatttaaagtttcttaatggttctagatgtcccaagaaatcctagaccccttgtatccaaaacaaatcaggttttagatgggaagaaattattttgctggcactctttcttaggttcggtagaaagtcaaacattttatattaggccaaagaaatagtgtcctattgcattatttctctggtggattatgcaacaattaaagaataagccagagacctttgttaataatgtataatttgaaaataaagacagtacttcattccttgttaaaacaagctcgttaaccagtctaagagacccagataccaacacaacgatatggccggagaccatatggtgttggtctccttattgctggttatgatgtaagttcattgaatattgttatatgttaatgattttttttaattaactagaaatttttataatttttagttcaaccaaagtaaataattatgtggtgtatttatttctatttgtaggatatgggccctcacattttccaaacctgtccatctgctaactattttgactgcagagccatgtccattggagcccgttcccaatcagctcgtacttacttggagagacatatgtctgaatttatggagtgtaagtgacagccttgctttttttttttttttttttgccttttccagtctatatagtaaataaacatagtatcctaaatgcataaaactgtaagtcttatagaaagaatttttttaaaaaaaattatgcccatgaagagtttattgtttctgtcacatatactaatcttaacttctggttaccacagtagtttcaagcacgagtagaactttttcaaaatataaatgtgttcccaaccttgaaaattcttgattcatttggtcagaagtgtgccctgtggagtggagagcggagaaccactgtactacctgccagttgtaagctctgttcacttttagttttctgtgagtcttttgttattttaagccacacagacatttctgcattagtagtccataaacaagaaataaaaaggcagtgtagttgagggagaagaaggtaaaagaggtaagatgttatgacaggacaggttttcaagtgctttgctttgcattggaaggagggtatcgggttttacatttctctttgtcatcttatctgttttctggtgacaaagcattctttggaggaaatatttggggtttagtgaatgcagagaaaaatagtttaattgacattactcaaagcaaacttgtgggatgacaataggtttaactttgggaaaagaggattccttggacaaataagcttggtaaatgctggcttaaagtttaacattgtaaattatggtaaatggattggggtccccaaggttacccctaaatttggagatatgctaggacttaaagcgcacagcatatagttgtactcccaggtaagacttttaacaataaaataacagtacataggtggatcattaaggaaaaatacagtccagaggaatctatgtgcaggcttccttatgctctttccttcccataaggagtcacagagtacacttgcagcaatatgtatgtgatgtttctgcccagagaagctcattagaaactcagtgtccaaagtttggttcagaactgctcatatcagcaccctctgcctagcacatttcaacctggataggaaattcctaaagattgcaataaatctatagataattttggggagtactgctactttgatgatacaaagcatctgatccatgaacatggaatgtcttcatttatttaggtatttaattctttttttttttttcctgagatggggtttcactgtttttgcccaggctggagtgcaatggcgcgatctcggcttattgcaacctctgcctcccaggttcaagcaattctcctgcctcagcctcctgagtagctgggattgcaggcatgcgccaccacgcctggctaattttgtatttttagtagagacggggtttctccatgttggtcaggctggtctcaaactcccgacctcaggcgatccgcccaactgggcctcccaaagtgctgggattacaggcgtgagccaccacacccaaccaggtatttaattctttcactgatgttttgtagttttcagtgtacaaatcatatttgtcttaaagtattttattatttttggtgctgttgtgaacagaattgttttcttaatttcattgcatattattcattgcaactatatagaaatacagttgatttttatatatcaatcttatatcctgcaatcttgctgaacttgtttattagttctagtcatttttttatagattcctaagatcatgttgtctgggaatagagatagttttactttttcctttctaactgccgtggctggaacctctggtacaatgatgaatataagttgcatgaacaaaccttcttttttttgttcctaaacttaagggaaaaggttttagtcattcactgctaagattgatgttacctgtcagctttttgtagatgccctctatcagactgaagaggttcctttcaattactagtttgttttgtgtttttattatgcaaacattttaggttttatcacgtgctttttatgcatctcttggggtggttatgcaggttttctcccttccttcagtgtaactgaaaattacactgactttcagttgttaaactaacttattcttgggataaatctcacttgtatatggtatataatttttttaatgtgttgccaggttccgtttgtagtttttgttgagggttttgttttgttttgttttgtttttgcatctatattgggtctgtagttttattttcttgtgatgtttttatccttgttatcggtaatactggccacatagaataagttggagattcctttttacaatgagcaaatataaggactaggattctacagaacacattctacaaaacttggagttgtataatttatagtcgggattttgatttgacctagcaaaagagaagatcaaaatcgtaacaaaaatcatgagtcctctcattaaataaaataagaatcagcaatgtcatagaatgctattaaaagattatatgactagcattaaacttggctgtttttactgtgataaatttagtgtgtaactaaaaaccacaatttgagactgtagatttgataaataacagaagcctagcataacaatgaaattaagaaataattgttaatttattacatataggtaatttaaatgaactagttaaacatggtctgcgtgccttaagagagacgcttcctgcagaacaggacctgactacaaaggtaagtattgtcttttccaattgtagatattaacgttacagtttaaacctttattgcataaatgtaatggagtatatatacaacattctgtaatttgggatatgattgtcttggcagattcttttcctttaagctatttgctaagtaatccaattttattttttaaacatttctttttggtacaaagcagtaaaaccagtaaatttcatgcaaaatgtccttcattattttcagcagattggcatatcttggtattatttagttaacaaaaatatatatatattgagcacctaccatgtgcaggcactttctaagcattgaaaatacagtaaacacaacaaataactttttcttcatggaacgtacatcctagtagggaaagatagacagtatatacataagtacattatatagtatattagaagaagataaatgctatgtaaaaaataaaaaagcgttaaaaggagaaagaatgaccaattggatgtaggtaggtgtaatttaaaataggtggttgaggatattctcaccaagaaaatgaaatttgaggaaaagatataaaggaggtaagtgagtatgagctatgcagatctagagcaaaattattctaggaaatacaaatgcaaaggccctagtatttaaggcaaggaggccagtagtgttgaggtcaatcatcgagaggaagaggaaaagggaagaaatcagagaggtaatggaggtcccataagccattgtggttactctgcattttactctgggtgggctgttaagagtttgagcagaggaataccatgatttggtttaggttttaaaacagtcactctgtttggcattttaacgacagattgaggctgggcgcggtggctcacgcctgtaatcccagcactttgggagaccaaggcaggtggatcacgaggtcaggagatcaagactatcctggctaacacggtgaaaccccgtctctactaaaaatacaaaaaattagccgggcttggtggcaggcgcctgtagtcccagctactcgggaggctgaggcaggagaatggcgtgaacctgggaggtggagcttgcagtgagctgagattgcgccactgcactccagcctgtccagcctgggcgacagagcgagactccgtctcaaaaaaaaaaaaaaaaaaacaaccggtttgtgggccagccgcggtggctcacgcctgtaatcccaacactttgggaggctgaggtgagtggatcacttgagatcaggagttcgagaccagcctggccaacacgatgaaaccctgtctctattaaaaatacaaaaatcagccgggcgtggcggtgcatgcactccagcctgggtgacaaagcaaaactccatctcaaaaaaaaaaaaaacagattgtaggggtagatagatagtggggctatgggtagaaatagttttaaggctattcaggtaattatgtgagagatgatagtgattgcagcagagtgacagagttaaagatgaagagtagtggttcaattttggatatcttttgaaattacagccaaaaaagtttgctaatacatttgttatagggtgtgaggggggaatgtctccaaggttttgggcctaattaattggaatgaaagatttatgatttactgaggtgaagaagatagtgggaggaacaggttttagagtaggcgttggggaggaaggtcaggcagtcagttgcggacatgtaaaatttgaaatgcctttttgtctaattgacggtacagagtaagcagttataagcaacacgtggagttccatggagagtggtccaacctacatttcaaatttttgaagtctttatatagaaatggcatttagagtctggactggaagagattcctaaaggaattgaatagttagacaagcattgtgaggactggaccaagaacactaacctttagcaactgggagatgagtaggtgttggcaaaaaagactgagagaggtggtcaaagaagtaggaggaaaacttggaaaatgaggcatctttggaggcaaacgaataaactttcaaggaggaggggcaatgaagttgtcactgaggacctgacaaaacaggcttaatggaataataaggcaaaaacctgatagtggaatcaggagagaatgggagacgaggaattgcagatagctttttggaggatatttctgttgacggtcactctgtcactctgctccaatcgctatcatctctcacatgaattacctgaatagccttaaaactatttctacccatagccccactatctatttacccctacaatctgggtttttttttttttttttttttttttttgagatggagtggtgactggaagaggagagaaataaattgttttgttttttaagatggaagaaattacatcacatttgctgcatgattgtgagagtaatccaagtaaatttagggaagcatttatgaggaaaaataatgagaaaattgttagaacaatgtcctttaatagtacataggtggaagggttggccttaggaagttttaatgggaaaggagagaatctagggacataggtacaggaaagagtggatacagtgggaacttgtgaaagttctcttctaattgcttctgttttcgcagtaatataggaacaaggttttcagcttcaaagagcttggagaatgttagaagtgtctaaaagaaggggagcatgaatgatgtagaaatgggtatagtgggatccaggaaccactaaggcctacttgaagttaatgatcattaataaagtgagattagtcagttttataaagccattttgttatggtgattggataattattgtttaatatcaatgtgaagactttatagcctgcattatctttttaaaaaaatgtttctagataacatagatctttggagttactcatgataatcaaaagttagtattaatattaaatctgcaaatgacaagggtccactagtttccttcttttttctcctacacataagtggtttttaaggttttattcaaatgctatataaattcttattctgcttttttcacccaatattttatcgtatgtattttttcatccaaattctcttattttacttttaccatattttacccttcagaatgtttccattggaattgttggtaaagacttggagtttacaatctatgatgatgatgatgtgtctccattcctggaaggtcttgaagaaagaccacagagaaaggcacaggtatataatcataacacaagaggctttagttctattgtaagctgctgttcttaccacaactgtgtctgtaaattttccattttgtcttaaatattgaaatgggcccataattcaaatggcaacaggaaaattaagaactgagtaaagttaaatattgaaagggcagtgatctccataaacacaaaaagggggccgggtgcggtggctcatgcctgtaatcccagcactttgggaggccgaggcgggtgaatcacgaggtcaacagatggagaccatcctggccaacatggtgaaaccccgtctctactaaaaatacaaaaattagctgggcgtcatggcatgcacctgtagtcccagctactcaggaggtgaggcaggagaatcgcttgaacccgggaggcggaggttgcagtgagctgagatcctaccactgccctccagcctgggcgacagagagagactctgtctcaaaaaaaaaaaacaaacacaaaaagggagaagtgttgattatttggttatctattgctaggtaataagctaccccaaaacttaggggctagaacaacaaacactacttctcacaattttgcggctgactggggctcacctacatggttctttgctggtctcacctgggatctctcaaacattgcagtcatttgtggggtgcaactggaacacccaagataacttcagtcacatgtcttctttactcacaccttttaggtgtcttagaggagcatctagaaggcagagacctctgctaggatgactgagcctctgtccacgtagtttcagggccgcttcttcagcagggtctctctagcatattggcaactcagggcttgcaaaagtcagaagtgaaagccgccaggcattcttaaggctgagatgcaggactggcacaacatcacttgtacacattctgttggttaaagtgagtcactggcctggcccagattctgtttgagcagagactgggagaaatgctcattgggggccagctttggacactaagatggctcttcataaagagaaaagcatcaagaagtgaatctcaggtgaaatatgggtctttttgctagatgtttagaatatacatttgctatttatagatgcttatttgatagcagtgtaattgaaagtaaaaaagaatctagtatggaaatttctacagcatgagtttttttaacttggaaaggatattgttggtactatttgggggatcaagatttgcaatatttaaactgtttttggtaaaaactagcactgttgggaagaatgctgtggaataccacaaactagtttggcaaaggggaaaagaatgtctaaaaagtgctgattgtattttaaacatagtagtgataatacaaggaaagcttttattcctgagcaatgcaaagtacgataaaatggtggaattgttcaatgatatttaggttttcagaaatgtgaaattatatatacagttatcctcgaacagtgtggggtttagtggtgccaaaccccagcatggttgaaaatccacatataacttttgactcctaaaaatcttctgatagcctgctgttgactggaagccttactgataacataaactgacaattaacacataaatagactagtttcttttttgttgttttttgagacaaggtcttgccctcttgtccaggctggcgtgcagtggtgccatcatagctcactgcaaggttgaactcctgggctcaagcgattctcctaccttcccccgcgccaccaagtagctgaaactacaggtgtgtgccaccatgcccagcacattttttttctttttagtagagatgggatctcactgtgttgcccaggccagtttcaaactcctgggcttaagcaatcctcatgcctcagcctcccagagtgttgggattacaggtgtgaactgctgcacccgaccaaatagactattttctacatatattttatgcattcggcatacctaactttttcttactctttttttttatatttctaggctacacagttggtctgctagtttatatttattggaaaacaaacaaacaaaaaaaaagcttcaccctaaacaatgttagagtaaaagcaaacaaaaaagaaaaagaaaaagaaaaaaaaatctgcatataagtggaccctcactgtttaaacctttgttgttcgagccaactgtattttttttaaataaaaaatctttattccctcaaatcatgagcactcaaggagaaaaaaaatactgctcagaaatgttaacaggacagtgaactaaaactgagtattcagaatatctctttacccctttttctcaatttttaataacgtaatatttgtgattagatgtgtatattgatcaagtgttcattttacatattttctttttttctttccctgttaagcctgctcaacctgctgatgaacctgcagaaaaggctgatgaaccaatggaacattaagtgataagccagtctatatatgtattatcaaatatgtaagaatacaggcaccacatactgatgacaataatctatactttgaaccaaaagttgcagagtggtggaatgctatgttttaggaatcagtccagatgtgagttttttccaagcaacctcactgaaacctatataatggaatacatttttctttgaaagggtctgtataatcattttctagaaagtatgggtatctatactaatgtttttatatgaagaacataggtgtctttgtggttttaaagacaactgtgaaataaaattgtttcaccgcctggtatattgggtttttgtttttttaagtagcttcaactctatatagtagtctgggattacaactggtcatttgcctaattaaattgccttatttttagtgatggagaaaaataatacctcttatctgtcatagccttataacagttctccagtgtatgaactggctgcatgagaatccatggagatttggtttagaatacaaatttcagggttcaactgtggtgattttaattaaaacttaagaaaccaccacttcctgatataagcatcagttatcatatgaatggttttctttccaaccagcaaatggcagtagttgtagctctggtctttgaagggaacttctgtaaaaacaacacatgggaaattgtaatcccaaaccttttatcctctccagccccactccagcatgatctttaggctgccttctgttattcccatgagtggcatactcaggtattgcagaaccatttttatcttagaccatgtaaactgaaattagaggaaatctgatttaaaaaaaaaaaccataatcctggctgggcgtggtggctcatgcctgtaatcccagcactttgggaggctgaggtgggcggatcacttgaggtcgggagttccagaccagcctgaccaacatggagaaacctcatctctactaaaaatacaaaacaattagctgggtgtggtggcacatgcatgtaatcctagctactcaggaggctggggcaggagaatcgcttgaacccaggaggcagaggttgcagtgagccaagatcgtgccattgcactctagcctgggcaacaagagtgaaactccatctcaaaaaaaattttaatttaatttaatttttaaaaacccataatccggccaggcgcggtggctcacgcttgtaatcccagcactttgggaggccgaggcaggcggatcacgagatcgggagatcgagaccacggtgaaaccccgtctctactgaaaatacaaaaaattagccgggcatggtggagggtgcctgtagtcccagctactcggagaggctgaggcaggagaatggcgtgaacgcgggaggcggagcttgcagtgagccaagatcgcgccactgcactccagcctggagcgagactctgtctcaaaaaaaaaaaaaaaaaaaaaaagacaaaaaccataatccaaaatttggctgctgacatctagaggagttattttattttctgagataatacatctttctgaagaaaaattcatttatagatagtaacccattttagacctaattctaattagctgctattggctttgggcaagttacttagctcttttttaaggaaaccctttggagaattatagtgagggttaaaagggagaatttatgtgataacaccttttaaactctaaaattcatagtttattttttccccccaactttcccaaatcttcaaaagccttagtaggtttaaatccccctgatttcttagagaatggtaaaagtagctctgggagccttattaagggaaagatgtctaagtactggaatgtgagagatgtcagtttctccagcagtagcctcaggaatctaccatgcaagcttgggagttagacgcaagtaccatgtggctatttgacctacagtggagttgcatcaagcacatgtaactttccacacacatacacacacacacacacacacacacacacacaaaatagtgaactcaggaactcccacctgcctctacactcaatgggtatttagtctggggagggagcataagtgggaaatataataatctgccctttgcttaggcagatctctcttccacatgcattccattgggtgagcctctgtctttgctgaatgattctgctgtttaaagatattgtggctcatacctgtaatcccagcactttgggaggccgaggcgggtggatcacctgaggtcaagagttcgagaccagcctgggcaacatggcaaaatcccgtctctactaaaaatacaaaaattaaatgggc

SEQ ID NO: 13696 - DNA, 6002 bp, Human
tcctacaacccaacaatgaaaaaaaccaaataccttgatttaaaaataggcaaaggacttcaacagacacttctccaaaaaagatacacaaatagccaacaagtatataaaaacatgttcaatatcactaattattagggaaacataaattgaaaccaccatgagatatcaccacaaagccattagaatggctaccgtcaacaaagaaaaaaaaaacagaaaataacaagtgttggtgaggatgtggagaaattggaacctttgtgctttattgctaggaatgtaaaatggtgcagcccatcaaaaagctaatccaccacaatcaccaaataggcttcatccctgggatgcaagtttggctcaacatatgcaaatcaataaatgcaattcatcacgtaaacagaactaaagacaaaaaaaaccacatgattatctcaatagatgcagagaaggctttcaataaaattcaccaccacttcattaaaaactctcaataaagtaggtattgaaggaacatacctcaaaataataaaagccatctatgacaagcccacagccagcatcatacagaatgggcaaaagctagaagcacttcctttgaaaacagacacaaaacaaggataccttctcttaccatgcctattcaacatagtattggaagtcctggccaaggtaatcaggcaagagaaagaaataaaggcatccaaaaaggaagagaggaagtcaaactagctctgtttgcagatgacatgatcctatatctagaaaaccccatagtctcaaaagctccttcagctgataaataacttcggcaaagtttcaggatataagatccacatacagaaatcaccagcactcctatacaccaacaacagccaagccaagagccaaatcaagaacacaatctcattcacaaccgccacaaaaataataaaatacctaggaatacagctaaccagggaggtgacagatctctacaatgagaattacaaaacactgctcaaagaaatcagaggtgacaaacaaatagaaaaacattccatgctcacagataggaagaatcaatatcattaaaatggccagactgcccaaagcaatttaaagattcaatgctattcctatcaaaccaccagtgtcattcttcacagagctagaaataacttttaaaattcacatagaacaaaaaaaggagctcaaatagccaaggcaatcctaagcaaaaagaacaaagctggaggcatcatactacctgacttcaaactatactacaggtctacagtaaccaaaacagaatggtactggtacaaaaacagacatatagaccaatggaacagaatagagggcccagaaataaggctgcacacctacaaccactgacctttgacaaagctgacaaaaacaagcaatggggaaaggactccctgctcaataaatggtgctgggatctggctagccatatgcagaagattgaaactgaaccccttcgttacatcatgtacaaaaatcaactcaagatggattaaaaaacttaaatgtagaactcaaaactataaaaaccctagaagaaaacctgggcaataccatcctagatataggaatgagcaaagatttcatgacaaagacaccaaaagcaattgcaacaaaagcaaaaattgacaagtgggatctaattaaacttaagagcttctgcacagcaaaagaaactatcaacaaagcaaatcgtcaacctacagaatgggagaaaacttttgcaacctatgcatttaacaaaggtctaacatccagcaactataaggaacttaaagaaatttacaagaaaaaaaacaaacacccctattaaaaagtgggaaaggacatgaacaggcactacaaaagaagacatacatgtggccaagaaacatatgaaaaaaagttgaatatcactgatcattagagaaatgcaaatcaaaaccacaccagtcagaatgactattattaaaaagtcaataaacaacagatggggacgttgagagaacgaggaggaaggagagaaaatggcatccatggattacagtacctatagccaagctgcagcgcagcagggctacagtgcttacaacacccagcccactcaaggatatgcacagaccacccaggcatatgggcaacaaagctatggaacctatggacagcccattgatgtcagctatacccaggctcagaccactgcaatctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcaatctgcatatggcactcagcctgcttatccagcttatgggcagcagccagtagccactgcacctacaagaccgcagaatggaaacaagcccactgagactagtcaacctcaatctagcacagggggttacaaccagcccagcctaggatatggacagagtaactgcagttatccccaggtacctgggagctactccatgcagccagtcaccgcacctccatcctaccctcctaccagctattcctctacacagccaactagttatgatcagagcagttactctcagcagaacacctatgggaaaccgagcagctatggacagcagagtagctatggtcaacaaagcagctatgggcagctgcctcccactagttacccaccccaaacttgatcctacagccaagctccaagtcagtatagctaacagagcagcagctacgggcagcagagttcattctgacaggaccaccccagtagcatgggtgtttatgggcaggagtctggaggattttccggactaggagagaaccggagcatgagtggccctgataactggggcaggggaagagggggatttgatcgtggaggcatgagcagaggtgggcggggaggaggatgcggtggaatgggcagcgctggagagcaagttggcttcaataagcctggtggacccatggatgaaggaccagatcttgatctaggcccacctgtagatccagatgaagactctgacaacagtgcaatttatgtacaaggattaaatgacaatgtgactctagatgatctggtagacttctttaagcagtgtggggttgttaagatgaacaagagaactgagcaacccatgatccacacctacctggacaaggaaacaagaaagcccaaaggtgatgccacagtgtcctgtgaagactcacctactgccaaagctgccgtggaatggtttgatgggaaagattttcaagggagcaaacttaaagtctctcttgctcggaagaggcctccagtgaacagtatgcagggtggtatgccaccccgtgagggcagagggatgccaccaccactctgcggaggtccaggaggcccaggaagtcctgggggacccatgggtcacatgggaggccgtggaggagatagaggaggcctccctccaagaggaccccagggttcccgagggaacacctctggaggaggaaacgtccagcaccaagctggagacaggcagtgtcccaatccgggttgtggaaaccagaacttcgcctggagaacagagagcaacaagtgtaaggctccaaagcctgaaggcttcctcccgccacccttcccacccccgggtggtgatcatggcagaggtggccctggtggcatgtggggaggaagaggtggcctcatggatcatggtggtcccggtggaatgttcagaggtggctgtggtagagacagaagtggcttccgtggtggctgggcatggaccgaggtggctttggtggaggaagacaaggtggccctggggggcccccggacctttgatgtaaccaatgggaggaagaagaggaggacgtgaaggacctggaaaaacggataaaggcgagcactgtcaggagcgcagagatcagccctactagatgcagagaacccgcagagctgcattgactaccagatttattttttaaaccagaaaatgttttaaatttataattccatatttataatgttggccacaacattatgattattctttctctgtactttagtatttttcaccatttgtgaagaaacattaaaacaagttaaatggtaaaaaacaaacaaacaaaaaaaaacagatgctggtgaggttgtggagaaatgggaatgctttcacactgttggtgggagtgtaaattacttcagccattctggaagacaatgtggtgattcctcaaaaacctaggagcagaaatatcatttgacccagcaatcccattactgggtatatacccataggaatataaatcattctattataaagacacatgcacatgtatgttcactgcagcattattcacaatagcaaagacatggaatcaacctaaatgcccatcaatgacagattaaataaagaaaatgtggtacatatacaccatggaatactatgcagccataaaaaagaactagatcatgtcctttgtgggaacatagatagagctggaggtcattattcttagcaaactaatgcagaaacagaaaaccaaataccacatgttctcatttataagtgggagctaaatgatgagaacacgtggacacaaagagggaacaatagacactggggcctacttgagggtcaagggtgggaggagggagaggatcagaaaaaataactgttgggtactaggcttaatacgttggtgatggaataattggtataaaaaacccctgtaacacaagtttgcctataaaacaaacctacacatgtaccccctgaacctaaaagttttttttttaataaaatggtgcagccactatggaaaacagtatgataattcctcaaataaataaaaaatgtaatagtctttcaaaaatattaaaaatacaattactctatgatcagcaatgtcaattctgtgtaaatactccaaagagttgaaagcagggactcaaacagttgtgcacccatgttcatagcagcactattcacaaaaagccaagaggtggaagcaacccaaacactcattgacagatgatgggataaacaaaatgtggtatttacatacgttggaatacgatctacccttagaaaggaaattctgacacatgctacgacatagatgaaccttgagcacattacgctaagtgaaataaaaacaaacattgtcgcaaaaaaacaaacattgtaggattctgcttatatgaggacatactgtagtcaaatccagagatagaaagcagaatggtgactgccaggggccggaggaaggaaagaatgaagaattgttcagtgtacgtagagtttcagtttcacaagatggaaaggttcaggaggttggttgcataaggaatatatttaacactactgaactgtacacttaaaaatggttaaaatagtacttttatgttagtgtatttcattgcaataatttgttttagaaactgctgttagaagtacagcaataggaggagagtgaaaaggacaccctggaagaaagcaggtgacaggagtgcagcagcattatgtaggtgtcagtgatgcatttgacaacgacctccataaaagttgtgctccaaattaaattggcctgtttttgaatgctctcgtctaagtggaatgctggcagggtgaaaacactgcataatcaggagtaaataggaactacatctggttgggaagcaaaaggtccactggggcatgtcggaggctgatgtcagaactggccttgtttaacaaactcactaatgacctagaagaaggcggaaacagccactgctaatgaaatttgcaaagatatgttggcaatgccctggacttggccataatggcataagcactgctgggatgcagagcgattttccactaggtagttaattggattaaaacaacgacttcctgggatatacataaacacttgctcaattctaactctta

SEQ ID NO: 13697 - DNA, 13519 bp, Human
gacagaacttgctcttccacctgcttgggccttacccacaggagaagcactgcttctctacccatgccccatccaactcaggcaccccagggacttgcaacagtctgattttttctcacgtccttcttaaggctctgggctagccacacaaatcaaatcccagtgataggtccagacaatcctatcctgaaactacatcttagtaagactccagggaatcctttccccaaagacagtcttactcctgttctcccccaagccctttctgggccagaagctttgcctggactcaagcaatggcagacaagtgccctctgaggacacggaagtgcatgctcagaactgtgattctccaagtggaggcagaggagaaggcccaggcttcccagcagggctaaggatatgcaaggagtgcattcatccggaggtgttggcagcatcccagccccaccccattctcatcgtaaatcaggctcacttccattggctgcatacggtggagtgatgtgaccatatgtcacttgagcattacacaaatcctaatgagctaaaaatatgtttgttttagctaattgacctctttggccttcataaagcagttggtaaacatcctcagataatgatttccaaagagcagattgtgggtctcagctgtgcagagaaagcccacgtccctgagaccaccttctccagctgcctactgaggcacacaggggcgcctgcctgctgcccgctcagccaaggcggtgttgctggagccagcttgggacagctctcccaacgctctgccctggccttgcgaccactctctgggccgtagttgtctgtctgttaagtgaggaaagtgcccatctccagaggcattcagcggcaaagcagggcttccaggttccgaccccatagcaggacttcttggatttctacagccagtcagttgcaagcagcacccatattatttctataagaagtggcaggagctgggatctgaagagttcagcagtctacctttccctgtttcttgtgctttatgcagtcaggaggaatgatctggattccatgtgaagcctgggaccacggagacccaagacttcctgcttgattctccctgcgaactgcaggctgtgggctgagccttcaagaagcaggagtcccctctagccattaactctcagagctaacctcatttgaatgggaacactagtcctgtgatgtctggaaggtgggcgcctctacactccacaccctacatggtggtccagacacatcattcccagcattagaaagctgtagggggacccgttctgttccctggaggcattaaagggacatagaaataaatctcaagctctgaggctgatgccagcctcagactcagcctctgcactgtatgggccaattgtagccccaaggacttcttcttgctgcaccccctatctgtccacacctaaaacgatgggcttctattagttacagaactctctggcctgttttgttttgctttgctttgttttgttttgtttttttgtttttttgttttttagctatgaaacagaggtaatatctaatacagataacttaccagtaatgagtgcttcctacttactgggtactgggaagaagtgctttacacatattttctcatttaatctacacaataagtaattaagacatttccctgaggccacgggagagacagtggcagaacagttctccaaggaggacttgcaagttaataactggactttgcaaggctctggtggaaactgtcagcttgtaaaggatggagcacagtgtctggcatgtagcaggaactaaaataatggcagtgattaatgttatgatatgcagacacaacacagcaagataagatgcaatgtaccttctgggtcaaaccaccctggccactcctccccgatacccagggttgatgtgcttgaattagacaggattaaaggcttactggagctggaagccttgccccaactcaggagtttagccccagaccttctgtccaccagctgagaaggacaagggcggaaggcagctgcacagagcagggccacggccttgcacacagtccagggagcttttgtgcaggagccaggcctccccctgggtccccatgatgagagaatgggttctgctcatgtccgtgctgctctgtggcctggctggccccacacacctgttccagccaagcctggtgctggacatggccaaggtcctcttggataactactgcttcccggagaacctgctgggcatgcaggaagccatccagcaggccatcaagagccatgagattctgagcatctcagacccgcagacgctggccagtgtgctgacagccggggtgcagagctccctgaacgatcctcgcctggtcatctcctatgagcccagcacccccgagcctcccccacaagtcccagcactcaccagcctctcagaagaggaactgcttgcctggctgcaaaggggcctccgccatgaggttctggagggtaatgtgggctacctgcgggtggacagcgtcccgggccaggaggtgctgagcatgatgggggagttcctggtggcccacgtgtgggggaatctcatgggcacctccgccttagtgctggatctccggcactgcacaggaggccaggtctctggcattccctacatcatctcctacctgcacccagggaacaccatcctgcacgtggacactatctacaaccgcccctccaacaccaccacggagatctggaccttgccccaggtcctgggagaaaggtacggtgccgacaaggatgtggtggtcctcaccagcagccagaccaggggcgtggccgaggacatcgcgcacatccttaagcagatgcgcagggccatcgtggtgggcgagcggactgggggaggggccctggacctccggaagctgaggataggcgagtctgacttcttcttcacggtgcccgtgtccaggtccctggggccccttggtggaggcagccagacgtgggagggcagcggggtgctgccctgtgtggggactccggccgagcaggccctggagaaagccctggccatcctcactctgcgcagcgcccttccaggggtagtccactgcctccaggaggtcctgaaggactactacacgctggtggaccgtgtgcccaccctgctgcagcacttggccagcatggacttctccacggtggtctccgaggaagatctggtcaccaagctcaatgccggcctgcaggctgcgtctgaggatcccaggctcctggtgcgagccatcgggcccacagaaactccttcttggcccgcgcccgacgctgcagccgaagactcaccaggggtggccccagagttgcctgaggacgaggctatccggcaagcactggtggactctgtgttccaggtgtcggtgctgccaggcaatgtgggctacctgcgcttcgatagttttgctgacgcctccgtcctgggtgtgttggccccatatgtcctgcgccaggtgtgggagccgctacaggacacggagcacctcatcatggacctgcgccacaaccctggagggccatcctctgctgtgcccctgctcctgtcctacttccagggccctgaggccggccccgtgcacctcttcaccacctatgatcgccgcaccaacatcacgcaggagcacttcagccacatggagctcccgggcccacgctacagcacccaacgtggggtgtatctgctcaccagccaccgcaccgccacggccgcggaggagttcgccttccttatgcagtcgctgggctgggccacactggtaggtgagatcaccgcgggcaacctgctgcacacccgcacggtgccgctgctggacacacccgaaggcagcctcgcgctcaccgtgccggtcctcaccttcatcgacaatcacggcgaggcctggctgggtggtggagtggtgcccgatgccatcgtgctggccgaggaggccctggacaaagcccaggaagtgctggagttccaccaaagcctgggggccttggtggagggcacagggcacctgctggaggcccactatgctcggccagaggtcgtggggcagaccagtgccctcctgcgggccaagctggcccagggcgcctaccgcacagctgtggacttggagtctctggcctctcagctcacagcagacctccaggaggtgtctggggaccaccgcttgctagtgttccacagccctggcgagctggtggtagaggaagcacccccaccaccccctgctgtcccctctccagaggagctcacctaccttattgaggccctgttcaagacagaggtgctgcccggccagctgggctacctgcgttttgacgccatggctgaactggagacagtgaaggccgtggggccacagctggtgcggctggtatggcaacagctggtggacacggctgcgctggtgatcgacctgcgctacaaccctggcagctactccacggccatcccgctgctctgctcctacttctttgaggcagagccccgccagcacctgtattctgtctttgacagggccacctcaaaagtcacggaggtgtggaccttgccccaggtcgccggccagcgctacggctcacacaaggacctctacatcctgatgagccacaccagtggctctgcggccgaggcctttgcacacaccatgcaggacctgcagcgggccacggtcattggggagcccacggccggaggcgcactctctgtgggcatctaccaggtgggcagcagccccttatatgcatccatgcccacccagatggccatgagtgccaccacaggcaaggcctgggacctggctggtgtggagcccgacatcactgtgcccatgagcgaagccctttccatagcccaggacatagtggctctgcgtgccaaggtgcccacggtgctgcagacggccgggaagctggtggctgataactatgcctctgccgagctgggggccaagatggccaccaaactgagcggtctgcagagccgctactccagggtgacctcagaagtggccctagccgagatcctgggggctgacctgcagatgctctccggagacccacacctgaaggcagcccatatccctgagaatgccaaggaccgcattcctggaattgtgcccatgcaggtgagacccaagagagacctggctgaacccagtcccgggagtgagttgacccattgtccgcacatgcagggctctgtgcacagtgcgtgacaatggcttttagatttgttctcacgtttaagttttgaccggtcaagtcctttcctctttctcaacctgttccatccactctctgtgaccctggggttgctgaacacctctgtagaacattcatattaggttggtgcaaaagtactttcaatggcaaaacccgcaattacttttgcacccacctcacaggaagccagtttgaaagccaaccaatactcacaggaagccagttcggaagctcctgggatagaaggcatttcagccttggctgggtggaaggtgagtgttggcagggcttctcattgtcagtgctagggaagaggccaacacctgtcagaggtggccaatggacttcaccaagtgccccacgctggccgagagctccacctaggcagcactcacacctccacactgttctacctgtggtctgctgcatcgtcacaattgggcagggcagcatttgccatgggatcccttgcaaggagggtctgagaccagggcttgggtgcaggcgctttgtctgggaggcggttactgaagcaggcatgaaggagggagcagggagagtgggttgggaagctgacaggcaggtgcctcaaagctgttctgctgaagccaggaccctgacgagtgcagggatgctcccaggcatagccctctgcaggcagggcccagtggttcctgtcccgcattggccaagagttgccctgagacatgcctcagggtggggcaggctccctcttcttggagaaggcctgagctacgggtggaaaggcagggctgtgctataggagagcctgtcagtggggtcgggtgcagctgaaagcagagggggctgagagtgccaaaagcatctactacagaattgttatccccattttccgcaactgaggcccggagaggagcagaggggagtggcctgaggccagagagctgtgactgagggcagggcagggcctggagggcagtgtctctgtcaatgaagtctccttgcctgtcaatctcaccaagacctgcctccctccagcagccttagagagggaggaggaggtgcatccacgtgcgagtagcctgtgctaggcttgcagaatccccagtttccaaatcaacatctccttcctttccagtatagccaaggttcacgatttggagtcagatgtggattcagattctggctccaccacttactgactgtgtgacctgagactagttacttaatctctctgtgcttcagtttttccatggaaaagatggggatcgtgttatctcctgtacaggtggctgtgaggatgatgataagctctacaaagtgcttagtacagggccaggtgcctggtaaaggtaactaacatcttccaatcctgccccagtggagcagcttagagacataggaagtatctggtaaggttggagaggtcagaggggagaccattcctgggccttctagctcaggacaccagggcatgtgggtggcagacaggagcatcctctgcaaggaggctgcccatagatcacacatgtcccagtggcatgtcacatccagacatgccactgggaaagtccctggtgtctactaattccttcagaaatgttagttcctgtcccatgcccttaatatttcccatggcgcctgctttcctgggctctaaaactggctgctcctcctgacactgagtaggacctccaactcttacagatcccttcccctgaagtatttgaagagctgatcaagttttccttccacactaacgtgcttgaggacaacattggctacttgaggtttgacatgtttggggacggtgagctgctcacccaggtctccaggctgctggtggagcacatctggaagaagatcatgcacacggatgccatgatcatcgacatgaggtcagtggccaggggtcagtgcttcctagccaggacgcagggctgccaggggacagtcaaagctatgggccacagcagggaagaaaaggaaccctgtgacacagcagaggacctgaggggggccaggcctcctgcctatcagggcttcggccagctagcccagcggatctgctgtcattgcaggtggggcccagcactggtagtttttgcaagcttctccagtgattccaatgtgcattccagattgagaattaccccagatttgcctggtcataggattcagtggggaggagaggaaggagatgttaaaaacactgattcctgggccccactcccctcttactgactcagaagctccaggggacaggcccgataatctctatttgacaggcatcccaggtgattctgatggtcagtggtgtgtgagacagccaggccccccacctgggagtgtgcctcacatcatacaaaatcaacacatgacaaccctggtcatatgaatcgtacaggcagaatttggaaatcacacagggaaaatttagaagttaatcactattgttaacaaaagaattctttgcatcaccaaatgattgtcagaaggatgtcttcagctagccacctcccctctgtttctgtaaaaatgtgcctcatatgtcatgagtttacctcatggaccaggggtaggaggtggatgagtaccctcaggcagtggccagacctggcatcccatgactctggggtccattggtggacatgccccagcaccctccctgggcaggttgccttcctcagacgggacccttccatgctcccgtgttgtctgaaagaagtggcagggggtggcagaccagaagcattcacccagctccagttctctagccctcagcgctcactcacatggttcttagtggtcactaggtggctctcggtcctgcacccactgcttctcctccctgggagataaaacattagccctggctccagttctgtgtgtgttcacagcctgagcttgaggctcctggggtctctctgatcattttattctttagaagttctgttgagcacccaaatgacactcatgctaagtctctttcttctgaatatgccatttacactttttaaagaggagatggccccagcctgcaagtgcactttgcttaaagaccctcccacccctgaggtttgtttggaggttcagacactgacatcacaggccccgaacccagccaggccatcccaggccatcagttggacgaggctccttaacacatcactagccccagtggggagacaggggcccaacgaggtcacacagtgggacaaatctaaatggcctgggagaaatacaggctcccctgctcccaatgcagctccacaagcctgaatatttcaatacactaagtgccctgttaagacacctgaactaagacagctggtaggtgtcataagattgtcacagaatgcaacgggaaaaacaatgtttcccaaaatgtgttccactcataggaagatatgggtgcaggggagcagtccatggtcaataaatgggggaaatttatcaacaagtttctgactgcaggacttgtcagggcctttaatatattaacatgtattaattacatagcagaaggaaaggataacatatttgatcactaagtttcttgttctaaagagactagtactcttggaaatactctggaaaatgccaacccatggaattctaaaggaggaagaggcactagactgaggctgccaagaattagaaccctccatgggacaaagatcctggcctccccgaggggcacacagggcctcactgtgagctcagcccctgaacaggctctgcttcccatccttcaggttcaacatcggtggccccacatcctccattcccatcttgtgctcctacttctttgatgaaggccctccagttctgctggacaagatctacagccggcctgatgactctgtcagtgaactctggacacacgcccaggttgtaggtacgtggagaagctttctcctttctgctgtcattctagaagcttctgggaaaccagggaaagacagcttgggtgtaggtaaaagtcatagtaaccagaatgtaaggccctgtcctagtccaggcactagatgtgcatgatctcgaatccctgaaaagcatgtatcactatgcccgttttctagaggaaaaaaaagggggtgttgactaggtcaaatatcttttctagggtcatgcagctaataagtgaaacccaaaatgtgaatattagtttgtctaataccaaaatttcccccaggcttagcaccataatcaccagcctgcaggacaaatgcagaatttgaaggattctccccgcccctcaccaaccccagtgggcattgccagtgctcacagtacttgagctctcaagccacagtgccacaaacttgcctggaaaggtcatgatgctgatcgggcttctgttccccgccctgggcccagagcagtggctataggagcaaaggcaggccctgagctttacagaaccataactctcaaagccccattccagggtggatggcctccatctatcttccctgcccagtgtgtaagaccaaggaacttgtgctcctacccaacaagaaaggactggagagaccgatgggggtgtgcctgtgaccagagaaacaccccaccattttcatgtccatgcttctgtaatacacaggcattttgctgtagctcctaggacatacgttcaataatattacaagtgtaaatgcaaatcagaaccaggtgaattctaaattcaaatagatgttcaagactggaagttaaagatagactcaattctgcagataatgaggccccaaaaccgcaaggtccaatatgggagccacaagccacctgcggccaccaagcatttgaaatgtggctctcccaagttgagatgtgctggaagtgtgatgtgctggaagtgtaatgtgcataccagattttgaagacattatgaaaagaaaacctcattaataattttatttgattacattttgaaaagaatgtattttggatacattggcttaaacaaaacatgattaaaattaacaccatgggtttctttttgcttgcttaacatggctactagggaacctaaaatgacatctatggccagcattctggctcacgttgcattcctgttggacagtgctgtcctggagagttgttcttatacatcacaaattgggcttttctgagtccaaagtgaaaaggaagtcaggtcggtttaggtgttctcattattcatgaagagagaggatgctcctttctcaggagagtcaagcctttcctatcacttggcataaaaaggcctcgttgggagttgtcaagcactgaaatcctcgtgattgggcatgcattcttgtccccattttacggatgcagaaatcaaggctcagagaagtcaagtggctcacaagtggacacaaggacacagacctaaacccccgggcctcctccatcactgcaggcccaggcaggatagagaagacaggtgctccagggtcctgacatgacccccatcctgaagggccttatgtcttccaggtgaacgctatggctccaagaagagcatggtcattctgaccagcagtgtgacggccggcaccgcggaggagttcacctatatcatgaagaggctgggccgggccctggtcattggggaggtgaccagtgggggctgccagccaccacagacctaccacgtggatgacaccaacctctacctcactatccccacggcccgttctgtgggggcctcggatggcagctcctgggaaggggtgggggtgacaccccatgtggttgtccctgcagaagaggctctcgccagggccaaggagatgctccagcacaaccagctgagggtgaagcggagcccaggcctgcaggaccacctgtagggaagggccccataggcagagccccagggcagacagaacctctgggacacacaccaagggcactcctgcaggtggcccggcctgaggttcccaggagcagcaaaggggcctgctgagctctggttaggttacagctggaggtgtgtatatatacacacacacacatgtatatacacatatatatgtgtatgtatatatatgtatatatatatggctttccaataaccacctaaattttaacaaaggttccttctaagtggtagaacttggggtggtatttttaccttccttcttcatactttgctctttttcttaaatactcattaatgtgcatatatcattattttcagatgcagctatcattattccaaaatacaaaataaagaagataaaataaattatatacccgagccattaaccacaatttagtgatcactagtggttgttaaatctcttcttttcatgagttctccattcacattatttagatcttctggatctgccctgctgacctctatggacagctgattttatttaagatgtggtgcaagatgctgtggggtcagcaggtggcaaagatcttgtggatcttaaatagggaaagggctggtgcggcccttctgctggtgatgtacatacactggctgtgtctcttctgagcctcatgccggctgcatagctggccactctcatcttctacccaggagccagctgagacacagacaaactccgcagctcacccaaggtcacacatccagcatggtggacctgtgtcctcctttgggccacccagcatttgcagcacctttggatgatcagagaatcactgcccataggaatcagtaggaaacagtgatgtcagccttgcctgggtgggaaaccagcccagccacttccccagctgagtggttctgggcaatttgtttcacttctttgggcctcagtttgttcacctgttcaatgggagaaataatactacacttggagttgtgagaatgaagtgagttaatctagtgtccagccaatgttagctgtcataatttctccaccacaaagctgaacactctggaagccccacttttccagcccttctggcagtagggcatgggcatgtgatcctgccttggtcaaccagaagctcctgtgcaagatgtttaatctggagcaagtggccagggagcctgggcagcggccatctgccagaagcctagtgtacagggacagcacagccatgccctgtgcttagcagggacagcagcagcaccctcaacaggtgcttcctcgacttcctggtgtgactttggctgtggtcctagtggagtgacccattgtcccaacccactgctcagccaggtcccccagcctgcccatctaggactgggcaccatccgggctccctcctgaaatccctgtctgcttccatccaccaaagacttcatttttctgtaatgaacagcacagtctggtgcagctggttaaagggtaggtgagatctgaacccatagctgtacagttccaaagatccttctgtttccaccacatcatgaagacaccctgggcctgatctggaaagggggtttgagatagagaggagcgagagtcctctgcgtagcaaagaacaggctcagccttcctaaatgcaagctttcttgcattgttacctgcttgcaggcacaagactggagaaaaaggaaaaggaaaacaaaatcccatcaggtctcttttctggtgggacagccagatggccgatagctgcctagaagttcagatgagccctgggccccttcaactctctatgccctggtctgagctcatggcctgcaccctgcccaaccctacttacctccaactcacatcttgcacacagccacacctccttccagacactcagactccctcaactctgtccccccactgctcacccagtgtccaccaatgatcaggacccaagataagttaatacctgagttaatgtcactctgctctgcacccagcctgccatcgtctttcccttccttgtcttggggtcccagctttgtgcttaaatccctgacacagcttcctgccccatctctgtggcctgacctgcagctaggggttcatcttcactggaagggcattgttaggtgatgcagacacttctggaaggtcatatttatctgtccctcttgcagatgtggtgaagaggtaagtcacccagtaccaagcaggggttcatttgactggcatccaggggtgctggagtgcccccaggagtcagctcagccctgttgtgacagcatgtataataaatggattataaaggccctggcagggactcaaagctggctctctggggcaagacaggcctagaagcttccctattgttcactatcaaagcccaggccacactctgggcagccaagccagagtcattgggtagag

SEQ ID NO: 13698 - DNA, 110243 bp, Human
  misc_feature (1)...(110243): n = A,T,C or G
tgggaattcactccttgctcaactgtgctaggcaggcaggcgcccctgtgggggcggggcctcggtggtccagcggaggtcagaggccacgcagggtgaggagcgggtagcatatggtggggtggaagcaaggatgagagactggttacacaggagataatcagagccaggttcctcactcccaaagcaggaggcccctcattccgaacaggttgagccctgtagtgttggcctggcatcagagtaaacacgtggtgcccaagaaaaacagacaaacacgcccatgaaactgtgtgtatacatatgcgtgtgggcatgtacatagatgtgttcccttgctccgccagctgcaatgacaccccagtagcaatgagcacatccggagccagatcccgggctctgcatgacattctcccacaatgaaccaggctgcagcagaaatagctgggttcaggctggggcagggagaatacaacagggccctggagcatctcgtgccagaaagaaagggctccagaaatgacgcggacaggtgaagtgggagggagagagaagggtggcaaggcgtgggttccctgtctggtggaggctcccctaggtagggggaagcgcgtggcacggagggcaggtggcggacgcatctggaagccgcacttactgtgtgtccactttctcacacaagcaccatgcacacaaaacaagaaggaaaacgtcagctgagagaggcgggtggtgtcccagggtgtggagagagtagaaggtgggaaataggtgttggaggtggcatggccccttgaggttgtggccctggttgaggggaggcccagtggatgaggttgggtctctctccccttcagctgtgctggtgcaggcctggaggaaaacggacgccaggtttggtgtggaaggggagctcggaggcgatgaaggcccaggcaggtggaaggtggtggttgaggaccggggagcagggcgctggctggggagaggcagagtgaagaagccgagggtgaggggcagccggaactcagctggaaagacagcaggaggcggtgggcgcaggggcgggttccatggacgttctggaggcttctgaggacaccaagcctggaagccaggacatgtggccttcttgacttcgttccccttcctcacctggaggtctccagtccccgctgtccactgctcagcggcatgggaggagtccgcggccttaccccgacactcccgcccaccggcccccgcccctgccaggcggccctgctcgcagcagcgcgaggagccacggggtgctgccctcctccgcagcccgaggcccacttcacacgcactgagcccaagcgcgagtctctgcccgtcagccgcgtctgagctcgccgcagtccctgcttgagaggccggggggcacctgcgcctgcccgggaccctgacctgctagcggggcctgttgcctcctctgcaggaagcgatctcgcccgcggtgcccccacccgccccgtccccggagggaccgcccccgcccgcggccttcccgcccctgccctgtcgcttgagtgccccccgcccgccgttaccccacccccgcccctggaggagcccccgcccacggttacccaaccttaccctgtccccggagggctccacgcccgcgttccccccgccccatcccaactccgagggtccactgccccggtccccatcccgcccggtccccgcagggccgggccgccgggggtctcccggggcagcggtacccgaaggcagcagcacggcccctttaagccgctcggacacgcgctcggggcccgatgcggtttggacgcgcacaggcgtgcgcgtgcccgtcgggcctggcgagcgcgcgcgacgcgcggcgtgcgtggtgacgcgagcgcgtggggttttccgaggctgcgggcaggggcccgccgcgcccatcccgatggctggaggcgtactgaggggcggacggaggcggcggcggcggcggcgggagcgggagcgggcggcgagtggggagcggggccgggagtggagcagccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggcccggtggccgcgccaagatggcgctcccaccgctgcctttgtggggcggccgccgccgcgccgagtttcggggcccggtttgcgatattccgaagcccgaagtgggggagaggacaggaaatagcacaaaggctgggtgtcttcctcttgcctggatcggcttttcggctggaagcggggtgggggtggggagtggggagatctgttgaaaattccacagggctgtcggctgaggcttttgacttttaagaacctgctatattttttcttgtgaatcgatagttgattcaaatgatattttaacatttcttgtgtccgttaaattacatggttagcatgcagaagcagtatcagcttttgtttgcttaattcatcttcatggaagccttttttttttttttttttaagagatgggatctctttgtaaaagagatcctgttaaccaggctggtctcgaactctggggctcaagcgatcctcccgcctcagcctcccaaagtgctgggattagcggccttagccaccgtgcccagcctgtcttcatggaagctttttcttaagattgtgaaatgggctcctgaaggaaaacgccgatgttaaaatttgtgttttgaaaagggagttggtgtacatttacagttagggtgtacagtactggacttatgggtaaatagtgtagaaatggtaacctatggttttcttttggggagcattggttcattgtattttcatgttgctatctatctgataacattagtctcaaatagtattaggtgattaagcagttgctggtgagattattaattaagaaaatatgaagattatttttcatgattagcaaatggacgtattagttttgtggaaagtttcagtgaactgcatactgaataaggtctttggagcaagcattgttattgataaggtttttgcataagttattttctaatctgaagtgatagtcttttgggagagggaggagctctttattgaaagtaaggttttaattttcatgctattgacatgcatagtctattctggattctttgggaaggtatgtatatcaagaaagtggataggcggttccttctttgctaacgctgggttcgaggctggggatggaggtggtgccactgacatggagacaggtctgagagcctccccagggtaggactgaatggtgggttttgtcttggtttatgctaaggcagaactttctttactttttgagatggagtttcgctcttgttgcccaggctggagtgcagtggcgcgatctcggctcattgcaacctccgcgcccccgggttcaagtgattctcttgcctcagcctcccgagtagctgggattacagctaccaccaccacacccggctaattttttgtatttttagtagagatagggtttcaccatgttggccaagctggtctccaactccagacctcaggtgattcacccgccttgatctgccaaagtgctgggattacgagcgtgagccaccgcgcccagccggtaaggcagaactttctaacgattagagctgcgcagaaatgaactgcaactgcagggtccagaggctgatgctgtcaaccctgggggaaggctggactgcaggtgttgggcggtggtcccaggttacgagcatttggtttcatcaacactgaaagtgctccccccgcccgcctttttttttttttttgagattgagagtttggaaaaccagttaagttctgaggtgcctgtgccccctcccagttaagtgcgcactgcccaggcccagtgtgaggatgacattttatcttctgcgggaacctttcaagatgagtcttatagaggaaactgttccaacatgaaatttcagctcagaattgactttctcaaaagagcacatccactggccaaaagctatttctctcgcgtaatctgaatttatgacagaaccatagttatctcatcagacaagtactgacagtgctcttcagtgatacctttaaaatattgttttttctttgatatcttcagttaattctgtttttttggtgggtgggaaagttgaagtaaattttctcagatttaattttaatcttagaagattcaagagactgcagaatagtgtgtggtttttttgttgtttgtttttaagagtaaaacccactgggtgtggtggctcacgcctgtaatcccagcactttgggaggtggaggcgggcggatcacatgaggctgggagtttgagaccagtctggccaacatagcgaaacctcgtatctactaaaaatattaaaattagccggcgtggtggtgggcgcctgtaatcccagctactcgggaggtttaggcacgggaatcgcttgaacccgggaggcaggggttgcggtgagccgagattgtgccactgggcgacagagtgagactgtgtctcaaaagagtaaaaacctctgtaaatccttttgatgcccaatgactttgatttcaaagctagtatcatctaggtagatttatgttgatcacttgagaaacagaatttgaaaagttaatttatttctcaaaggagatgttgtactatcctgcaaaagtaccagagctttgttctcttccctttgctttgctaaaaatttctgggtcttttggtttattttatgtgtgtgttggtccactggaaaagttgtagctttgtagctaaaaacagctttgataaaaggatgaaaaaggtcttcagggcatctctagacttcatctaccatcagttgactttttgtagctaatactttaatgaataacattggtattattttagaagtgcagtgttggcatttattatagttttgtcgttgtttttctctgcccgaaagatttggctcatgttggtctctaaattggattacattcttactgtctgtgactttggctttagcattagtggattggtaatagatattctcaatttttaaatctggcttgaccatatggcaggccatgttattttgaaacccctatttagtgtaagtctcacaagacatggaacaaaaatttttataaaattttaaactggtttgaccgggcgtggtggctcacacctgtaatcccagcactttgggaggccgagtcaggcggatcatgaggtcaggagatcgagaccaccctggctaacacggtgaaaccccttctctactaaaattacttctctacaaaaaattagctgggcgtggtgctgggcacctgtaatcccagctactcaggaggctgaggcaggagaatggcaggaacccgggagggggagcttgcagtgagccaagatcggccactgcactccagcctgggcgacacagcgagactccgtctcaaaaaataaaaataaaaaaaattttaaactggtttacattctgatttcaggtttgcatttgttaagagtggttggagagattatgaagtaggcaattcagttaagtgtttggtttaggaacacagaatgaggagataaaataaatttaaaatggaaactatcagaaatttatgaaactgcagtgttcaacattactgaaagaaaaagcagggccaacgtatatgggagtgagtgtgtatgaagagagagaaatgcaacatcacatcagctgctctgggagagggacagagcaccacctatttcaaagctatgcattttgttctagaactttgattgaagaaatagagacaatctatagacatttgagtttgctagtggattagtggaatgctgaaagctttttttgtgagacagagtcccactcagccacccagtctggagtgcagtggcgcaatctcggctcactgcaaccaccatctcacgggttcaagtgattctccagtctcagcctcccgagtagctgggattacaggcacccgccgtcatgcccggataattttttaaaattttattttagtagagatggggtttcaccatgttggccaggctggtcttgaactcctgacctccggtgatctgcctgtctgagcctcccaaagttctaggattacaggcgtgagccaccgtgccctgccggaatgctgaaagcttttttaaaccttttagcctcttgttcttgtgtcagtgcctaccattgggtgccatggtaatcagtggaaattactcctggctttcagtggtagaaaagctttctgttttatagagcaatgttgcttgcttgcttttttttttttttaagattaagtgggccgggcacggtggctcacgcctgtaatcccagcactttgggaggccgacgtgggcggatcacgaggtcaggagattgagaccatcctggctaacacggtgaaaccccattgctactaaaaataccaaaaaaattagctgggtgtggtggcgggcgcctgtagtcccagctacttgggaggctgaggcaggagaatggcgtgaacccgggaggcggagcttgcagtgagccgagatcgtgctactgcactccagcctgggtgactgagcgagactccgtttcacaaaaaaaaaaaaaaaaaaaaagattaagtggaagtatttccttatttatgtcttcttaaattagaattctgagaaagacccattttttaaaagcttactgatttaaaagaccagattaagattatctaaggtaattccttttttctttcttttttttttgagatggagtttccttcctgttgcccaggctggagtgcaatggcgctgtcctggctcactgcaacttctgcctcccgggttcaagtgattctcctgcctcagcctcccaagtagctgagattacaggtgcccgccaccatgcctggctaatttttgtagttttagtagagatggggtttcaccatgttggccaggctggtctcaaactgctgacctcaagtgatccgcccgcctccgcctcccaaagtgctgggattacaggtgtgagccaccgtgcccagcttaatttttaagtttattctgttgaacctattttgccatagataaaatatttttatgatttaataattcattgctccaaacttactaatgcattatatcaagagaggactttatgtattaattcattcacctgtagaaatgagaatactggcggggcacggtggctcatgcctgtaatcacagcactttgggaggcccaggcgggcagatcacgatgtcaggagatcgagaccaacctggctaacacagtgaaaccctgtctctgctaaaaatacaaaaaaattagccgggcgtggtggcaggcacctgtagtcccagctacttgggaggctgaggcaggagaatggtgtgaacccgggaggcagacctcgcagtgagtggagatcgcgccactgcactccagcctgggcgacagagcaagactccgtctctcaaaaaaaaaaaaagaatgggaatactaagggcatcagtggaatgtattcttgtttactggtgggtaatcatgtctccatgcatgtctgtgtgcagtcctgtagcacttagaaaatatattccctatgttgattacagacactcaacttctgccgagtgttgtagttaataaagcttaaaaaattctgggctgggtgtggtggctcatgcctgtaaacccaacactttgggaggccaaggtgagcggatcacctgaggttgggagttcaagaccagcctgaccaacatggagaaaccctgtctctactgaaaatacaaaattagcccagacgcggtggctcacgcctgtaattccagcactttgggaggccgaggagggtggatcagcctggccaacatggagaaaccccatctctactaaaaatacaaaaaattacccaggcatggtgatgcatgcctgtaattccagctactcgggaggctgaggttgcagtgagccgagatcgtgccattgcactccagcctgggcaacaagaaggaaactccatctcaaaaaaaaaaaaaaaattagtcgggcatggtggcacatgcctgtaatctcagctactcgggaggcagaggcaagagaatcgcttgaacctgggaggcggaggttgcggtgagccgagattgtgccattgtactgcagcctgggcaacaagagtgaaactcggtcaaaaaaaaaaaaaaaaagtccggacactttataattagatgagcatgtcaaaagagtctacaataggtttcagaaaatttctcataggaattttaaaataattcctaaaatctagggagtgagagaaattcagtagttttcaaaaggattggcactgtctgagttagagcccagctcagctctgttgcctcactggctgatttgcagtgttaggacttttattcgcactgaaaatcaagatcagttcaacttctacccttccactccacaggagctttctgtcctccctgagcctgccttaatttaggccacctgcagtgttaggacttctgtgtctgtccttatctgtgaaacaggctcctagagcctccttcatggggtcattgtgaggattaaatgagtcctgatgtgggcactgataacagagctcagtgcaaggattagctatttctgttgctgatggccttgctttgtaaaaatttcttttatggcaaggttaacaaatgttataagatgacagtttactgagatttttctttttttctccatggttccagaagaatattaattcagggtgtggaacatgcatattagctatctttgcaaatccctatcacttatttactgccttactttctactaaatctctcacatccttatcttttcttgaaaggtttttttttctttttcttttttttttttttttgggacagggttttgctgtgtcacccaggctggagtgtggaatgtgatggtatgatcatggttcactgcagcctggacctcctgggctcatacgatcttcttctctcagtctcacaagtagctaggaccacgggcacatgccaccgtgcccagctaattttttttattgtttgtagagacaggctggtctccaactcctgggttcaagtgatcctcctgccttagcctcccaaaatgttgggattatagatgtgagccacagtaacctgctcttaaaggctttcctttacctttgtagaataatcttgaactatgcctcattttgaaaactggtaagtttatgtcctttttttttttttgagacggagtcttgccctgtcacccaggctggagtgcagtgacatgatctcggctcactgcaacctccacctcctgggttcaaacaattctcctgcctcagcctccagagtagctggggttacaggcacctgccaccatgcccagctgatttttgtatttttagtagagacagggtttcaccatattggccagtctggtctcaaactcctgacctcgtgatctgcctgcctcggcctcccaaagtgctgggattacaggcgtgagccaccacgccctgcccatttatgttcatttttttagagaattctcctcctcccatttatgaagctagatttttttttaatttcaccaaaatttgttgacgtcccttgatttgctgatagggacaataattaaatattttccacttgtttttataaaaactgtaatggtgatttgtttaacagatgttgacttagcaccttctctctttttttttttttttttttttgagttggagtcttgctctgtcacccagctggagtgcagtggcacgatttcggctcactgcaacctccgcctcccaggttcaggcgcttctcctgcctcagcctcccaaatagttgggattacaggtgcatgccgccacgcctagctaatgttttttgtatcttagtagagatggtgtttcaccttgttgcccatgccgctcttgaactccttggcctcccaaagtgttaggattacaggcgtgagccactgtgcctggccccaatttagcaccttactgggtgctgaggctgtgagccatagtagaatgcatgtgatccagggccttgctgaattcatggtctaatagggagcctgacacgcaggcacagagcggagggcagtggctgtggctcccagggacaccaccctgtccagagttcagtggcagcttctcattaaaaaaagctttgagacctgaattggagtctgtctggcaggcaggtggggatggaggggaggagtgtatcctaggctgatgagatggtgtgtttttcatccggcaaccaactggtctccttcactgtctccagcaccccgcacaatactgtgtgccaggtgctcagtaattatttatcaagcgcataagagcacagcacatccagggacggaagttccaaagggctaggagagtggttagacctggaagccaaaaggtttacagtctggataaagagcttttaccttgaggccgggcacagtggcttatgcctgtaatcccaccactttgggaggccagggcgggcggatcacttgaggtcaggagtttgagaccagcctggccaacatggtgaaaccttgtctctactaaacatataaaaattaggcttggtggcgcacacctgtattctcagctactcattaggctgaggcacaaggatcacttgaatctgggaggcggaggttgcagtgacccaagatcaccctagcctgggtgacagtgtgagactcaaaaaaaaagaaaaaaatgaacttttacctcgagagctccaggaagccctgaaagagttttaaggagattgatctgatggggatcattacttggtagttgagcgtagagtgctcaggggagggaggggactctagtcagttggcaaagctgctgtagaagaggaaaggggtctggaccaggttgacgattgataagacctggtgaccgaagggaaggcgagagtggcgagaaagatgtaaatgaccacaggtttccgtctgccctctgggtggctgtgggtcatgatgagtttagtttgtgtgtgttgggtttgaggagtctctgaggctttctcatgttttgcatcgagggtacggcaggccttatactttctcctccctgtccttggaaaactcctggctgtgtgtttgcacagttcactccctctctccgttcaggcatttgtcatgtatcccttcctccgagggtgtgctctgatctcattgatctctgctgttttaccccactctgtcttcgtagcctgataatgctcttcccacttcttctaagctccatggacacaggcagtctggttcactgcagaccagcccctaaaacggtacacagtaaatgctgacgtagtgactcctgtgcctgtgagtggggagctctggaagataggtctggatggaggcaggcctttgggagttagcaacatttgggtgatgattgaagtcttggggagcagtggtcacttagagcagtggttctcaaagtgtgatcgtggacccctgggggctcctgagacagtttcaggaattcacttagtcagaactgttttcatcatcatatatatatatattttttttttgagatggagtctctctctgtcgcccaggctggagtgcagtggcgcgatctcggctcactgccagctccgcctcccgggttcacgcaattctgcctcggcctctccgagtagctgggactacaggcaccccccaccacgcccggctaattttttgtatttttagtagaggcggggtttcaccgtggtctcgatctcctgacctcgtgatccgcctgcctcggcctcccaaagcgctgggattacaagcgtgagccgccgtgtccggccttcataatcatattaagatgttatttgacttttcattgtgttgacatataaaaataaaataaaaattctatagaaatactgttcttggctgggcatggtagctcacacctgtaatcccagtgctttgggagggtgaggcaggaggatcacttgaggctgagattttgagaccagcctgggcaacatagtgagaccccatctctacaaaaaaatttgaaaattagccaggcatggtggtgcgtgcctgtggtcccatctactggggaggctgaggcaggaggattgatggagcctggcaggttgagattgcagtgagctatggttgcaccatggcactccagcctgggtgacagagtgaggccctatgtcttaaaaaacaacaacaacaacaaaaaacagctcttttctttttccagctgcatatctatgtgagactgaattttcctcttagacttcagctaaaactgtgtattgcatcaggctgagagcagacacgatgtgaagatccattgctcccattgaggcagacaaggtaaatgtaaaatgtaaaatatggcttatcaccagattatttttcttagaaaatagttattcttttttttttttttttccctgagacagagtctcactctgtcacccaggctggagtgcagtggtgcgatcttggctcactgcaagctccgcctcctgggttcacgccattctcctgcctcagcctcccgaatagctgggactacaggtgcctgccaccacgcctggctaatttttgtatttttagtagagacagggtttcaccgtgttaggcaggatgctctcgatcgcctgatctcgtgatctgcccgcctcggcctcccaaagtgctgggattacaggcatgagccactgcgcccggcctagaaagtagttgttctttataaaaatgttatgtatggtaacatgcagtgggcttattttcaaatgataaacatttttaggacatttcagttttaatttatagcacagtaaatattgatagatcaaaccctcataaacaaaagcccctggggtccttaatagttgaggatgtagagggggtctgagccgaaatatctgagcagcgctggtttagagaatgggccaggcccagggcacctgtggggaccagagaagttctcagctggagacaggcaccctgtccctgcccccatgtgcagtactgtaggattgtgccttttcctggggaggagaactcagagatttgtcagaggtgaagacccgttggtgtagcttgagaagaggcccttgtgttagggatgtgcagaggaagagaaacacttaaaggagtgaccagactttgggagactctcagcactagtgtcgcagaacccacagaaggtattctgagagcagagggaatggtccgaagttggagatggattcgtcagtggtagagattgctgagggccagtgagttccagtggggtgaggagagtcttgtaggaaagtagtcggagagagaagtgtggggctaggggaggctctgtctgcatggattttagatgggaatactgagagggcagcgcccataaaggggaagagaggagagatcttttgtaaaatgcgtattcagggccaaagatgtgccaaggagaggcaggtgatgggcagtgaataagagatgccaacttgccttggtgagaggaatgttacctatgcgacagtggaaaaggctgtgtgctgaaaaagatggcggacgagtctgctgtagggctctaggcattgctggtgcttccatgttgaaaagggtggtccaaacatttgaggagagagtaggaggaggtgagaagacaaaccagacagacatctgggaaaagagggttccaggcaggagaagccccaagtcagggctgtgcttggacttggaattgaaataagtcctggaaaattggttaatccccgcttggcatacatattatgtaaagtgtgttgggagaggtacttgaaggttttcctgttgaaataaattccctacaaccttagccttccagtccctctgcctgacactcccatggcagttggtgcacttgcgttttgccctgttgaagatgcctgtgccattagctcgcatttgttgggtatctttcttgcaccaggcaccatgctgggaactatgctattactgcgtggtcctcacatcagctctgataggtgctgttaatagctccatcttacagatgactggatctacagggagattagacagttggccgtggtgacagtgaacttagttcttgggtcattgctcctggagcctatgcattatagacctgctggtgtgagctctttctcctcattcatctgagaagacttctgtgtctgcatttgcctcttcctatgttagtaaaaggaacatttttccactggaaaacagttaccaacagttttgtcagtggctactctattataccttcaaacatgcctaaatcttatgtaactcaacacccagttaatcttgctatctattctagccactcttcttgtttttctctctttaaactccccaacaggcagtctgtttccattgcctccaccatctatcctatcctttctctggagatcttgttcctgttgtctcagttttattttcagcttcttcattttgctaataaaaacatctaaaatgttcattgtagtaaattaggggcttggcatggtggctcatgcctgtaatcttagcactttgggaggctgaggcaggagaatcacttgaggccaggagtttgagaccagcctgggcaacacagctagaccctgtctctatttttaaaaaaataaataaaattttataaaaaagggaaattaggaacatacagcaaaaatctataatctctcaatcaggaaataaccatgtaagattattatatttcttctagtgttttgtatctctcatgcatgtgtgtatagagatgtttttcctcggattgggggtcccactctgtgtgtgtgtgtatatatatatatatttttttttttttttttttgagacagagtctcacttattgcccaggctggagtgcagaggcgcgatctcggctcattgaaacctccacctccccagctcaggcgattctcctgcctcagcctcctgagtagctgggattacaggcatacaccaccatgcctggctaattttgtatttttagtagagacggggtttcaccatgttggtcaggctggtctcgaactcctgacctcaagtgatccgcccaccttggcctcccaaagtgctgagattacaggcatgagccaccacgcctggcctgtatatatagatttttaaaattgtgatttttctactttgtaattgtttccaaatgtcattcatcttggaaaacatgagtagtaattatgtagatatcagtggtatttcttgtacctgaatccacgtgctggacatcctggttctgccaactcagatttgaggtctggagcaagttactgaacgtctctaccttagttttcttgtcttccaggattgttgtgaggactgaatgacatgctacaaataaaattcttagcttcaagccaagcaagacctcaaagtgttagcttccagtaccgctactactgatggtgtttgactctgccttcattcctgaaatgcttctccattgactgggtgtggtggcttatgcctatgacacttatcactttgggaggctgaggtgggaagattgagaccagcctaggcaacatagtgagaccccatttttgcatgtgtgtgcgcttgctcactggctcgtgcacgtggccatgcacgctcgctctctctctctctctctctctcgtgtgcacatgcatgtcctctctcttgctctctctttttcttagctgggcctgatggtgtacacctgtagtcccagctatccaggaggctaaggtgggaggattgcttgaacccaggagttcgaggctgcagtgacctgattgtacgactgcactccagccctgtctctattaaaaaaaaacaagtccttctccaagctgatctgggcacttgatttctacccttgtggttctggcttagtaaaggtcttcagaaatgacacaatgttagtttcctgtggctgctgtagcaaatcatcacaagttggatggctcagaatgaattgattccctcagttctggaggacagaagtctgaaatcaaggtgttggcagggccccagtgcttctgaaggctccaagggaggacacttcctttcttctttctggcttctggtgggtgccagcagtgtggcttgtagaggagtcactctctacctctgttttacgtgggcttttctcagtgtctctactcaccttataaggacatagttattagattagggccaccctaattcagtatgacctcgttttaacttaactaatcatacctggaaagacgctccaaataaggtcacattcccaggttccaggtagacatgaattttgggggggggacactgttgaacctgctaaagttcctagagcttcatccttcgccccttgtgtttctagctctcttgccttccatgtcttcccattccccttgtggccagccttgtgaaatgaagtctctgttggaggttgaagaaacttgtaagataatttacatagaaaaaggggccggatgcagtggctcactcctgtaagctcagcactttgggaggccaagatgagaggatcacttgagcccaggagtttgaggctgcaatgagctatgattgtgccactgcactccaacctgtgacagagcaagaccccgcctctaaaacaaaacaaaatagaaaaggtaaagtgtccttggccaggtgtgatggctcacacctgtaatcccagcactttgggaggccacagcgggtggatcacttgaggccaggagtttgagaccagcctgaccaacatgtgaaaaccccgtctctgctaaaaacacaaaagtttagtggggtgtggtggcgtgcacctgtagacccagctacttgggagactgaggcatgagaatcacttgaactggagaggttgaggttgcagtgagctgagatcacaccactacactccagactggtaggcagagcaagactttgtctccaaaaaaaaaaaaccagaaaaagataaaatgtcttctaagcatgggcccccaactcctgggctgtggtctcttaggagccgggctgcacagcaggtgagaggtgggcaagcgagcattcccacctgagctccacctcctgtcagatcagcggcagtgttagattctcataggagcgtgaaccccgtcatgaactgcacacgcgagggatgtaggctgtgcactccttatgagaatctaatgcctgatgatctgaggtggaacagtttcatcccaaaaccatcccctctgtctgtggaaaaattgtccttcacaaaaccggtccctggcatcaaaaaggttggcgaccgctgctgtaaggattctggatgcttcacagaacgaagctcaggaggcactttttttttgtcttttttttttgagacagggtgtcactctttgtcacccaggctggactgcagtggcaccatctcagctcactgcaactccgcctcacaggctcaagcaattctcctgtctcagtctcccaagtaggtgggactacaggcgtgtgccagcatgcccagctaatttttgtacttttttttttttttttttttttttttttagatggagtcttgctctgcttcccaggctggagtgcagtggtgcagtctcgtctcactgcaacctctgcctccaaggttcaagcagttctcctgcctcagcctcccgagtagctgggactacaggtgcacaccgccacgcccggctttctctgtactttggtagagacggggtttcaccgtgttgcccaggctggtctccaactcctgagcttaggcagtccgcccgcctcagcctcccaaagtgctaggattacagacacgcgtgagccaccacgcccggcctaatttttgtatttttagtagagacagggttttgccatgttgaccaggctgctcttgaattcctggcctcgtgatctgcctgcctcggcctcctagagtgctgggattacaggcgtgagccaccgcacctggccaggaggcgcgttgtgtttatgctttgctagtctttcttttgtgggaactgaagagtgttgtcctcggtagcttccacagggatggatcgaggctgctgccagcatttgttccactgactgtccttggggaccagtaacctagatcagaagtcaatgagaagacataaagaatgcctccaaagcagggaatctttccttcccctgtgaaagtgctgagtcccctagaggcaggtatgcgttccctcttgtatttagtccccacgctgcctgcctggatacattggtggttgtgacagctggggtgtgccacagggatcctgctccaccatggagaattgtccagtccagcagtctcggtgccaagtttatttaagatggagtcttgctctgtcgcccaggctggagtgcagtggcaccatcttggctcactgtaacctctgcctctggggttcaagcaattcttctgcctcagcctcctgagtagctgggattacaggtgacccgcccacctcggcctcccgaagtgctgggattgcaggtgtgagccactgcgtccagtctcggcgccaagtttaagaagagcatattgtcatggccttacatcagttatatgctcctgggtaacaaactaccccaaaatgaagcgacttaaaacagtaagtccttgttcatcatcatgtgggagtatggatgtgggcagggctcatctctgttcactgtgctggccacgctagcaagggcaattaacagttggcaggtaggctggcttgtgcttcccattgccctcacccacatgggctttcagccagggtgcctctgatctcctcagcctgcctctccaacagtctagctcaggcttcctcccatagtggctgaattccaaaagggcaggagcagagtttgacaggctacttgaggacatgtttagaagtcacagtgtcacctctgttgcattcccttgcttattgcaagttatgaggcctagcataggccaggagtgctgcctcatgcctgtaatcccagccctttgggaggccaaggtgggaggatggcttgaggccaggagtttgaaaccagcctggacaacatagtgagaccgcatctctaccgaaaatgaagaaaaaaaaaaaaacaaggcttagcacaggcttggagagtaggagatagactctggtccttaatggtgggacttgcagaaaccgtggccatttttcatcacagcctttcctatactgtgtgacctcaagaacttcctgctttaggatgcccagttaataatatggtatctgtgggatggagtgaactctttaacaaatatttaccaaatacttactttgagcaagacactgtgcttggtgatggttgagtaccgagaagttgcaactggtggttcattctctgtggggagatggcgaactggaagaagcgaagtttgggcctgtggtaggtgctgtgagctgttgggtggagagggcacttggtttagggtattgtttagggtatttagagtaaaggcctgaaggatgagaaggaaccaggtaggcaaggagcccctatgcttcaggtggagagggcagtgattgcagaggccctgcggaagggacagcaggcgaagctcagcagaggtcctgcggaagggacagcgggtgaagctcagcacacaggagcaaagctgtagggcagaggtaggggtggaagccaggccttggccacacggcctcaggcaggtgccagaggcccagtttgcccaggacagtcttgatttataccaggtgagggtcctcgtgcagatggtgcattctctagtttccaaactggcagagagcttggatgttttccttgatgcagtgggaagccgttgaaaaattttaagcctcaagtgacaaaaggtgaattttaaaagattgttgaggctgggtgcagtggttcatgcttatagtcctaacagtttgggaggttgagacaggaagattgcttgagcccaggagttcaagactctgtctctacttaaaagaaaaaattagctgggcattgtagcatacacttgtagttccagctactggggaggctgaggagggagcatcgcttcagcccaggagttggagtttgcagtgagctatgatcacacaactgtactcgagtctgggcaacagagcgagaccctgtcttaagaaaaaaaaaaaaagaaaaaagattgttcagattgctgaatgaaaaatggattgtcgggggcacagattgagacagaggtcattttaaggagactgttgatgagaaatggcgtggtttggctgaggatggagactaaggaaatgggaagaaatgggtggtagagtcagccaggttgctgatggaccgggtgtaggggagtagggaaaggaaggaggccaggatgatttctgtgtgtgctttgcacatgtagagggtggtgatgttgagcactgaggggaggcaaatctgttggctgtgcagagccatgccttgaatatctgaagctcaaaatgggtatagggcaactaagtgccaaccgccggctaacagcctgttggcctggagtccagtctggaagtcttggtctttctgtttttgtgatggtcggtggaggggttattaaaaggagaggtggggtgcccagctattagaggttagatcgaggagacacggagaggtgggatgtgacagtgtagggtgcagttgaggagtcaggtgaatgggggtggggaaagggttcccttaagtctcactctgttgccgtggctggagtgcagtagcgcgatctgggctcactgcaacctccgcctcctacgttcaagcaatactcctgcctcagcctcttgagtagctgagattatagatgtgtgccaccatgcctggctaatttttgtatttttaatagagacggggtttcaccatgttggtcacgctggtctctaactcctggccttaagtgatccacctgcctcggccttaatgttatccaaaatgctggggttacaggtgtgagccactgtacctggccaaaggttccttaaatttaaggactgcaggtactaggtggtcagcccttttggtttcacggtagggagtgaaagccagattggagtcaattgaaacataggagatggaagaggagaccacctgtgtagatacgacttaaagaaggttgctctagagggctcagagaaggagctcagtagttggagggtgatgtgggcaacagtggagagttctgtttttattttattttattgtttatttttttgagatggagtctctgtcgcccaggctggagtgcagtggtgaaatcttggctcactccacctcccaggttcaagcgattctcctgcctcagcctcccgagtagctgggatgacaggtgtgtgccaccacgcccagctaatttattttgcatttttagtagaggtggggtttcaccctgttggtcaggctggtctcgaactcctgacctcaggtaatccactcacctctgcctcccaaagtgctaaaatggctttttatatcagaaatgggttgaactggctcttggcagatgattattcttactgtaattccagcaacgctaacatgcgtaacagcgcataaggaagtgtctgctgagctcagaatattatgttttggaaaagacaaagtgcgattcagaaagctgagtttgatagggagggatttgatttttaaacaagacgggctgattatagtggcttataactataatccctgtaatctctggatttggggaggctgagttgcgaggatcccttgaggccaggaattttagaccagcctgggcacaatgtagtgagaccctgtctctacaaaaagtttaaaaaacaaaattagctgggcatggtgcctgtagtcctagctactgggatggctgaggcagaaggagtttgaggttacactgagttatgatatgccactgtactccagtctgggtgccagagtgagaccttgtctcaaaaaagcaaaaacaaaaccccacaaacaaaaacataagattgtctttgggcctggtgcggtggctcacgcctgtaatcctagcactttgggaggccatggcgggcagatcacttgaggtcaagagatcgagaccagcctggccaatatggtgaaaccccgtctctactaaaaacaaaaattagctgagcatggtggcgggtgcctataatcccagctactcaggaggctaaggcaggagaatctcttgaacccaggaggtggaggttgcagtgagcctagattgtaccactacactccagcctgggtgatggagtgagatgttgtctcaagaaaaaaaaagaaaagattgtttttgaatctgaagacataacaaagcagcattacaagttgtgttgtacaagtgtgttagcgtaggttgtccttgataaatggaatataaatagctctgaagtttttgtatatattgacctattacaaaatcagagactttctttcggggttgggagggcagtttgagggtagttgggtcatctggaagaagaggcagaaaagaggaaccagctacgtgatgaataactgtgataagacaaataggctcctctactgccacctccttgttttttcctgcttactatttctgtggctgtgattgttgggattcacgggaggaggaagcagggacagtaggaaaagctccagttcctgatggacctgtgttgctggtgctgcactgccttttctctgacttcatcccacccacctgagagacactaaggtgggggctgaggtccaccctgtaattaagctcttgggcatgaatggttagctgaaacaagactgtcaccttctagtgaaattctgttttttggattcttatagaagtcagtagtaagtgtctgagataatgaatggtcagataacaacataaaggagcagtggactgactagagcctctggtctttgtaagtttgcttcttttttgtaagtaacttattcttttttttttttttttttttttttttgagaaggtgtcttgctctgttgcccaggctggagtgcggtggtgtgatctcagctcactgcaagctccgcctcctgggttcatgccattctcctgcctcagcctcccaggtagctgggactacaggtgcccgccaccacaccggctaatttttttgtatttttttagtagagacggggtttcaccttgttagccaagatggtcttgatctcctgacctcgtggtccgtccacctcagcctcccaaagtgttgggattacaggcatgagtcaccacgcctggctgtaaataacttattctttatagaaattaacttcagaagattttttgagttcttaggcaaatacactaatggcatttgtttcatgattgttaggcctaaaactttttcactttttttcttttttgagatggagtctcactctgtcacccaggctggagtgcagttgcacaatctcggctcactgcaacctccgcctcctgggttcaagcaattctgcctcagcctcctgagtaactgggattacaggtgcccgccaccatgcctggctaatttttttgtatttttagtagagacggggtttcaccatcttggctaggctggtcttgaactcctgacctcgtgattcacctgcctcggcctcccaaagtgctggaattacaggcgtgagcgactgtgcccggctaactttttcacttttaaaaacgggaaaacatggccaggcacggtgtctcatgcttgtaatcccagcgctttgggaggctgaggcaggtcaattgccaggagtttgagaccagcctggccaacatggtaaaaccccatctctactaaaaaatacaaaaattagttggatgtggtggctcatgcctgtaatcccagctacgcgggaggctgaggcaggagaattgctcgaacccgggaggcggaggttgcagcgagctgagatcgcaccattgcactccagcctgggcaaaaagagcgaaactccgtctcaaaaaaaaacaaaaaaacaaaacacacactatatgaaggaacctttagatgcattattgaagaggtgaaagagaacttgaatagatagacataaatacagaacttgaatgcagtattcctatatgcatgtgcttgaatattttcaagatgtcacttgatttggagaagtaaatatttgaggggagttctaaagaaagaaaagggggaacgtttcctagtagattttttataagtattataggtaagtggaacaaagcagtctagatactgatctataaattaatgggaatttatgattaatgtagcatttacaatcagttgggaatggatggtttgtcatgtaaaaggtattggatcaactggcaatccagctgtaggtaaagagtttcttagtttgacaataaggctataagctatgaaaagatatctgcttaagcattcggaacatatctacagcaaaagatgcctgtttgggggcctctgaactatagttcaaaggcaggaaaattagaaaaatgttaggaatatatatgataaagggttattatttttagtataaaagcatttctaaaataattgttccagcaagtctatttttagaaatttatccaaaggaagaaataagagaatgcttattataaaattagttataaaagccaaatatttaagacagacaatgctcaaaaactcctagctagaatttttggtataaaagcaaaaaattgtcagtagccactaaaatataagctccatgagggtagagaacttcatgttttatttcctggtatatcctctgacagtgcctggtacatagtaggtctcaataaatatttgctgtatgaatgcctagtcatgcttgtccaacctgaggcctgtgggccgcattgcagcccaacacaaatttgtaaactttcttaaaatgttgttttttggtggagtttcgctcttgccaggctggggtgaagtggcctgatctcggctcactgcaacctctgcctcccaggttcaagcaattcttctgcctcagcctcccgagtagctgggattataggcgcctaccaccatgcttggctaatttttgtatttttaatagagatggggtttcgccatgttggccaggctggtctcgaactcctgacctcaggcgacctgcccacctcagcctcccaaagtgctgggattataggcgtgagccactgcacccggcctagaattgaggtttttttgtttgtttgttttgagatggagtctccctgtgtgccccaggttggagtgcagtggcgcgatctcagctcactgcaagctccgcctcccgggttgacgccattctcctgcctcagcctcctgagtacctgggactacaggcgcctgccaacacacccagctaattttttgtatttttagtagaaacggggtttcaccgtgttagccaagatggtctcgatctcctgacctcgtgatctgcccatttcggcctcccaaagtgctgggattacaggcgtgagccaccgcgcccggccacattgagatttttttttagcgattttttttttttttaagctcatcagctattactagttagtgtattttatgtgtggcccaagacagaattctccaatgtggcccagggaagccaaaagattggacacccctggatgaatctaaatgtccatcaatagattggttaaattaaggcagacttggaatggcatactgtgcagttgttaaaaagatttaaggtggccttcctttattggcatgaagagatgaccacaatacagtaaatggttgggcattttgaatatgtatagtttggggaatatggtatcatttgattgacttgtgaaaaattatgcacatatgtatcaaagtctggaagacatccctgtgaaacgtggtatctcatggggtgaatggaggaaaggaacatactgttttaagatactgttttctggctgggcgcagtggcgcacgcctgtaatctcagcactttgagagaccaaggcgggtggatcacctgaggtcaggagtttgagaccagcctgaccaagatggtgaaaccctgtctgtctactaaatagaaaaaattagctggccgtggtggtgcatgcctgtaatcccagctacttgggaggctgaggcaggagaatcagttgaacctcggaggcggaagttgcagtgagccaacgttgcgccattgtactccagcctgggcaacaagagtgaaactcaaaaaaaaaaaaaataaataaatactgttttcaaggccaggcgtggtctcaaaaaacaacaaccaaaaaacaaaactgttttctctttattttttggaaaattcgccaaagtcagtgacagaaaaaaggagttatttttcattttggaagaaatgtgaaagtggattatttacatttaaaagttttaaaagctttctcaagttagcatgactgaaatgagcacattacaggaatttgtttaaatctgcctttttaggtactgtagtctcctgtttcatagaccttgtagtcatgtttcttgctgtatcctgtcactggatatttttggatgctggtattgtgaacataacataactgtaatccggtagttctttttgagatggagtctcactctgttgcccaggttggagtgcggtggcacaatcttggctcactgcgacctctgcttcccgggttcaagcgattctcctgcctcagcctcctgagtagctgggactacaggtgcccgccaccacacctggccaatgttttgtatttttagtagagatggggtttcaccgtgttagccaggatggtctcgatctcctgaccttgtgatccgccctcctcggcctctcagagtgctgggattacaggcatgagccacaatgtgttgcctgttttttttttttggtttttttttgttttttttttgttttttgagatggagtctcactctgtcacccaggctggagttctgtggcgtgatctctgctcactgccacctctgcctcccgggttcatgccattctcctgcctcagcctcccgagttgctgggacttcaggtgcccgccaccacgcctggctaattttttgtatttttagtagagatgaggtttcaccatgttagccaggatggtctcgatctcctgaccttgtgatctgcccgcctcagcctcccaaagtgctgggattacaggcatgagccaccacgcctggcctggcctggtagtttttataacagatgttagatagcaatactcttcataactctgtacaaggcaatcaggcaaaaccaaaggccaagtaaaatgtaattggttaagctaattgtagctgatgaaacctttacgttttgtgaaagaggagatgtgcatcagcagctgtaagtgagcactctaagatgcagtgagtaaaaggtgttgggagatgagcaactaaaatataacctcttagttataaattgcagaacgaagaattttactcagagtacaaactagtggaaaaagtctttcgtatactgggtttttcagagttcttaggcaagattatatagtttgatttaaagacccaaaaatgtacttcctggggtgcaggaatgtcaggtttctgttaggtggaacatgctcctcatggcacagaattggctacatgaagttaacctacaggccaggtggtaatcggcaggatgggtcggccggagggaataacttgtgatgatagtgggagaaaccagtatcattgcggccgttttaactacctactgtgtactaggccctatgctatgagccagaagttgccacgctacagccatctctttctgtggcccagaagctaagaatagttttttcgtggggttttcttcttttttttttttttttttttttgagagagtcttgctcttgtcacccaggctggagtgcagtggcacgatcttggcacactgcaacctccgcctcccaagcaactctctgcctcagcctcctgaatagctgggattacaggtgcctgccaccacgcctggctaatttttttgtatatttagtagagacagggtttcatcatcttggccaggctgatcttgaactcctgacctcgtgatccacctgcctcagcctcccaaagtgctgggattacaggtgtgagccaccacgcctggcaaattttttaaattttgtttttttgttttgtagagacagggtccaactatgttgcccaaactggatccacccgccttggccttccaaaattttaggattacaggcgtgagccagtgtgcctggcccagaccctcttgttttcagtcactgtgcaacaccacctcccacagaaacattgttctgtcctattctttaaaaaaatgttatcaattatgtgctgccatatactacactgagagtggggattcagtgcttaagcataggtaggttttctgaatttttccaacttaaatctcctttgaaatcttactgtgtgtgatatctgaaatttgggtgtttgctcactaaaagaaccttggaaggagaagatctcaaaatgagctatttgtggatgaagagtgagtcctgtgggtttttgttttttgtgttcttttatagttaacagagtagcagcatgtagaaggtggtggagcctgaacactaggtttagccatagaaaggcagttaggtctcctaagtagacgtttcagtaaagggctttgttgacgctttgcaatgtctggggtgtgtttgccccactcccaaacccctccagtggcagcagccacagtgggcaagggacggcagtgcttttctgaattggtcaggtttctgtgggagatgaggctctaaaatcagtcaaattatctcacatattactcaggttggctataaattgcataacttacatgattgggtgttgtcacatactttcttttctttgtttctctgtggccctcactgcttccatttctagccagcaccacctcacaacttgcccatctgagcctctgttactcatttgtttggttggaaaacctctacagcccatttgtagactgatggctgaagaggggcagtgaccaaggattgtgttcatctgatgaacagacgccagtgatgctgttcagcaccctgcaccacccgggatgaccccagtgtccacagtgctgagggtcagacacattcagcctgggtctagcactgtgctcttaggtagagggatgtggcctggcgtggggctgaatgaggtttggttttccctcttgtgtgtgtatggcagttatttgtgtggacttcagcaccactgcagttcaaattcagccaccttgcctcctccgtggtgttttctaagagtctccaaggtgtgatgcctacgtgtaataccttaccggggagccctcctcagcttccttacctttctgctgggtgtatttgttctgcttctgtacaaataaagtactggccaggtgtagtggattgtgcctgtagtcccaacactttgggaggtcaaggcagccgattgcttgagcccaggagctggagaccagcctaggcaacatgggggaaaccctgtctctacaaaaattacaaaaatcgggggcatcagagcacggcttgtagtcccagctactcgggatgctgaggtgggaggattgcttgagcccaggaggtcaagtctgcagtgagccgtaattgtgccgctccagcctgggcaactgaacgagaccctgtctcaaaaaaaaaaaaattaataaaaatgaagtactttacactaccgggtaatagacttaggaaactgattgtctcactcagtgtggggagaagttaatgggtggacttctcactcagactgttgtaatcatctcctaattgacctgacaagcctccgaagaggaggtcccaggagttacttagtggctcttcatcctccaattcatggtacatgggactgccacgttgctctgctaacatatacactttacttagttatttatttatttgacaaggttttactctgttacccaggcggagtgcagtggcgcaatcttggctcactgcaactttcatctccttggttcaagtgattgtcctgccttagcctcccaagtagctgggattacaggtgtgcgccaccacaccaggctttttttttgagatggagtctcactctgtcgcccaggctggcgtgcagtggtgcgatctcagctcactgcaacctccgacccccggggctcaagtgattctcttgcctcagcctcccgagtagctgggattacaggcgtgagccactgcgcccggcctcccttgaggtttaaagagtacaggccagttatcctgtaggacatccctcactttgggtctggtggctgcctcatggggggattcaggttttgcattttgagctgaataccccagagatgtgtcctggggcttctctggtgaatgcttccagtgctgtctgtgttgcttgaagggtccagtttgagctctaactggagcctcagcaccagctctgttttagccacagattgaagcctccttcagggctgcttccagctctgacctgtgtcttccttacatcctctcttgcccctccatcacttctcccccaccaccaacccccaaccccctgaggatataaaatctctgagatgcgtctgttctcaaggctgcttgccaatcctgcttcccttgagggatgcctttcaataagcagttactgagttcctgctgggtttttattattattattattattatttttgagacagtacacagggtcttgctctgtcactcaggctggagtgcagcggtgggatcataacttgctgtagccttgacctctgaggctcagtgatcctcctgcctcagctacagatgtgcaccaccatgtccagttaatttttaaaaaatttttttgtgtgtgtggagatgaggactctttatgttgcccagactgggctccaagtcctggcttctaacagtctccctgccttagcctcccacaatattgggattatgggcatgagccactgtgcgcagctgtgctgggttttgttctgagacacaaagattgggaagtcagttcccttttttttttttttttttgtgagacagagtctcgctctgtcgcccaggctggagtgcaagtggcagcatctcggcttactgcaacctctgcctcccgggttcaagggattctcttgtctcagcctcccaagtagctgggactacaggctcgtgccaccatgcccagctaatttttgtatttttagtagacatggagtttagccatgttggtcaggcgggtctcgaactcctgacctcaagcgatctgtccggctcggcctcccaaagtgtcagttcccatttttgatgagcgtgtagtgtgttacagcttactgcaaagtggaggggcagagcagtaggtgaggcttttggggtggatttagagctgagctgcagtctggtcggtttgtggggactcttcctccctctttttttttgagacagagtcttgctctgttgcccacaggctggtttgtggggactcttcctccctctttttttttttttttgttggagatggagtcttgctctgttgcccaggctggagtgcagtggcgtgatctcggctcgctgcaagctccgcctccaaggttgacaccgttctcctgcctcagcctcccaggtagctgggactacaggcgcccaccaccacgactggctaatttttttttgtttgtttgtttttatttatttattttttgactaattttttcaacttttattttagattcagggttgcatgtgcaggtttatttcctggttatattgcatgatgctcaagtttgggtatgagtaatcccatcacccaggtactaagcatagtacccaacagtcagttttccaactcttgccaccctctatcatgcccctgtctaatagtccccattgtctatttttgccatctttatgtccacaagtccctgatgtttagctcccacttataaatgagaacatgtggtattcagttttttgttgctgtgttaattcacttaggataatggcttccagctgcatccatgttgctgcaaaggacatgctttcattcctttttatggttgctattttttacttcttctttgtttactttttttttattatactttaagttctagggtacatgtgcacaacgtgcaggtttgttacatatgtatacatgtgccatgttggtgtgctgtacctattaactggtcatttacatttacattaagtatatctcctaatgctttccgtcccctctccccccaccccacaacaaaaactgaaaatggatcccttccttacaccttttttgtatttttagtagagaacaggggtttaccgtgttggcaaggatggtcgatctcgatctcctgacctcctgatttgcccgcctctcggcctcccaaagtgctgggattacaggcgtgagccaccgcgcccggcctgcctccctcttctttcccacccctctcccccaccccacttctccttcctctccccttttctctcctttagtttaccctgctccccctttctttacattttctttcctcccccactcctgccaatcagtctccgttggcgtctcatccctgagggcagattcatggcacctttatgtctccaaatgcctttaggccacgatacatagttcacattccctttattgaatttttttgtttgtttgaagagacaggatctccctctgttgcccaggctgctctcaaagtgctgggattacaggctcacatgagccaccacgcccagccctttgttgaatctttccatctaaacagtttaactatttatgtcctaggaagttagggtagccatttgaaaactaatccccgtcggggcgtggtggctcacgcctgtaagcccagcactttcggaggctcaggcgggtggatcacttgaggtcaggaattcgagaccagcctggccaacattgtgaaaccctgtctctactaataatataaaaattagccgggctttgtggtgcatgcctctaatcctggctacttgggaggctgagacaggagaattgattgaacctgagaggtggaggttgcagtgagctgagatcgcgctattgcattccagcctgggcaacaagtgaaactctgcctccaaaaaaaaaaaaaagaaaataaatacccataaattgaaggaaactgtattttatttttaaatagccacaattactaatgggttgtacagcttctcaaacttcagaatcagattggactccgtcccaccccaccccttgtttcctgttccatgttgatttcatgcagagcttgcttttttatcacagcagccactgcaaacagggctttattaggatgtgacgtcatcgggaagggtgtagctccatctgctgttggagcacgaaccccctcgagctgtggctcccttggtgtccagcagctgatgttctgctgtgcttcccttggctttaaaatgtctttcggtgtcctctgagatggctgcagtgtccctggcatcttgtttgttttgggagcttaggctttcatggcccacagtctgggctggactcatcactgtggtctggtgagtgggggtagtatgttcccatgagaaggggacccaccctctggaagtacctggacaagggtggaaggagggatctgtccctttttaagaatcaaaattaagtcttcggggtgctgcctgtcaccagaggggaggccataggatgcccaggaagaacccagggatgagggaccacaaaggggcctctccaacatgcagaatatggcttctatggtacaagtggaatttgtcattgaaaaaaaataaaatagttaaaaacggacttttagaagacagtctgtgtttttcttgacagatgcgacagatgaactgaaaacaaatgacttgtcagaataacaagtgactgcctttattggatgttccatgattctggccatggccttctctcctgtttttgacatagtaggcagataaggcagtggggatattcatgaatgcttttaaagaaaagaaaaaacaccagtgactgtgcagttgtgtttttattttgtgtgttttggggactgtaattgttctggattctccattatggatccatgtgtgctgctttgtggcatgtcctcagctagtgcagtgccagagggaagaattgcagtagcccctgtacccgtggccttgtcttttgaggtatggcaccataaaatatcacggtacagtacgagagagaccacattcccataacttttattacggtatgttgttatggtggttctgcttgattattagttattattgttaatttcttactgtgcctaatttataaataaaactttgttacaggattaagttcctatcatttgtataggaaaaaatacagcataaaggaaaaaatgtagtctatataaagtgtggtactatccacagtttatctggcatcccctgggggtcttggagcatgtccttctcagatatgggggtactgctataagtgcacatgtagagaagtttgttcccatgttaaagatatcgtcattgcttggcctacccatgttcccttctcaggtactccacccattgtccctttggcaagggcagctgcccacaggacttgctgtatcctccccagttccacagtgtaccagccacctggcctgcagacagtgagggagtgagttggtgcagaggagactctggagacagagacatggctgacatttgatgattgctgtgatttagaatcctaggctgcgttgaaccctgtacaagatgacagtgattggttaatagagagattcacagaggagcagagaaagcacactggaaggagagagagaggagccagccagccccaagagccatccgagactgggttcttggttcctctttccactttctcgtttccagtttagtttccttgggacctctcatattcctcctctccccacttcccagtgagaaccttggctagactgggtagacttttgaagtgggggtaaagtgaagtcaggagtagttttaattttccatttctagaattaatgatttcctaaaagatgtagttaataccaaatttcccattaaggcttctcattaatcagcaggattttgagacaggtgattggacagtgaatttaattacctggtgaaaatacctgaagtgattaaaatcagagtatgctctccatatacctgggctctcctgaatgtctttacggtattactgttttgtaggatacttccctcagaagagtgaacagtacaagagcctttttcttgggccttctgaattaataatattttttgttttaaatgaaatatcaactgttttcagaaattacattcttggttgtcccaacatatcaccaaactgttaattgctacattaggtgggattgtggagggggagagaggaacattaagaaattctaggccaggcgcagtggctcatgcctgtaatcccagcactttgggaggccaaggcgggcggatcacaaggtgaagagatggagactatcctggccaacatggtgaaaccctgtctctactgaaaatacaaaagttagctgggcgtcgtagcgcgtgcctgtagtcccagctactcgggaggctgaggcaggagaatcacctgaacccaggaggtggaggttgcagtgagctgagatcaggccactgcactccagcctggcgacagagcgagactctgtctcaaaaaaagaaagaaagaaattccgggccagtgcagtggcttatgcctgttatcccagcacttcaggagatcaaggtgggaggatcacttgagcccaggagttggagatctgcctgggcaacatagcgagaccccatctctaatttaaaaaaagaaagccctattcaggaggttgtggcaggaggatcacttgaggctgagagtttgaaaacagcctgggcaatgtagcgagaccagcccatctctgaaaatataaaagttagccaggtgtgatggcacatgcctttagtcctggctgctcaggagactgagatgggaggatacttgagcccaggaatttgaggctgcagtgagctatgatggtgccactgcactctagcctgggtcacagagcaagatcgccatctcttaaagaagaagaagaaagtccattgattaaaaaaatttgggaggctgctttacgccatgagtcctgagaacacagtggtgaaaaggtagagggccctgccctgagctccctgcttatcaccttccccagatcagtgctgtcaacttcactcttaggttaagaaggtcatagcatctagttctgtagacactattgcctcctcctctttgaaatagccaaagaagcaaacaccaggtgtctctctttccccaggttactctgatgtactttcctcactggaaaacagtgacttagtgttttttccttttatgggagtttttttttgttttttttttgagacggagtctcgctgtcacccaggctggagtgcagtggcgcgatctcggctcactgcaggctccgccccccggggttcatgccagccattctcccgcctcagcctcccgagtagctgggactacaggcgcctgccacctcgccctgctaattttttgtatttttagtagagatggggtttcactgtgttagccaggatggtcttgatctcctgaccttgtgatccgcccgcctcggcctcccaaagtgctgggattacaggcgtgagccaccgcgcccggccgggagttattgttttgcttgctttttaagtcattgctggttaacttggatggaatttgggttcttttttcttcttttcttttctttttttttttttttgacacagtgtcttgctgtgtcacccaggctggagtgcagtgggggcgatctcagctcactgcagcttccacctccccggttcaagtgattctcttgcctcagcctcccaagtaactgggattacaggtatccaccaccacactcagctgttttttttttttttgagatacggtcttgctctgttgcccaggctggagtgcagtggagctatctcggcccactgtaacctttgcctccagggttcaagcgattctcctgcctcagcctcccaagtagctgggattacaggtgactgccactgcgcctggctaatttttgtatttttagtagagacggggtttcaccatcttggccaggctggtcttgaactcctgacctcgtgatccacctgccttggactcccaaagtgctgggattacaggcgtgagccaccacgcccggatgtatttttagtagagatggggtttcaccatgttggccaggctgatcttgaactcctggcttcaggtgatccatccacctcggcttcccaaagtgcggggattacgggtgtgagccactgcactttttaattttttaaagacatgacgtcttactatattatccagtctggcctccaactcctgggcttaagcaatcctccttcctcagcctcgctagtaggtgggattacaggcatgagccaatgcgcccagcttaaaaacttacttaggaaggaatgtctgggactaacaggagatgtatctgtcttccttaaaacaggttttgtagtgagtccctcttgctgtgtatctgctgcttcattgtggtccccttcctctaccttttttttatgactgagcttttttgtactgtcagagtttaatttaagagaaggatagcagttggactgaacattccaggatggagacaataaagttaatttgtctctcacattcagaggtagaagtggcaggctttgtcagtgtttcagcaggtaagaaatcttgactagtaggaataagtcagaatctcagggactctttatacctgttcaccctgtccttgggaccccgctcagatttctccacaccagagtggccttctctggccaccttctaagagagacctccccatctcacctgtttccccttcttacgtagttttatgtttccttagcaatggatagcagttgatgtatcaaaataaagacttgcactgttcgcttaatgccttcctcgaccaacaagcaagttctagaacagcaagtgctgtgtcttgtttcctacggactcccctgagctgtggtgcctggcacatgattggagatgggcaggtcgttgttgagtgagtgaatgaagccatacaaatacgaacccagatattgaggccactttattgttaaatgttttatcaacaattgacacttctatcctattttcatgttgttatataatatgactatatatgtactcagactcccaagtaaatatttgtgcttactttactctgacctaaactggtgcctggcaccagagtaggctcacaaaatgcttttctcacagtgaccgcctaacaaacctagacattagctgaggtttatagagcactgtgtcattctaaatagcctgaagacatagtttctattattcctgtttccagttctctttctaaatcacagatgatttagaatatgggttataaaaacatttccaactcagggtactttctatattttgtgggttttgcaggaaataagctaagttttggaagcatgtcttttttcttgcttggtggggagatattttacctttaaaaattggctctcattctttgaggcaaaaatatgttcatgtttctaggatttctctttaagagactagtggtcagagttcggcagagaccaccaaagttgtctggggtgttcgtgcccatgtgtttggccctttctaggcttacttgactccctggggaggagtacctgggaatacagtcagtaagagctttaaattaggccaggctaaaaagtttgattttttccgtaggaggagtatttgaagacttctgagcggaggagtcgcatgtcagagctgtccttcagaaagataaatcaggcagtgctgttaagatggattgaagtggaaaagaggtgggatagagacacagattagtaacgggccaggcaaagatggtaagccatcaagaggctgaagcagtgggagtggagcacaggggcaggaggggaaagggatggaagggaggcttgagtctgtgctgcaggagagctgggagggactgccagcaggtttggaaaggaaaggggtgctgaggcttgctttacactggtggaatctgaaaggattgaaccctcagagcgctgcagtgcgtagagctttctaggaactggggtacattcagggaaagggaataaggagtggatcctcgacttgagagaagaaccacaaaagaaccagttgagggttcagaagggggcgtgactgggtgtggcagatgtggagctgggttggtgagagcaggatgaggggctgttgctggctcctgagtgtagggtaggcccgtaagttgcactccactcaggggctgagaacctgtgtgcatagcaaggcacacaagacattcacttttttttttttttcttaagagacagagtctcactgttgcccaggctgacatacagtggctcgctgctgccttcaactcctgggctcaaccagtcctcctgtcttagcctctggagtagctaggactacaggtatgcaccaccatgccaatttttttaaaaaatattttgaggccgggcgccgtggctcgagcctgtaatcctagcactttgggagactgaggcgggcgggtcgcgaggtcaggagatcgagaccatcctggctaacatcgtgaaacaccgtctctactaaaaatacaaaaaaaattagccaggcgtggtggcgggcgtctatagtcccagctacttgggaggctgaggcaggagaatggtgtgaacccgggaggcggagcttgcagtgagccgagatggcgccactgcattccagcctgggcgacagagcaagatgccgtctcaaaaaaaatttgagaggcaggatcttgctatgttgcctaggctggtctgaaactcctggcctcaagtgatcgccccctggtattacaggcgtgagccaccacgcctggctcctaacgtttggcatctctttttatatattcaaccacaatatgttgatttttttttttccagtaaagtgaatgtctctttatttattttttttgagacggagtttcgctcttgttgcccaggctggagtgcaatggcgctatcttggctcaccgcaatctctgcctcctgggttcaagcatttctcctgcctcagcctcccgagtagctgggattacaagcatgcgctaccatgcccggctgatttcgtatttttagtagacatggggtttctccgtgttggtcaggctggtctcaaactcctgacctcaagtgatccacccacctcagcctcccaaagtgctgggattataggcgtgagccgctgtgcccggccgaatgcctgtttaacagacattcagtctactgccaaaataaagtaaaggcttgtcctcatggtagcctgcaagactgtttgcatcttcatgtgaagttgtatggcttgcttttctgcatttgttctgtcctcctctaggtgtgagtagtgaggtttcctctttggccaatatttttttaaattaaatttaattaattagttaatttttgagacacagtcttgctgtgtcgcccaggctggagtgcagtggtatcccaggttcaagcgattctcctgcctcagcctcctgagtagctgggattacaggtgtgtgccaccatgccctgctaatttttttttttttttttctttgagatggagttttactcttgttgcccaggctggagtgcaatggtgcaatctcggctcactgcaacctccgcctcccgggttcaagcgattctcctgcctcagcctcccgagtagctggaattacaggcatgcaccaccacgcctggctaattttgtatttttagtagagatatggtttctccatgttggtcaggctggtctcaaactcccgacctcaggtgatccacacgtctcggcctcccaaagtgctgggaattgcaggcatgagcctccgcgcctggcgccttgctaatttttgtatttttagtagagacggggtttcaccatcttggtcaggctggtctcaaactcctgaccttgtgatccgcccgccttggcctcccaaagtgctgggattacaggcgtaagccaccgcgcctggccggccagtatgtttttgagaaaaatacatggtgccacgaagttgaaggcagccttcccctgaggattataaaatccaaacccaactgaagactagattgaattaacccctcatccccacacagtagtggctcagacaaagaggtgtacccaattctggttttattgaatatcatctgataattcaataaaaaattatgagatacacaaaaaagcgatttcttgttaagagagaaataaatggaagccaacttagagatgacccagatattggaactgccagagactttaaatgactgtgatggatgtggtaaaagattgagtgagaaaggtatacagcatgcattatatgtgaaaagatcgagaatttcaggaggcagaaactctagaaaaagttaaattgaaatgttagagattctttaaaaacattatagatgaataattttctcagtgagtttgtcagcagataggaaagaatcagtgaaactgaagataggtcaatagaaatccaaaatgaaacaagcagaagaaaataaaccagaacaaaaatagcatttaggctgggcgcggtggctcacccttgtaatcccagcactttggggaggccgaggtgggcagatcacctgaggtcgggagttcgagaccagcctgaccaacatggagaaaccccgtctctactaaaaataaaaaaaattagcagggtgtgatggcacatgcctggaatcccagctactcgagaggttgaggcaggagaatcgcttgaacctgggaggcggaggttgtggtgagccaagatcccgccattgcactccagcctgggcaacaagagagaaactccatctggaaaaaaaaaaaaaattagctgggtgtggtggcgggcacctgtaatcccagctactcaggctgaggcaggacaatcacttgaacctgggaggcggagattgcagtgagctgagattgtgccattgtacttcagcctatgtacagagcgagactccatctcaaacaaaaaaaaagtgttgagtagttgtgagactatagcaaactgtcaaatatacagataattggagccctaggaagaaaatggggcagaagaaatattcaaagagctaatggttgagaattttttcattagtaaaagacaacaaaccagaggtctgtgaagttcagaggactccaagcaccataaatataaacaaaaaaccctcaacacctaggcacattatagtcaaactgctgaaagtcaaagagaaagttttgaatgtagccagaaaaaaagtatttcatacaggccaggcatggtgggtcatacctgtaatcccagcactttgggagactgagtggcagactcacttgagcccaggagtttgagagcagcctgggcaacatagcgagacttcatctctacaaaaaaaaaattatccaggtgctctggcggtgcctgtggtctcagctactcaggagactgaagtgggaggatcgcttgagcctgggaggttgaggctgcagtgagccaagattgtgccactgcactgtagcctgggtgatagagtgagacctagtcccacaaaagacttcctcagacaaaagttgtggggtttgttgccagtagatctgccctgtgagatggaggaagttcttcaggcagaagtgtatcccatcacactgcagttatcttctggtgctatatctagtttaatataaatcagaccaggcaaatgaagagatatatacagcaaggcctagcagagtctcaagcacacatcctccaagccctctccccatggagtctctcctgacaaatcggggtcaatgagcttctaaccaggaagctcccctgagccttggtgttgagagtttttattggggctttgttacttgggcacaattgatagagcacaatctctagcccctctcccaccccagtcagaatggtttcaaaccccaaccgtctaatgtcatggtttgtctttctggtgaccagcctctatcttgagtcagctcatctcagcaaaaacatggaggctcatgaataacaaagacatgcctatcactccggaacatccaatagtttttgaagctccttctgaggaactgggaacaaagacccagaaggagtcttcaaaaaacatgtagaagtaaaatgctagacagttgtgttacaaagagtgaaagggaaggaatatcgtgacccttaacacagggattaggagtgctaacctgctgtgcagtcaaaattcttctatcacttgactcccaaaacatgaactactaatagcctgctattgactggaagccttaccgatagcagtcaaaagacagtttttatgttttatatattatatatttttgtgatcaagctagagaaaatattaagaaaatcataagggagagaaaaatgtatttactatttaatgagtggaagtggatccctcataaaggtcttccttctcattttcaggttgaggctgaggaggagaaagagatgggattggtcttgctgtcttggatggaggtggtggaaggggaggtaggagagacaggcatacttggtggaactttactgaaatacataatttctgacttctttctttttcgttttattttttctttttcttttttttttttttttgcctgggctggagtgcaatggctcagtcttggctcactgcagcctccgcctcctgggttcaagcggttttcctgcttcagcctcccaagtagctgggattacaggcgcccgccaccatgcccggctaattttttttatttttagtagagacagagtttcactgtgttggccagggtggtctggaacacctgatctcgtggtctgcccgctttggcctcccaaagtgctgggagtacaggcctgagccaccgcacccggcctgctttttcatttctctaaaaaagtttctgtatgatagcaaccttctgttgtatgctttatagttttagttcctgtgccataaaagctctgtgtcctaaagaagtcaagtgcagtcttggggaatggggaccttctgccagattgcccagtgtccacgtgtttttggcactgcttctttctcatcgtttggcaccacgttggaagtactgacatctgtcaaggtgtgttctgttaattcctctggtgtggtgtctaatagctcttgaatttctctaagatccacatgttgaagtccttacccacccccctacccttttaaaagcatatgcacagtcttttcatgatttcctcgtctggctctcgtaaatcctgtgaggtcaggcgcagcatctggacgtcgtcctctccagcaggagttgattgtttcaggctcatggccttcacagctttttctgtaacaaccttggcatcttcagcaggataatccttccagacttaaacgatgttctgtctattgggattctcttccatagcattgacaattctttccatagagtactgtgtgttatgagccttaaaggtccttatgaccccctaatctagaggctgaaggagaggtgctgtgtttgggggtaagtagaccacttcattgccgtcagtattgaactcatggggttctgagtggccaggggccttgtccaatatctaaagaactttaaaaggcaatcccttactggcaaagtgtacttcctgactgcagacaaagaacatcgatggaaccagtccagaaaaagggattttgttgtcccagtcttgttccacaaccaagagactggcaactggtgtttatctcttccccttcaaggctcaggggttagcagctttgtagataagagcagtcctgatcataaacccggctgcatttgcacaaagcagtagagttggcctctccctgcctgccttcagtgctggggctcacttttcttccttactaataagtgtcctttgtggcagttttttccagaatagggcacttttgtctgcattaaaaacctattcaggaagattttcttttcctcaatgattttcttcatggcatctgggaaccctggtgcctcttggttggcagaaactgcttctcctgttatcttaacattttttaagccaaccctctttctaaactgatcaagccacccttttgctggcattaaattctctagctttaagtccttcactttcagctagaaccagtggctcattcctataatctgagcactttgggaggccaagggaggaggattgcttgagaccaggagttgaagaccagcctgggccacatagtgagaccctctctccataaagaaacaaaaaatttagtcacgtgcagtgtggcacatgcctgaatccttgctacttagggggctgaggcaagaggatggctgtgcctaggagttcaaggtttcagtgagctgttcaaggctgtcacccacttgggtgacagtgagactctgattgattgattgattgattttgagatggagtctcactttgtctcacagcctggagtgcagtggcatgatctctgctcactgcaacctccgtctcctgggttcaagcgatccttctgcctcagcctcccgagtagctgggattacaggtgccagccaccacgcctggctaatttttttgtttttagcagagatggagtttcaccacgttggcctggctggtttcgaactcctgagcttaggtgatccgcctgccttggcctcccaaactgctgagattacagacatgagccactgcacccggctaaatcttactccttctatgtgtattggcattcctctgtaaagaagagcttcgcttttcctctttttttttttaatttatatgttaccatgtgcttgtgtgttctttttttagatccagtaaggtatattccattaccattgttcgtcatgttgaccctcagattgtcctaaatttggccagcagacttccttcaagctggtgtgtttttgacatgttctttttagttttggagcccttcctttctgccatagcaagagggttcctgtgccagaccttgagggagtgatttctcagaggaaccctgaagctccttttaaagggaaccgtttttataaaaccaagatttgggctttgtgtgtggagaggtcgttgcttccagacctttcagttgacaagagataggagatatacgtgtgtgtgtgtgtgtgtgtgtgtgtgtgtgtgtgtgtgtgtgtgtgtatggacttacacacaaatgattctacagcggaataaatgtatagagaatttccattgtctccaaattcagattgaaccccagggggccattccttgctttcagatagtccgtgttgtgcctcccttctccagtgtgagccttgctccccaaataaccatatcttcgcttatttcgctctggcatacatatccatattaatattttaagcattattattattatttttattttattttattattattttttttgagacggagtctcgcactgtcacccaggctggagtgcagtggcacgatctcggctcactgcaagctccgcctcctgggttcacgccattctcctgcctcagcctcctgagtagctgggactacaggcgcccgccatcccacctggctaattttttgtatttttagtagagacggggtttcactgagttagctaggatggtctcaatctcctgacctcgtgatccgcccgccttggcctcccaaagtgctgggattacaggcgtgagccaccgcacccggcctactttaagcattattatgccaccaatatgacgcttaaatttcagaactctatttgcccttagaatgtacccccacgtttgtacagttagagtattctaaattaacgtgatgtctttagacctttttttggttggttggttgtgttttacaggtattgttatctttttattgatactgaactctaatttttgtttgaaagaaggcatttctagtttgtttttatcctgtttattagtatgatcatatatagttgaagattatgatacagagttgtcattaagttcagtattatttcacattctagttgttcagtgtgtttttgaattaaagaattatttggaagggagtttactttgtttcttacaagcccccaggcctttaggcaaaactcttggggctggatgttttccggaatatagactttttcagggttgagaaagatgcagtgagtatgttacatgtgcaccacacttacggcaaggctttaatcagataccccaaagtttgtagtaaacataagactgctcaccctgaatgtgagaaagtctgcctaatgccgtgtgtcctattctggtttgggtatctcagaattgtagataaccagtggtgcacttatgtgtttcccatcttaggattatgttgatagagaagaaatcatcccccacaagtatacctgtacttgattagaaatattaatgcagcttgtagagaaattctctaggtatgtctcaaggattcagtttctagattttgaaaaatgctgaaataaaagtataagtactaggatatgtgcaaagaagtcatattaatatttaatattgctaaattagctgtatagagtcagttgattttatcaagagccttgaaaaagtgcccatctttttcttttttttttttttggagacggagtctcactctgccatcgaggctggagtgcagtgatgcaatcttggctcactgcaacctccctgtctcaggatcaattgattgtcctgcctcagcctctcaagtagctgggactacaggtgcatgccaccgtgcccggctaatttttttattttttaaatttatttttattttattttaatttttttttgagatggagtcttgctctgtcacccaggctggagtgcagtgacgcaatctcagctcactgcaagctctgcctcccgaggtcacgccattctcctgcctcaccctcccaagtagctgggactacaggcacccgccaccacgcccagctaattttttgtatttttagtagagacggggtttcatcgagttagccaggatggtctcgatctcctgacctcgtgatccgcccgcctcggcctcccaaagtgctcggattacaggaatgagccaccgcacccggccagtaatttttgtatttttagtggagagggtttcaccatgttggccaggctggtctcgaactcatgacctcaggtgatccacccgcctcggcctcccaaagcactgggaggtgcgagcccagctcctgatgttctttaagggtagtgctactggtttagggttacattattgtgggactggtagtcctgtccttagtgtggggttctatgagctggatagtcagaaaaagagcatacatttgggtcatcttgtttttagccagaaatgggtccagacaactctccatgtgaatccaggctaaggtgatttgatagcacttttagcatccttactccaatcttgagtcatgatttgagccacagggcaatctaggcattaaaatagagcagctgggtgcggtgccttgtgcctgcaatcccagcaccgtggaaggccgacctgcaaggatcgtttgagcccaggagttaaagaccagcctgcgcagtatggcaagaccccatgtctacaaatatatatatattttttaattagctgggcatggtggcacacacctgtggtcccagctactcaggaggctgaggcaggaggatcaccttagcccaggaagtcgaagctgcagtgagccatgattgtgccactgtactccagactggctgacagagggtgaccctgtctcaaaaaaataattaataatgataaaatagagcagattatgtataattttttttagtagtatttctcttcctacctgtcccttgatctggaaagtacttgaaaagatttatatttagtggttgagataattgtgacagttgaagagttctcaactggggtcagtattgcctctcgggatgccaggtggctgttacagctggggaaaggagcactactggcatgctgccagatatcctcctggggacacacacacacccctgcctaaaatgttcattgtgctgaggttgagacccatgctttgaaacttgatttggtggcacttttcgggtatgctcataggaccctgccccggagcgaggcttcgcttcctgaagtctggggtagtttgcatcattcactgtttactcctgtgtgccttttcacacccaactttttttctgaggtgaaattcacataacataaaccattttaaagtgaatgattcggtgccgtttagtacatttacaatgtgttgcaaccaccgtctctagctaattccatgacattttcatcacctcaaaaggaaaccctgtacccattaaataattgtccactgcacacacatgtgcatgcacacgcagacacatgcagcccctggcaaccactgcattctgtctctttggatttgtgtgttccggatatttcatgtaaatggggttgtatatatgtggctttttgtgtatggcatctgtcacttagcatatttgtgaggtttgtctgtgttctagcagagacaggaccaggacttcttttttttttttttttgagatggagtctcactctgtcaccccgcccaggctggagtgcaggggtgcaaccttggctcactgcaagccctacctcctgggttcatggcattctcctgcctcagcctccagagtagctgggactacagacgcccgccaccatgcccggctaattttttgtatttttagtagagatggggtttcaccgtgttagccaggatggtctcaatctgctgaccttgtgatctgcccgccttggcctcccagagtgctgggattacaggcgtgagccaccgtgcctggcaatttttgtatttttaatagagacgaggtggccaggttggtcttgaactcctgacctcaggtgatccacccgcctcaccttcccaaagtgctgggattacaggcgtgagccaccacgctcggcctcctttatctttatagctgaataatattcaattgtttggatagaccacattttattcatccattcatgctcagtgggtatttgggctgtctccaccttctggctgctgagtactgctgctaagaacataatgtgtacatgcattgaatccctgctttcagttcttttgggaatatacctaggagtagaattgctgggttatggggtaattctgtgtttaattttttgaggaactgccaaactgttttccttccacactcatttttactgccggaaaagtacgtgcttgcttgtacataagcagcataattgcaaaacgaaactactttaagtaaatgaattagaattcacagttcaactgggagatatttcagtttgttgattcatctactgactccagactagatgtgtgcatgtgagtttgcagactcacaagacactgaattaataggcaggtggtgacctgtgaagcctccacaagtggtcttttcacatagtttaatttgagggagcgattacagaagcatctttaaatgttctgaaatcaggccaggctcagtggctcaggcctgtaatcccaacactttcggaggctgaaacaggcggattacctgaggtcaggagtttgagaccagcctggccaacatagtgaaaccccatctctactaataaataataaaaggcatggcgtgtgcctgtaatcccagctactcaggaggctgaggcaggaaaatcgctggaacctgggatgcagaggttgcagtgagccaagatcatgccactgcactccagccagggtgacagagtgagaatctgtctcaaaaaattaataaatgtggccatgtgcagtggctcacgcctgtaatcccagcactttgggaggccgaggtgggcagatcacgaggtcaggagatcgagaccatactgaccaatatggtgaaaacccgtctctactaaaaatataaaaattggctgggagtggtggcatgtgcctataatcgcagctactcaagaggctgaggcaggagaatcactcgaaccagtgagtcggaggttccagtgaactgagatgataccactgcactccagcctggtgacagagcgagactgctgtctcaaaaataaaaaaaatacaataaatgttctgaaatcagaagaaatctagaattggacatattttcattccaccagaagtatgtcaagaggagtcagaaacctctcttgtgatctctgtcaccattcaagccaccttcctgggcaccagggccaggcactggatgggaccgtgtcagcaggagagggacagagggagggattggaagtgtcccaacatagacttgccaggactcacaaagtagttatttagtggcttccttgagattcagatgaaatgctctccactgtcatgccaaacaggcaaagtctggattaaattaatcttcagaatttgttgaattgtattagtgttgtgtctgtgtgtgtgtgtgcgtgtgtgttttgagacagagtctcgcactgtcacccaggctggagtgcagcggcacgatctcggctcactgcaatctccgcctcctgtgttcaagcaattctcctgcctcagcttcctgagtagctgggactacaggtgcctgccactacgctcggcgaattttttgtatttttagtagagatgaggtttcaccatattggccaggctggtctcgaactctttaccttgtgatccgcccaacttggtctcccaaagtgctgggattacaggcaggagccacggtacctagcttttttttttttttcttttcgagacggtgtcttgctctatcacccaggctgaagtgtagtggcgtgatctccactcactacaacctccaccttctgggttcaagtgattctcctgcctctgcctcccaggtagctggggttacaggtgcctgccatcacgcctggctaatttttttaatttttagtagaaacgtttttttttttagttcgctgccaagaacataatgtgttcttaaaacacattaaaattaaaaacatttaatttttagttagccacgttggccagactggtctcgaactcttgacctcaggttatgcgcccacctcagcctcccaaagtgttgggattacagatgtgagccaccgcgcccagactgttgtgtgtttttgttttgagacagattcttgctctgtcacctaggctggaatgcagtggaatgatctcggttcactgcaacctccacctcccggatttaagcgattctcctgtctaagcctcctgagtaaccgggattacaggcttgtgacaccatgcctggctaactttttttttttgtatttttagtggagatggggtttcaccatgttgaccatgctggtctccaattcctgacctcaggtgatttgcctgcctcagcttcccaaagtgctgggattgcaggggttagccactgggcccggcctgcattagtttttaaattgttactgtaatttttctagtgataggattctaacctctgtgcccatacttttcagtttaattcaaggtattttccctggggcatttctaaggattcttaaagaagttgagatctgatttcttattttgttcccatgctgaaaaacaaaatatgacagtactgctaaataaagcaattttgggggagaaatagtaatagggaagggtcaaatttatgtgtcgttgcataaaatatagctactagcaaaatagaatattttattcacaacctgagtgcaatacaaatacagccttttctgtttgtttcagacaaatttacatgtattggagaccagaccagaagcccttctgaattaaggtaattttgatatatttgatcctcatcagttttagaaagacaatatataaatttcttcagagtttgtttttataaatagctggtgggttggttttttaaagagacagtgttttgccatgttgctcagactggattctaactcctggggtcaaggggttctctcacctcagcatcctgagtagctgaggctatagacatacgccagcatgcctggtcaataccctggtttttgttacagtttttttctatctcttttaagccaaagttggttttcaaaacaatttgatcctcaaaaaaagcttccatttagtgttgagcaagaaggtttagggtcccagtgatgaggatttaccttctgaatcagagtggtacatcgctagtttttttcgttagaaagcaggagagcccttttttcaaatcagatcttagttgaaataccaatatatggccgggtgcggtggctgatgcctgtaatcccagcactttgggaggtcaggttgggtggatcacgaggtcaggagatcgagaccatcctggctaacacggtgaaaccctgtctctactaaaaatacaaaaaattagccgggtgcggtggtgggcgcctgtagtcccagctactctggaggctgagtcaggagaatgatgtgaacccaggaggcggagcttgcagtgagccaagatcataccactgcactccagcctgtgggacagagcgagactccgtctcaaaaaaaaaaaaagaaaagaaaaaaaagtaaggtgaacatgattcaggaaaacaaaacaaaacaaaaacctttttgtttgaataaagtgggaataatgaagccatgttcgtagtgagtgagtctgggtgaggagggtacatggtttctttgtattattcttgcaactctttgaagtttgaaataattttaaattaaaaagcaaaattaaattgaatagcaattaggggctggaacaattggatattcttttttttcttttgagacagagtcttgctctgttgcccaggccgaagtgcagtggtgcaatctcagctctctgcaacctccccctcccaggttcaagccattctcctgtctcagcctcccaattagctgggattacaggcgctcaccaccacacccagctaatttttgtatttttagtagagacggggtttcaccatgttggtcaggctggtctcgaactcctgacctcaggtgatccacccgccttggcctcccaaagctgtgggattacaggcgtgagccaccacgcctggttagtcaattggatattcttacgcaaaaggagaacttgacatcatgtacagaaattaactcaggccaggcaaggtggctcacctgtaatcccagcattttgggaggccaaggtgggcagatcatcaggtctggagatcgagaccatcctggccaacatggtgaaaccccgtctctacgaaaatacaaaggaaaagatttagccacgtgtggtggcacgcccctgtagtccagctactcaggaggttgaggcaggggaatcgcttgaacccaggaggcagaggttgcagtgagctgagattgcaccgttgtgctccagcctggtgacagagtgagactccgtgtcaaaaaaacaaaaacaaaaacaaaaaggccaggcatggtggctcacgcctgtaatcccagcactttgggaggccaaggagggtggatcacgaggtcaagagatcgagaccatcctggctaacacgatgaaaccccgtctctactgaaaatacaaaaaattagccaggcgtggtgatgggcacctgaagtcccagctactcaggaggccaaggcaggagaatggcatgaacccaggaggcggagcttgcagtgagccaagatcacgctactgcactccagcctgggtgacagagtgagactccgtctcaaaaaaaaaaaaaaaaattaactcaatggatcatatacctaaatataaaacgtaaaattagaaaaaatgagattttgaattaagcaaacagtttttagatgtgagatcaaagatagaatgcgtaaaagaaaacatttataaattgaatttgttcaaaatttaaaacttctgctccttagaaaaaacagagaacgaaagacaaaccatagtctggcagaaaatattagcaaatgtcttttagatgacttgtatccagaataggtaagaactctcaaaactcaattttggctaggtactatggctaacacctgtaatcccagcactttgggaggaggattgcttgaagccagttgttcgataccatcctgggcaataaagtgagacccctgtctcttcaaaaaaaaaaaaaaaaaaaagttagcagtcgggcacggtggctcacacctgtaatcccagcactttgggaggcccaggcaggcggatcacctgaggttgggagttcgagaacaacctggccaacatggggaaaccccatctctactaaaaatacaaaaattagctaggtgtagtggcttatgcctataatcccggccatttgggagactgagacacaagaatcacttgaacctgggaggtggaggttgcagtgagtccaggttgtgcaactgcactccagcctgggtgataaagcgagactgtctccaaaaaaaaaatttagccaggcatcgtgttgtgtgtctgtagtaccagctacttgggaggctgaggtgggagaatcacttgagcccgggatgttgaggctgcagtgagtcacgatcacaccactgtactccagcctggacaacagagcgagaccctgtgtcaaaaaaaaaaaaaaaaaaaaaagcaatattaagaaaacaggtaacccaataaaaaagaggcaagtgacttgaacagacactttaccagaaactgtatagacagcaattgagtgcctcagaagctcagcagtcagcgagatgcagatggagactacagcccacgcccccattagaatggctgtgacacccacccagcgttgttgggcgtgaggagccgggactctccacattgcttataggatgttgggaatgtgacccagcataaccattttgaaaagagttggttttttttgttttttgagtttgttttttgtttttttgaaatagggtctcactctgtctcttagactggagtacaatggtgtgatcatagctgactgcatccatgacctcctgggctcaagtgatcctctggcctcagcttcctaagtagttgggactataggcacgcactaccatgtctggctttttttttttttttttttttctttttttaattcttgtaagacggggtctcagtatgttgcccaggctggtcttcaattcctgggctcaagtgatcctcctgccttgcctcggaaagtgctcagattatagtcatgagtcactgcacctggcctggcattttcttggaatgttcaacacacacctgtagtatgatccagccattccaccgctaggaatctgcccaagagaagtgaaagcagatgttctcataaagacttgtacatgtaacaacatgcacagatttcaaagtatcacatctatctgattaactccactgttacactggttgccactgctacatatatttttgatttctgcaaaagggcctactgcactgactggatggaaagtgtggcaggtgaggcaggaggtagttttctggacattacttaaaactttcagggcaacagttttacacctgctttcatagcaagtcatatttagtaagcatttactgtgtcagtcatggttctaaggggcttgcatggattctaatggaattgtcatagcatgagctgtggggactattactgtccccactttcagacaaaaaaatgtaggcagagagaagttaggaaacctactggaggccacctggtgagaagagatagagtctgggttagaacctggggcttccaactttcctgccatgaagcgtcactctgcttccagccagggctgtcagacatcattggtcctgcttaagtgggctggacctgcaaatgccaataaaaacacggaagtttttctaggaacagaattctaacccccaccgcccatttgctgttgggaaagcacatagtattcattgtagtttgcagcagtaaatgtaaaaacaaagattatttttatatactggagtgcagatggcatggcacacagcagtctttccctaaacctaaggatttccaggccccttataaaaggtgcttggaggccgggtgcagtggctcacgcctgtaatcccagcactttgggaggccgaggtgggcggatcatgaagtcaggagatcaagaccatcctggctaacacggtgaaaccccgtctctaataaaaatttaaaaaattagcagggcatagtggcaggcgcctgtagtcctggctacttgggaggctgaggcaggagaatggcatgaacccgggaggcggaggttgcactgagccgagatcgcaccactgcactccagcctgggcaacagagtgagactccatctcaaaaaaaaaaaaaaaaaaagtgcttggagtttagcctcctctgttgtgtgcgctgcatgattgttagtttctcaccacctttccctgttagacccgtcttctggatggatgccattcatttcatgagactccatcagttacatataaagtttggctttgaaatgatcaaagtgggacttccaatttggcctcaacatgtttgaagatgtgtatctattgaatgatttccaattgtcctagtatgtgctagattttgtgctccgccctaaaagcaaaaagaggccataggctaacagggttagaaaagggagagcagaatgggagatcagatgttttttgtgatgcatgagaaataataaggcttcgggagagtcagtagccacttctgggatttcagagttccaagggtcagaggtaagctcttagcagctgtgcctcactggctcacccctggctgttagacccctccctggagaattgccttctgagggctttgtgaccgcacaccatagttcctgcccttcccccagttgccagcgtctgatgggtgagtgagctcacttgtgactgggacatgaaggagatgattctggggagtctcttcacttagtccagaaatcctccctccattgtttgctttctctcctttttcccttgaagtttatttgttaaagacagactaaccgacctgcctggtcgtctgtcctggagtgtttcccaggccattgtgtagtaccgttgcctctgtggggtcattgaacatgtttccctgtcttctagttctagagctttggtcacattcactttttcgttaagattactttataggcacaggcaaaatcctaaggtaagatttttaaaattgttaccattgcaaaaaatagcacctcaaacaagaacagttgtgttatttttgcccatctgcctgctgctcaaatgttggcccattagcaaggtcatgtctaacagccatgcaaagcagcatcctccctgccctcgttggcacacttcacccgttcgcagtgactgtgtacgctcccagcctctgtaactccacgtgatttacctgtttgtcttctgtctccctcaaactagaatccagcctggttcatgctgctcagcaccatgctgaggctctacagtgcctgttgtgttggagggagggtctgcgcatgcgttgctctgcagctgcgttagtggtcgtgtcctttatcagttgcggtggtcccctgctccccttattcctcacagtattgttaggagcggtgcgtaagggaagcagggcctgaggactttttccgttgccctttgaattcccacagtcttagttttggagattgacctggacttgggaatgaaagaaaaatggaaaagtgagtgaaattggtttaaattcctcatgcaaactcctctctttcaaaatgctgcttcgtcttggaggtgagctgtgatccttgtgtgtttggtcaagttagcaaatttcctgccccggtgtaagacactggggccggtttggacttcggaagttgtccaaaccatccagagatgcagccatccagtgctgcacaggaggctcaggggtgtgcggctagctggtgaccaggtgactcaggactgccctgttgctgcttggtggtgggaccacatgtgtgcactttggtgagcatggtgcctgttgtccttgagattgttagtcaaaggtacacgtcatagtttaatcactgtgagactgacagagcactttcagattggttgtctgatttaattttcattttagctctgtgatatagataacaccattcccattttgaattaagcagattagagtaaaaaacaatttagtgaaagcattattctttgtatgttgcagaaccagaacttgaaattatttttcaatatctgtaccctattttgtcattggcaaacttgcagcctgaatgttgttattggtgactgtgtaatatggggtcctgagggcaccgctgaggtgcccctcctagactctcaggggtctggatgagaggcctgggctgctgcattgccatgaagggtagaggcactacacggagcacattgcattgcaaatatgaaatattctgactttaaaaatcttgctaacacttgactcacaaagatgttgttctaaagtaggggcagatcccttcacctgcttgcttttaagttattcaaatctctctcaaaaggatttccaaaactcagattctgaataaaagccaatggcagatatgggtcatcaggaagactagacatgaggccttagcagagcctgtcttagtggattagacgggcgggctcttggagtcagcacagccagagcttagccgtgacgtcggcaccggaggagaggagcccaggccagggaaacctggtggtgggtgttctggaaggtctgggggactgagggaagcgaagagaaaagcaagagcaattaaatgtgagtaagacttttaaaatttacatttattctttaattttcaaaggaagctgcatcaatattacgtttagtagaaaaacgtgactaatagttataataaaaatgctattctatctttctttaaagtgagtatatttttcttttttcttttcttttttttttttttttgagacaaggtctcactccatgtgctcaggctagagtgtagtggaacagtcatggctcactgtagcctcaatttcccaggctcaagtggattctcccacttcagcctcccaagtagctgggactacaggcgtgtgccactgcgccagctaatttttgcatttttagtagagaccaggtttttgccatgttgttgcccagcctggtcttgaactcctgagctcaagccatctgccagcctcagcctcccaaagtgctgggactacaggcatgagccaccgcgcccagacctattttaattataataaagcagctacaattactacatgtgaccgggtgcgtgtaatcccagtactttgggaggctgaggcaggcagatgacttgaggtcaggagttcaagaccagcctggccaacatggcgaaaccctgtctctactaaaaatacaaaaattagccaggtgtggtggtgcatgcctgtaatcccagctacttggggaagctgaggaaggagaatcgcttgaactcaggaggtggaggttgcagtgagccgagatcgcgccattgcactccatccagcctgggcctcagagctagactcagtctcaaataaaataactatatgcaaatttatattatttttgacttagtatatagtaagcgttttcccaaattattactgtcttccttattgttcttagcaatatgttacagttattccagtaactatttagagacaggatcttgctctgttgcccagattggagtgcagtggtgctatcatagctcactgcagccttgaactcctgggctcaagcgatcctcccacctcagcctcccaagtaggtaggactacaggcacgttccacgatacccagcgaattgcatcaagtaactttttttttgagatggagcctcattctgtcacccaggctggagtgcagtggcacgatctctgctcactgcagcctccgcctcccaggttcaagccgttctcccacctaagcctcccgagtatgtgggattacaggcacgcatcaccacacctggctaatttttgtattttttagtagaaacggagtttcaccacgttggccaggctggtctcgaactcctaacctcaggtgatccacctgcctcagcctctcaaagtgctgggattataggcttgagccattgcacctggctgcatcaggtaactttaaaaagttaactttaggctgggtgtggtggctcatgcaatagattagagtctagcgctttgggaggccttggcaggaggatcacttgaagccaagagtttgagaccagcccgggcaacatagcaaggcctcgtctctaccaaaaatttcaaaaatagctgggtgtgatgggtggagtctgcttgtagtcctggctactctggaggctaaggtagaaggatggcttgaactgcagtgagctatgatcatgccactcactccaccctgggcaagagtgtgagaccctcacagagattttttttaaaaaatgtaacattaaggctgggcgcggtggctcactcttgtaatcccagcacttcgggaggctgaggcgggcggatcacgaggtcaggagatggagaccacggtgaaaccccgtccctactaaaaatataaaaaattagctgggcgtggtggcgggcgcctgtagtcccagctactcggagaggctgaggcaggagagtggcgtgaacccgggaggtggagcttgcagtgagctgagatcgcgccactgcactccagcctgggcgacggagcaagactccatctcaaaaaaaaaaaaatgtaatattattttattgaaactgaaaagtataaagaaaaaaatgtttctttgttctaggaccccagattagcctctgttaactttgtatgcgtgtgttggtgtgtaggggggttagtaagcaaactatatttgaagaataatgagaagaataaaagctgctaacctgtttctctttctccaaaaacaacgccataacatctggtgtgtgtagaaaaaagatggcgggccgggcgcagtggctcacacctgtaatcccagcactttgggaggccgaggtgggcggatcacctgaggtcaggagttcaagaccagcctggccaacatgatgaaaccctgtctctactaaaaatacaaaaaattagccgggtgtggtggcatgtgcctgtagtcccagctactcgggaggctgaggcaaaagaatcgcttgaaatcgggaggcggaggttgcagtgagccagcactgtgccactgcactctagtctcagcaacaagagcaaaactccatctcaaaaaaaaaagaaaaaagatggcttgccctggcattggcgtttgtccttcttgtacacacaaaagcatcatgctttgtacactgttcgtttttgtttcgttcactgtcttcacggtaaagatgaactaagagccactgagaaggctgtttatgggaaccagaaggttgtttgcttcccttaagttcgctcttcctggcacctggtgcccttgcagcccatggggaatgtgatggtcacgttttctcgtctctcctgcctcatcccatcagccagttcactgctgtgcctgaactcctgtacagggtgtctggtgcatgtccacataacaaaaagatggtactgatcattgagtttatctccaaaaatttttttcaatttgattgtagaaaatacatttttaggcggggcatgatggctcatacctgtaatcccggcatttgggaggccgaggcgggcggatcacctgaggtcaggagttccttacagcctggccaacgtggtgaaaccccgtctctactaaaaatacaaaaactagccaagcgtggtagcatacgcctgtaattccagctactcgggaggctgaggcaaaagaatcacttgaacctgggaggcagaggttgcagtgagcagagattgcatcattgcactgcagcctgggcgataagagtgaaactccgtctcaaaaaagaaaagaaaagaaaatatatctttatcctggagactagagaatgtaatttttttaaaaaaattgaaatgcctgacaatagatttttcttatcacttctatgtgtggactgaagagggcctgaccaggaaatttatttttattgctaacaaaaattgtgtgtgtgtgtgtgtgtgtatgtgtgtatgtgtgtgtgtacacagcgttttgccatattgcccaggctggtcgcaaactgctggattcaagcagtcctcccgacttgacctcctaaagtgttgggattatagcccaccatgcccagccaggaatacgcctttttaaaaaaaattgacaaacgtaggttttgagtctctgaattgaaactcaaatgttggcacagcagagtgctataataatttctgctattaactatgaaaaagaagtccgtctggtttttttctctttgcatgtgactaaagatgaaagttagcgagttttggcattactacttctgaaattttgtgaggtcactaagttatattgagctcattttaaagatacttagatttttggtaaatttgtttctctagtctcaagcaatacagctgggtgattgttgtgtacatgttcttgtataatatgtgaaaagaacatctaattaaaagcagtatgtaagatttcaggagttatcccacctaatgatggaatttgggcctttacacacccacccaccaccctccagccacaagaaacatctctttttttctcgagacagagtttcgctgttgttgctcaggctggagtgcaatggcaagatctcggctcactgcaacctccacctcccaggttcaagcgattctcctgcctcagcctcccgagtagctgggattacaggcacacaccaccacgcctggctaatttttgtatttttagtagagatggggtttctccatgttaaccacgctggtctcaaactcctgacctcaggtgatccgttgtccgcagcctcccaaagtgctgggattacaggcgtcagccaccgcccccagccggaacatcatttttgaagcatctcagaacatgcgtttctctttcccgagatcccaggagtttgttgtttttagtcccgtactataaaaattagctttactttttagtgtttaaatgatcagaaactgtgtgtgttaactaaaacagtttaattcggggtacttcataacattaacttgttttcttcatgttgattttggaaggattaaagtagctttacagactaagaacaattctctattatgcgtgcggggtgctggtgaaataaaactacccccaactctgcaaaattgtgtgcataatataatttgatcatgtgtgaaatacaagtgagtagtgtcagggcatgcagaaagaatgcaaagcacaaggcatccagacagcttccatctgagacactgctcatcttgtcctggcactcttactgcttaacacattaacgtccacaaatcgcagtcgctaggatttatatgtgaaaaccagggaaagaattaaccagtcttatcccttaagaataaactgcccttgaggtgtgaccttgtccatacctaattccggtgatgctccatgtgtgcagggaggcctgaggtatttttccttagtgaagctttcctcatgattaaaacatccgtttcaaataatgcctttagaaacaactatttggtcagaaatctttctgacaccgtgttgctgtgcagcctgcctccccagagagcagtggcagcaggatgcctggtctgcgtgctcgtgttacggggcatgccttgcaggcctttctggttctgtggaccgtagacatcaagtatctatactgtaggttattcgaattcctttaggcacactaggaaagttcagactggaaactgacggctgagcttcttaggtcatcggatagtttcccacagatgggttttaatctcaagaaaataactgctatcagttagattttgatgtatattgtattagccttttgacttacacaaaagttataatggtaaaattgatcctctgtgtaatttatgtaggaaattgaagtgcttgcataagccgtacttgcatgtgagagctaattgtaagggattaaagacattagcaactgtgtcctcagctttgttatacttgagtcatacttaacagccaagatcttcagtcatacattaacagctaagatcttggtcagaaatgcagcctccatttatgacattctcttgggaaaataagtctcttgtttaacaaggtgatttagtttttactttgatttcaggaatattgtctaacgtgagtagggcgagaaggcagggcggcttgtactgagcctaatttagcctgcacctataaggatcaaggtgttgtttctgagcctcctgggatcccagggctcacttgggtgggagagtgggttgtccctgagccaaaaaactgctggacacaccctgtgtgctcaggattgctgtgtgagcatcctgacagcttttgaccagtagcggttcatggttactgagatgaggtggctttgagattcttggttgccaggttgccactcacccccgttccctgaagtaacttcccctaggtcttcatgcgatagctatcctaagtgtcaggttttattttttttattttgagatggagtctcgctctgtcacccaggccggaatgcagtggtgtgattttggctcagtgcaacctctgcctcccaggttcaaatgattcttctacctcagcctcccaagtagttgggattacaggcgtgtgccaccatgcccagctaatttttgtatttttagtagagatcgggtttcaccatgttagccaggctggtcttgaactcctgacctcaagtgatccacccgccttggcctcccaaattgttgggattacaggcatgagccaccacacctggcctaaatgtcagtcttatgttcttggatttatagggagacctagatttttttatgaaaaatgcttaacagatttttctttttataacccaccagcatatgttgagtagtattttagacattgtaatattatgcaaagccaataaataatcataattatattttatttacctggccctacttagccattgtataagttctgatgaatgctgaagaaaagttctctggtttgtaatgagaccatagttctcagactttccttttttttttttttgagacggagtattgctgtgaagcccgggctggagtgcactggcgccatctcggctcactgcaagctctgcctcccaggttcacgccattctcctgcctcagcctcccaagtagctgggactacaggcgcctgccaccatgcctggctaatttttttgtatttttagtagagaaggggtttgaccgtgttagccaggatggtctcgatctcctgacctcgtgatctgcccgcctcggcctcccaaagtgctgggattacaggcttgagccaccacgcccaccttaaactttcaatttacttttctcacctgcttcattaaattatccaacagttgtttattgattgtgcttgtctttctgtttcagatctcacattcttgaaggtggcattgaagagcactaagatcggaagatgagtgagcttgaccagttacggcaggaggccgagcaacttaagaaccagattcgagtatgtagttgtgtgtgcttggttttattaatcatttgagtttcaggttagatgttacttgttttaggaaaaatggtttacaggatgacttgttctatgttttatatgaaattgaatcttagttggcccaggatgtactaattatagatctagatacttagcctagtacattgtttttgggattttgctttctgtatacaatttgttatttgaatatacaccagatgtctccgtagaatttataagtgtcttttgcattctttatcataaccttgaaaatttgtgataccctgggccactgatcagactgtgatatctacctccctcccctgaatattgggactattgacagcagaaaacttgcttaaaagtaagagtattaacaacaataaaaaaagtatttcaggtatatctgatgtattttttcctaattttgaaagatcttccctagcggtgatgattggaatctacagcttctgatagactgctagatggagcagatatatctaaatccaagatagaggccgggtgtggggggctcatgcctggaatcccagcagtttgggaggccaaggcgggtggatcacctgaggtcgggagttcgagaccagccagggcaacatagtgaaacccccatctctacaaaaaatataaaaattagctgggtgtggtggtgtgtgcctgtattcccagctactcaggaggctaaagtcagagaatcccttgaacccgggaggcagaggatccagtgagccgagattgtgccactgcactccaacctgggcgtcagagtgagaccctgaaaaataaaaaaaaaattgaagataaatttatttaccgtgtgtaaataaactgcactgtaaaaagaatacctttcacagaattctaaaacattaaattccagtctgtgactgatgtaggatgttaaattgcagagttcataaacttttatttgagagagagtttcactctgttgtgcccaggctggagtgcagtggcgcgatctcgtctcactgcaacctctttcaagcaattctcttgcctcataactttctgaaaagggaggagcagtaggtctaaatggaattcattctgctgctcctacttttgtgaagcagtacttctagtaaatattttatagagaaacatttaatgcaagtatgtgtttcctttctgaaactgctgatgtgaagagtaagagaaaaagaggcagacttctcaggaaaaaccacgtcttcagtatgtttttaggttttgtccatttgatgtaagagctttctcttactcttgtttgctctgtcaagctttagctgttcttcagagtgtcgctgtacaggaagctgatgacattcagtacatacctaaataacagtttataagctgggtatggtggtgcgcgcctgtagtctgagctacccaggaggatcacttgagcccaggaggttgaggctgtatagtaagctgtgattgcaccactgcactgcagcctaggtgacaaagtgacaccttctcaaaatacagtaaaataaaataaaaaacaacagtttatttttctgactccagtgcaaggatgaagtcaagtatttccttttaaacggccaattacatgtttagaaagcccaccaggatttggagagagaaacaccaacataattttaggcaacttgttcctgaacttgagaaaaaataatggaattctctgagatttacagccaaagagaaaacaaagtatcctctactgtaagaattttaaatcttaacatttaaaagatcttacataggtgaatagggaagacttagatttttttaatagtttgctctgatcagacttgtttaacatgtcccctccaccaaaattaatcaaatgtgttctgaaatatttagtttgatataaaattattctctgaaatatctatttaaataaaaccaaaaggtattcaaattttgcctgacttaatacttaagcttctgctgttcattttaagtcagcatggtttttggcaagtaaaaaagaaaagcaaagtgttgttatttaataataatctaactgggtttttgggggggttcagaacactctcagctctttaccacctgcttttgagactatatttcatcttatagaaatcagatttttttttttttttttttttttttctggagacagtctcgccctgttccccaggctggagtgcagtggcgcgatctcagctcactgcaagctcctcctcctgggttcacaccattctcctgcctcggcctcctgaggagctgggactataggcgcccgccaccacacccggctaattttttgtacttttagtagagatggggtttcaccgtgttagccaggatggtctcgatctcctgacctcgtgatccgcccacctcggcctcccaaagtgcggggattacaggcatgagccaccacgcccggcctagaaatcagaattttaaagtttaccctgaaaatgtcttaaatagtagggtgatttggcatatttgaagaaattttgtttttctgacagctataagttgttcacaaatagtggacttggatctattcatagcagatggaaagagcttgtatggcacaggtgaaagacacccaaatttaaaaaattaaggccaaaaggaactgttgcacctccttccgaggtttggaccctgtcacgttgtgaattccccagggccttcttgcacagggggctccctcttgggctggcacaaatgtcacgtgacattccccacatgctcttgttgccacataaaaaatgtaaaaagaggtcgggcgcggtggctgacgcctgtaatcccagcactttgggaggctgaggcatgtggatcacaaggtcaggagatcgataccatcctggctaacacggtgaaaccccgtctctactaaaagaaaaaaaatacaaaaaaaattagccaggtgtggtggtggtgggcgcctgtagtcccaactacttgggaggctgaggcagggaatggcgtgaacctgggaggcggagcttgcagtgaggcgagagcgcgccactgcacactccagcctgggagacagagcgagactccgtctcaaaaaaaaaaaaaaaaaagtaaaaagagagacggccaggcaccgtggctcatgccgttaatcccagtactttgggataccaaggcaggaggattgcatgagcccaaaagcttgagaccagcctttgtaaggtagaaaggccctgtcttttgaaaaagaatgaaaagaaacgggtggaattaaccctaacaaggtttttttcatttttttgtttgtgtgttttgagacagggtctctgtcagtcattcaagctggagagcagtggtgcgatcacagctcactgcagcctcccgagtagctggaactacaggagcatgctgccacacctggctggtttttttcaattttgtagagacagagtccaccatgttgccccagctggtcttgaactcctggggctcaagggatcttcccgcctcagcctcccaaagtgctggcaggtgtgaaccaccatgcctggcccaacaaattttatctaaggcagtatatctaaaatattatttattatgcaatgtgtaattaatacattttaattgagatatttgacactgtttttgtcccaagtctcctggttccgtttgctgtgcgcagcagccacaggcaggtcatggcccccgcggtgggacgttcactaggagaggcgcctagctgctttgtctccgaagtaccaggaaccgcgctgtgttagttcctttgcacgagacagggacagcaaaagctgttgaagtccttttaccccaaatgggaaaggaagacttatttttaaaatgtagaacattttttcctgattgcccaaggaatacatgcttgttaaagaatgcagagcatagtgaatcaaacaagaaattgtagatgattctaaaaggggctgttttctttcttagatttgtttttcagccaaaagacccttaaaggaccttgcatgctccttttgattattattgaggaaacacaggctctcagagggattctgattaaaacatggtgtgccttaaaatacacagagtagctgatggagtaaggaaagctccacaggatgcacaggcgtagatgtgttctggagcggcatgccagccagtgcaagggagcagggtccattcgtgcgagaggcagctgcaatggatgcccggtccaaaatgtccagcgactccatgctgagcagggcccaggctttaatttaggatgaaaccccaaagtaagtgtgttactgtgtcatttgacaaatccaaaaagaatgagaaatcaactgatgagtggcttggatatgttcatctctggtttaagtggacatcataatatgtatctacaggagtccattaaactggaaattaatctgaaagaacttgaagactttttcttctttgttaagcagttatagagcttgtttccattaaaagacttcttcctacagttttaaaagttgaaggtgtctgttctgcaaagtgctgcactcagttaaataagctggttattggctaaaataaagattgaattgaagttatctgtgtgttgtttttacagtagtttttccttcggtttaacagtagtatcaccacagtctgttacactgtaccttaagaaactcattttagtcattggacactaaccgggggaagttgcttaaatctcatgttttattttctccattttaaattttcttatgatgttttaaaatcaaaggctgtaacatcaacaagaatagtatttcaaaaacaaatattaaactcagtacttgccagtaaaattcattgacaaaaagacttctgctgctctaagtattcttcatcccccttactccaaatgttactgcttgcatagaaatactcgatttttttgtgtgtgtcttaattataagcagaatgaccaataaagagcttaactaaagatgaatttggaatgtataaatttggtatatttataataatctcagtatagttccttttttttttttttttttttttttaaacagagtctcgctctgttgcccgggctggagtgcagtggtgtgatctcagctcactgcaacctctgcctcccaggttcaagcgattctcctgcctcagcctccccaaatagttacgattacaggtgccggccaccatgcctggttaatttttgtgtttttagtagggatggggtttcaccatgttggccaggcttgtcttgaactcctgacctcaggtgatccacccacctcagccgcctgaggtgttgggattacaggcatgagccactgcgcctgaccaatatatttccatattatcagtttataatattcccacaagcttcctaaagtagaaatcatttgcagtgagcagtttgccccaaaagcctgaaccgctgggaactcgtcctccaccttccccatgtggggcacttggacgcacgcctgtaagggctgcacatgccatttgccattttgaaagtagatggtcagatgacagcatataaacacatttttcttactagaaagtgtcagctgggcatggtaactctcccctataatcccaacactttgggaggccaagggggaaggatcatttgagcccaggagttcaagaccagccacaggcaacatgacgagatccccatctctacaaaaaaaaaaaaaaaattagccgggcatagtaatgcatgcttgtagtcccagctattcaggaggctgacgtgggagggtcacctgagcccaggaggtcgaggctgcagtgagctgtgatgacatcactgcactccaggctgggcaacagagccagatcctgtcataaaaataaataaatacatagtttaaaaaaaaaaagaggccaggcggggtggctcacgcctgtaatcccagcactttgggaggctgagatgagcggatcacctgaggtcaggagttctagaccagcctggccaatatggtgaaacctcatctctactaaaaatactaaattagccggtgtggtggcacacgcctgtggtctcagctactcaagaggctgagacgggaagaatcacttgaacctgggaggcggaggctgcggtgagctgagatcgcgacacagcactcccgcctgggcaagacagagcgagactctgtctcaaaaaaaaaaaatagttgtgattaaaaaaaaaattataccaacactcaaactttaaacctgttagccattgtcttattttccttcatgttacgtacctttctatttctaaacgtacgttctcttttgagatttccaggtctattttctagtaactttgatcccttagtaatgaagacacttgagttagcattggtggatcccttcacagtgcctacctgcagccgcaggtcatttgtagatgagcaacgagaacagccaagaggctcatgtacatctgattgtctggctccaggtcccttgctcgttttccatagaatttatttatttttctttgttttcctttattttattttattattatttttgttttttttgagatggagtcttgctctgtttcccagactggagtgcagtggcgcagtctcggctccctgcaacctccgcctcccgggttcaagtgattctcctgcctcagcctcctgagtagctgggattacaggcgtgcgccaccacacccagctattttttgtatttttagtagagatggggtttcaccatgttggccaggctggtcttgaactcctgacctcaggtgatccacccacctcggcctcccaaagtgctgggattataggtgtcagccaccacacccagcctattttccttaaatttttaatttttatttttagtagagacaaggtctcactttgttgcccaggctggtcttgaactcatgggctcaagagatcctcctgcctcagcttcccaaagtgctaggattacagacgtgagaccgcgccctccatagaatttagaattaatgattgtttctcttgaaaacaaagtacttagttaatgcagtctgaagaaaagtttttttgggctgggtatctggtcctttttagacttttttttttttttttttttttttaatagaccttttctttgggccacagccttcctgaccctagatgggctttgtaaaaagagcaagtcgtgtgtgccagcctgtgcagcagtgagggcacaggcagcaccagggtcccgggtgtgtgggtgctgccccagcttgcagtgtggtctcctcggtgctggccacagctgtgggtccccaggaatattgtgctgcaggtcttagacagatttgggtactactggttctctgttcagcgtggcctggacagtccacagatggtagtagaccatggggtgttgagatgcaaggagactctgccgttctttcacattctgcttttgctcctgacagcttaggaaagctctctttgaaactttggtatgtgtggacctgagattgaatgtatctgaaaggttgctaatttctcactgtccttgcttcccaggacgccaggaaagcatgtgcagatgcaactctctctcaggtaagagcccactgagtcacgcagagccatctgcctgtgaggaggctagcacggcacccacacctggagcctcgggagggctctgcttgcattctctgttgcgcagtgaggatgccaagccactgcttttattaagaagtcattctgatggtaggcataggaaatagaggggcttattgagataaaaatgagatatctcaagccttgaataatcatctacctgttacagagggtaatagttgtaaaatattgttattgtcttaagatattttgaagctcctctcctcaacagaatctgcctcagaacttctatttctaatatccaatttgataatacctcaaaaagttaaacatagaattattgtatgactcagcagttctgccattaaatatatgcccaacaggattgaacactgcttttcaaacacacacatgtacatagcagcaccattcacaatagccaaaatgtagaaacaaccaaaatgtgcataaatgaatgagtggagaaacaaattgtggtgtctctgtgccctggagtattatcagccattaaatggacgtcagtacagtcagaggctgcaacgtggataaaccccataaatattacgatagtgagagaagccaaacaaatggctatgtattgtttagttctatttatatgaaatatctagaatagtaacattcactgagacagagtggactagtggccagcaggggtgttaggggagagagggagaggaagtgaacagggagtgactgctgaatcaatgtctggtctccttttggaagatggtttggaactagatggtggcagtggttttacaacaatgagtgtactaaatgccactgaactgtagactttaaagtgattaattggatgttacgtgaacttcaccttattaaaaaaatgaagtccatcccagcactttgggaggccgaggcaggtggatcacttgaggtcaggagttcgagaccagcctaaccaacatggtgaaaccctgtccctactaaaatacaaaaattagccaggcatggtggcacacacctgtaatcccagctactcagggggctgaggcaggagaattgcttggacccgggaggcagaggttgcagtgagcagagatcgcaccactgcactccagcctgggagacagagcgagactccatcttaaaaaaaaaaaaaaaaaaaaagataataaaaataaagtccaaataattggacagaaatgtgaaagaaaaactatattcctacttctactgaagatgattaagttttttacattgtctaaatgctttaggggatgtgctttaattgaggttaaattgtaagttaaagaaaaaaaaattaggctacatagaattacctgaatttcaattctgagaagcactttggactgtccgtttttaaaacccactattgtaatccacttactccgtttgccaacctaaactcattaacatcagtgtctatatgtaggatgggctcagcaggtgtgtgtacagctggtgctccaagtgatggtcgtgcagaagcaggtgtcatgcaggcccacacatagcctgacataggaaccagctattaaattgtggtgtgggacatctgtgtggtgtcataagaagagttgcgagatctcaaagaactcagagacctaggaggagatggtcctggatggacagggagaggaggaaggaagcaggaagggaacagcaagtgcttcaaggctggccatgttcgtgtgcgtgcattggagggcagggcacacaggttcctgatgaccagccagactgagacttggtaagaggtacggaaggggttcagtgcagaatgccacagtggaagccactggagaactgtgggaagggctgggaagaggtaggcacagtgggcgagccaacagccttgacaaggatgggtgatgaggagaatcgtttaatcacagatgttgatttacagaaatgtttttattttcaagatcacaaacaacatcgacccagtgggaagaatccaaatgcgcacgaggaggacactgcgggggcacctggccaagatctacgccatgcactggggcacagactccaggtaggcgtgggcatgagcaggatgctgcttgttacattcaggggctgctctgttgtcctaggggaaaagtacctgaacccatttgctgtgctgtgcagtgaagaaattaggaagttgaatcagaactctgggcacgcaaggtgcagcgttcacaggtgcatattccctgtccagttttccacttacctgggctgaaagaacactgccatttcttcactgtctgaatcacattaatacaagttctgatttttctttctcccttctcctgtctctttcagtttctagacctctgtcttcccagttctactgcatcctacttatgtgaacttggggaagttacctctctgtgcctgtttctcagggctggttggccctcgccctcttgtgatgtcagtgccctggctcaggaaatcacagaacctgccccgaggatcctgagggattaagtgtattgagccttagaacagcattgtgctgtgtgtgctttgctgcggcagacacacgggaatgcgctgtgagctgctctcaccattctctcatctggcctgtctgccctgccttcctttggtttaccatcccaagagataattcccttcatgggctcctatttgttcttttcttttctctttttttttttttttttaaagacggagtctcactgtgttgcccagcctggagtgcggtggggcaatctcggctcactgcaagctccgcctcccgggttcacgccattctcctgcctcaccctccctagtagctgggactacaggcgcctgccaccacactggctaatttttttgtatttttagtagagatggggtttcaccatgttagccaggatggtctggatctcctgacttcacgatccacccgcctcggcctcccaaagtgatgggattacaggcgtgagccactacgcccagcctctttttttctttttttttttttttttttttttgagacagggtctcactcagtcatgctggagtgcagtggtgtgatcatatctcactgcagcctcgacgtcctaggctccagcaacccttcctactcagcctcccaagtggcataggccacaggcatgtgccaccatgcctggctaatattttttggttttttacagagacagggtctccctttgttgctgacactggtctcaaactcctggcccctaagtgatccttccacctcagcctcccaaagtgctgagattataggtgtgagccaccaccacttctagcctatttcttgtactttaaattatacccctttcttctccaccaggcatctcccttccgtgaccccacactctgatttagaggctattacaaagtcttatttggtgcctgttctatctaaataatttaataaagtactgtttgatttgtgtaactgtgacatgctcgttgaagcacctgacataacaatttttaacatgcccttctttgagtagtatttctttgtattccgttgttagcgtggaattttctgctaggctttttctttgttcgtgaaattgtccgctttagagcacaaacagctagagaacaaaagattctatctttagtttgttctatatagtatcccatacaattccccatgcaaatgagagctcgcatgatggttccaatgacagcaggagtcagaaagaataaaagtgggaagggggagggtggggaagtggggagatgatattctgagggtacagagttttagttaggaataaattttagaaatgtgccacacagcacggagagtagttcataataacgtgtgtttcaaaattgttagtaaagtagacttaagtgttcccaccacagagcaaattggaagtgatgggtatgttgattagcttgattgatttatttcacaatgtggatatatatcagaatatcacattgtactccgtaaatatacatataattacttgtcaaaaattcttttaaatattcaaaataaataagtaaccaggcacattggctcatgcctctcatcccagcactttgggaggccaaggcaggcgaatggcttgagcccaggagttcaagatcagcctaggtcacatggcgagaccccttctctacaaaaagtacaaaaataagttggttgttgtggtgcgcacctggagtcccagctacttaggaggccgaggtgggaggatcacttgaacccaggagtcagggaagcagagcttgcagtgattccagatcaccccactgtgtttcagcctgcacggcagagtgagaccctgtctctaaataaataagtaaataagtaagaatatactttgtgaattcaaagttattcctttaaaaaattaaaaagaattttttaaaaaatgttctggctggatgcagtggcgcacacctgtaatcccagcactttgggaggctgaggtgggcggatcacttgaggtcaggagttcgaaaccagcctcctggccaacatggcgaaaccccatctctgctaaaaatttaaaaattagctgggcatggtagctgtagtcccagctacttggaaggctgaggcacgtggaggttactgtgagccgaaattgcaccactgggtgacagagtgacactgactcaaaaaaaaaaaagaaaaaatgttgttactagtctatctatgttagaatttattgtcaaaagtagatggaaaacaaaacagtatgttacctctggggcctttcctccatgtgtgggaacactgatgtgcagattaggcaggttagtggagtagacagtgctgctgctgggcagtgttcaggtactcagagcactgcactgccaagtaatatgtctccttcaccagctgggctctggactgggtagtctggaagggatgagagtgacctgcaggcaggtgtgttcagggaccgaagagatgggtgtgtgaactgagcagtggaggtggggctgggggctcagggtgggtggggtgggcgccagatccttgcatgggaggctttatgttccgtctgtctcaaacacactttgtgccttgaaagccccaggattagaaggaagaaaagcaagggctgacaaaacaggaccaagtgcagaatcatggccaccctgtgagcaaggcggtcttcagtgaggcctgtgggaggctggggtgccacattggtccatgttcttggacagggtgctaggtgcatggcatttgttgtataattgcacagtcatgagaaaaccaaaatgatattatggagaacctctgcttttcagagccttctagagattgcttgttgtaaatagccgtttttttctggataggccagtgtttgcctctttaaggtccaaaagaggttttttggggggagggtgtgtgtgtgtgtgtgtgtgtgtatgtatgtgtgtgtatatatatacatgtatatctatatctccttgttccacaagcttttttttttttctttaagttctagggtacatgtgcacaatgtgcagatttgttacataggaatacatgtgccatgttggtttgctgcacctgttaacttgtcatttacataggtatttctcctaatgctgtccctcctcctgccccccaccacatgacagagtggggagggtatatattttctttaatcttcatatttcctgccttcataaacaaatgttattgcttgtttttcatgacttaaagctataatttatgaataccagtttttttgggtttttttttttgagacggagtctcgctctgtcacccaggctggactgcagtggtgcgatctcggctcactgcaagctctgcctcccaggttcacgccattctcctgcctcagcctcccgagtagctgggactataggcgcctgccaccacgcctggctaatttttttgtatttttagtagagacagggtttcaccatgttagccaggatggtctcgatctcctgacctcatgatctgcccacctcggcctcccaaagtgctgggattacaggcgtgagccactgcgtctggcctatgaataccattcctttaactgtgtttgtttgatttatggacactcggaaacagtagaaatgactactaatttgtctttctgtttttttgagacggagtctcactgtcgcccaggctagagtgcaatggtgctgtcttagctcactgcaagctctgcctcccaggttaacaccattctcctgcctcagcctcccgagtagctgggactacaggcacccgccaccacgcccggctaattttttttgtctttttagtagagacgggatttcaccgtgttagccagggtggtctcgatctcatgacctcgtgatccgctcgcctcggcctcccaaagtgctgggattacaggggtgagnnnnnnnnnnnnnnnnnnnnggtcccagacaatccgtagacggcaaggagtgagagacgacgagatatagtcatatagatacggcgataatcggagtagggtctcagagaatagagtgagtccgtgacataccaacggaggactgaggtcacgactatgtgtgatttgctccaaaagaagagaagcggggaatcgtaaaggaatagcatggaaatggatggatcatagaaggaaggacgtgccatattagcaagaagaagggacagtgtaagacaatagaaaagatgaggggacgacattttatgaatacgagagcaatggagaaggatggaagaggctatgaagacagcccagagagaacagagagagagccactgtgcccggccaagtttgtctttcaaaactacataaggctagacgcggtggctcacacctgtaaccccagcactttgggaggccaagtcaggtggatcgcttgacttcaggagttcgagaccagcctggctgacatggtgaaaccccatctctactaaaaatacaaaaattagccaggtgtggtggcgagtgcctgtagtttcagctgcactcaagaggctgaggtgggagaatcgcttgaacccaggagctggaggttgcagtgagccaagatcacaccactgcactccagcctgggcaacagagtgagactccatctcaaaaaaagaaaaaaaaaaaaaatatatatatatgtatatatatacccacaaacatgcgcattgcactcccgcctgggtgacggatggagactctgcctcaaaaaacaaaacaaaacacaaataaagctacatgagaggccaggcaccgtggttcacgcctataatcccagcactttgggaggctaaggcgggtggatcacctgaggtcaggagtttgagaccagcctgcccaatatggtgaaaccctgtctctgccaaaaatacaaaagttaactaggcttcatggtgggtgcctgtaatcccagctactcaggaggctgaggcaggataatcgcttgaacccaggaggcagaggttgcagtgagccaagattgcaccactgcactccaacctgggtgacagagtgagactctgtctcaaaaaaacaaacaaaaaagaaaactacatgcaaggcccacaatgattacttgttatgtatgtatgtattaatgtatcagatgtacatttgtaatatgtttatcaatatatttgtactaaaaggcaacttttttttttttttttttttttgagactgggtctcactctgtcgtccaggctagaatgcagtggtgcgatcctagcttactgaagccttgaactgctgtgctcaagcaatcctcctgcctcagcctcctgagtagctggtaccacaggtgcacatcactgtgcccagctaatttttaaaaaatattttttgtgggccgggcgcggtggctcaggcctgtaatcccagcactttgggaggctgaggtgggcggatcacgaggtcaggagatcgagaccatcctggctaactcaatgaaaccctgtctcaactaaaaatacaaaaaataagccaggcgcggtggcaggtgcctgtagtcccagctatttgggaggctgaggcaggagaatggcatgaacccaggaggcagagcttgcagttagccgagatcctccagcctgggtgacagagcgagactccatctcaaaaaatatatatatatttttttttgtggagacagggtctccctttgttgcccatgttggtttcaaactcctggacttaaccaatcctcttatctcagcctcccaaagtgctggggttacaggcatgagccaccaccctccctcctttgagtaaaatgaagggcattaggtgttttgatttttgacagctactttcagggtcctggagcctgttagcttgcttcctggcccttgcctctatgttctaggtgagtggcacctcagataattgatttttgagtaggtaaaggcactactaggcaacgtgaacccagctttccaacagctccctgacccgggactaggaggcatgtcttctctcaccttctggaggatcagtggacagcttacgtgtccctaatccctctggaagtcagcagttattaagctctctgaccgggagacctctgtaaaggtgatcctcctaatctaggaggatgagctgctttagatcagctctgatactcgacagaaagtctcagaagggctgggcagaaataaagctagagtgggaacatgataccattacgtagaaataattttaaatgtttaatatgttgatgacaacctggattgagaagtttgctttaagaattgcaactgaaggctgggtgcggtggcttacgcctgtaatcccagccgaggcaggcagattgagctcaggagttcgagaccagcatggcaaaaccctgtctctactaaaaatacaaaaaagtagccaggcatggtggtgcacacctgtaattccagctaatgggaaggctgacgcacgagaattgcttgcatctgggaggcagaggttgcagcgagctccagcctgggtgacagagtgagactctctctcaaaaaaaaaaaaaaaaaaaaattgcatctgaaaaataataggatgggagcctgcacttagtttttagttctgtgataaattttgtaataaagtgcaggtgaaaaggtttttatttgttcttaaactcattgacacctgtatcaaaacatctagtttgatattaaaagtgtcagagttatcaacaaaacttgagagagcgttactccagctttaggtcagctttaagaagccacatatgttcacagctgaaatagttaaaacctgtgttttgaggcgctgtggcttatgtctgtaatcccaacactttgggaggccaaggtgggcggatcacttgaggccaggagttggagaccagcctgggtaacatggggaaaccccatctctactaaaaatacaaaaattagccaggtgtggtggcacgtacctgtaatcccagctacttgggaggctgaggcatgagaatcacttgaacccaggagatagaggttgcagtgagctgagatcacaccactgcactccagcctgggtgacagagcgagactctgtctcaaacaaacaaacaaacaaaaacaaacaaacaaaaaaccttgcgtttgatagaaactttaaaattaaaaatccttatactatcatttaccgtactgacagatatccctgcatcaaacagtggaaccttcttgctcttccttgaaaacagcattctgtgctacagggttccttaggacctctcataagcaactgtggttcccaggagttacctttcacccaccttacttgcctgctaaggtgaaattcttttgctccttattcatattctcctttgtagtatggagctccttttcaacatgtggattccgaactgagcacagttgccagagcaaggaaatagttatgaaaaaattcatggtcgggcgcagtggctcaacgcttgtaataccaaaacgttgggaggccgaggtgggcggatcacctgagggtcgggagttcgagaccagcctgattaacgtggagaaaccccgtctctactaaaaatacaaaattagctggctgtggtggcgcgtgtctgtaatcccagctactttggaggctgaggcaggaaaattgctcaaatctgggaagtggaggttgcggtgagccgacgcaccattgcactccagcctgggcaacaaaagcaaaactccatctcaaaaacaaaaaaaagaggccgggcgtggtggctcccgcctgtaatcccagcactttgggaggctgaggtgggcagatcacgaggtcaggagatcgagaccatcctggctaacatggtgagaccctgtctctgctaaaaatacaaaaagaattagctgggcgtgatggtgggcgcctgtagtcccagctactcgggagactggggcaggagaatggcatgaaccccggaggcggagcttgcagtgagccgagatggcgccactgcactgcagcctgggccacggagcgagactccgtctcaaaaaaaaaaaagaaaaaaagaaaaaattcgtgatagttactggtctctgctcccggaccatgcgcagtggtgctgttgtttaccaagcaggtgaggagggaacgcctcctttggtttctaggagaccttgattccaattttagctcagtctgggaaatttcatggggtattttgggtgagaaatgtttcatgaatttggaatgtctaaaagtggtttgttctttctgtttgttttttttttttttttttttttttttttttcagtcaggatctcgctctgttgcccaggctagagtgcagtggcgcaatcttggctcactgcaacccccgcctcctgggttcaagcagttttcccacctcagcctcctgagtagctaggattacaggcatgcactaccatacccagctatttttttgtgtttttgtagtggagacgggattttaccatgctagcatgaggccatgctggtctcaaactcctgtgatccacctaccttggcctcccaaagtgttgggattaaagacatgagcctctaatttgatttgtaatgaaaccaaacagaaacacttatgaaatgatgtcagcctgtctcagctgacaaagggaatgggtgccaggggtgatgtggcctgcattcggttggggccaggcatctccactctcaactgtggtctgtgacagtgtttttgttcatgctttgaagttggtctgacatttagagccttcctttcctttctttctttctttcttgaaacagagtctcactctgttgcccaggctggtgtccagtggcatgattgtggctcactgtaacctccgcttcctaggttcaagcgattcttctgcctcagcctcccgagtagctgggattacagagacgcactaccatgcccggctaatttttgtatttttaatagagacagggtttcgccatgctggccaggctggtcttgaactcctgacctcatgtgatctgcccacctcagcctcccaaagtgctgggattacaaacgtgagcaactgtgcccgaccagagattttttttcttataaataagtggctttgtctgaagcacatgtaacatgggagcacataagccaccagagtctgggttttagtctgttgctcttgtacactttctgtgttgtgcggtactgataggtttgcttttgtctgtccctccaggcttctcgtcagtgcctcgcaggatggtaaacttatcatctgggacagctacaccaccaacaaggtagggactggaggattcccttccttgaaaaaccaacccaggaaacagggttttaagctctggattcattttgttaaatcacgtaatacaggatagggaaggcagcagcggcaagctctgtttgttagtagtgaagttgcgcaggtgagatagaagctgagtcacgtgccacctgtcacggtctcttcctctggaccaggcacagttgtgctgttgtccgtcatctccttaccaagctggtgggagctaaggaccttctgtgtttctaggagacctcaattccagttttagcagagtctgggaagtttcatgttttatttatagagtgcagaagtatcacttttcattcagttacaagtttttagaagagatcatctgaaagacatcatactttaaagtgtaatttatgttattttcaagacttaatccaaagtgtattgttttgaataaaaagtattgtcattggtccaaacatgtatgtaaaagatgtaattcagtttattttactaaagaatactaaatgtgtataaatgattgcattaattacagcagatctaaaacagtgggagagatgtggcagggtagattgtaggaatgtccattttggttattccataaaaatcttttgttttcggctgggcgccgtggctcacacctgtaattccagcattttgggaggctgaagcaggtggatcacctgaggtcaggagtttgagaccagcctagccaacatggtgaaacctcgtctctactaaaaatacaaaaaattagccaggagtggtggcaggcgcctgtaatcccagctactcaggaggctgaagcaggagaattgcttgagcccaggaggcagaggttgcagtgagcctagatcacgccactgcactcaaacctgggcaacaagagcgaaactccatctcgaaaaaaaaattttttgttttcagatgagttcatagccatttgacaggataatgcagtgttttccttccaatacgtgtgggtttttttgtgtttttgagacggagcattgctcttaccgccctggctggagtgcagtggcgtgatctctgctcactgcagcctccacccccctggttcaagcgactctcctgcttcagcctccttgagtagctgggattacaggcgcccaccaccacacccagctaatttttgtattttagcacagacagggtttcaccaatttgaggccaggctggtctcgaattcctgacctcaggtgatccacccgccttagcctcccaaagtgctaggattacaggcatgagccaccgcacccggcctgtttgttttcttttgagacggagtctcgctctgttgcccaggctggagtgcagtggcgtgatctcagctcactgcaacctccgcctcccgggttcaagtgattctcctgccccagtcactcaagtagctgaaactacaggcatgcgccatcacgcccagctaattttggtatatttagtagagacatggggtttcaccatgttggctaagctggtcttgaactcctgacctcaggtgatctgcccgacttagcctcccaaagtgctgggattacaggcgtgagtgaccgcacccggcctaatgtggttttgatgagtgggcagcactactgttaagactccacctaatcataagttgtgacttcagtaaaactggactgtgtggattgaatttgaatcccatgtgcagcactggacttctcattaagtatgcttcacctgagtggccacatatgggaatcgctctctagataattttggctcttattttgttctgttacctcctttgcagtgaaagttggagatgagaaaatcctggtgtcagtgttgtttttgaacataaagttgtttgcatcatctgtctttctgtcattaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggtacctgtccttgttcataagcttcaagtgacacaagctgtttacctggggtacattatatgctttggatactcactttttatcaatcattttttaattaattaattaattattttttttgaggcggagtctcgctctgtcacccaggctggagtgcggtggcgtgatctcggctcactgcacgctccgcctcctgggtgttcacgccattcccctgcctcagcctcctgagtagctgggactacaggcgcccaccaccacgcccagctaatttcttttttgtatttttagtagagacagggtttcaccgtgttagccaggatggtctcgatctcctaacctcgtgatccacccacctcagcctcccaaagtgctgggattacaggtgtgagccaccacacccagccttttttttttttttttttttttttttttaaagacagagtctcactatgtcacccaggctggagtgcagcagcgcattcttggctcactgcaacctctgattcctgggttcaagcgattctcctgcctcagcctcccaagtagctgggaccacaggtgtccgccaccacgcccagctaatttttgtatttttagtagaggcggggttttgctgtattggccaggctggtcttgaactcctgacattgtgatccgcctgccttagcctcccaaagtgctgggattataggcgtgagccgctgcgcccggccttatgaatcattaaatgagactggttcaaataaaagtcacagtaatggccagaagttttctgaaaatgaaactaaaaacaagcctgatatgcctttaccagtaagaaacctgtggatttgcgctggacatggtggctcatgcctgtaactgcaacactctgggaggccaaggtaggaggatagcttggagccaggggttcgagaccagctggggcaacaaagctagaccccttctctacaaaaaatgaaaaacagccacgcacagtggcacacaactatggtcccagctcctcaggaggatggctcaagcctgggtggttgaggctgcagggagctatgattgcaccactgcactccaggctgggcgaaagcgagaccctgtctctgcaaatgaggcataatagagccctgtggccgtaagtgctaggtagtctattatttcaccaagattttatttacttgtgacactaattcatcatgaaaggcatacatttgctgaaagaggatgtactattctaatattttacctctctggctgtattatttgttctcagacattttatgccccagtactttttgataacactccgcccacttcacatgcagccaaagaaatcagttcatggagtcactagtactacagttgacacccattaagcagtctgttaaataagttaattttggccagattacaagtttaaccttgtcctttgaaagataatgctgctgctgttgttgatttctgttctctgttcttttctgccttctgcttactttggagttgccttcttaattttccagctacctgaagtagatctgtaggccactggtttgcttccttttcaaatagaatcacttaaagttttaagtttccctctaagcatggctttagccacatcacacacatttgtttcatattgtcttttttttttttttttaagatggagtcctgctctgtcacccaggctgtagtacagtggtgcaatctcagctcactgaaacctcaaccccctgggttcaagcgattctcctgcctcagcctcccgagtagattacaggcgtgcaccaccacgcctggccaatttttgtatttttagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgccatgttggtcaggctggtcttgaactcctgactgcaagtgatctgcctgcctcggcctcccaaagtgctggaattacaggcttgagccaccactcccagcctatattgtattttaattatcattcaatgtgaaatttttaatatccttgtgagtgcttatttgacttataggttatttagatgtataatttttacatatctgaagttttcttagttattgttgatttctaattagatgtcattgtgcttaaagacacacttggtatcatttcagtcctttgacatttgaggcttgtttttaatggagctgatggtctgtcatggtggccgcgctgtgtgcacatgggaatgatatgtgtttttgttgtatctcggcctgattttctacatacatgttaattagagcaagatttttggcatgttcaaatattctgtgtctttctatgaaatgctcatgcagggctgttaaaatgattatggattttctaactttcctgttaattctgtcaatctgtgcttcagatatcttgagctcttttagtagatgcctttacatttgttgtctctttgtgattaattgaccctgtgaccctgctctcatgatgaactgttctttctcactcataatgctctttgttgggaaccgctgctttttctgatactaatgtagtcagtcctgccttcatgggggtcctttcagcttaactgtgtctttgaaaatagtctgttacagacctcgcatcattgttgggtcttggttttttctgcccgcctttggaatatgcttttgcacatttatatttcttactgtaactctgctactttgccacctttttgtcccttcatttttgttttttggttgttcccttcctaccttcctttgagttacttgattacaggcatgagccaccacgcctggcctgggttacttgattttttaaagaaatctattttactttgtctgtgggctttgtaggtaaaccattttgcctgatgtcttagtggtgtctttagggattatagtgtacattcccaatgtctcgcggtcctctagttaacttggtcctagttgataggaaacgtaaggaactcacagccacacgggcctgctgtctgcccttgctcactcttgtggttttcatatgcatcacacctgtgtgtgttattagctccatgatgcattgttgtattctttactttaaacattcttaagaaattaggggtcttataatgtgaataaatatgaaaagcatgaaataggctgggcatggttggctcacgcctgtaatcccagcactttgggaggccgaggcaagcagatcacctgaggccaggagtttgagatcagcctagccaacatgacgaaaccccgtgtctactaaaaataaaaaaattagccaagcatggtggcatgcgcttgtagtcccagctgctcaggaggctgaagcaggagaattacttgaactgaagcggaggttgcagtgagctgagatcacgccactgcacctccagcctgggtaacagagtgagactccgtctcaaagagaaaagaatgaagtaaatctactctgccctccagagagatcttccatgtccagtgcccttcccgctctcctgcaaaggcgccttctgcgggcgtcctttcggccgggagccctacccggaacaagtcatggttaatgcagttctcaggtctgctgctagcaaagcacttagtgttcatttctctaagatttatattttgcctttattcttgaagggtatttttgctggatatctagaattatgggttgactctttttttaatttatttttcttttttttttttttttttaacaatctaaagatttggtttttagcagtttgcacgtaggtgcctcggtgtgattttctttgcatttattgcactttggcatcttgaatctataaatttgtctttcaccaaatttgggaagttttagaccatgtcttcaaatgcatcttctgtccttagtccctgcccctctgtgctgcaatacacacgcatctgtgctgtccccgaggctcagggggctggggtttgttcatcactttcccacttcttcagatttgttcctttttgttgttgttagcaccacttacttgcttttaacctttttatttccattcaagttcatgtacttgttacctctgataaactaaggctatccagcaggttctttatgtcagatattccttctgcagttgtagagtttctattgcttttatttagaaattttttattttcctgctgagattccctgtccttgtataatagcatgttttattttgcatccacaaggagagtttaatagctgcctttagagttcttgtctgctgatcccagcatctcatcttcctgaggttggtccttgtggatctctcctctggattctgagtgacattttgctatttttttagtacatgtagtaatttcaaattgtattctggacattgtaaatgttgtgtcatagagactttgtgtccggttacattctccagaactaactgatgtttagtgtcattgtatcaggcagtctatctctgtctttcttgtgtggcagcagcagaaacctctgttcagcttttctgcgctggctgggctgcatgcctgtgcacttcaggtgtcggatatctggtcagccgtgtgtgtagtttgggactccctttctgtggctttcttctttgtagttgttatcctttcgctttctggctgtggttgcccagtaatctgtctactggctcttgaagaccttggccacaggtcttgtgtgtgaggctgtagccctggggttgtcacagacagtcccctcctcagagaaagctccttaagaacaaaccatgtcctgcctttcttttctcccaggggagactcctccagtttctacctgctcctgttttcatgctttcaggtgtttcgttttgtagtttgtgcagtgcttatagttgtttctgtgagaaggtaatgcctacagataggagcccctggccatcgctgggagtccagccaggcagctcacactgaccctgtaaaccacacagctctgtctgacgcagcaccctttttggaaaggtgttctctatgttcagcagtcccttcccatgaccgtcagagtctgtgcatctgtttccattggtaatcaaaggttgctggatttaacactgactgtatttgtctttgaaaccaaagaaagaaaagccaaaaatactcaagaaaataaaaaaactggtattagtaggaatattttagaaattttatttccttcatatttcatgaaattttacttctaaggagttgtgttatttaaaaaaaacacacacacacatttggcctcttaagagtgtttgtgggctgggcgcggtggctcacgcctgtaatcccagcactttgggaggccgaggcaggcggatcacgaggtcaggagatcgagaccatcctggctaacacggtgaaaccccatctctactaaaaatacaaaaaattagccgggcgaggtggcgggcacctgtagtcccagctactcaaaaggctgaggcaggagaatggcgtgaaccccggggggcggagcctgcagtgagccgagatcgcgccaccgcactccaacctgggcgacagcgagactccgtctcaaaaaaaaaaaaaaagagtgtttgtgagtctgggtgacatagggagacccgcctctacaaaaaatacaaaaactagttggatgtggtggcatgcacttgtagtcccagctactcgggatcctgaggcaggagaatcacttgaacccagcaggcaaggttgcagtgagctgagatcgctccactacactccagcctgggcaacaagagcgaaactccgtctccaaaaaaagcttatttccagccctctgatccagtctcagatttttatcaaagcagatccctaagggccaatgcagggagactcaacgcttgctcttagagctttgttctttgcatacctctcgggcagtggagacacggcggcccttgcctggatcattctgatcaagatggctacagatacataagcattgatcagaagtccagcctaaggccttcatgatacagcgtgcacagctgtcagtgacagagcccactgtggtggccaaaacttggcatttttaggcacggtgtcttcatatagtgagaagcagaacattttctatattcatgaaaatagcggatttttttctgacaggcctcacaagcttggacacagaaggggatatatgttgtctccccgtaaaccctgcttcaggagccacaacagggcagctggtgactgggatgtctgcttgaggctcactgttaccagccccagtatcttggctgcactggtgggcctcacagcctcacaccatcatggaggcactcatggtgcccgggcactcctctgtgcaaccctctgagcctcactttcacatcttcaagttacttcctcatctctttcattttccttcttactgaacttgaagaaaacacctctgctctccaagtgcatgcctcggtgcagggctgggcacctttccctccaggtctaggctgagcctgtccctcgccagcacggtcttgtttttgctccttggagccgatcctggggcggcacaggtgctcctgaaaccacctgtcggaggaggactagtgagggactgggcgtggtcatggctgacttcttggcatttgcccgcctgcctttcagtgtgtcctgtgcgcctcccttgggtggggtctccttgcccctgctcccaacagggatgttctccagggtgcaggtaggagaactaaacctttcaaagtgtgttcattgtagaaattttggaaagggggctgggcgcggtggctcatgcctataatcccagcactttgggaggctgaggcaggtggatcacctgatgttaggagtgcaagaccagcctgccaacatggcaaaaccccatctctactaaaaatacaaaaattagctggatgtggtggcaggtgcctgtagtcccagctacttgggaggctgaagcaggagaagtgctgaaccggggtggcggaggttgcagtgagcagaggccgcaccactgcactccagcctgggtggcagagcgagactccatctcaaaaaaaaaaaggaattttggaaaggaactttgaatcatcatcttttatgttgggagaccctataattccatccagaaatacagtattatacaatagttatgcagtagtattatacagtattatataactatagtattatactgtcgttctgtaactcaggagctgtagagagtttcatggtgtggtgcactaatttgttcctattgtcagacatttaggcagttcacagtttcccacaatttattataaacattgctgcagcaaacgccatccttgtagatggatggtttctcaagcccatcgtcccgttcttgggtaagtttcctcacagggctgcatctggccacgcttgtgtgtccttcttggctttgctgtctttgggtcggcagccatgctgggtagagcagtgtgtgcacccatgctgtgctcttcccagagcctggtgatctgctcctttctagactctggactcactctatccttgaggcacctctgctgacaccacatgcccaggagcccatctttctcctacgcttccactctctgccgtgcctctcttcaagccaccccctctctcctggactttaacagccttgtccctatagccagtggtccctatgagacacaggacagcccttcacacccactgcctatatgaccagaccactgcgaggtccccaggccgcgtttcagcctctccttgaggcacttggtgccacctttgtgcccttgcacctcctcactgggtgcacacttttgttcagggtctgttttccctgcccctctgcaggcttccagagggtggcagcacaggcccccgcaccaggggaggaggggcgtgttttcacctgaagtgtccccccacacatacccagggaatttgttcaaattcaataataacagaaatagtaactgtctccatttactgagaacttcttatgtgcacagacagctctgctcctcccatcagttccccagttacatggggaggctgggacttctaaaagaacttagaggaattttcactcttcctcagctgccatgctgacagtggagcccaggtatttctgatttcagagtctgcagtcttcaccactcgtggcctcttggccagaaggccctacgaggctttcctggaagaaggggttagacctggtctctgttcacagactgggcctcatggagtatgcttgcaccctgggcattgcaccacccatcctgctctccagccgcactggacacacctcaccccccaacctgaacatgcacagacacttagagtggcctctggttgggcagaaccatctaacataatacatatcttataagaaaaagttgaacatctcatgtaaattattggacactcctgaaaatgaaaacacagaatagttgtatgggtacttggagcatggttttcctattaaatgcgtgtgtctttcaaaccatcataaagtcacaaaattgtaagtcaggggccatgtgtggcttatacattcggtcattccccttgtccttcatagttcctgtcagctgatgcttgtccacatcattttatcagcgcttgagagctgtgattttagggttcagtctctggttcttggagtaagaagctgatggattctgtgtagcttcactacagcctgcacagggtgggacagagaggtcatctttgagacctatgaggtcatgttttttgtttttttgaggcagagtctcactctgttgcccaggctggagtgcaccgctgtgaactcggctcactgcaacctctgcctcctgggttcaagcgattctcctgcctcagcctctcgagtagctgggattacagacccagcacccaccaccacagctggctaatttttatatttttagtagagacggggtttcaccatgttggccaggctggtctcaaactcctgacctcagcctccccaagtgctgggattacagtcatgagccaccgcgtccagccaaggtcatgattctttcatgcagtaaacttgggagtgcctccgcctggtcccctgtgtgagatgcaggctgtgctgaggtctccatgactcttctttcctgcccttctgtgctcacattcaaacaggctaagtgctacaaggctcggtggcctggtctggatgggcatctgacggggtgggggtgcttccctgaagcaagggtgagtgtgaaccaggaagccagtggaggagggctcgggtggagacccgggagcatgacagtgagctgcggggcacgacagcaagctgcagggcactacagggggcgccaggtatgcagggctatcctcctctgagctggacttgggttcacctttgtggtccctagtgtccctgtggtgtggcctccaggaagtatttgaccacgcatactttcgtaggcacgtagttaatattttgagctctgtcatctatgcatatttttcttctgtcagagccagtttaataatgtttgttggccaggcatggtggctcacgcctgtaatcctagcactttgggaagccgaggtgggtggatcacaaggtcaagagatcaagaccatcctgaccaacatggtgaaaccccatctctactaaaaatacaaaaattagctgtgtgtggtggcgtgcacctgtagtcccagctacttgggaggctgaggcaggagaatcgcttgacctgggaggtggaggttgcggtgagccgagatcacatcactgcactccagcctggcgacagcacgagactctgtctcaaaaaatagtgataataatgtttgttaaataaatgctttgttttctctgtaatcttacactttctacattaaaaccccagtgggtttcttcttttggtgcattttatttttgttgtttgctgattcacgcagtgtcgcatgactccctggggtgtagttggggggaaggcttttcagtaaacactcaaatctaaacaggtatcccaagaatcaccagtgccactggaacccctgaatcttcagattagggccagtctgtcaccaatcctgggcacacactaactggtttgttgaccctatgcttttagttccacagtaaataccagaactgtgatcaatgtacaaaagaaataatggtcaacagaagtcattaacaacttgaactgccgggttcaaatgattctcctgcctcaccctcctgagtagctgggattacaggtgcccgccaccacgcttaatttttgtatttttagtagagaccagtcatcatgtgtggatattgcggactgattttttgttgttgcttttcctcattttggaagttgtttaggacggggcatcttggtgtgtcctgctctcgcctctgatgcttccttcccagtgggagtgggtgggaatactcagagacacagaattgtgcccacgctgatgtgggtgtcacagccactgtccccaagaaaacaaacccacccacacatattcacgagcacccccgtgtctgcagtgttgctgccatgccgcgttcctgttgccttcgttatcccttccatgacctgcaggcccttgccaccctgaccctgtggcctcgccgcctcctgccctggctgggccctctgtttggatcctccttctctgagtctactctcgtcctccctcctctcctggctcccatcttgtgaggcccctactttgtcctcttccttcccctagcactccctttctgatgtcctctttcagtgattctcattctctgtccctgctgagcgtgggctgtaggagagcaggaggtgtctgtctggttaaggctgcttcctgggcactggagtcagcgtgccctgaatgagtaaatagacgagggatccccagcctttgatgggtcaaacagtaaagcagatgaaagatgtgtatgtttcatgggtgtggtttctgcttctgcccccatcacggagctgtgggtctctgtgggacgtgctgtcctgcctggccaggctctcaccctcaccagcagtgcgtgtggaccttctgctgtgtgcacagatgggaataaaaggtcactagcatggtgctggtcttaccttagacgtagagcttccaccgggccaatgtgtttctctatgtatgaggctgggtgcaaggcctgctggattcagctcatcacttaggcctgttctttgccaggttacctgtcctgctgccgattcctggatgacaatcagatcgtcaccagctctggagacaccacgtggtaagtacctgacccggggcaggcagtgccttgagaacccacagcccctggcacattcctctgtgaacatggaggaaataaggttcttgacataatattaggccatctgtaatttaagtggccttaagatttaaaacacatagtagcaatgtgtgaattcattatactttttttttttttgagatggagttttgttcttgtcacccaggctggagtacaatggctcaatcttggctctgcgacatctgcctgccgggtttaaatgattctcctgcctcatcctcctgaatagctgggattacaggtgcccgccaccacgcctgactaatttttgtatttttagtagagaccaggtttcaccacattggccaggctggtcctgaactcctgacctcaggtgacctgcccacctcggcctcccaaagtgctgggattacaggcgtgagcctccgtgcctagcctcattatacttctaataaatttacaaagtttaattttcagcagctgagaactaaaatacacatttttttctttttttttttttttttgagatagagtctctctctgtctccaggctagagtggagtggcgtgatctcggctcattgcaacctctgcctcccagattcaagcaattctcccctctcagcctcccgagtagctgggaactacaggtgtgcgccaccacacccagctaatttttgtattttcagtagagacgggatttcaccacgttggccaggatggtctcttatccgttgacctcgtgatctgcctgcgtcagcctctgaaagtgctgggattacaggtgtgagcccccatgcctggccaacatagatattttaactacaatcaggctcaaagtacctgctcttcttttttttcccctctatatatttgtacctccttaggtgatgataggtgggagtagggtgggttttgattgtccctttctgatagcatcatgtcattgtgaacaatgagcacagactaaaaataacagacgtcacaattcaagtgattccatcagacttcatttttagtgttttcaccttacaggtaaacggaagcccacttaaatgctagaattttttcatttgtggcatcaaagtactaaattaaatgtccagatagttattttatgagagtcattttagacttcagctggccatgtgggtttttctggtcttctgaggcatgatttggtggcaggagctgtgcccagcccagggcacagacccctagtcacgcagttggtggggttcaccgagacatgggcccttaaccaacttgtcagcaaagcatctgtggtattataaggtgtcctcgttgtataaatttcatagatttacaaaagatttgtcacctagattgtcaatcttgagaagactttatttattagaagatatttttaaagtgcttctgttcattaatcatttttttcagactcttttacgtatcttgcttcccttctgcagtcagtccctcaggccctagagaggaggctccctgtgcagtgtctgttgagattggctgattggatttgcattgccaggcccagccaggctttcctctgaggctgacatgaacggacagtgctctctggtgttgccttccatgggtcgaggcacaggagaatagtatgttggtgggcgtgtggccctcacagctgtccttacacctgagccaggcttctgctctgtgcagggctctgtcagcgtctcaccttttgacagcttgttaagcagaaatgtgatagaataccaggtatggccgggcgcggtggctcatgcctgtaatcccagcactttgggaggccgaggcgggcggatcacctgaggtcaggagttcgagaccagtctgaccaatatggagaaaccccgtctctactaaaaatacaaacaaaattagccgggcatggtggcgcatgcctgtaatcccagctactggagaggctgaggcaggagaatcgcttgaactcgggaggcggaggttgtggtgagccaagatcgcgccattgcactccagcctgggcaacaagagtgaaattcggtctcaaaaaaaaaaaaaaaataccaggtgtgatcactgagaactcagctgctctcctgtttgtgattccaggaaagggcaggaggacctcagaattgctgtgagccatttgtttacctggcattggccttctcctgcctgccttttctgagaccctgtggaggggaggccaagggagggcacagagggagcagccacagatagagtcgcgtcccctccgccatccagggcctccacgtagcttcctgccaccccttccatgcccatccatgaccaaagagggggcacagcctcagtggtgctgcttgaaaagtgcccccagctccctgtttgctggcatttgagttgaggtagcgatcccgtcattctgaagcccaggccctgtgctcatctctgtataattttgcttgctttgctttgtttcccttccaaagttgtattacatttaaatttgtctttaaacaatttacgtttttaaagtaacagtgcagaggctcactgtggccctgggtggtttgaaggacagattgtctgtcacatgactagccacccaagaagttaaggctgatgtccccttgtcattcgctcctgctccagtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcgtgagtctgggtggaggtgtggggtcgggtcctctgccgtctctgctagccgttcagattgctaaattttaaacttttctggattagatgttctcctttctgatccttatacaacctcatgtacagatggggatacagaaaactcccgatgggaaacttctctgtgttgaccacttgtctcacagatactcacagggtgttgtatgccagtccccgttcccacctctacagctgagcagtggttgggatcctggaggggaaagacagtaagataactcaggccaccagtggttacagagccttactggtcaggggcacagctaaccagggaacctgccctcctctttagcacgcggatggctaggcagtgtttccagcccctggccttgtgaggagacttagaaggatgtatctgttggttggacagagctctgctgcagtcctgaccacagccttggtcagcccgcttccctccttcctccatgagattagccctgatggctggcagctacagcaacatgcacacctgtcagtgatgactactttctcactatcctttggaataaattctactctttggggacagtaatcacagtgtccaagatcacagtgtttgtgtgcctccccagtgcaaatcccctcccatcccagtcccctgtagttcctcccccatccccccaccctttttttttttttttgagacggagttttgctcttgttgcccaggctggggtgcaatggtgcaatcttggctcaccgcagcctccgccgcctcccggtttcaagcagttctcctgcttcagcctcttgagtagctgggattacaggcgcacgccgccacgcccagctaattttgtatttttagtatagatggggtttctctatgttggtcaggctggtctcaaactccccatctcaggtgatccacccgcgtcagcctcccaaagtgctgggattacaggcatgagccaccgcacccggcccagccctctgttcttaccagagcacagtcttgctggtctttgcctgctgtgttctctgcagccctaccattgagcaatccatattcccaatgtttctttctgagcgtttacatgatgtcttgatttgctttctctttccagttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtacgtggccatggggcctttctgtgtcttgtggacatttacgtggtatctttagagcaaacacagagtggttgcataagctgcagtgttttagtatcggtgggactgtggcatggcgtagcaggagtgacagtcgcaaactgatggcccagctctgaccctccaggcaagtggactccgaggagtaccagcagatcttcccacatgcgtcggggagggctctggggagagtcagtgggcaggagagggtcagctgtgcaggctccagggcccagccccgtgctttcccctctgaactctgcttcagggggaggagttccatgcagggacacctctgggtgccgttacagttaacatatcaaaggcaagcgtgttattgccaggtgtacaaaagatgagacttccttactaaaaatggtcatttgggcatttgaatttgagaactgttgacacttacagacttagattcatttgtctcagtacctgggaggacagaagggagcatggctccaggtcttggcccttaccggggcttcctgcttccggatgggtgccactcccacctcctggttaaacacatttctttttctccccagcctggggggaccagagtggagccatttccagccaagtctcacagtcacagtgctgttgaagggcggtggaagccagcccaggccttggcagagcacacgccggcccctgtactcagctgtgtggtggctgcaggaggtggaggagggtggctgaaatgggccttcggatccccctgggaggaagtggagcttctggctggtgatgatccaagccaaggttattgggagtgttgacagaaggccccctcatcacatgacagtgacagtgcagtgccagtggtctcagccaccatcgctactcctgtgttctgtgccttgtgctgggctctagggatcacagacaaaggaaaaacggctcatgcctctaagctcctgtgttacagattgctttgagattggggcggttttgattttttttttttttttttgagatggagtctcgctctgtcgcccaggctggagagcactggcacgatcttggctcactgcaagctccacctcctgggttccaatgattctcctaccctagcctcctgagtagctgggactacggcccgcaccaccacgccctgctggtttttgtatttttagtagaaatggggtttcaccatattggccaggctggtctcaaagtcctgacctcatgatctgcctgcctcggccttccaacgtgctgggattacaggcctaagccactgcgtctgatgatagttttgatttttttgatagtggcctttgcttctttttttaagttttataagtgagtgctgagaagtcaatgccaggggctctggatttatcgattgcgtgtgtgtgcgtgtctttgaattttaacaaggctggccatatgctgcaggttaattccccacgtggatgcaactttccctcccttcctggccgtgggagactctgggtcttgtcccatgagagatgcaccatccgtcctcgtcacaacatggcacacaggtgagatcgatgcctctgggctttggtgtgattctgctgttgtttgctcccaggtgtcttggctgggcatgacaaccgcgtcagctgcctgggcgtgactgacgatggcatggctgtggcgacagggtcctgggatagcttcctcaagatctggaactaacgccagtaggtaatgcagcagcccaaatgcccttctctgaggagaactgtgcgtgtttctcatagaacatttgaagttgtcattaacggtttctagataaatgttgatgtagcattgatttggaattgtgttgtgggaaacgtttacagaaagctgaagtcacgtgccctcagctgcagacactcatgcagtgatgggaagagcagtgacctggctgtgcgtctgcacttagattctctgcctcttttcacatttctttaaactctgtttaaaacagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgagggactttggtgtggtgattatttacgggtccacttccagtttgcaacgcgcccgcttccctaagctgtccctgttgctgtgaggtctgacgggcctgctcatgccaggcggtgccatggccgccaccacgtcacagaatccatgagtggcgcattggctcctcggaggggttcctgggaagctccacctcacaggccagcagagcagggaggtccacctgccatcgcccagacccctccccaggcataggccttgcccacagcaccgtgggagtctccacaggcggctgccttgcctttctcctctgccatttccctcccttagaatgtctgaggatgttactccagagactagctttccttgggactgaactgagtgttcctcttggtctgaatataaagaactgcatctagtaagaaaaaaatgagcactggccatggtagtgtggaaaaccatggctgtgtgtgtcccaaatagccgctcctaggctccagaaccatccacttccctgctttccaaactggtgattttttaaaatcttaaataggcaatacaaaattagctgggcatggtggcacacgcctgtaatcacagctactctggaggctgaggcaggagaatggcatgaacccgggaaggcggagtttgcagtgagccaagatcgcaccactgcactccagcctgggtgagagagcaagactgcctctcaaaaaaaaaaaaaaagtaattttttaattcccatggctccagcagctggaactttttttttttttctcccttgatgtggagtctcgctctgtggcccaggctggagtgcagtggcgctatctcagctcactgcaacttctgccttctgggttcaagtgattctcctgcctcagcctcccaagtagctgggattacaggcacgtaccacgacgccccgctaatttttttttttttttttttttgagacggagtttcgctcttttttgcccaggctggagtgcaatggtgcgatctcagctcactgcaacctccacctcccaggttcaagcgattctcctgcctcagcctcctaagtagctgggattacaggcgcctgctaccatgcccagctaattttttgtatttttagtagagacagggtttcaccatgtttgccaggatggtctcgatctcctgaccttgtgatccacccacatcagcctcccaaagtgctggggttacaggtgtgagccaccgcgcctggcccagatgcccggctaatttgttgttgttttttgagatggagtctcgctcttgcccaggctggagtgcagtggcgcgatctcggctcactgcaagctctgcctcctgggttcacgccattctcctggctcaaccttccgagtagctgggtctacaggtgcccaccaccacacccggctaatttttgtatttttagtagagacggggtttcaccatcttagccaggatggtctccatctcctgaccttgtcatccgccctcctcagcctcccaaagtgctgggattacaggccgagccaccgcacccagccaaactttttcctagtaagtgaagaaggctctcagcagaaagtacctgtaggccccctcctcccctgggcaccagagaacccagcagcccctcctctaggctggcagtccctggccggagaggctcccatagggcacttgggattcacggagcagggcccagccgccctgctccaggcaaggtgctgggtgtgtttctgacgccaccaagggtgcccatctgccagcactgcaagtgacactatggcgttgtctccctggtggggtgacctggtgctgttttaggctgctgaagtgggtgtgattggcaggctgaacggggtgggctcgcctggcttcgtcatcccccacttttccctgaaataaatcagttcttcatagacatgcaagttcttcacaagccctaaccctgccagctgtcttacaaaaaccccacttaaaatcactagagagttgaacttgt

SEQ ID NO: 13699 - DNA, 4875 bp, Human
tcagccagcattctccctctcagttcatcctggtcattacctcactaatctgtaccttgactcttattctacctgggacctcccctcactaaccatacttgatttatttccttaagagcggatatcctgtgtattcttagcttacagtggctgagcttttgggaggtttaacaaattgtttttcaatagactctcagtcctaaatgattttattgcagctgtattattctttttgaggggagtagagaatgtaatcctagttgtatgccatattttttgtattgttcaagttgcattttgttgggcctgtaatattgaagaaaatgtcacttgtatgcagaataggagggagattccttatgctgtagaggaaccattttcctaggatagtacaattccttagagtcatctctaagggtgagcagcaaagctagaatccctctcttggctttgaccttgaaggagtcagttttcccaaagactagttcccatggaaagaagatggtctccttatcacagcagcaagaggaggcagtatgagcagagtgcctcactgttgttgacctctagggacaagtgagccagcagtatttcagacaagctgggaaagaggctgtctgtgagtcctgggagcgagtgagcactggcaggctcagacataggtgctggttagcaggactgcttttctgtttcttgtgtcggctttgtttatttcctctctattttccccctggacttagtaaagtctttccgaaaataccaaaggtgaaccaggggaagagtttttattttccatgtttggacagaactttaaagaggaaatgatgtacccccctgggagccagtgaggtggcagcgatggtgattaaggagtgaatatctcaaggaggtggacgaattcggggatcactagctcagctgcccctctccacctggagcatctccttccagtgctaccctcagaacatctgggctttgctctagtgagggagagactagcaatgaaggtgtcttgagatcagcactgtaattccaccaggacgccaccggagtccggtgttaagcttctactatggcaacagaatgagagcgtggatgggttgaaatgccatttcaacaaggaaatagtagaattagaagaagcataagcactaaaaggaacattttgtagcagaaatgttaaaaatctaaaggaggcaagtgaatcaacaatgactcttctattctgggcaagtccagcccatttatgtaaggtggttattctgcatctctgtcttctgcaagtagtgctgtggcagagctgcgttttgtggagagcgtccccggggatggagcagatcagttggtgatgcgtatgtatcagaaagctcggcagagcaccctggaacgtaggccctctcgcggagtgggtagtggccctacatgttcatttccaagggcaggagaatagaccgttccagctgcggcctggccagggatgaccccacatctgacactgcaatatgggggcaactgaaccagtcctcagcctcagtgtgttccaggggctgcagctggggagcagtcgaactctttcttgagacaattacaaggccaccgctgctgctgctgaagggaagttactccatgtttacaattctcaggtttgaagttttcatgctttgccaaggtagagtgaaccatgcgtctttgcaggctcaagggatgtttaaagaagcggtaggacatcgtccacccacaagcagagaccgcaggataaagcagacatccaatgtaaatacaacccgtgcaaaaagcagagtcggcagacctggagtgcattcgcagtatctcccgggggtgggggaaagaaatcacctcttcagaatgtccagaggggagttgccttgcttacctggggggcggtaccctctctcgtgccctcacagggctactcagcctcaggtagctggtgccagaataacacagactcagctgccagagcctgctcttaacacctgtgtttccttttcagatcttacaggtgaacaaggtgatgtccatcttgttttatgtgatatttctcgcttatctccgtggcatccaaggtaacaacatggatcaaaggagtttgccagaagactcgctcaattccctcattattaagctgatccaggcagatattttgaaaaacaagctctccaagcagatggtggacgttaaggaaaattaccagagcaccctgcccaaagctgaggctccccgagagccggagcggggagggcccgccaagtcagcattccagccggtgattgcaatggacaccgaactgctgcgacaacagagacgctacaactcaccgcgggtcctgctgagcgacagcacccccttggagcccccgcccttgtatctcatggaggattacgtgggcagccccgtggtggcgaacagaacatcacggcggaaacggtacgcggagcataagagtcaccgaggggagtactcggtatgtgacagtgagagtctgtgggtgaccgacaagtcatcggccatcgacattcggggacaccaggtcacggtgctgggggagatcaaaacgggcaactctcctgtcaaacaatatttttatgaaacgcgatgtaaggaagccaggccggtcaaaaacggttgcaggggtattgatgataaacactggaactctcagtgcaaaacatcccaaacctacgtccgagcactgacttcagagaacaataaactcgtgggctggcggtggatacggatagacacgtcctgtgtgtgtgccttgtcgagaaaaatcggaagaacatgaattggcatctctccccatatataaattattactttaaattatatgatatgcatgtagcatataaatgtttatattgtttttatatattataagttgacctttatttattaaacttcagcaaccctacagtatataagcttttttctcaataaaatcagtgtgcttgccttccctcaggcctctcccatctgttaaaacttgttttgtgatccggctctcaggagtcactctgtaaaatctgtgtacaccagtattttgcattcagtattgtcaaggccatgactgttgttttagtaaacttgttaaaatcagatgatgtcagagttgtgtataaacacagttatatccctcttctggtacatttaatgttgggttaatgaattaaaagaactgttatggcctgcacttacttaaaatgataccctgtagctctggccagcaagttctatatcaaattctctgctgttagcttggcaaattagaattatgatttgctccagtgttatggtcctggaacaataacaacgaccctggcaattttagttttggaagtttctttgcagcacatttgttgttttggggtttggggttgtttaagggttgaatttttttgttttggctttggtttttgttttgctttttgcaagtggtttcatctttttaggcacataggaattttttaaaactatttgtaacaaaataattgcatgactacccagaagcaaactgaaatggatcatgaatcatctatacatagaggataaatttatttatggccgactctcagcctgtgaccacccctcctcatctgccagccccttctagagctgtgagcagagttggaaagtgctagggctttggagtcggacctgggttcaagttccagctcctcccctgtgagcttgtccaggttttagagactctctgagcctgtgcttcctagggtcagagtcagacagcggtccttgcctacgtccgaggaaggttataacccctgaaactttctagcatagcgcaggcattcaagaatgttagtacctcacccattcccttccatccccccgagatgtaaaatgcctaaatggaagggaacttcttggtgccttctgagtcccaacaggagtccatgacagccaaggggtcattgtggtgatggcctcacctgtcatgcccaggcaggactgaggggacaccagggatgtccatcaaggagtttgttgatgcccatttcccattgagaagcagctcatcctcttggggttggaacataaggatgctcatctcccatcttggcggaggtacaaggtgtccactaatccagcactgccctgaagccccgccctctgcccaacctggattgccctgcattcattagggcccagctgtcctacacactgacatctccttagcacacacctgtatggaatgtgtcctttatgggatgtgaacttttgaaatagactcagcaaatagcagtagccttagttaggaacatcatgacactgcacttgatcttggatgcctaaaatatgggggaaggaaataaggaattgaccatgtgcccatcatgggccaggcatattcaaaccctgccaccattaattgtcacaaatcctttgagggagccagtatcatctccagtttacaggcgaggaaactgaggctggtgggttcaactagcccatggtctttagtaagtaagtggcagagtgaagattgtaatctacgtggcaatgatggcacagtcttgaaccctcggcactagtctctccctctcccacatagcagcatcacatttcagagtgggtattatagtcctagttatatgaaaagcacagccctctgcatgggaaccttttgtcctattgtttcactgagccttcatcaagaacacaataaaccagctgataggacaaggagagtcttaggactagcccaagcccagttatcaggagctcgtcatttcaaagtgaccatttccctgggcttctagtaagccctccacccctaaaacagcaggctgagggatactgcagctgacgcatgtctataaagcttgagtctca

SEQ ID NO: 13700 - DNA, 16836 bp, Human
aggtgcctgccattgtgtctaatttttgtatttttagtagagacggggttcaccatgttggccgggctgatcttgaactcctgacctcgtaatccacccgccttgacctcccaacgtgctgggattacaggtgtgagccaccgtgcccggccagggctctgtcttatacagtttcatgttgctataataggatgccacagactggacaatttataaacaatagtttatttggctcacggttctggaagctaggaagtccaagatcaaggggtagcatctggcagcagccttttctctgggtcataaaatagcagaaggcatcacatggtaagagaaacagcaagggaaagccaaactcatttttataaccaaccgactctcaagataacccactcctgtgattacgttaatccattcgtgaggggtagccctcataacccaatcaatttaaaggtctcacctcttaacacttttgcattaagaataaagtttccaacacatgaactttgggggatacattcaaaccacagcaagctctatggataccaatctgtaagaggcacaaaaataaaaaaatgatgctaattaacacagccacttgcagtgccttacataacttttgaaacctaaattggtcctattcccctgaggtaagacagtgcccttgaatgttaatttaaaaattctcctggttggcaattccaattatcttatgttatattcagggcatgtaataagtcccttatttttacataaagagcttttaaattcttattaatagaaaatcaggtgtcttttaatcctttgctgaacagatatttaaagaaaactggcctgttcatgcatttccaaattattagctttctggtaatttacatattcctctaacaagccctggatggaggcctctaagtcctccttccctggtaaacatggggctgttcatttggctgggtaagctgagaacgttggtgtgtgggtgcgtaaaagagaatctgtgttcaatgaagtattgtcgatagggttaattgtgtatttggcacacataaacgggacaagacgtgtaaagtacttggtaggagagcgacagtatttctccttttttttttttttttggagactgggtgtcactctgtcgcccaggctggagtgcagtggcgcacggctcactgtaacctctgcctcccaggttcaagcaattcctcatgcctcagcctcccaagaagctgggattacaggcctgcaaccccatgctctgttactttttttttttttttttcatttttagtagagacggggtttcgccatgttggccaggctggtcttgaactcttggcctcgagcaatccgcccgcctcggcctcccaaagtgctaggattataggcgtgagccacagcgcccggcctaattttcgtattttcagtagagacgaggtttgccctgttgcccaggctggtctgaactcctgggctcaagcgacccacccacctcggcttcccaaagtgctagggttacgggcgagcgtgagtcaccgcgcccacccgggagtctgtatttctaatttgtattcagctctcagcatatcctcaacgtgaccccacccaggttcagggtactggaacctgagcgaggaaggcgtgtgccggggagagtaggtagtgtgaggggccagagtgcaaaggtcagaaggcatctggtggaagcggtgtgcaaagaagcctgaggggaggtccttagatctcggttaccttggcgatctctatcagagggttagagttgccgagaggcgccagctgccgcttcctctctcccgccctccgtttggcttagctcgccgggttctcccacaggttaaaagcagacgccgacgcggttgcctagtgacacttttcccaaaatgcctagggtattgttgtgttcttcttagccaatgagagaggcgaagcggcccaccgcctgccaatagactgcgagatcagggcccgcgacggttaaacggggcccaaggcaggggtggcgggtcagtgctgctcgggggcttctccatccaggtccctggagttcctggtccctggagctccgcacttggcggcgcaacctgcgtgaggcagcgcgactctggcgactggccggccatgccttcccgggctgaggactatgaagtgttgtacaccattggcacaggctcctacggccgctgccagaagatccggaggaagagtgatggcaaggtgagcgtgggacctaccctgcgcctgcccctgcttaggtttcgtcgcctcggggcgagcgccctgcgccaccgaagggaaccgacagggctgaggaaatgggtgcccggaagactaaaccgtctttcctgggtctgcatctgacagcctgtcctgggtggcttaaaggatgggagaccgcttcttttgatatatgtatttccatcttttcccgtttctctccccatttctctctttctcctgctttggcttgctaaggaccttccattggtgacaggtaactaattcctgagctgtttttagagctctaagagtggccctctcaggcacaagaaaggggcaggactaccagaacccgaagctttgtatctgcagtcagactccctcaaaatatccattattaggattattggattcatatttcccaatgtatataggtagaacttttacagaaagtaacattggacaggaaactgcctggctgctgatggagggatctttaccaaggtgtctcatcctgggaaaacacgactggggtggaatggggcagggactttgaccaccttcaccccaattttgactatagtaccttttagccaacttcccactaaccaactgagggtaggggttgggggagtcctcatgtgcctcattcccgtttgtctccccacaacatacatttactgcttagaactggaggaagattatggaagtaaactcacagctccttaagttcattgaactaaattagataatgaccttgattgtaggatataattaaaagggaggtaatttgttaaatcttggaactttcattctttgtttttgagcataatgagttcattcataccttggaaattcttatttcagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggtaagcataatcttttaaaaatgtaagctgaaattggtctagtttcatttattttaagcatcttgttttaggatcagtaatatggaagagtgtatttgtatttgtttggtaggtccacagtactttagaaaattcctggtgaatcaacacccatattttatatcaaaataacaatttataggctgagtgtggtggctcacacctgtaatcccaacactttgggaggccgatgcgggaggatcacttgagcccaggatttcaagaccagcctgggcaacatagtgggaccctgtttctacaaaaattagccaggtatagtgacatgtgcctgtagtccaagctacttgggaggctaaggcaagaggattgcttgagcctgggaggtcgaggctgcagtgagccatgatcgtgccactgcattccagcctgggtgacagagtaagaccctgtctcaaaaaatataaataaataaataaataaattccctatttgtacactggataatttatatcatcccatcttggcaatgatttttttagaagttatatgctgtataactgctttggttttaggcaatacttagatgaagagtttgttcttcgagtgatgactcagttgactctggccctgaaggaatgccacagacgaagtgatggtggtcataccgtattgcatcgggatctgaaaccagccaatgttttcctggatggcaagcaaaacgtcaagcttggagactttgggctagctagaatattaaaccatgacacgagttttgcaaaaacatttgttggcacaccttattacatgtctcctgtaagtatttcagaatttagctactttttaaaacatcttttatttttgttttcttgtttgtttgtttttgagacagagtctcgctctgttgcccaggctggagtgcagtggtgcgatctgggctcactgcaatctctgcctcccaggttcaaaggattctcctgcatcagcctcctaagtagagtagctgggactacaggtgcatgtcactatgcctggctaatttttgtatgtttagtagagacagggtttcatcatgttgaccaggctggtctcgaactcctgacctcaagcgatctgctcacctcagtctcccaaagtgttgggattacaggcgtgagccaccatgcccagccaaaacatcttttaatgttaagcattctgaagcagggaaattgagttttctgttcgtttagtaatatctagtagccaagaattgaaaatactgttatatttttccacatggaccaccagaccaataaagtctatatcagtttttgtttgctgcatgagttatgtgcattaatgtaagtatgatgaagacagattcctagtctaaggtttgcgccgtttgtcatctctcactgggttcaattttttgagcattcatgcaaattaaagcatattcagttcaagcttttatggaatgactatgatgcattaaactcaaggattacaaaaatgaaatggattttgtccttgccctcaagagttgtttcccaatgtgtaggtcctagttatctgcatcagactcacttggagtgtttgtttaaaatgcagagttctgggtcccaaacccaaacccaaatccatcgagtgaatttcgatctctgggtgggttcttgaactctgtttttttttttttttaatattttactttttattttagactttgcatttaagaggctctgtaaatgattcttgtgtatgcagaatcagagctcaggaagtttgctcacttcagatagcatgtttttacaatgttaactttttgtacattttatttttttgttgcctatccctgaaatatcttgctgagtccactcaccaattacctctattgctggatattttgtttccaacatgtttcaccattcttagaagtactgctctgcatatctttgtatgaattattctttcttcctttttggttatttccttggagtgtagctcataaaatgaaattgctggggtaaatgtttatggctgttattagatattgtctgatggcttttaaaaagtttaagtcaattgtgatagcactaatgtgttagtatataacatctgaacagataaagatgaagaaatatttgttagtattttagtagttcacctttctaggattttccaaatatttataaattatgttaacagatcttactatagtataaaactttgtaaattaatgattttggttttgactaaaaatagccagaacagtaccattttctcactgtatcaaattccaaatagaatgtttttaacataaaggacaattatccagaagtggttcttgggaaatttgaaacctattcttttgttccttttccctcctgcccttgtaattagagtggttcagctttcctaaggcactgattgtcaaaaagtggcatcagactcaccagttggactttaaaacactaaccagccactagagattgcttctattccctctgttgagaataggagctctggtaggctgttgttactgtagatgtggaagaaaggcaaacaataaaataggtaaggataatattagttactactgtgatttatggagtggactaagacaaaatataaatggataattcaattagctatttatgtctatatccatttaaatgtggactagatacatattttgactattcttaaatttcctctagttcttttaaaatggtgtttcttaatttgccttgagagtagaagtctctcatattcacctctgtattgtcagtgcctagtctatactaagcactttcatttgtgaatggaaaatgagtgaatgaattatgtatgatggagtgtattggaacaagatcattgccttttttccattataaatttcaagataaagtataagctaaaaactttgaggttctgtttttatctcaggagtaatttaatgtgttttttaagtttcaaaacaaaataaactcttaacaccttccactttcttaccctttttccctgtataggaacaaatgaatcgcatgtcctacaatgagaaatcagatatctggtcattgggctgcttgctgtatgagttatgtgcattaatgtaagtatgatgaagacagattcctagtctaaggtttgtactgtttgtcacatttcactgggttcagttttttgagcctctgtgctaacgaaagtatattcaagtctgaaagaattgtaccctgggtaaaattaaggtagatagatgaacaggctaaaagaaactattcacaaattaaaactataagccatgaggctgggtcttgactgttcaagggtcttggctggttaggtgctttcttattagattgacacttagctcaagggagagcacataggtcaggcaggtaaggtaaagctactgtaaggatgtggaagaaatgaaacaagactcgggtagaggtctggggatctgtagagcagggaagagctccaattcttttcctttgttcttcttttcattttctttccctttgaaactattctgtagagcagtgattctcaactagggataagggaagcaaatttgcctcttatggggcatttgatgatgtttggataaatttttagttatcacagctggggagtgcttctggcatctagagggtagagggcagggaggctacaaaatacctataatgcacaggacagccccccacaacaaagaattatatgacctcaaatgtcaatagtgccaaggttgggaaacttacttataagaagaaaatcccagaagtagaaacttaaatacaaactggagcttaagctgtgcttttgatttagttcctattgtatattttcatttttacaatttgaaaatgtcttcgtcgtcttcttcttcttttttaaccctaggcctccatttacagcttttagccagaaagaactcgctgggaaaatcagagaaggcaaattcaggcgaattccataccgttactctgatgaattgaatgaaattattacgaggatgttaaacttaaaggtaaagatgataagatgatatattgtctgtttctagctgtcagttaagtgtcagagcatacattctctcttgtagatcaatggagactgaagaaacgttaaatatactttcttagctaaatttactgtgttaacacaagtgaaaacatatgtaaatttggcaaattgcacatccttgctggcccaccttctgcgctttctttatttctcctcccactctgtcatgctaacagatggtcggtagcaaggaaagattgcaaaaagaattcaaattctcgttccccttgtccttgcctacctcacagtggcaggtagtgagggaaggggccagaaataagagtttattactctgcctctagctctaattgagagattaaagaccagaagaaggggaggggtgatggagggcggacggaggacagctaaaaacagagggaaaatcaataaagagattatgtggaaaaactctggctatagaatggggaaggagatgttctggggaccaggctgacataagagaagaaggaaaatgccgtaggatcacagagaaggatacagatgaagtgacaggattgagagtcagtgagagagtatcttgctaaatgtagtttagaaatgcaagggcagtacttcccctaaaacagaccctagcaatgctaccaagccccagcacaagatgtgccaatcttcagggattgaaccttcttagaaaggtgaaaaggggaaaagggaaaaaaggtaagttaacatctgcattaccttgtggacccagaacctcatgagttaaaaccaccagtgaacttatttttccaagtgtttaagacctagccataaaggagtcctttcttttgtcttggaaacacatttttgtccttttattttaactgctgtcttaggaggactattctgttatgcaatctgactataatactgagtattttttccccaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcgtaagtctgaatgggggtcaaagcaaaggagaactaccaagtgggttattttgatgtgtctgaatatctctttgagcagaatattttatacatacagatcttattagaagcttttgaaaaatacttgagaaaccaaaatatgtattttagactttttaataatcaggcttgctggcaccttcatgttggacatctttctctgagatcagttgctagttatatattattgggccttaactgtgatggccctaatacgatagccttgtattttactctagagttacttttttctttttcgtctctactgtgaataccctaatgttttcccactgtaaaggaaggtcttaaaattgctgctttccataataaaaaaccatgacttttgtcttttgaaatggccactccaacagaattccaggtctaaaaccctacagtatgtagatgagatatgttcaggcaattcttttctttttttttaactttttatttttgaaaatgagatggggtctcactatattacccaggctggtcttgaactcctgagctcaagtgatcctcccatcttacctcccaaagtgctgggattataggtgtgacctaccacacctggtctgttcaggcagttcaatagagaatctagatacaagatattttaagtctataaataatactctggtgggtattaacattgacttatgagtattaactgattagatgctaatttagttttgatattgaaagtgtgtctactccaccaagatgagagctactcgcaagcatttagggttatgcaaggtagctacagagtgaggttcttcattttaacatcaggagacgagagatggggtcgtatttgtgacctgtcaccctcatgactcacctgattttacttctgcagctttatgcccaatccaggctttaaataatgaaatattgtatagtcctgtgagatatgcttactgtataggtacaacctatacttacttggaaacctctgtaaaaaataagaaagctttttcttataactttccccagtgtttcataatttcttttcttttttttttttgagatggaatttcactcttgttgcccaggctgaagtgcagtggcaccatcttggttcattgcaacctctacctcccgggttcaagcaattctcctgcctcagcctcctgagtagctgggattacaggcgcctgccaccatgcctggctaatttttgattttttagtagagatggggttttgccatgttgacctggctggtcttgaactcctgacatcaggtgatccacctgcctcggcctcccaaagtgttgggattacaggcgtgagccactgtgaccagccataatttcatatagcaactgaaatctgaatactttctgaatttggggccatgaataaatagtaacatttgttattaatactaatcctatgaactaccacctaactgaattgtgttttttttcttttgtttgggtgtggtcattcaaccagaagaaggagatttttgtactgtgaggccagatcatgccctgaaaattagctgttgcttatcttcagtgaagagcagagatagctttagttttttgttttcccaaatgagttactcccacaaaagatgaccaaaggttgaagctaactttgtatttgtttaaacaagtcctttcaagaaaatctaagataacatacagcctactaaaacactcaattaaaaactaacataatcaggttgactgaggcatagtgagaatcctttccccaaacattgcttatcagtatcaggcatgctagtagtgataagattgccaaatgtaaattgttttttagtcaaggtcagttgttaatttttttttctttgtccattctctttttaaagagaaagaacaggagctttgtgttcgtgagagactagcagaggacaaactggctagagcagaaaatctgttgaagaactacagcttgctaaaggaacggaagttcctgtctctggcaagtaatccaggtatgagaatcaacttggtcaacagaagctggtgctacaaatgaagaaatgtgcaccagtgttgctcccaaagtggcttaggtagcccttttcatttacaaatctcaaattttaagatggatttcattgaatatatgcatttcaatggaaacaaaattctgttatagcagtgatttatttcctgggttcatagacctgaggcaatgagtcatagaatttcatgtttgattttctttaccttatcaaactacatgtttagtaattgatacttatttttattatcattatttatttttttattttttttgagatggagtctcactctgtagcccaggctggagtgcagtggcacaatctcggctcactgcaagctctgcctcccgggttcacgccattcttctgcctcagcctcccaagtagctgggactacagacacccgccaccaagcccggctaatttttgtatttttagtagagacggggtttcaccgtgttagccaggatggtctcgatttcctgacctcgtgatccgcctgcctcggcctcccaatgtgctgggattacaggcatgagacaccgtgcccagccgatacttatttttaaaaattagggcatttacaaaactattgtatgtttcagatttcagagagataaactgcatttcaagtaaaaataaacattttaatattgccatgcctcatttttcatagaaagcatggcttaaaaggcatgataagccacctgcagaataggctgtcacgtttggatctttgctaacaccctttcaagttgaaagacatatttgttgaaatttgattgtttaatatctacatatgttctctgcatttccttctttatttaaagtctggtatatagatattcagctttctcagggccctgcctttgtgtggcattgtcccttcactctgccgcactgagatgtggttatcgtatataccagtgaaccattgtctaacattctccattttatagaaaccctcaatctaatttaatcgactctttaagattatgtaaaatgcaaactgtgaaacatctttttgcttgatttatgacacaaactaactgttaaaagttgttggtttcaaaaatcgagcatctgaattttcaataaaattcagagtttttataactcccttattccatgtaggacagcatatatgaaagctattattcccatctttaataaattgagatgtagtgtgatcaatttagtgagcattggcagcattttgtaaatggaacagacaaaaaaccctacttaagttagattgatgatcacaataactttgtagtgaataagtgatggaaagaaatgaaactactgatagaagtaaatgaaacaaggattatatgaaactttggcttcatctctgttaaaataccttcttttttcccaatattgcagtctaccatttcaatattataaaaatatttattctggcttttcatagattccacactgtcatccataaagacaaaatagacttaaatcatgattagggtgataaaatgaggagaaaattttacctggatgaatttcatgcatcaaacccattgcagagaattacttaagaccctgttggggatggctgttcggttaaagagtttatttacatttgccctgatagtctttgagcaaaagatgaaaatagctaagtaaggatgatgtgttttactttataggatacacagataagtatgggaatctacttatatgtgaatcatggcaaatatttaaaatgagccataggaatcaagtatccactggggcaagcagacattttagggtattgagtgctgaaagtagtgaacacatcagagctataagataagcatcatagcagtggggagcgggtaccattctgaactcaggacagttggaaatattctctccccatccttgggctataaaatccacacgtgaggaagccatcacaagtatattgaaatcatcacagcaagcagcagtgtcttttttaaaagctgttcttttcgtatttgatgaaatattcattcttctatttaatggaagaattttaaaaatgtttttaaaacactttctttcttataaaactgtcccattaagagccaagtgtggtgacgcacctatagtcccagctactctggggctcaggcaggaagatcacttaagccgaggcgtccaaggctgtagtgcactacagctgcacctgtgactagccactgcactccagcctggaaaacatggcaagaccccatctcagacaaaaacaaaaacaaaataaaactatcccattagtaagacaatgttgacttacaaatgtaaaggtatttgtggtaataagaaggtggatagagttgaaacagtggagataaggtctaaaagcaatccagtttgctttgaagcagaagcgacgtatgaagcgggaagtcacaggacccttggaaggcagtgcatctgtgtgccagcctttcctatttcttctgcctggagcactcttcatccagacagccctgtggcttcttacttcagaaatgctgtatgaggctttgtatcattacacccagcacccagcacccagcatgtccctgtttccagagctatttttcctaatagcacgtattaccatcaaatattccccaccagtacttgtttgtttgtgtttggtttatctcctcctactagaatagggcctttgtttggttcacagtggcccatcctatgagctcagtaaatattcgaacatatttcctttaacacaaaaaataaaaggattctagaatctgtaagcctccagcccccagtaattctgtcagcagttaatagtgttgccactttaagtaaatatgattattatttattttttccatgtaaagaatagtttacagtttttactactcttacttgatttaccttttccacactgaatttgtttagattttttggaaacagatttctcgtccattaagatgctttgaactaagtgttcttgaacatttaaccaaaactgtaggtgttctctatttaaaaaaaaaaaaaaaacaaagacagaaaaaaacctctgcttctacacttttctgtaggtaaggtgttctgcatagaatggcacttattttcaaggacagagataaataacattgatttccaaaagttttatgttgtccataatactcagtgtgtttaagagtaaaattgattgttggttgttaagagaataaaacttatgttccttgaattttggcacattccaatattattttttcaatgctgtggattaaaaggctgatttctgcaagtcctacacccctaacctcctatcccagagaaaataaaacaggcacctagatttcaaatgtgagccataagagcaaatactttttgataagtataagtatgaaggagttgaactctgttcaagtaactcagagccctttttctttttccttctaaagaacttcttaatcttccatcctcagtaattaagaagaaagttcatttcagtggggaaagtaaagagaacatcatgaggagtgagaattctgagagtcagctcacatctaagtccaagtgcaaggacctgaagaaaaggcttcacgctgcccagctgcgggctcaagccctgtcagatattgagaaaaattaccaactgaaaagcagacagatcctgggcatgcgctagccaggtagagagacacagagctgtgtacaggatgtaatattaccaacctttaaagactgatattcaaatgctgtagtgttgaatacttggttccatgagccatgcctttctgtatagtacacatgatatttcggaattggttttactgttcttcagcaactattgtacaaaatgttcacatttaatttttctttcttcttttaagaacatattataaaaagaatactttcttggttgggcttttaatcctgtgtgtgattactagtaggaacatgagatgtgacattctaaatcttgggagaaaaaataatgttaggaaaaaaatatttatgcaggaagagtagcactcactgaatagttttaaatgactgagtggtatgcttacaattgtcatgtctagatttaaattttaagtctgagattttaaatgtttttgagcttagaaaacccagttagatgcaatttggtcattaataccatgacatcttgcttataaatattccattgctctgtagttcaaatctgttagctttgtgaaaattcatcactgtgatgtttgtattctttttttttttctgtttaacagaatatgagctgtctgtcatttacctacttctttcccactaaataaaagaattcttcagtttccctgtagttatgtgtcttgcatttgttggtctcttagttgatgggagttgtgtttatgatttgtaggtcttcattgtagggtacagaaggaaacatggatctgatgctcaagggagtggcattccagtcctaaactgtatggcgctttacctcccatctcattaatccatgtatgtaagccagtggtccttaacagggtgattttgctcctcaagagacgtttggcaatgtctgggggcatttttgattgtcatgatttggggtagggtgctactggctgctagtgggtacaggccagggacactgtaaacattttacaatgcacaggacagctgctgacaacaaaatgtccatgggtttggatcataatcctgaatgatacaatctcaaatgcgaaaatcctgaaagaccaaaatccctaatgtcttaaatcccaaaagatcagaatccctaatgtgtgaacttccaaaatcacaatcctgaaagattaaaatcccagatgttaaaatcctgaaagccgaatttgaggttagggattagtgccgtttcagctgtatacaggataattgcatcatgttaggcagaactattaccttgttattgtcttcatttggaaattaagtatggtttaagagatgtggatggatatcgagttgataaggggtgaacttgttgatttatgtgtcaacttgactggattaaggaatccctagaaatctggtaaagcattattttagatgtgtctgtgagggtgtttccagaggaggttaatatgtgagtctcagtagactaggtggggaatatctttcctcaatgtttagtgttttgaagatcataaaagcgacttttcaggtgaaaagtacaagaaatctctcctgccaaattattcagttatgtacaaattctgctccttcatgaatagtgccacgcttgccttaaaaaaatgccctttgtcagagaataaaattcgacaagctgaacgaccttgtgaaccaaagacacttgctgatactgaggttcctccagtgttacaaaactcattaaccaaactgttcttggttagggatttgactgtcgaagaagatagactgcttatatttaccactaaatctaacagaaaaactatcgcatgttttcattttggctagtggacggcactttcaaaactatccctactggtttttatcaactatacatgattcatgcccctgttggttctgaagattctagaacttatctagtcatttaaacaattatttgaagatttgctgcactttgcagaagaaaatagctttcgattgaatccccaaaccataacaacagatttggaattaggtgtgatcaaagcttctaaaagtgaatttcaaagtgttaccaataaagtttgttttttttccattcagcccaatgcatttgatagaaaattagatgagtagataggccaggagatacagcaatgacaaaaacttcagtttagaagcaggaacccgcatccaggaatagagccctttgctcctccctcagaatgaatggagatcaaaaatcagatgcttatgcccaagaaaaacaggatttcattcagcacttctcccggattgttagggtgctgactgaggatgagatggggcacccagagacaggagatgctatcgcccagctcaaggaggtcctggagtacaatgccatcggaggcaagttatcaccggggtttgacggtgcttagcattccgggagctggtggagccaaggaaacaggatgctgatagtttccagcgggccctgatggtgggttggtgtgtggaactgctgcaagctttcttcctcgtggtagatgacatcacggattcatccctcacccactggggacagatctgctggtatcagaagctgggcgtgggtttggatgctgtcaatgatgctatgcttctggaagcatgtatctactgcctgctgaagctctgttgttgggagcagccctattacctgaacctgattgagc

SEQ ID NO: 13701 - DNA, 91559 bp, Human; identical to SEQ ID NO: 12581

SEQ ID NO: 13702 - DNA, 54251 bp, Human
  misc_feature (1)...(54251): n = A,T,C or G
atcaactggaaacctcagcatcagcaaacgacgacagagcgttcatccgtaaggtgaaccagaaaagccagttcaatgacttgtttaaccatggtccatctcagaaccaagagttgggcctcttatttaccagaaaaattgtgggggctttgtgatatggctttaaaaaaatcttgtaattgccaggcgtggtggctcacacctgtaatcccagcactttgggaggccgaggtgggtgaatcgcctaaggtcaggagttcgagaccagcctgaccaacatggtgaaactccgtctctactaaaaatacaaaaactagctggatgtggtgacgcgtgcctgtaatcctagctactcaggaggctgacgcaggagaatcacttgaacctgggaggcagaggttgcagtgagccaagattgtgccattgcgctccaaaaaaaaaaaaaaaatacattaacataaatttaaatattttataatgacaatccacattaactacttaaagcataagctattttccaggagaggcagcaagtgcattctactcccatgcccaagaagaaaggagcgtgactttggtgggagtactaggagtttctactggagcacttgcccgcagagtgagaaacgttcctagagaggaagttatacctgctgtggaatttaagagaatcttgtcatattttgacaagttttttgagatggaagtctcactctgtcgcccaggctggagtgcagtggcgcaatctcagctcactgcagcctgcacctcctcggttccagctattctcttgtctcagcctcctgagtaactgggattacaggcgcccgccactacgcctggctaatttttgtatttttagtagaaatggggttttaccatgttggccagactggtctcaaactcccgacctcaggtgatctgcctgcctcagcctcccaaagtgctggaattacaggcgtgtgccactgcgcctggctaatttttttttttttttttttttagtagagacggtggtttcaccatgtcatccaggctggtctcaaactcctgacctcaggtgatccacccaccttggtctaccaaagtgctcggattacaggcatgagccaccaggcccagtcaacgtgatgtgttttggaaccctgaattccttggcttgcccggagggttttctttttgttaatatctttgcttgctttctagtatttaaaaaattgtgttttgctctaactatgcaatggctttaagtcttagacaaatttccagggagcaaaacacactcaaccatttcataataatcagaagagagctctgatcaataaataagcaagactgaattttacaaaataatccaaagtttaaaaccaaagcccactttttgcatgatcctttaagagaaagaaatctggaagcaaaacaccttataaaatgacaatgcactttcaggagcccagggcactgtggtgaaatgatgatggctagtacaggttataagccttggggaattatttatgaattctcaggatccttcagttcgccgcatccttctccattatttgaatattggaggctgcctgaccagaatcttgtcaggactttgctccttcatcccaggtggtcccggctgactcctgaggacgttacagccctgaggggaggactcagcttatgaagtgctgggtgagaccactgccaagaagtgcttgctcaccctaccttcaacggcaggggaatctccctctccttttatgggcgtagctgaagaaaggattcataaatgaagttcaatccttctcatcaaccccagcccacacctccagcaattgaacttgaaaaaaaaaacctggtttgaaaaattaccgcaaactatattgtcatcaaaaaaaaaaaaaaaaaaaaacacttcctatatttgagatgagagaagagagtgctaggcagtttcctggctgaacacgccagcccaatacttaaagagagcaactcctgactccgatagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcaggtaagggcctgtgggtgcccccggaattccgggaaggctgatgggcatccctcttcccagccacagaaccagagggagtccccaggtagatggttccaagaagggagttgaatcttgggttccacctcttgcctgtgacccacggggaccccagtttatgcctcactgttccttggtctgtcaagagagcctgaaatagcattaggttctcctgtccttctcagtccttgacaattaattctgggaagaatagtgtggcatgatatttgggatatttggatgttaacagggtcccgatgagcaggtttctcaagaaattatcttttattcttcaatgaatttccttttattctctgcactcccaccccccaactaagaagctatcaggaagctctttaagttcaggttaatttgctggagacatgagtactcatatatcaaacactgggagaatttaagatctcagaaaagtttagcttcaaggatgtatacactgcttttacgtcttaggaaataacacctaggaatttccttacaagtgcaactttacagaaatttttaaaaatatgcatactcacttttagaacattactacttctcataatcctatgtatatacatgatatgtatatgtatacgtgtttatatatgcaaattttaaatttcattccttgtttcaaatggattttctcgaagattttttttttttgacactgtctctgtcagccagactggagtgcagtggcgcgatattggcttactgcaaccttcgcctcccaggcttagcgatcctcccacctcagcctcctgagtagctgggactacaggcatacgccaccacacctggttaatttatttttttgtagagatggggtttttgccatgttgcccaagctggtcttgaactcctgggctcaagtgatccactcaccctggcctcccatactgctggtactacaggcatgaaccaccgtgcctggccaatatttttttttaaagaaataaaaaaccaccaacttctacctcaaaccactcttcctaattgagtgtgaattttctaataatgtcttccctttgcttactcaggaagacagataagaaagtttatagtgttttttgaaagtctataatggcaacaagtagaatgctaactggctgtagaaagaatttattaagaaatgaaacataatgatgcatttcaggagtctgcttgcttgtttaggggaagtgcccagtcatgctgggctgtgtactggcccagatgtaggagtgtctttaaagagggcattttatttacttattacatttttatttattttttttttactttttgagacagagtctcactctgttgcccaggctggagtgcagtggcgtgatctcagtccactgcaacctccacctcatgggctcaagtaattctcgtgcctcagactcctgagtagctaggtttacaggtgcgtgcaccaccacgaccagctaatttttgtatttttagtagagatggggtttcaccatattggtcaggctggtctcaaactcctgaccttgtggtccaccagccatggcctcccaaagtgctgggattacaggtgtgagccatcgcgcctgacctatgtgttttattttaataggttttggaggacaggtggtgtttggttacatgaataagttctttagtggtgatttgtaagattttggtgcacccatcacctgagcatgtatgctgtacccaatgcgttgtaagattttggtgcacccatcacctgagcatgtatgctgtacccagtgcgtagtctcttttccctcacccacctcgcaccctttcccctgagtcctcagagtccatcgtgccgttcttataaagagggcatacttttaggaaggtttttcaatgtgatttctacatccacagggtctttgctaactcagtctaagccaagaacaggaaaatcttgacaattaatcatgctctgcctctggaagacacatttcaagtaaactcgtgttatttctagctattggtgacttatccaagggtctgagtggtcttggagggagcaggggaactagagtcccataaggactccttcacgccattctcaacatctatccataccccatctgcccctcaacactataggaaatacaaaaatgagggagatatagtcctgacacttaagcaacttataacctggtgaggaggagaaaaacatagatataaatatagtaataccagtcagagtgtggtaagatctacggagcgttgggctatcagagaaggcttcatgaggatgacatgtaaagggagccccaagggaccagtaaatttccatcaatgagattccagggagagagaccccaatgagccaaaacacaggagtgccttagggagcagcaggtggtccaatgtgctcctgccctggacagggagggtggggatatggggaattcaaactggaaagttaggatgaggtaaaatgaatcatctaaggcattaggcatttttagtctgtatattgctgggccctgggatgtggtcagaaagagaattctcctagtgataacttcttaacttcacctagtaggcaataaagaactacaagaaaatttaaaactaccatttataaagtaacttctatgtgccagatatgtgtcctattgtaatcttcatagccactttgcagtatggatatcatgaacccctagatgaagcaagaacccaaaactcagactcgcacaggcagtgagagtgccagggtttgaacctggtctccctggattgttctgtttctgttcattgcaaacagggtcagcgctttatggagatgatactggcatagagtggagagagatcaggtgcacagagacaggtcatgaggctcttaaaatagtccaatcacaaggcaaatgaggacccagtggccaaagacaatgacaggggtcaagtttctggaatcaacaggaatttctaggcatcactccagggtaagaaaccatctcatcacagactttttctccaagaggaacctagtcttgaaacaaatcagactttttattcctcagggtaagagttctctaatgaaatcagactgtcaacagatgcaatttctagctgattcataagggcagattttcattctgaaaatttccaaagccaccatttaacatggcaagggtttatgaggacatattagtcaacttgagtgtttttagtctctatattactgggctctgggatgtggtcagaaagagaattctcctggtattaccaatatggcacgttattgaaggcacctttctcagaactgtggaaattctgagagcttgtatgtcccttgatcatctttctttcattctaggaattctgtgatcaaatctttatcctctagactcaaaaataattctttaaaaaaacagtgtggaaacccattgagataatgtgtttgtgtaattatccattcttgtaaagacaactgcccacaatggaatttcccatcttcacctttgtcagtcaaacacaaaatgtttaacccttcacatttaatctttcaacttcttgagatcccaaagtattattgctactgttacttcattcatcttcaagacatgtcttgaggctgtaagggctttcctaaacattgggagctcttcataagacagttgctactttccttaaaacagcatgccttaaataggcagtttgataaatcacctgtgcatatacttcattttagatgtgagaattgaaaaagaaaaaaattgacttcacaattctgcaccaaaagaatgagtttcacgaatgcgtcagttagaggtgctaatatagaacggttgctgagctctaaaactccactactccaccccactcccctgatagagaagtattcccagactggtttttgcctaaagccttgggtattctgaatacctctttgtgatttttttttctcttcctttttgagacagggtctcactctgtcactcaggctggagtgcagtggcgagatattggctcactgcaacctctgcctcccgggttcaagtgattctcctgcctcagcctccccaagtagctgggattacaggcacctgccaccacgcctggctaatttttgtatttttagtagagacggggtttcaccaagttggccaggctggtctcgaactcctgacctcaggtgatctgcccaccttggcctcccaaagcactgggattacaggcatgagccaccgcacccagtcctctttgtgacttttttgttggagtcattcttctgcgagctatggatatcatcaaggcaggcagtccctcaacgtggcagctgttcccacccttccctgctcctcttcttgcccaaggatgagcagaaactttacagaaaaagagagaattccctcaggaaatgaggcatgttgcttgaggtcacagggaatagaattagcaggaaaataaaccttgcaggaagcagaaagtgggccaaagcactgaggagaggacacggggagggcgtgagtttttgacagatttctctctgtaaaatgaggaggtcacccagggatcttgaaactcccttccagttccttcactctatgtcaaggattccagaaaggaaataaaataagctctgcttaaaaggcattttcaagctggggaactttgggatgaaaaagtttcccaaatgaagacatactggcacggtcagggttgagcgacttttgtgtatcaatgcacccaagcctgatgtctcattgtgggttatttccagctctgaagaagtactgcctggcagccagcatgacccactgcttctgtaattgctgcagttgcaggtgtcaacgcaaaaactccactcactcaattctcaaaatctatccaatatctctcatgccccttttcaatactataggaaatgtaaaaatgagcgacatagtcctgatccttaagagagtcataagttggtgaggaggagaaaggcatagatatagtcatggtaacacaagtcatatgtggtaagatctactgagcatggggctatcagagaaagcttcatgagggtgacatggaaagggagccctgagggactggtaaatttccatcagtgacattccagggagagaggccccaagacacaggggcagcaggtggtccactgtgctcctgccctggacagggagggcggggtcctctgctgtttgtttgcttgtgtaggaattttcccctcaaacaatgtccttgtctcccatgggagaagttttacatgagtgggaacctgtttctcttctctatcccaggccattccctgagagaagagaaaggggaatcttttttttttttggacagtttcgctctgtcgcccaggctagagcacagtggtgcaatctcaactcactgcaaccttcagctcctgggttcaagtgattctcctgcctctgtctcctgagtagctgggattacaggtgtgcaccaccatgcctggctccttttttgtaattttagtagagagggggtttttgctatgttgcgtaggctggtcttgaactccgagcctcaagccatccatctgcatgggccttccaaagtgctgggattacaggcatgagccactgtgcccagctgaaaagagaatcttaattcagttgattacttctaaaagttataagaccttcttcactgaaagagttcacatagaagctgaacttgaatccagccctcttaaatttcagttcaatattccctgcacatctgcacatctttacatgaattctcagtgatattccttcatccatccattcatgcatgaggattacagagatgaagaaagttccagctcttatcctcttgtgctcacagtttaacacgggagatgaaactgctgctgaatggctcccattctgaagtcagccaacagtgtttgccaatagcccccactgaataccccaccatattctcaagtaactcactcatttaggggaaaacaataatataattgtctctagaaattttaggtattctccactctaagattactcagtgttttgactgatctcaaggcgactccgtggtttgcttctgtcaaaaagaaaacacagttcccactgggaaatgtgtggagagtaatggttcaaaacgccagctgtacattagtgtatatccaggatgctttaaaaagtgatggccaagactcataagatgaattaagcggactctctggggaacagaaccgaacatcacaataccttcccttccagttccttgaatacttccaaatcgcacttaggattgaaactcaccaaattagagagatggaataatgatttccatggttggtctgattcactaggaacaggtatgctcaagcagtacttctcaacctttaatgcatttggaaatcatccagggatcttgtcacggagcaaattctgactcgggaggtcaggggttaccgcctaagattctggtgcaaacaggttccacaggaggcctatgttgtgggtgcatgaaccccattttgagtaacaaggctatcaagtcagagaataaatacgcattgcttttacccacacagaacttgcgactgaaatgagaaaataggctgagtgtgatagctcatgcctgtaatacctgcactttgggaggccaaggcaggaggatcccatgagcccaggagttcaaaaccagcctgggcaacatagtgagactctgcctcttaaaaaaaaattagaaaaagggaaaaccaatctgggaaagatcaaatattgatcaaacattgcaaataatgccataaatgatcagaatagggagagtaacatgctacctggagaactagaaaaaaaattctcagagaaggtggccctgggacctcctggctctgaatggtggttctgaatatcaggagaggggctggagaatggtgttttctagtgatgctgctggagtcgtgtacatggaccgtgttccatgagtagtgagctgaccaattagagagatgaggggtttgccaggacaactacataatgagccatatttcaacatacatgcagttttgtgtgtgtgtgccaagcaaatgagtctcagattctcggacaaaaacgaatacttttgctcagacagacagcatgtgagtgcttctcccccagcttcaaccctgcagtgtctacaggtgtcattggtccccggtagacgtcctcggttcaatgggtcactgatcacttatcaccagcaccacatgaccctggatggcagccaaagagttcctgggtcttgtttccctacctccacatttttttcctgacccagcccgagccacgtgcacaccacagggctggagtcccagtgcttttgtcctgacagcccattctcccactcccacacccaaccagttccccggggggtttttgaccagcagctccgcctgcagccctcgacccggatccaggcatcctgcttaaggaggggttcaggtggcaggaaactccagggcaacaaagtgtgggtggcatgggtggggttgaccggaaggtcactgtgctgggaggaagaggaacgggtggagggaaggcaagatacggatcaggagtattgacatcctgtgccagtagaggggcctgccccatggtggaaggtgtggccggatgagctcgctggcccatgtccccccgtttcccaggctttttcctcccacgctgtatgcagtgcaagaacaagctggtgcaattggactagcagcaattgagtccttttacccaaaagaagaagaaagagcaatgtttcaaaagaataaaaaggaagctgcagccaggtgcagtggctcattcctgtaatcccagcactttggggggccaagaggggaggatccctggagcccaggagtttgagaccagcctgggcaacatagtgagaccccacctctattttttaaaatgataattaattttaaataaggaagtttgtgaaagccattggtttctttattctaaagagcgtggaaaataggacagtctccaacaggccctgatttcctttggtaagaaaatgagcaaagctatagactaggaaacatgactggttaaagccggcccatgcaccaactccgatactgatagttatgtttcctttcgttcttatttgcttcaagctttgatccagaaaacatttgaacactagctagaaccaccacagtgaatatccattgcctaaatgctatctttcaggtattatgttcagacatagtattactttggttaattctcaaaataaagtaggtcatatgattatccccattttctgcctggtgaactgtggttaaatgggcttacagagattaaatgggttgcctgatgtagcccaacgaggaaggggctaggataggaagcaggcgctctcattccagaacctgccttttttcctcctgtctaaactgctgctaaaggtcaaagacaaaggtgccatgtgagcagggaagttatttttgttttttacaaaggtgaagtaataggctgtgagtaatgcccactgctccttcagccccaggtacatgcagtgaggcggtacccacagagccgcgtggcactcctcaacctgctagagcagccggcctcctgcaggatggcttaaggaccacctggtccttggggtctgggttctccgggtcctgctgttccctgcagccttccttctacccccagagcagcttgggggcatctttagagaaagcggcagtgtcgcacctgccccagcagccacaaaacagaggaaattctgagcacctccgggcgtgagtcaccataccacattcaggaattgccacctctgcccacagaatcacccactcttttctgtttgggaccaaaatagatacctccttcagaagccgctgctttctgtactctcagcaataaaaaaacaaaggctaggataggtgtgtgcctctgaggcgtgagggggggcgcgttttctcccctgggaaggttttcagagagaagttgttgctacagcagtacaggcagctgatgggttgagggtacaggaggaagagggaaagtcagggagattggagacaacctcttgtgtggtaggacttccggctattggtttgttcattcctttgttcattcattcattcagcaaatgttcattgaggaactgctatgtgtcaggcacagggtttgagacacagagatgaataagagcccatccttgacctctgcacagacaattatgacacaggctaagtgctgagatacaagtttaaagaaggagtcgatggaacacacagatcgatgttcattacccctgcaaaacccagcacatctcacatcagggactgcctcattcacatcatgttagatgtgacagagaggacagcagagagcgttgttttgtcatcaactactaaaattattaaaaccaaacaccactaattttgaacttcaggtagacagaggatgtagagttttcctttgctcaagaaattcctttacagagaaaatgggaacatttcaagtgggagtatttcaattcctttaataacaacctgttttctagctcccacattccccaagtattctagaagcacctttcataatggacagctctgaccaactgccccacacacatgcatgtgaaccgttctccaatcctaaaagtctgtgacttctccaaggaaaggaggaaggaatcgtattagtccagtttacattattatatactttgtagcaaagcagcaatgtttccttaaaaaattctatatatatatatatatatatatatatatatatatatatatatatagctgggcatgatggctcacgtctgtaatcccagcactttgggaggctgaggcgggcagatcacctgaggtcaggagttcgagaacagctgaccaacatggtgaaaccccgtctctactaaaaatacaaaagttagccaggtgtggtggcacatgcctgtaatcccagctactcagggaggctgaggcaggagaatcccctgaacctggaggctgaggttgcagtgagccgagattgagccactgcactccagcctgggtgacagagggaaactccgtctcaaaaaaaaaaagaaaaaaaaaaatatatatatatatatttgtgtgtattttctcctcatgaaatgagctccttgaagcaaatcggcccatcttttcagagaaagatcagtttattacgtcaccaagtaaagggcaaaggaatcatttctaaaagtttcgtttgaagtccccggagttaaagttgacgtcagcctcttcctgccctggtgccccgagagtttcccgggagttttggggatgacacccggctgcatgcgtgacatctcgctggctgggggcaggcctggtggcttccccgacaatgaaaccaggcagagcctgcaacccagctgagcaccagtgtggtctctgcttccggtccttgtggtagcacctctgtttacagcctgatttagaacaaaaagaacttttgtaaaggagaaaactccttatattaaatggaaagcaaaacaaacaattaccaaaaaaaaaaaaaagttggaggggtgtttcagaataaaagagccgtctctccagacatctgtctgacgcccaggtggcgctgagaccacagggtgagccttttggctggagatgttgatccctggtttactgcacttcgggctttcactacctttcacccaccggaccatcagtttcactttccctctcccagcgtctctcaagctctgcttctctggccccgttttcaatctagtgcaagaggacctgtagccagggcacccatcctcctcctcctcgtcctgcactgggatcccagctctgagcactcccgggccagggaggccttgctgcgtgctctgcttctgtgatcttacagattcctcatggccaccataggagatggggactgttagcactattcccccaccccaaccaccttttttttgagacagagtctcactctgttgcccagactggagtgcagtggtatgatctcggctcactgcaacctctgcctcccgggttcaagagattctcatgcctcagcctccccagtagctgggattacaggcatgccccatcgccatgcctgactaatttttgtatttttagtagagacaggttagtagagaccatgttggccaggctggtctcaaactcctgacctcaattgatccaccagtctcagcctcccaaagtgctgggattacaggcttgagccaccacgccctgccaccattcccattttacggatgaggaaactgagaccatgaggcagtaattcactctcccaagaaagcaaggagccagtagatctgagcagaacccatgcattcaggccgacacaggaagcaagctgtcaacaggcactgttcatctcctgggcttcctaggcaggccctgaagctctggttttcagtcaccctgttattcatccccaagttaatctcccctgaaagcacctgtcgtgatgccctttcggctgcaagagctccagtcatttccattgcctcaggggcactttgctacctcctctgcctggcacacaacatgctccccagccaagactgttccctcagcacatagcacgccttggccagcaggtctcctcctgtccttcaaagggaacctcctcatttgtgatttcaaagctggactcccaggaacaccctcctcccttactggaacaatcttccccatcttgtctgcctaccggaatttttcccaaccagaaaagcgtcttgagagaatggaaaagtcttatgaatttggaaagttgacagcttgaattcaaatcctagcttgaacttgtgaatttctactttcctttacgaaaacctttgcatgccattctgtgcaggcactagcaaggtggtgggagggagatggatacagtagggtgagtgccgtgtaaagaaaagggagcaaagtctgggactgcagagaaatgccacaaagcacagacagaagagtcccggaggcttcccagagaaagatgacagccaatgggagacctccagggaaagcaggagttaagaaggtagaaatgcattagggaagtgtggcatgagcatgatggtcaatttcaatgtgtccacttgcctgggctaagggatgcccagatagctggctaaacagtctctctgggggtgtctgtgagggtatttccaggagacactagcatttgaattgaatagactgggtaaatttcttgttggtagactgagtaaagaaaatcaccctcaccagtgtggtggggatcatccaaccttagaggaccagaatagaacaagaaggcagaggaaggttgcattctctctgttcaagctgggacatccgtcgtctgctcttggacatttgcactcctggttctccagcttttggactctgggacttacagcagggcccctctgctcctcaggccttcagtcttagactgagccacaccaccagctttcctagttatccagctccagctggcatattgtgggacttctcagcctccataattgagtgagccaactcccattataaatattctcttatttatctacatacatcctattggttttgtttctctagagaaattctgtttccctgaataatacaatgaccaaggcccaagacaaaacacatggtgagctccaagagccacgcagagtcccgcaaggcaggagagctcaggcacatagtggaagcagagattttgaagttgggcatgagctgtgtcttggagtctccccatgtcactgggcttaaactgtgtcctggaaggaacagaacatcccagaggggtctcagtcagggcatggcttgtactttggagagacagcattgggtttatgtgaagaatgaaggaagaagagaaagcactgggtttatgtgaagaatgaagggaagcagaaaggcaaacccatagggcattgagtaacctccatggaagtccatgagggtagggttttaacctcggtgggcctcagcttctgttcgtataaaatgggaataacacagaccctgctgggtgctgtaaggctacataagctagcctgcctagagtgaccagagcacacagtaggtgctcactaaatgtgacttgctgggcttctagtctgcatggccaaaggcccttccctcggacctttccgtgtggatgcctcacaggctgctcagtctacacatccagaactgtcctccctccctggaacctactctttctcctctctttgctatctcaatgaatggcaccccatcctccccatcgcccaggaaatctgggcaaaatcctcatttcttccttgctgtcctccatgcacctaataatccagcctcaatttttggcaattccaacttctaaaatctcttaacgccagcaacccctcttcttgcttacttatcaccacccacctcaggactcccatgacagccttcctgtgatgcatgacgggcacatgacaagggcagttgagggtcaggggccacgggagcaggatgcagccagcacatgagggaggataggcgggaggacaggcagacacttgtgcgtaagagcacgcacttgtcaggctgcctgggtccaagtcctagctccaccactgaggggctgtgtgtctctgggcaagtcactgggcctctctgtgccttagttcctgcctctagagaacggagatgagaagaacacatcacctcataattaattactgcataagtaataattttaattatattgactattatactctattagtgtatgatgtcttttattatatatatttatcatataatatactaattatattaatgagtatactatagtattttatataacataccctaattgcttattatatatctgtataattattttatcatataagataatttcataagctaagatggtattttatatatttcatttattatatatttatatttatatactttattgtatttgaattgtgatgtctaataaaataatagatatgttaattatccttcatattcataataagctccttcattggtgtctgggaagccgagaacatttgtgcgtgtgagctctcctgtgtgttcggcatgcagtgtgttgcgtctcagctgacgtgattgctgtttttggtggcccggaggcacagggtgcatgctacaggcaggaagagctttggagcaggctgactcctgagctctcctctggtgccgtggcttctgaggcccccaggtgacaaccagcctttgccattctagtgtttcctctatgttcatcccgcgttctgagtgtggcacaggccacactcctgaccccaccagcatcaggtgctgtgcacatggtatgaggtcgggatggagtgctgttggcatgggggttgttccttgggctacctgtgtccacatggtctgattaaccccttctgcacatcagcaagggttcagcacctcctcagggttagggcatgcgcagggcatgcagggatttgagggtccttggacaatgcatgttctccatgcaagcatgcagagacatggagagggtctttgtccctttcagtcctaacattctgtggcttcataactacttgtcccacacccgagtaaaaagcaggatcttctcagcactgtgctgaggaagtctttaaaccttccagtaggacatgggatccctgcctgcatcttaagttcccatgtccttaggaaacgtggccaccttggaattcagctctccaagaagcccagtgtgaatgcccattgcaggagcatctgagctcacccccactaaccctgaggtatctgttgaaaagaatagaacccacccactgaaactatcagagatcaaatgttgtgtgttgactaagaatttgtgttaaggcagggatagttgagcaccaatgctttcaaggaactctggagaaatgcaagcctgtatttcctctcagcatggctgcagaagagggccagggcagcagacaggcattttgacccactcacagatgaatacaaagactaaactcagcaaaagccttgaggttgcatttatgtgtctgagaacagtccctggagcacaggcatgggcttttggtaccacgtaacctacaaccgtaagctctctgctctatgctgtccactccatcaatcccacagtgcctgaaatgtcattgtcttacccgatgtctggggtagcatctgtgaacacacggatttgacacttttatgatgctgtttgtctctactgaacccttcttaagcaaaatcacagtagactagcagatcatggtagtatctgaaagcgccaggaccccagaacctcaatcagtgctccccacttcccatggttttctccctgtgtttccacatttggattgtcattgtctgtgaaaaggcatgatccctgtcaacaacacacagtgtatgcaatgtgtgtcttgtgtaaaacggagtgtgaattcttgagagcaggaaggaaaaggggtacaagaggttcccctgcgagatgggtgaggagcagggcagagtgagcctggctgctgggaacccctgaggagagctctggagagggttctggacacgtgggcttggtcagcctgacaattaggatttgtgttaacaggaccggccctcacctgacaccaactggactgaggttcccaggagaaacacttagcatcatgactttggaggttgccatcatttttgatgactttttctttttccttcttttctgtttccctcttgtcaagtttctacctgtaagttatacttacttattttgtgtttctttacagtctcaggggaaattccgttgagttgaaaatttcctcagctcctcgctccagtttctcagaagagtctctctccttgcagaaaagactgtgggtgggagtcaccaatttagcatatttctactaaaaatatgactccatcccaagaaattggttttaaagatttgaggaaaaactgcttttagatttcagagaaagaaaaagagtgtgtttctacttcccccttttaaatctgataacttttattttaatcaggttgacattctgtggtgagcttgtggttaactctttcatgcccggaagcctgttgtcgaccgagaagactcccaggattagaacataaccagcgcccaacatttcatttgcagaagcatctgaggtcccaaaatgtgatggtttagcggcagctgcttgtaggggtatttttggtttcctgcttcttttttcccttctaagtaaagacaaaataactagatccctccaccccaccaccccatcatttcgttgttgtttaacaagtgttgagtaaggcacagttgttctccaaaagggtcttaccctgtgagttactcattttagggttacggaaactctgactatttgacccagtcaaccaggcctcagaaactgtgggtcagataacaaataactcatggtgcttctgtgctaattactgcagagatgtgtccaagtgctcggagatctcctccttgaagccaaggtctcctccttgaaccacaccgccttcttctcctgtcccgagggaatcaggcaacttttctttgatgacagcaacttccttaaatcccccaagccctgagacaggcactttacttctcccacatttccttcaacatttgtgcttgctgaatgaaacaaggaaggtgaatgtttgcttgaatgaaccaatcaatgggtaacagcaccagtgctaatgctaatacactcaactactcattcagaacctaccatggcccaaggcttgtgctctgctcttgggtgctgatccagcaaagagtgggtggagggggagtgggaggtgaagtccctataccaccacttatattttgcactgtcttattttttcctctggtcacatgcatacataaattttatatctctgtaattatgccatttaaaaatcttcctactgaggtagaagttgggactcaacccccgaggcagggctcagacatcggacaaaattgaggactagcaaaaacaggattggggcagaagcagctttccataagacatgctcatgagtgtgccatgtcagtttaccattgccatggcaacacccaggcgttcctgctcctttccatagcagtgaccggatgacccaaaagttactaccccttccctagaaatttctgcaaactgccccttaaactgcatgtaattaaaagcagatataaatatgaatgcaaaactgccctgacctactactctctgcctatgtggtcgccctgctctacagaagcagtcacggagctgtagcacagccggaactataacattgccacttcaataaagctgttttcttttattctaccactggcttgcccctgaattccttcctgggcaaagccaagaacccttgcgggctaagccccacctcggggctcgcttgtcctgcatcactaccaccttctctaggaagatgctctaggcttaatcattgtgttgaattcagctgctgaggactgagaggtgatttggatgattgacttcataaataaaattgggagttagactttccccgctgtggacttgccactgagttgggggagaggggggtttctttctctgataaagttccacatccacagacagaaggaaaaggccctgaactaatcacttcctttggaagaagctttggtaaagaattaacatttgggaggttgtcaagaaaaacctatttgttctataaatatttaaaaattattaaaatttcaaccaatacagaaaaacacaaagattaatataaccaacatgtgcccatcatcaggattcagtaaatgtttacagtttaccttggttgtttcatgtcctttttgtttattttaaatacatgctcttgtcgtgcgtgatggctgatgcctgtaatcccagcaccttgggaggccgaggcaggtagatcacctgaggtcaggagttcaagactagcctggccaacatggtgaaaccccatttctactaaaaatacaaaaattagcctgatgtgatgcaggcgcttgtaatcccagcttcttggggggctgaggcaggagaatcacttaaaccttggaggcagaggttgcagtgagcccagatctcgccattgcactgcagcctgggtgacagagcaagactccatctcaaaaaaaaacaaaacaaacacaaacaaaaacaaataaatacatgctgtagatacagtggagctccctctcggtccaacccaatctcattcttcccctccagtaattgttctcttgaatctgggctgtatctcatgatgcaatatacactactggtttgttttttattttatacataaatgcataatatactgtttctatttgcaactttgcttttttcactcagcagtgtttctgagattcatttttgatgtttattctttttaacaactgtacattattacattgtataataatacagagttcttgataatgccaagtttattaatctaaccttcttttgatggacaattagattgtatctgatttttccctattacaagcaatgctctaataaacagccttgaatgtgtgcacatatgcaagaatttctctaggaatatacctagaagtgagatcactgatcctagaacatggacagcttcaattttactgctatatttaaaatgttctctttgaaatcgctatgctaatttataatcctcatcagcaatttatgaaatttcctgaattcctcacatattcctcatcatcacttaccatagggaaattttaacattttttgccaatctgataatataaaataaaatctcattactatcttaagtttcattgatacctggtgatattgagaatgcttccacatgtttttttggtcatctctgtggcctccttgttcatatcctttgtccctatttttattgggttgttggcctttaacttattgatttgtaagtcttccttatgtattacggatactgagtctttggataagtatagattcttggatcttctaagtagacgttattacttataaatgacaattttattttttgttatccacttcttattcctctaatttcttttgcttgttccattgcattagctggggtgttcaatacagtatagaataaaagcaggaattgtatatgtttccaccattaaatagaaggcttttaaggtatcacgtacatgttattttctgtaagctttcagtgtctactgtctattggttaaataagtttctttttatttctactaccttaaaagttttttttcttttaatcaataatggatattcttttcatcatcattagatgctcttcttcatctattaaaatgattgtgtaggttttcttcctttataccataaaagtatttaagtacattgagagattttctaacgttaaaccattcactattgctgggataaactctgactgatcagaatttttttttttttttttttttttttttgcttaatacattgctagcatcaggtgcaaatgtgttaacattctccagtttgactgtagaattaatttctttttgtaattcttcaccttatcaaccatatgtattgttgagtgtatacatgttcaagattatcataacttccagaataatttttatttgtgaaaatgcctttttgatctagtttctcttatgttattgtagctatggagctttcttatatctggctaccttatcaacaatatgtattgttgagtgtttacagggtcaagattattataacttccacagtgatatttatctgtgaaaatacttttttggtctagtttctcctgttactaaagctatcgagctttcttttggttgctaaatatctgcatataatgtgttttccagccctttagttcaaccttcacatgtcactgtattttaaagacgtctcttgacataacaaaaatagaccttgtgcaggactttgggggaaatttttccccctcaatcagaatacctctgtcttttacaagcaagcttaattgatttatatttattgtactacatttggacttatttatgctattttactttgaacttttattaaccattatttttcttttactgttgtatttatcttttcttgtcttctgttaaattgattgagtttcctttattttctcttttccttctactggtttgtgtattatatgttttaattctacttttagaattaagtcaccattggccgggcgcagtggctcccccctgtaatcccagcattttgggaggccgaggcgggtggatcacgaggtcaggagattgagaccatcctggctaacacagtgaaaccccgtctctactaaaaatacaaaaaaattagctgggcgtgatcgtgggcgcctgcagtcccagctactcgggagactgaggcagaatggcctgaacccgagaggcggagcttgcagtgagccaagattgcaccactgcactccagcctgggagacaaagcgagactccgtctcaaaaaaaaaaaaaaaaaaagaattaactcaccctttaagttctcaaagtactcgtgatgttaaaagtccacagttaattaacatctctcccagttccaggatcttctgttcagaacttagcacatttctggcaactaaggattgacaactgttaaaaaatatcatttcccattatatttttggattggttgttgctgatatataaaaaatgttgaattttataaatgaattttctatctggccaccttatgaaactcttaatagttctaatactttaaccgtcttgggttttctaagtacttaattaaattcctcacatagaatgattatttttatcttctctttttccaacaattgtatgccttatctatgttaccagttttatcagatcactaataacgagggttcttttaaagtcaattggagtgagaaaaacccaaagatgccattaagtccttgagtgtctttggggaagaaaaggtaggtttaggaaaagagagacaaaaggcaaagtgaacaactaagacaataccatgtatcgcaaatttaggtgtgatttaatgatggctaagaaaaaattctaaattatatataaaagtgtattcgtatataaggtagtttaaataaataacaggtaatgtgggcaggcaacaaccatcaaaaatgactggaaatattcaaattcaaccatggtgatttggttggcagcaatcagagaattgactatgcttcagtagattgaaatccgttataatctattaatgtgaatacaggtgacaggaaacaaccgaatacagcattctcataaatagttcttagaatatgaattcaaaagaaactctatttcctcgttgtgacacaatcaagctttaagcaatgaacgctttaattattgtttttcagcttagaaagtaactatatattttatcattgggttctaaaaacaacaccgctcaagaggtcattgtagcaacaatcaaaatttgtggagcattttacagatttcaatgtcacttatgttatttcaactgatcctcatatttccatccttcataccctcacgattcatgcttcagcaaaacattctacctgtagtctcttgtatcttccatatgatgatgctgttttacacttttacacattctctgccagaatggcctgacgtgcctaacctgccagttgaactcccacccacctttcaggcaccttatagttaagagcagccttcattctgttgcctggctcatgggcaggggcaggattcccagcaaggggtactatgtcaagaggcctaaaaggacatatcagcatggtaaaaggaaatggcttggggtgtatgagaagctcctatggttacatgattgggaggaattcttttcatttcgtgttacagacggagcatctgaaatgagaagggaccacagtgagccagtgagtgaaagaggaggaagattctgacacccagagctttaccttcaacatttccttctgtttattccttatctagacttccattttcctaccccatagatacccactctttgcccctaacttgccttcaactcctctactgccttgtaaatgtcccatgtgtgcttgaaaaaagagtgggctctgctattgttggaatcaaatttgttaattgtggttatcacatttgattgttcttactgattttctgtctgtcctatccatcataaaggaagacactgttaaaatttctcattatgatagtagatttctaaatttatccttgttttgtcaatatttgctttgtgtattttgaagttatgttattgggtgcatagaagtacgtaagtgttatgttttcctgattcttgatttgtatattttgaagtgatgtttttgagtgcatacacatatagcatttttatgttttcctggtgaattgaatctttagcaatacgtactgacttctgtatttctattaatgcttctgccttgaagtctgatgttaatataactccttggattcaattgtccattcttttagtttcaaacttttggagcatttatgctttaagcatgtctcttataaacatcatataactgcatatttttaaaaatatatgcagtccaacattctgtaactgcagggttaatctatccacattgataattattactgatatagtttgatgaatttccactgtcttattttgttctttattttttaccttctctttctatgcatttcccccttcttttgatttaagtaagtttttatcctattttattttcttccaatagcttgtaagttattcactttactctgtcattttagatgtaatttttaacatcttaacatgaatccagactttacaaagcctagatttaaccaatatcatagccttcctctcaaataataaataaccttagaacaaattgcctccacaaaccttttctacacagttccctcctcttcctccttgcttctttgtgcgcatttatgtttgctatttgaaagaatttcctgaaagtaaaagtgagattttttagaaggctgacatgagggcagcaatagtagactttcacgtgactcctgtcccaccaccttgagctgtgtggtttagccaacttacttaatctctctgaacctcaatctcttgctttctaaagtggggatgacagtatctaccttccagagccatggtgagcattgaaggtaatatatgcaaagaagcagcacataggcagggctcagacatcatagttattattatatagataaccccaaatggagggcctgggccctctgacttcttcaaagataataatctgaactaaaccacaacatcacacaaacacctcccagcacccagatagtttagacatagctccacctctttgtaagagataaccttcaacagataggtgaaaagcacgctccttcctgaagattatgattctgggtgttggaaaagcactgaactaggagtcagggaacctggtgatctgttgtaatccaaggcttgccacaaacttgtggaatgaccacaggcccagtgttcttatctataaaatgtagaggttggcctaaatgatctttgagctctcttctagttctcatattctatgataccattaaaagggatgttctacatcccttttgcacccaaaccacttactttctatacggcctaaacttctggtttgggtttcccaaggaagcgagagacaaccttcaatattaggcatatctttggagttcttattaaacagtaaacctcatctcactatcaaagatagcctctggctccagcgtcctctttccagtctcccacagagatttcctctgggagtcaacgagcttaaggtgaaatttggctaggggtctgggaggaattcttttcatttcatattacagacagagcatttgaaatgagaaggggccacaggggggcagtgagcggaacaagaggaagattcgggtctctgacacccagaatctatctgattctgacacagaagatgaaccgcgttagagcaagaaccagatccctctttacccagtggcccaagctcttgatgcgtacctgtgtcccttgtaaagctcagtgaaatcatcacctagacatttcctgtgctccgtgcgttattctaatcttcactgggtacaagtagagcttaaagttctgatatatggacaggaaagagaagagggatgaagcctttatccagggctggctgggctaagagtaaaacaacttcacctggattcacccaaggggcagagaatcttatctcagactcggtccacatctttatcagcccccttttccctttatctttcatgttgctcacatgggctccaggggccagatgagttttctcttactttgaacatcagagaaaaaaaataacgacaaaaagttactcaaccgacaaacgtttctcacccacacacctttcctccagtcaatgacgtttccactgcaccctgttagacgctgagtgaggaagcatctgggcacaaaccgctgtggatgcagattgagcagcactcactgtgcactggagggatgggagtcctgtcctcaccaagggggcagatggagagggggcagagagagcagccggggcttcactccctggaaactctcatactccaagtgcggcctggggctctgcagccccagcatcatgtaggagcttgttagaaatagcctcaatgtccacacctgccctgacaaatcccagtctgcaagatcccgggggctctgcacacacgctgctgcgaacaacctcagcatccgtcctgccggctctagagcagccaaccgggatatccttcttcttcagcagtggtgtccgctctctaaaatgactgtcccccacatctctttccagggttggtatttctggttaactcaagggacacaaaaatagctcagggaaaaattaattttcattctactccaattctaataatgaagtggtaaaaattaaagggacagctttcagattatgggagtgcagctgcgggtatgtggcaaaatcgaagaaagagggctcataattccacgtcagggaagagctgctggcctgcccaggctgctgtttatctttactgtgaatggggcctcttttttgtttgtttgttttgttttgttttcacttaacctcagtggcaagaaaaatggggcctcttgccaggaggagcagagagtgacgcggaaggcaaagaccacctcatttcaccaagttcctcgtcttttatttgaaatccaagacatagaagctgcacatttgtccttctgggaagagtgacgagtgactgagagtggagtcgaacactcgaaaggagagagcaggtgcctgggagtcagaaaagctggcttgaattcctaaatctgtcgccgtttgtcctgggtgaggtcattctggtcatctgtggcaggaggactacaaatgcctggcttttccctttctagcgggcacacaaagagacagagaagttgaatctttagcaatccattgaaggggaaaccccacaatgcaaagagaagcattgtcgagggcccttcacctgcaccctctgttctcccagacctgttccatgatgcattccagaggaggtggctctccgtcactgtcacttgcgattgccaaggcgtcagccagacaaggcaaaagctcccaaggggtgttacccttcagctgcatacagaactcctagaggcaacaaatccacaaggaaagatacacccatgatcgtgtatttcagccacaatgatggaggtgaggtggaaaaggacgaggaacaagtgggattctgcccatgtctgtctaatgagcatccacagcaaactccaacggaagatgtgaaacacgctcaacactagaagaactcggtttgactctgtcttggtgtgggtcccaggccaaagccctcggcattttcaggattaatgatcactgctggctgtctctttttccctctgcccacataaaaggcacaaaaactaaagaggaaggccacatcaccgcagagcccgtggttcaggattctcctcctgggagccccgatttcttttcttttctcaccttaacagtgtccagagtacttttattgccagaatagagatatagcctgctcagagcctcatgtgcggcccaccactcaggaacaaagggagagacagatactaagcatgtgtgcaacagagaaaatccagcccacgaaaccgtgtgcaagagcagctccgtcctgcctgaatgtggctttgggaagcccacctagaacttggcctggcgccagtcacccactcagagcctactgccatgaaggcaggccctcactctccatccctgcccacacagggagacccagggcaaacagaaagtcccctagcgggggcccaaggaacccctggctctctcagggtcccattcaagtttctgggctagtcttgcagactaaataccactcagttgcctggtgggagtaggtgctgggcagggtggacaggagccccactgcttctcagccctgtgccaacccctttgtgtgagaccctagtgcagggtggggagccccaatttctaagccttgagtgtttaccaccctacacccccacctccaactcccgaattgatcatctcaaattttcccacagtccataggcaccagacacttcaaataatctcagaaaagaaggtgatgtctacatccagaatcgtgccaatactttaaaattacagggagaaaaatattccccttcccctcttctaaggaaaattctgtctgcctcccaagctcccaggtcccttggtgtgagctgggggagtgcgtagagctaggaattggaaaatattccgggagagaatgatttatgttgagaagacccattgggagaagcaggaagtgggtctggaaagacaggaggaagtgtaaaggcagagaaaagcccttgttagctgaattttgagaagtaatttttggcattgttagtgagtaaaactagagaatgaggacagttgtatgctgtcttaaaaaataaaagaatgataatatagggaaagatgatttcaacattttggagtcatataagtggaatcctcctgttattactgtgcaagacttttagacaaattattttttattctttttttggatgttgttctgttgctgcttttataacactacactgagaagggctaaaaaaaaaatcccaaatttattcctattagattgaaaaagagcaaccctccagcgtacctttccacacactcttctacctcctgctgccttcaggtgatgtttggcacttcctgacaaggcctttcagggaaaaggattatagccaagctctttagtggttactgagctacagacctggaggtgtcaagatcctaaattccaggaaagattctttatgaaaggaaagtctgtgagaataagaagttctggaacttccccttgtccccgcatgacctcttcagacactcgggctaatttatgatgactctgaaaatgcccatgacctcatctagaaaaacgcactctcatggaattcaagagtttctaagggcacaaaatagcttccaagacaatttgtttccttcttttcaaattgatgtgtttagaaatgttcttggcttgtgattgacatctcagattccaaaaacatctgaggtcaatcctggttatttgtgctaatgaataattacaaaagagtagctaaatatgcttctcgctcattttgttgagctaaaattacttataaagaaatgcatagatctgcggcatacaatttgatgagttttgacaaatgtgtacagctgcaaaaacgttttcatcacttctgccttctggtcaatacccacctaccacaagaaaccactgtctgctttctatctctggatataacttttgtctttttgtgaacttcatataaatgaaagcaaagtgtatgcactatttcgtgtttagcttattttgttcaacataacatttttgagatttatcaatattgcctgtatcaatagttcattattttttatttttgaatggtttctatagtatgactatatcataagctacttgtctgttctcccaatgatggatgtttgaattattgagttggttattattaataaagctactatgtactagaatggaaggggcttaataaaagaaagaagttactataaatattttataaaagtctttctgtagacacatcccttcattcctcttagataaatacctagaagtagaattgctgaattgtagggcaggtatatatttaacgtcaataaaaatactttctttttttgttttttttttgttgttgtttgtttgtttctttgtttgtttttgagacagagtctcactctgttgcccaggctggagggcagtggcgtgatctcagctcactgcaacctctgcctccttagtagagaaagggtttcgccatgttgaccgggctggtctcaaactcctgacttaaaatgatccacctgtctcagcctcctaaagtgctgagattacaggcgtgagccaccatgcctggccaaatactttcagatagtgttccaaagtaattacattacttacactgccaccagtaacataagagagttctggtagttctacttcctccccagtatttgacgtatcagtcttttatccatttcctccatttccccaatgggctatctcatcattgttttcaacttgcattttattgatatctgatgttaaatacactttcaagtgtttattgatagtcgtgtatcttctttggggaagtgattgttcaagtctttgcccatttattgggctgtttgccttttactcttgctttgtttttctttatatattctggacacaagtatttgtgacaaatatatatattgcaaatattttctctcagtctatcatttactttttcatttttttctttttttttttttgagatggagtctcgctctgtcacccaggctggagtgcagtgacgcgatctgggctcactgcaagctccacctcccaagttcacgccattctcctgcctcagcctccccagcaggtgggactacaggcgcacaccaccacacccggctaatttttttgtatttttagtagagacagggtttcaccgtgttagccaggatggtctccatctcctgaccttgtgatctgcccgccccggcctcccaaagtgctgggattacaggcgtgagccaccacaccctgcctactttttcattttcttaatgtctctggatgagtagacattctcaatttttttcttttatagtcagtgcttttgcatcctctatgagcaatctttgcctatctccaacttgcaaagtcatttgccttaattttcttctgaaatctttttagttttgccttttatggttacatctataagatatagacctagtacatagatctttatctttatatatataataaaattaattcttgcataagatgtgagtttttttctcatacatttatccatttgctccagaagcatttgtcgaaaagatttttcctttctcattgaatttccttggcacatttatttgtttaaaaaaaaagcagttgaacaaacatgagttgagtccatttcaggactttctgctctgtttcattactgtttgtccttatgctaatactacgctgccttgatttccatagttttatagaaagcctgaatatcagatgtcatgaatcctccaaatgtatacatctttacgattgtcttagatattctaggtcttttgtgtttctaaggagcttttagaaataacttccaaatttgtactaaaaaattgtgttggatttttaaactgtagttgccttgaattaattgatcaatttaaggtgaatagattttttaaatgaatgttacaatctataaagatagtatatttttccatttgcttaattcttttaaaatatgtctcagcaatatttcagagttttcagtttagtggtattacaagtttttggtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcactcactctgtaacccaggctggggtgctcggctgactgcaacctccacctcccaggctcaagcaattctcctgcctcagcctcccaagtacctgggactacagacatgtgctgccacactcggctgatcttttgtatttttagtatagatgggatgtcaccatgctggccaggctggtctggaactcctgacctcagatgatccgcctgccttgtcgccccaaagtgctgggattacaggcatgagccaccacacccaattttacgggtctgtttctattgagcacttttttgagtaggtcaagtatgtcacattttcctgtttcttcacatgtctagattttcttttaatttgctggatattatgagctatacattataaagggtctagattatcttatggtcctttaaaaggtaatgcattttgctctgccaggcagttaaatgactagcgcatcctcttgtctattaggcttggttttaatctttgtaagggcaggtctattttggttttgaaattcatcctagggatgcctctttctctaaagcaggattggaaaactacaacccacagctcagacacctgtttttataaataaaacttagcataactcttcttctctcagccctcacaatggacaatcagggctaagtttcactgagttctgccctgttcaggttcagaccagctcttggctaagaacctgaggtggacccctatacataattttggggcgaccttcatgcagtgtcctctccagagccccaccccacaaatcccagtcatgtcacgtcaatgaaaccactctgcttgggttccacctgggtgctgccgggaaggaaagcaccccaggaaggaagccagggcaactgtgggcgcctctcacgtgtttccctcctccaaaatcatgtagccctgagctgcctgttgttcagcacctgaaagcacttgctgtatacatttggactggttttacagctgtttcagcagaaacgtaagttttggtcccagttactctgtgatggctggaagcagaagtcttcactggtttttctgattattatccatgtcttgctttagtaacagatttatcttctgatacttaaaatattggttggtgttgatccataataagtgccaacaaatggtaccagtgatatgagaagtacagagagacaaacttttgcaggagttaaaggttaaggtaaacttcagtccagtctctatctgaattaccattctcttcttctggacagtgagaaaaaggaaaggaacagaactaccatctattccatacctgttattttccaggctttcttcaagttaccttagtatattatttgctataatcattaaatcaataaaataataattattacagcacgaagctgagccttagagaagtaaaataataaaactatgtagcttgtaagctgctggagctagaagttagaaacccatctttctccttcccaccatgctgctgctcttgccttatcatgagattaccagcatttattgagcacttatgttgcctgttccactgtaatttctggcccatggagcccatttaaattgcttttgcttagtcccttgttggttagagatgggccaagctgtctgatttctccctatcttcgtttttttttttgagacagagtcttgctgggtttcccaggctggagtgcagtggcgtgatctcggcccactgcaacctctgcctcctgggttcaagtgattctcctgcctcagcctcccaagtaactgggaccacaggcacatgccaccacgcccggctaatttttttgtatttttagtagagactgtggttttcaccatgctggccaggctggttttgaactgctgacctcatgtgatctacccgccttggcctcccaaagtgctggaattacaggcatgagccattgcacccagcctccctaccttcagttcttaggggagacaggagagtcctgagccattggatggggatggtcttccggaggacaaggtgctgggcagagtctaagggcacagagaagcttcactcaacctgaatgaccaatacacaaccggccaacccacagccataagtacagccagcagccctgatcagcctccgtgtgggcttccattgacggagaggccacagactcctgctttcctgcctcttcctgtccctgtcatctccccgtccacttcctttatccagcatgtgatatttccccccaaaatctaatctcttagagcagagaacttgttgcaaagtaggcaatggaattatttttctgattagacctgtgccacttttccttttaatagtttgatgtttgaccactgcttctggtgcctttagtgagataccagagtccatttttcaggctgagggagggtaaggtcttcataatataagaaggtatttggtgaactcagaggtgggcaggtgggtgagaaatacacatttcctatttgccagacattgagtgaagcactttctgtatatttctcaaaaaatggcgcacagtcattaattatagaaagtctaacaactcgtatatccttaaaagtatcttgcacagacatattttgcccctcaattaaatgtacgtaactttgcttcttcctttcttcacattccttgaccctcctctctccatacttgcttgacatgaggcatattcggaataaaaccttgttaatttctactcatctagtttgaaatacattgtgctttggagaggagcttggttgtagttaatttttgagccagctctgatacaaagctttctaaagaacaatggtagcagccttagttgctttctcacaaaaagtagggcataccatcttttaaataaagtgaagaaatatgtgattaagtcattataggattaaatatgtgagtacttgcctggggcctcttgagttcctaataggcttcttttgctttgcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctggtaagtgtcccttctgtgactaccaagaacaaaagaactgcagcaaagagtgagacagagcccagcttttgttcactcagccctatagacacaaatgggccagtccagtctacaggataactaattttagtggttcctgaaaagtcattcactaaacacaattttttttttttttggagacagactctcactctgttgcctaggctggagtgcaatggcacgcgatctcggctcactgcaacttccgcctcctggcttcaagtgattctcctgcctcagcctcctgagtagctgggattacaggcaccctccaccatgcctggctaatttttgcatttttagtagagatggggtttcaccatgttggccaggctggtctcaaactcctgaccttgagtaatctgcccatctcagccacccaaaatgctgggattacaggcatgagtcacagtgcccggccacacaattttatttttatttttgagacagtctcgctctgttgcccaggctggggtgcggtggtacaatctcagatcactgcaacctccacctcctgggttcaagtgaatcttgtgccacagctgcccaagtagctgggactacaggtgtgcaccaccatgcctggctaatttttttatttttagcaaagatggggtttcgccatgttggccaggctggtctcgaactcctggcctcaagtgattctcctgcctgggccttataggcgcacaccaccatgcctggctaatattttgtattttttgttagtgatggggtttccccatgttgtccaggctggtcttaaactcctgggctcaagcagtcctcctgcctcagcctcccaatgtgctggaattataggtgtgagccaccacacctgacctagacaccctcttttatcctgagctggaatactgatcacccccctcactggggcactcagactcaactcctttgccaaactcttcacaatagagagggctgttctagaagtttccttgtcattgtgttaagatggcgtctctaacttcaagcattctgaacagccttagggagcaaaggatcagtgtgttgtggagtgagaccactcctgctgctgtcaaacaacacagagacaattgacagcaagcaaggagtcccttttggtgagagacacacacatgcacacataacatacatgacatacacagacacgtaacatacatggcatacacagacacgtaacatacatgacatgcacagacacgtatacacacgctcaaaaacatgtcgtgggcattgccatatgcacttgaatacccagaggccggtgctgggagggcatactctggtttcgtatttgtaagctcagcagccagacaccaccagacacatcgtgggccctggacaggtgtgcttctcaagtgaatgaatacatgaacagtgttttctatgaagcatttgtgaaattatctgcatcattccatctatattttctagccactcggaacacaacgaaacaagtgacacctcaacctgaagaacagaaagaaaggaaaaccacagaaatgcaaagtccaatgcagccagtggaccaagcgagccttccaggtgagagatgattctgtcctccagctaactcctgctagcgcacccttctcctgcaggcagatgatgtgtacccaaaggaagaaggtctgccctgccttctataaacacatgcatgtggctccgtcctcccaagacatcattgcagacaagaattagtgcagagttgctcagaggctgtttgctcagcaactaaagccaatctgacggcagccaatccaggtctgggcttactccctggtttggtaactggccaaatagaattcaacccaaattcaactcaacttaaaagcgtctgttgggtctgtgtgccaggccctgctgatagaagacacaaacaagagtgtgacaacgatccctgccctcaaggaaacgctctgcgtcttccccttaagcacaagacaacgcaccgcaaaaaaattacttgcttcccagtatttcttccagggcaaggttgtaaaatgtgcatgccacacttgtgagtctcaaaagctccagatgcgtgtgtcctggccagcagtctgtgcatgagtgggcactgtggctgtcccttgtctgccctctgctttcccatgactgaattgggattcagttatggtgtcaagaaaatgggctgggcgcagtggctcacgcctgtaatcccagcactgtgggagtctgaggcaggcagatcacttgaggtcaggagttcgagaccagcctggccaacatggtgaaaccttgtctctacaatcatacaaaaattaagctgggcatggtggtggatgcctgtagtcccagctactcaggaggccaaggcatgagaattgcttgaaatcaggaggtggaggttgcagtgagcagagattgcatcactgcactccagcctgagtgacagaggaagactctgtcccccctcaaaaaaacaaaacaaaaaagaaaaaaaacccacagaacctgctaggaagaattgagctttctaaggtcaggctagccttaggagacttcagagccctttgctgattttacaaccttacaaagaactgtatcagataccatcccatttgagcctggctatacaatgagtcaggaccaggaagggttacttcaacttactgaagaaactgagatgcacaaaagataaaaagatttggttaagctcacatagtagggctggaatcagacctcaggtctcccagattagatgaggaaactttctgctgattacttattttaaaagagtttgaatttacttacagcttccattattttattttttaaaacagactaatctaggggcacagttgcaacatgatgctcttactccttccccttccgactttgtcctggaatggtgtttccaagcacatttgtttgttttgttctactggctcccccatagtcaccctgcacagattattggaaggcttcaaagaggccaatgcttgttgtcctttctcgaaggctggctctgcctgagggatgtttcaaagattgtctcagtttgggtgttttcattggaaagaagcaaacccaattcaaacatgttcagacagttacgaattgtactggctgtcaaacaaccttttatcctgagaccaaaacacaagttcagtcgtgatgttcaaggtgccacatggcaggagccagcctgggacagggccacccagcttcctgctggggaagaggctctggaggatatttacagaggctctgttgggtatgcagggttggggagagtctggaagttcagagcacgtgcgcagtttcacaggctggggttagagggcacatacaattccatatgtccaggttgggggctgtgggtggggaattcagagatttaatcagaacaagacatggtctcaggccacaggtccgtcaggcctgggatgtagttgggtgagtggaaagttctggggatgggaaattttgagacgtcttgaaagggcgcatgtgtgtcaaccttcaggtgtggcttgatcagagatggtgctccatttctctgaggttccctcagcccgtccctcctcctggctttggtgttgtccccaatccttccgacatcatcccaagatgcccagccgctgcccccaagaatgcacttcctcacttgtccagcagaaatccaaggtggtcttcatgctccattggcccaaataggcttgagcctacccttgtgtctcagctgagactgccccgcccactcctgtccactgtcaacacctgcactgtcttccaagaggcagttgtggcgttcctgtctcggggccgcaccaaccagaatgaatcgctcattcctctgtgttcccattgccaacgtctgctatccttcacatgcctttcttacccaatccactgtccaccccttgcaggagtgacagggtcttcgtgccttcctacagggcctagcaaacttccccacgctcagacgttctcaacatatattggttgaatgaaaggatgagcaagcagtcaagagagtaagaaccaaggtccagtccctagcaagaggcaacctggactcactcgcggtgctgtccccaacttgccttcagagcgttccttccatcttccaggtcactgcagggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaaatggagaccagtcagtttccaggtagggtggctcccttctggggtccacaatgttgctttgctccatcaggctgaccagggtggaatccctgaccactcctgctggacaagagtggtccttggacaagacccttgatctccctgggcttccattttttctcattctgagaaaaaaaaaaaatttaaatagaccagatcagatggactctaagggctccttcaatgaaggtccccctgtgccctgagtggggagaaaggttggagacagaagagaaggaaagccctctcctaagcaccctagatgctgcctcgtagttggtcctaagtccactacttctctaagccaccaaggcctcctctggctccaagggcaagtccagtttcccactcacacatttttcctcttactggtgatcgtgtaaatgcatgatctgaacagccctccgcggtcagcatgttccttccccttgtgccattccccagctgagcttgtaaaaataaacataaaatgtgcagagtcgggacttactcagtgcacatgcgcgcacacacacacacacacacacatactcatgcaaatgctcagcccaccgatgtcgaggtctcctgctgtcttccttctgaaatcttattagtatcacgacaatcaaaagtgacttacatgcaggctgggcacagtggctcacacctgtaatcccagcactctgggaggccaaggcgggcagatcactttaggtcaggagttcgagaccagcctggccaacatggtgaaaccccgtctctactaaaaatacaaaaattatctgggcgtggtggtgggtgcctgtaatcccagctacttgggaggctgaggcaggagaatcacttgaacccaggaggtggagttgcagtgagctgagatcacaccactgcactccagcctgggcaacagcaagactccgtctcaaaaaaaaaaagtgacttacattcaaccacaagtattcctggttttcttgctcactgcacttctcatactccatgtccttctcttgggttccctagggaggctgttttgttcccttagctgcttccctgggccaccctgacagccagggaatgcttgctgcttccttggaagagggtgagaggcagggcagagccagggttgctgacccctcaggagaagtggagagcctggcacagaagcagctgtcccttagtgcatctctgctccatccagtggttcaatggcattcgtattattatgacctgtttccaagtcacagatggaaaccaggactggggagggaggctggggagaaagcattgctcagagttttggggacagctagggtcagagttagaattcagcctcgtctgctctgctgagaccacttcaccgcttcccagtgcccctgctgtggaaccatgtggggtggcatccctggcgaagtgcccacaccaggattcctgcctcctcgggcgtgtctggggccggctgcctggggcaggcggggtgggagtgaggccctgactcctgtgtttagctccaccagcatcacttactctctcccccaggtgaagagaagcctcaggcaagccccgaaggccgtcctgagagtgagacttcctgcctcgtcacaacaacaggtgcgggagaagacaaacgctggaccacagaggcctagtccaaaagggcaggggtgaccaggagccaggctcagggagataggcggaggtgacctgtaggggagaagcccacagcagcctcctctccctctgagcagggacagggcctcagcaacctgcaggccccaaagcaagtgtcagaaagagggaacccaggaccaggaccaagcacggtccccaggcagagatggaacaccttccctcaccaccaccacgtgtctcccaccagcctctgagcttctcattcacagagacaccctgacttcctttagcctcgtgctgtcctaaagtcacggtagcaggagtgtctctctttatctctttttcacagattttcaaatacagacagaaatggctgcaaccatggagacgtccatatttacaacagagtaccaggtagcaggtgagtggggcactggctttgtggacaaaatgtacaccaggctgagatatggacaggttgactggttagtaggttggttagttggttggctggtaggttggttagttggttgattggtaggttgataggtaggttggctagttgattggtaagttggttcgtaggttgggaggttagttggttagttggttggttgcttggttggcaggttggtttgtatgttggtaggttagttgattggttggtaggttggtagattggcaggttggtgggttagttggttagttggttggtaggttggttggcaagttgataggttggttggtgggttggttgataagttgataggttggttggtaagttgataggttggttggtgggttggttgataagttgataggttggttggtaggttggttgttagggtggtagattggcaggttggttggtagttttgttggtagtttggttggttagctggttggttggttagtgagttggttggtagatagattggtagattggttggttggttagtttgttggtaggttagtaggtttgttagttggttagttgattggtaggttggttggttgactgaaaggaccccttccttacactgcagaatgtgtgagtgaaagactaatccagatactgacgtaactcagaattcgcatgaaccagttacaggatgctgtgagcaaagtctcaagtcagccctatcagctcctctcaagctgatctggaagggctgtaccccgggcctctgccaggggtcaagagtgggaggaaggagccacgtagccagtcagagaggacaggcttccagaaacactgccattgtttcctggtaggagggaaaaacagactctgagtctgcatctgcctagaaagtaaacaaatgtcagcctccaaaacctcagcagagcagcatctggaaaacccgacctctttcaggagatgttaatgtgcttctcatcatcttcatatttcaacatttcttttaccaggcgctctcggtgtccttaaacgaggcctggcctctgagcctttctgaggggcttttgtgagagaagggtgcctcctgaggggaagctccctccaccctcaccctgtcctccctgccctgttcctcaagactcctaggaaatcccatggggagggacctacttcctgagacagggaagagaggctgcagcctccgccttgctctttggggatgtcctcagcctgccctgtggccctggctcctgctgcccccatgccaagcccagggccctttgctgaactccctctctctattgacagtggccggctgtgttttcctgctgatcagcgtcctcctcctgagtgggctcacctggcagcggagacagtaagtgtggcatcaccaaggcagcccttggtcagatcaaagtcctgtacccagccccaccctgcctcccccctaccccctccatgctctctctaatcacctgcagttcagggagtggcaaagggagaggccaatccatgcctcggaaagagtcagttaaaaagaattaaagcaccgccgggtgcagtggctcacgctggtaatcacaacactttgggaggccaaggctgagtggatcacctgaggtcaggagtttgagacaagcctggccaacatggcaaaaccccatctctactaaaaatacaaaaaatcagttgggcatggtggcaggtgcctgtaatcccagctacttgggcggctgaggcaggaagattgcttgaacctgggaggcggaggttgcagtgaacagaaatctcaccactgcactccagcctgggtgacagagcaagactctgtctcaaaaaaaaaaaaaaaaaaaaattaaacgaccagggaaatgggaaggcaaaggagcctcacattcattgagcacccactatacaccaggcttgatgcttgttttataaacattattgaaatctaccttctcagaaacctttggaatagctgtggcctagagagatgcaacagcttggagaagatggcacagcagaggccagcactgcaacatgaatctagagcccatgattttcccacccagcccctacctatagaggacccagggcagcatctatgctgagctttgcctatcctgtgctccccaccctcccgtccacagaagctcacaccggcatccccttgaccaggaatgtaaaccatgtgtggtctttttgcattaactcagattttcaaccctgcatgcatcttagaacatccaggagacagtcttctaaaataccagtgagtggcaagatatgagtaaattccacaggaaaaggaaggcagtccaaagggctgtgcttctcctgtggctcagtgttattcatagctgtgacatcttttaagagaggtttacaagagggaaatcctgtcaccaaaaccattgtgacccactttgaatttggggggaatcttcatttgcaacaatagaagaacaaatttgttgcaataggaaatatttttgtagcttatgtaggttgttcagccaaaacagcataataatttaaaaagttaaaagatagcccaggagttgtggctcatgcctgtaatcccagcactttgggaggctgaggcaggtggttacctgaggtcaggagttcaggaccaggctggacaacatggtgaaaccctgtttctactaaaaaatacaaaaataagccaggcgtggtggtgggtgcctgtaatcccagctacttgcgaggctgagacaggagaatcacttgaacccaggaggcggaggttgcagtgagccaagatcgcgccactacactccagcctgggcaacaagagtgaaactctgtctcaaaaaaaaaaaagaaaaaggtaaaagatatcaatgattgggctccagtcagaatgtctgggggtgagcccaagacatcagtacgtatttttaattgagataaaattcatcatttaaccatcataaaatgtacagttcagtggtgtcttagcccattttgtgctactgtaacagaatgcctgagactgggtaacttataaagaacagagatttataaagaacagagatttataacttataaagaacagagatttcttaccattctggaggctgggaagtctgaggtcgaggggcccccatgtatcaagggcgtttgtgctacgtcatcctgtggcagaaggcagaagggcaagagagtgagagacagcaggaggggctgaactcagcttttatcacaaacccactcctgcaataacaacattaatccattcatgaggcagagccctcgcgacctgatcacctcttcaagatctcacctgtcaacattgctggattagggattaagtttccaacacctgagctctgggggatgtattcaaaccacagtaagtggtatttagtatgtttgcaatgttgtacagccatccccactgattccagaatacttccatcattcccaagagaagccccacactgccaagttccccattctccccagccccgggaaaccaccactctatgttccgtctctatggatttgcctattctggacatttcgtgtaaatggaatcacgtggccttttatgtctgggatagtcgtacgttttaaagcccctcagatgtatctaatacatatgcatccaggtttgacaaccctacacccggccattggttttcaaacttgaactagcaccagaatcatctgtaggaacataaagaaacgataaatgtttgagatgatggatatgctaaataccatgatctgatcactgtaccttgtaggtatcaaagcatccctacatacctcataaatatatataactattatgtgtcaacttaaaaacatttgttgaaagaatcatctggaggccttgttaaagcacagattgctgggtcccacctgtggagtttctgacgcagtcgtcttgcttaggtccaggaatctgtatttctatcaggttcccaggtgatactgacgctgccgttccagggagcagactctgaggatcaccgcactaggctaacagcattaagaatcagggaagctggccagactcacgcttgtaatcccagcactttgggaggccgaggcaggcggattacttgaggtcaggagtttgagaccagcctggccaacatggagaaaccctgtctcttctaaaaatacaaaaattagctggctgtcatggtgcgcacctataatcttagctactcgggaggctgatgcaggagaatcgcttgaacccaggaggcagaggctgcagtgagctgagatcgtaccactgcactccaccctgggtgacacagcaagactctgtttaaaaaaaaaaagaaagaaagaaaaaagaaaagaaagaaaaagaaaaagtaaactctagaaactccctctgtctctctcttgattatccagggcctccctgacccctgccagcatccactctggccaaccctgatacaaactccacagtaagaccctgagaaaatacagatccactcccccaaaaccaaagcccttagcccagccagagagaaaaataaaatatctcttcccttcttatatgggtcatcaggtccataacatactcctaattttcctcatgggaattaaaaagtataaattactgcagtgcaaatgataagccccctagggttattgtagcaggaatgattcatatacccggcagtctaccagtttctctaaggggttagctgactcctaaggtgtcattttaggcttccaggaggggaaggatgtgacgtggctgacatgttgtacgtgtactcagtacttgcatcctctccttcctcaggctgaacacctgacaagccttaacaccttgcaaggatttttttcatttgttagtttgaagatcaaaagccttcgggcccagaggacaaagctatttggaagtaggaatggttcagtgtttatgttgtgaaacaaataactgtgtgaacctatgtgagttcccacaaggtctcccagaactacaatctttggggagactcaaacatacatctagaaatgacccctctagtcagtttgtccaaaagccttcctagaatctgatatcaacccatggtgccctcttgtggcaacagaaatgctgcatttgaattaccgaaagatcactgtagcccagccagagagttttggttggggaaatattttttgtttgtttcgggcaatgaccaggagcccgtgatgtgctacagaaggctcacagtggcttgtgagagccagcggttaaattttcgggacttctgcaaactggtttttaagcatagccattatggaaaattaaagtatttaggctgggagcagtagctcctgcctgtaattcctgcacttcgggagactaaggtgagaggctcgcttgagaccagcctgggcaacaaagtgagaccttgtctctacaaaaacattttaaacttagctaggcgaggtggcacatacctgtagtcccagctactggtaagggcgaggtgggagaatcccttgagtccagcagttcaagattgcagtgagctgtgaccatgccactgcactgcagcctgggtgacagattgagacgctgtctcaaaaaaaaaaaaaaaaaattaaaatatttaaatttacaatttaataaattatattaaaaacaaaggcaagaattacttacaactgatcacttcctaattatttgctaccttttactgttatctttgttcgctgggtggtttacatctattgtgtccgcatggtggaaataccgtttgacggtggctaccgcgcatctcttcccaaccgcgtgatcagtgatgtcacattgccagctggaagctgtgtgtggagggaggattgacaccagggaagacaggcaaccgtcatcagagagctgcttgttaaacatcaccagcacacctctgcttggagtcttgtgctatgggaactctgtgcaaagtagggagtaattagaaattcccatgagccaaataagaactgggaaaaggctaagaccgtattgtccaatacagtagccactagccacctgtggatacttaagtgtatttaaactcaaataaattaaatacaattaaaaattcagttcctcggttgcactagccacatttcaagcgttccctagccacaggtgtctgtgttatcggacagcacaactgcaaaagatttccatcatctcagaaagttctatagcacagtgctggctagaaaccaagtgctttactgcatgcacatcatttagcacagttagttgctgtttattattcctgttccacagctattgtctgccatataaaaacttaggccaggcacagtggctcacacctgtaatcccagcactttggaaggccgaggcaggcagatcacaaggtcaggagttcgagaccagcctggccaacatagcaaaaccccatctctactaaaaatacaaaaattagccaggcatggtggcgtgtgcactggtttagagtgaggaccacatttttttggtgccgtgttacacatatgaccgtgactttgttacaccactacaggaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtatggaactctctccaccctatatgtagtataaagaaaagtaggtttacattcatctcattccaacttcccagttcaggagtcccaaggaaagccccagcactaacgtaaatacacaacacacacactctaccctatacaactggacattgtctgcgtggttcctttctcagccgcttctgactgctgattctcccgttcacgttgcctaataaacatccttcaagaactctgggctgctacccagaaatcattttacccttggctcaatcctctaagctaacccccttctactgagccttcagtcttgaatttctaaaaaacagaggccatggcagaataatctttgggtaacttcaaaacagggcagccaaacccatgaggcaatgtcaggaacagaaggatgaatgaggtcccaggcagagaatcatacttagcaaagttttacctgtgcgttactaattggcctctttaagagttagtttctttgggattgctatgaatgataccctgaatttggcctgcactaatttgatgtttacaggtggacacacaaggtgcaaatcaatgcgtacgtttcctgagaagtgtctaaaaacaccaaaaagggatccgtacattcaatgtttatgcaaggaaggaaagaaagaaggaagtgaagagggagaagggatggaggtcacactggtagaacgtaaccacggaaaagagcgcatcaggcctggcacggtggctcaggcctataaccccagctccctaggagaccaaggcgggagcatctcttgaggccaggagtttgagaccagcctgggcagcatagcaagacacatccctacaaaaaattagaaattggctggatgtggtggcatacgcctgtagtcctagccactcaggaggctgaggcaggaggattgcttgagcccaggagttcgaggctgcagtcagtcatgatggcaccactgcactccagcctgggcaacagagcaagatcctgtctttaaggaaaaaaagacaagatgagcataccagcagtccttgaacattatcaaaaagttcagcatattagaatcaccgggaggccttgttaaaagagttcgctgggcccatcttcagagtctctgagttgttggtctggaatagagccaaacgttttgtgtgtctaacaattcccaggtgctgttgctgctgctactattccaggaacacactttgagaaccattgttattgctctgcacgcccacccactctcaactcccacgaaaaaaatcaacttccagagctaagatttcggtggaagtcctggttccatatctggtgcaagatctcccctcacgaatcagttgagtcaacattctagctcaacaacatcacacgattaacattaacgaaaattattcatttgggaaactatcagccagttttcacttctgaaggggcaggagagtgttatgagaaatcacggcagttttcagcagggtccagattcagattaaataactattttctgtcatttctgtgaccaaccacatacaaacagactcatctgtgcactctccccctcccccttcaggtatatgttttctgagtaaagttgaaaagaatctcagaccagaaaatatagatatatatttaaatcttacttgagtagaactgattacgacttttgggtgttgaggggtctataagatcaaaacttttccatgataatactaagatgttatcgaccatttatctgtccttctctcaaaagtgtatggtggaattttccagaagctatgtgatacgtgatgatgtcatcactctgctgttaacatataataaatttattgctattgtttataaaagaataaatgatattttttaaaaagtcttggtttttattataaatatgataaatattgctagctataatctacataaccaaaaacctttatagttttttggtgctttttttttgtttttttgttttttttttttttgagatggagtgttgctccgttgcccaggctggagtgcagtgcacaatctcggctcactgcagcttctgcctgctgggttcaagtgattctcttgcctcagcctcccaagtagctgggactacaggcacccaccaccaagtccagctaatttttgtatttttagcagagacggggtttcaccatgttggccaggctggtctcgaactcctcacctcaagtgatccacccaactcagcctcccaaagtggtgggattacaggcgtgagccacggcacccagcctggtatcctctatagtttttaatagttttaaataacatgcaaagatcctgtgaaatggccaacaagcacatcaacatcactggtcatttcagaaatgcgaatcaaaaccacaatgagatactacttcatacccattaagatgactttaagaaaaagaataggaatgctcacagatggctggtaggaatgtcaaaatgtgcagccactgtgcaaaacagagtctgttttggcagttcctcaaaaagctaaacataaatttgtcctataacccagcaattgtattcctaggtacacacccaagaaagacaaaaacgtgtctaaatacaaacttgtacacgactctttataacagcattattcatactcaccaagaggtagaaacacccaaatacccaacaacaaagggatggataaaggccgggcatggtggctcatgcctgtaatcccagcactttgggatgccaaggtgggcagatcatttgaggccaggagttggagaccagcctggccaacatggtgaaacctcatctccactgtctctactaaaaatacaaaaaattagctggtcatagtggcgcgcatctataatcccagctgcgtgggaggctgaggcacgagaatcccttgaacctgggaggcagaggttgcagtgagccaagatggtgccactgcactccagcctgggcgacagagggactcttctctccaaaaaaaaaaaaaaaaaagaattgataagcaaatcatggcatatccct

SEQ ID NO: 13703 - DNA, 67755 bp, Human
  misc_feature (1)...(67755): n = A,T,C or G
ctcaagacacactagcagattgaagcttttgagatgttctgtgggaaagaaacccttttaatctttaaaacgttttgacaaagcattttccctaccctttttccccagataatgcctttttagaacctgcagaactaatgtcctgaggtattttctttggaaactgctcacataaccaaaagtataacagtaggaattaacacttcatgtgtgatgatgacctataattacctagaattggagaggccactctgggaagttataagaaaagagataaaggattaggcaatattaagggaaagacatttttctatggtaggctcgacgtttgtattttggtataattgctctaaattgtcctggtcagttataagtattaaaataactgtagtatagatgatagcagacaggtttgagcatggaaggattggatttgggtaacggctactggaatgcaaaaggcagtaggaagtcaaagacagtagatgaaggatctgtagaatctggtaactaattaaatctggaaaaacaacttggatgttttaattcaaagatctaagtggtctatatactttttggatgtatagttagactaaggtgaaaaagaaacattgtattattgacagctgaaaagatgtgtaacagcagggagtagtttctataagttttttgggtttttttttttttttttttttttttttaagacggagtctcgctctgtcgcccaggctggagtccactggcgcaatctcggctcactgcaagctctgcctcctgggttcacgccattctcctgcctcagcctcccgagtagctgggactacaggcgcctaccacggtggcgcccggctaatttttcgtatttttagtagagacggggtttcaccgtgttagccaggatggtctcgatctcctgacctggtgatccgcccgcctcagcctcccaaagtgctgggattacagacgtgagccaccgtgcccggcctctataggtttttaaattttagttttgtttattttgtttatattttaacaggataaaatttattataatatagtttgccttctaaaaagagtccatatagaaatcactaacttaaactgaattcatacacaaacttcaaatcacatcagaagtttttcctggaaaaattaggtcctcttttttcaataattggggcttgtttatcagaaacgacttagtgataacaaagcaagacacatttttgtattattatacatttaatttagacgatggggaaattccttcacactacctcataacataaagcaggtttattaggccttaagaatcatagaatatttatacttttcatgtaaaatagaaaacctaattttccagccattcatgctaaacagcagggttaaagtaatgatcaggaagactttatacgttttaaaataaggtagttttcatgagacattttgcagtgctcccttggtaatgttcatattcagtgagcagaaaagaaaagatgagagagttaggactctactattgaacctgtttcttgaagaaaacaaaaaccagatagtacaattggatgtcagaaatgattattagaaagctaggtaaaaacagtacaggttgagtatcccttatctgaaatgcttgggaccagaattgtttcagaatttggaattttttggattttagaatattcgcatatacatatgagttaccttggggatgagagccaggtctagacacgagattcatttatgtttcatatacaccttatagtctaaaggtaattttatacaatatttttaatgattttgtacaggatacaaagttttgagccatagcatgaggtcacatgtggaattttccttttgtggcatcatgtaaatgctcagaaagtttcagattttggagcatttcagattttggatttttggattagggatgttcaacctgtatttccaaatacttaagatagggccttaatttgtcttcctttttattgtcttttcagacaaatgaccatggaaacagttgaatcccagcatgatggaagtataacagcttctttgacagagagcaagtctgctcatgtgcagactcagactggccaaaattcaatccctgctttagctcaggtaggcaataggcaggcaccgttgaaagtcaaaatatatggaaatgagaattaggtgcagattctgttttcttgccattgatcttaaattttccatgttccctggttatcagccattcttgcttatttgattgtgaagaaaagatacgtgttgtaattagccttgcattttaacagacattcagcagtgccccatctccattgccaccaccactatggaaggaaaaacaaaaacccttcctgaatatgtaatcctcaaagtatgatttgagagggttgctaattcgaaattgatacagttctgatgtccttagctgttaagatgacagaaatcttaccattttccccgtatatatttgtcttaatcattactttcttttcagttaggtctcgaactttgaattggtttcattcagaggtcaccagtatcagttagtacctgtttctagatcctaaaatttatttctgagatatctattaaaaatatagtaaaaataaacacatttgttagttcatcaaatatttattgaatgtctgctgtgtctaattattccggatgcatgtggatatgtagtttcaggacttaaatatcccatggtttggtagggtagacagatattttagcaataattccagtagggtaagaagtgctgtaagatactatgtagaaaatgaataaggcctacagaagagggagcagccagctgactaggagtgctttatatatctcctttgagctaggcacaaaggatgagtaggagtctgccaggttgataaggtgaggaagcatattctaggcagagcgaagagtgtgcacagaggcacagagccagagcatgggatgttcagggaactatgggtattgagtttaactggagccaggtgtctgggctgggcagtccagctggtaaaggtaagtagaggatcgtatacatttcagggtttagagtacactgtactctaaatagtattgaaatattttcaggtgcccaccgtattttcagttttgacactagtagccatgtggaggtggaattgaaagtcagtgagtcggaactgaagacaccatcagggtgcctggtggagtcaaagtagcgtgagatacagagcagtggtgagacctttgtggtacattaaagggagaataaaaaggacctggtggttgactggaaggcccaggggaaacaccaggcacttcttgggttatattaggccagactggtgtgagagctctcctttcctgtgcacccagcctgcttttctttcctctttaaagctgccaacacccactcgttccctgcaggttttctgcggtattctgtagagctgtatctccctagcaacaccttttgttacactgagagacaggcatttaggttaggccaggccttttgcttaaacacacacacacacacacacacacacacacacacacacacacacacacacccttgttaaaaaaaatgcatgttcattgtagaaaataaatattaaaatgaagaatataaaaactatccataatcttaacatccagagatttaatcattgttaacattttggtgtagctcctttagtctttttgtctgtgtgaatagaatagaaagcatatactttttctcatgattttgggattttccagaatctttagagctatggtttctggtcagtaattctgccctttgctgaagttgtagttgaaagcactttcttttttttttggtagagacaagttctcactatattgcccaggctggtctcaaactcctgtgctgaagcagtccttgcacctcagcttcccaaagtgctggaattacaggtgtgagcttcttgtacccagcctgaaagtacattttcttccttctgactctacttccttctaggtgggtcccggctcactaagttctacagatgccttttgccccagaattctggggctgaagtcccagcaatagatttccattatctaaatatggtaatttgcaattctgaggaccttcaggctgggcgacagccacctctgtgagcctcactcagaaattgccaacaggtggccaggtgcagtggctcatatctgtaatcccagtactttgggaggccaaagcaggtggatcgcttgaggccaggagtccgagaccagcctggccaacatgaagaaaccctgtctctactaaaaatacaaaactaggtggttatggtggcacacgcctgtagtcgcagctgctcgggaggctgaggcacgagaatcacttgaacccaggaggctgaggttgcagtgagccaagttggagccacttcactccggcctgggtgacagagtgagaccctgtctcaaaaaaaaaaagtgttgccaacaggttaagtaatgtggagtctgaaaagtagtcttaggtttctgagggcttgaaagtgttgccaacaggttaagtaatgtggagtctgaaaagtagtcttaggtttctgagggcttggaattgaataggagaccagtggacagaaactaggttttagtaggttatagaataagtaagaggaggggaagtggaagttggaagtatagactcttttaagaaatttgtcttgaactaatagagaaagatgggtttgtgaaacaaaggggtgagaactgggatgtgagaaatttgggaatgttttgaataaaatggaacattatagagacttgtgagaaggcagaatcaaggaactagaaaaagcctgtgtttacgtttgtaatgcttctttaaaaatctcaaataatgttgtatgctaataaatattgatagttattaaatctggatagtaaattcttggagttttgctgtttttctattttatattgttagaagtatttttttgttgttgtttttgttttgtttcgttttgtttttttgagacagagtctcactatgtcacccaagctggaatgcagtggtgcaatctcggctcactgcaacctctgctcactgcatcctccacctcccgggttccaatgattattatgcctcagcctcccgagtagctgggattacaggcatgtgccaccacgcccaactgatttttgtgtttttagtagagagggttatgccatgttggccaggctggttttgaactcctgacctcaagcagtccacctgctttgatctcctgaagtgctgggattactggtgtgagccactgcacctggcctgtttgaagtatttgatcaaactgaaactatggtttttatctttcacatgctagaaatatagagattaagaagtaatctgtatgccgacttatggattattttagttaactaagaattatcctccatgccatgcatggatcatgattttttgaagaattagaagacaattcttagcagtcagaattttctgaacataattactcattaaagttcttgtgacaccagcagctgttcgtttatgagtattgttactatcatacaatagtatatgtcttacaaggagtaggaaatcaagctgaactctattaaccctatgatgtatgccaaaagtgactgactcttctgaatttctgatggcttcatatttacttgccacttgtctcatttttcttcagacttgaggattgtaaatttccatatgttttagatttaaacttagttgtgaataaagaggaatttctgacactcaccttccttgtttatatgatcagattatcagtaaacagtgtgggaacaaaaggcgtaagcagaacgttcagtgggtttgattctttgcatctaaggtcatttgatactggttgttttgattgtcctggcctttccagagcttctgctaatcaagaatatactatgaaaatcatcagagacctagcaactgttgagcttggttttggctgtcaggcccctgttctgctgatggattgaggtgaggtgcaggtacaccaggggacactggagttttgcttttctgttttataactttgtagtaataaatggagcctttctcttctgtttgaaaacaaaatcacggtggtggtaatgtcaaaaagttggaagcaggagttgccatcaacaaatcctagtacggcaaataactggaagttaaatgttgtcttggctttcttcttgcctaaattatttttatgctgatttatttttaatggaagctggtatcttatttattaagtacgtgtgttgatatacaggactagactcgctggattctggtaaaactgttgataataagttggagagtccattttaaataacctggccaggaggaaatcttttccagaaatcaaaatggtgaaaagcaaaaatattgtatgtacaatacaagtagttttaaaatagtgacacttacatcctccggaaataatattgtttttaaatgggtaatgggaagttaaaacttcttttgttgtgaaagacttcaaacatacataagagtagaagaatgattccacatatatataaagttagtaattattaagattttgctagaccaggcatggtggctcatgcctataatcccagcactttgggaggctgaggcaagaggattgcctgagcccaggagttcaagaccagcttgagagcttgtctctttaataaaaaataaattaatacaacaaaaatttttgccaggtgtgatggcatgcccttgtagtcccagctacttgggagactgagaccagtggattgcttgagcccaggagctcaaggctgtagtgcactgtgatcatgcctatgaataaccactgcactccagcctgacgacatagcgagaccttgtctcaataaaattaaaaaaaaagattttgtagcacttgcctcatctatcttctttttttcttcttgtcgctgaagtattttaagctgctcagcagatctcagacatcatgtcattttactcctacttacttctgggtatacaactcttaaaacattatggacattttcttatataacaaaatgtcattatacctagttaagtataattaatatgcaatccatattcatttcacaaatgtatgatctactctgaaggcagtagagtggacaccttgaacttttcttgttcctagactcttgggaattggtaacactgccatgaagacctaggtgggtaaggtcattcagatggagccagtggaaaggatgtaccttaaaactgactttctgaagtataattctccatagctgctgctgaagcctggaggcctcgactctgaaagctaaataactcttctttataaatgactacttctcaaggtttcagcaaagatagaagggaaagatgaaaggagcagtatgctaggagtcaaaaggggggaaggaaactctggagattgtcaaggtcagcaaactgcctcgagagaattagttctgatataacacttaacctctccaaggacctctgtatttttggaaacaaggagacactagggaggcagagaaagccgctagggaatgttgttcagagattatactctcctaatcaagctgaactctgttaaccctatgatgtttgccaaaagtgactgactcttctgaatttctgatggcttcatatcttatcctttcttatcttttccattctaagtgcacaatgtgtaaggagtccctcggaataaagcagccctggcatgccatcggggattgaagtaggaacgatttaacaagggatacttggaaatgttgtcatgtgcgagttgtaaattttcttttttaatctggtggaaaattggaatggcatttctctgttttgcccagctatgccaaaaatcttcttggtcccacataggcctaggaaggatgtagatggcaatcacaaaacaaacaaaaaatgagcaaacaaatagaagacctcaagcaacattttctcttgttaataggttagcaacctcatatttgtatattaaagagatctgcattatgttaggttgatttcatataatttcagctaagtagatctagtttaaggtcagtgttttattgaatcttgtattttagcttcagtatattaatttccttagctgagggactcctactgaaggagaaaagtgttcctgttaaaattttgaaataaaagtttctgttttactgtagattttttcactattgctccttatttttatgtattctttcccctggctgtttttcatggttcatattttatctgttacacagaacatttgtattctgttagaattatctataaaaatgaacaaaggatggaagaaaaaggaagagagtaatttttttcaataaatgctaaatctgtattataaaatgttccttagtcatccaattcagaaaaacccactgctttgaaccgtaactcattattgaaggtaattcaaggttcagaggccataataaaaagtaactggtgaactgttaatattagtaaccaacttttttcaacttcaacaagaatttgttatgtatctgtactcatattttgataattttgtatataatagctagtatatttctttaaaagtttgtttttggctttagaatacgcttttatgttttcatcccagtagtgtattaaaggtgacagtactttgctttaaataaattttgatgttgcagaggtaatttcaggaagtataaagcaatcagagtcaaatttcagaaaaattttggttttataattacaataaaaatgcatacaaatttattttagtgtttgagagactgttaaagatttttttgtaatttgtaatgattatgaggtttggatactcgtagaaaatgttcaagttccctttcttagttttactaatgggtagtttgtcactagcagtaatgaaaaaataactgagtataaatacagttactccttttgcctttttctgtatgattttctttagtaaaagagtaagctgagaggacggaaaaatggggagtcattttttaatgggtatggagtttcagatttgcaagatgaaaaagttctgtagatctgattaacaataatgtgaatatacttaacactacaaactacacttaaacagtgaatatgttatgtgtcttttaccacaataaaagataatgaataacaaaaaaaataggctagacattgaaatttgaaaaaagaaacattaattttatagtttcttttttgagtaagacttagggattcttttcttttcttttcttttcttttttttttgtagagatgggagtctcgctctgtcacctaggctggagtgcagtggcacaatgtcagctaactgcaacctccacctcccaggttcaagtgattctcttgcctcaggttcccgagagctgggactacaggcgcgtgccaccacacctggctaattgtttttgtagttttagtagagatggggtttcaccgtgttagccaggatgatcttgatctcctgaccttgtgatccacccgcctcagcctcccaaagtgctgggattacaggcatgagccactgcgcctggcctcttctttctttctttcttttttttttttgagacagagtcttgccctgttgcccaggctggagtgcagtggcgcgatctcggctcactgcaacgtccacctcccgggttcacaccattctcctgcctcagcctccttagtagcagagactacaggcgcccgccaccacacctggctaattttttgtatttttagtagagatggagtttcactgtggtagccaggatggtctcaatctcctgacctcgtgatccatccacctcagcctcccaaagtgctaggattacaggcgtgagccacagttcccggccacctcttttcttttctttttttttttaagaaacagagtctcactctgtcacccaggctggagtgcagtgatatgatcgtgactcactgcagcctcagtctcctgggctcaagtgatactcctgcctcagtctcctggagtaactagaactacaggtgcatactgccatgcctggctaacttgtaagttttttgtagagatggggtctcactgtcttgttcaggctggtctcgaactcctggcctcaagtgatcctccctcttcagtctcccaaaatgttggcattacaggtgtgagccactatgttcagccagagactattttctttcccttattttatcgtttgttattataacccttgtaaatcccagactattaagaattatatttggaaaacagaggctttgggaaatttctgcttcattgcatagttgtgacgatatcttcatagtgctctccacaaatgtggatttttgtagccctatcagagataaaactgtagtggttttcttaaaaggtataggggagaaaagcctggttatggtaatgaatgtattaggtagagacaatgttagatgaagaaaacagacatagttcaggaaaaacacatgtctttaaacaggtttcattcagaagtagacctctattttggcagataataactattttcctttaaaacaatgcatataaagatgcaacaacaacaacaaaaactacaggtcaatatccctgatgaacataggtacaaaaatccttaacaaaatactagcaaaccaaattcaacaacatattaaaaagatcattaacagtgatcaagtaccattcatcccagggatgcaaggatgtttcaacatatgcaaatcagtaaacctgataaatcacatcaacagaatgaaggaaaaagaccatatcatcatctcaatacatgcataaaaaacatttgaaaaattcattatttccttattataaaaactctcaacaaattacataaagaagggatgtacctcagtgcaacaaaggcagtatatgacacacccacaactaactaacatcatgctgaatggggaaaggttgaaagctttttctctaagatctggaataagataaggataccaggccaggtgtggtggctcacacctgtaatcccagcactttgggaggttgaggcaggcggatcgctggagcccaagagttaagagaccagcctgggcaacatggtgaaagcctgtctctaccagaaaatatacaaatattagccgggcatggtggcacacacctgtaagtcccagctacttgggaggctgaggtgggaggatggcttgaggctgggaggcacaggttgcaatgagccaagatcatgcccctgcactccagcccaggttgcagagccagaccctgtctcaaaaaaaaaaaaaaaaaaaagtcacagatgcccatttttgccacttctatttagcattgtactcaaagtcctagccagagcaattaggcaaaagaaagaaaaggcaactgaattggaaaggaagaagtcaacttttccctgttcatagatgacatgatcttacatatgaaaacctttaaaaaaaggaacaaaaattagaaaaccttaaagatgccaccagaaaaacctgttagatctaatacatgaattcactgaagttgcaggatatgaaatcaacttataaaaaccagtattgtttttatgtactaatagtgaactacctggaaaaaatatcaagaaaactctatttacaatagctatgaaaaaaatacttagaaataaatttaagcaaggaggtgaaatatctgtacattgaaaactataaaaaacattgatgagagaaattgaaggagacacaagtaaatgttcatggattggaagaattagtattgttaaaatgtccatactacccaaagcggtctacagatttagtgcaatccctatcagaaatatcaatgacattcttcacaaaaatagggaaaaacaatccccaaatttatacaggaccacaaaagaccccaaatagcgaaaggaatattgaaccaaaagaatgaagctggaaccactgccatggccagtccattgcagggtatcctgcagctgctacagaccgagaagcaggctgctgagaaggtttccaaggcccacaggcagatgaaccgggggctgaagcaggccaaagaagtagcttaggctgaaattgaacagtgccgcctgcagagggtaaaaagagttcaaggcgaacgaagctgaagcactgaagtggagaaggaggcccaggagaaaagatgatcaccctccagacctacttccagcagaacaaggatgaagtcttgaataacctcttggcctttgtctgcaacatccggccagaaatctgtgaaaactgctgcataaatgggtaggagaagaaaaaagcacctgttctatgaattggcattttagatgctctcatggaatatgaagcttcaacatagctcaagttatattcttaaggcattaaattatttctgtatattatataataggtccctccactttttggagagtagcaaatatagtgttttttttttgttgttttgtttgttttttttttttttttacagacttagcaacttatctaaagatttcatgtttcttagaaaattaattggtatatgttgtctatttttatatgccttttggttcaagcaacatatatatcagtgttgacattttctttcttagatctaattaaacaaaaccaattttttttgaagaaagaaagtgattaaataatttttccccctaatgcattcttgaattcatcagggctttatctatgaaaaagtagtaaatagttatttgtaacctatgtgaagcaacattcagccttaatctattcctgctaatgattagaacaacaatattggtatagttgtttgggttgcttttagtttctcttaatcatgtttactagatgatagaacttaagaacttgttacatcttattacttggtgtatgataatcatttgaaagtcaagactctttgtcatgcaggaaaaaaaaaagaacaaagctgaaggcatcacactacctgacttcaaaatatactatagagctatagtaattaaaactgcatggtaccagcatgaaaacagatacattgatcaatggaacagaatataaagtccagaaataaaaccatgcatttacttacaccaacttatattcaacaaaaatggcaggaccacacaatggggaaagggccatttctttaataaatgatgttgggaaaactagatatttacacagaagaatgaaattaggcccttgtctctcaccataaacaaaaatcaactcttgaaaatggattaaatataagacccaaaactatgaaactactacaaggaaacaggaaactccttgacattagtctggccgatgagttttttgatacaaccttaaaagcacaggcaacaaaagcaaaaatggacaaacagtattacgtcaaactataaagcttccccacagcaaaggaaacattccacagggtgaagaagggacctacagaatgggagaaaatatttgcaaactatacatctgataaggggttaatatccgaaacacagaaggactcaaacaactcaatagtaagaaaacaacctgattttctaaaaatgtgcagaagacccgaatagatttttctcaaaagaagacataaaaatggccaagtacagtcattcatcacttaacaacaggtctacattttgagaaatgtgttgttaggcaatttcatcttttttttttcccttatgatccaacagaaccaatggtgtggtgatttcatctttgtgcaaacatctagagtgtacttacacaaacctggatggtatagcccactacatacctaagctgtatggtacagcctgttattcctgggctgcaaacctgtataggatgcgattatactgaatactacaggcaattggagcacaataataagtatttgtgtatctaaacataggaaaggtacagtaaaaatacggtatcaaagataaaaatggcacatctgtatagggcacaaaaccatagtggagcttgcaggactggatgttgtcctgggtgtgccagcgagtgggcagtgagggaatgtgaaggcctaggacattattgtacactactgtagactgtctttttttttaatagaattttgttcttttgcccaggctggagtacagtggcacaatcatagttcactgcagcctcaaactcctgggctcaagtgatcctcctgtctcagcctctcgagtaactgggactacaggcacatgccaccatgcccagctaacttattttatttttttgctattgtagacttgataaacattgtacacttaggttacactaaattcataaaacatcatttcttcaatgaactgtagcttactgtaagttttttactttttgacttttgtaataacacttagcttaaaacacaaacatattacacagctgcataaaaatgttttcttctatgcttatgctgtgtaaaccttttctgtgtttgaaattttttattttttttatttttaaacttttttgttaaaaactgagacacaaacacacatgttggcctaggcctgtatagtgtcaggatcatctgtattgctgtcttccaccttcatatcctgtcccattggaaggttctcagggaaagaacactcatggagctgtcatctcttatgacagtgccttcttctggatactcgctgaaagacctgcctgaggctgttttacagttaactttttaaaataacttgaagtaaaataataataaaaagtatggtaaatacataaaccagtaacagtcatttttttattatcaagcatatgtactgtacataattgcattgctatgcttttatttaattatttatgagacagggtctcactctgttgcccatgctggtgtgtggtgatgtgatctcggctcactgcaacctccgcctcctgggttaaagctattcgcgtgcctcagcctcccgagtatgggattacagtcgtgcatcaccatgcctggctaatttttgtattttcagtacaaaatttctctactaaaaatacaaaaataagcagatgtggtggcccgcgcctgtaatcgcagctactctgggaggctgaggcaggagaatcgcttaatactccagacgcggatagttgcaatgagccgagaatggtctcatgctctacatccaggcctgggacaacacactcatactccgtctcaaaatcccaatctggcaccaaaagaatgatgaacaaggaaatgcacgttctaaccacactttgctcacgatgcgcaaaannnnnnnnnnnnnnnnnnnnagacgagacaattgtcaaaaacacaaaaaccaatgtgtgccagcccttaatcgcagatactgggagctgagcagaagattgcttaaacccagaagcgcgaggttgccagggaccgagagatggttcccagtggactccagcctgggcaacacagcaagactccatctcaaaaacaaaaaataaaaaaaattagccaggagtggtgttgtgcacctgtaatcccagttactcagaggctggggcaggagaatcacttgaacccgggaggcagaagttgcagtgagtcgagatcacaccactgcactccagcctgggcaacagagtgagactgtctcaccaaaaaaaaaaagctcgacatcattaatcatcagggaattgcaaatcaaaactacaatgagatatcaccttcctcttgttaggttggttattatcaaaatgacaaaagataacagatgttggcaagaatatggagaaaagggaacacttatacactgacggtgggaatgtaaatttgtatagccatatggaaaacagtatggaggttcctccagatatgaaaaatagaagtaccagatgatccagcaatttcattactgggtatctatccaaaggagatgaaagcagtgtgtggaagagatatctgcacttccatatttattgcagcactatgcataatggccaagatacggaatcagcctcggtgttcatcagtggatgaatggataaagaaagtatggtatgtatacacaatggaatactattcaaccataaaaaagaatgaagtgtcatttgcaacaagatggaggaatctggaagtcattctgttaagtgaataagccaggcccagaaagacacatactgcatgctctcactcatgtgtggagtctaaaaagttctcatagaattagagggaagaatggtggttaccagaggtgggggtgcttaggcagagggaaggatggggaaatgttggtccaagaatatataattacagttaggaggaatgagttcaagagagctatcatacagcatggtgactatagttaaggacaatgtattgttgaaaaatgcagagatagttgaatgttaataatgttctcaccacaaaaacaactatgtgaggtaatgctattattaattagctagatttaactattacataatgtatatatactccaaaacatcatgttgtacatgataaatgcaattttttctgtcaattcaaaatgtaaagtaagaacatttaaaaggtacatctccaacctccacatgctttccttgcccagtctttctctcctgcttgtctctctccctgtcagtatgagacaccctctctaggaagccgctgtcatcctttacaaagaaggagtccagaatctaaaatcttacacagcctgcttcaggcagtactgaagcctggacttctcagaggccacagtagaggccagttgtagcaaatttggttgaaaaagcaagaattatttttaagtttttctaaccacctgagctccatttgcccagttgtgagattaaacactttcttcgggcaccagcaaatcatggccaccagaaaataaaatcaaatacaaaataataattaatgggagaggagcagtggctcatgcctgtaatcccagcactttgggaggccaagtcaggaggattacttgagcccaggagttcaagaccagcctgggtcaaggtaagactccatctctacaaaaaaaaaaattagccaggcatggtggcacttgcctgtagtgctatctactcaggaggctaagatgggaggatctcttgagccctggaggttgattgaagctgcagtgattcgtgatcatgccaccgcactccagcctgggtgacagagcaagaccctgtctcaacgcaacaaaaaacaaaaataaaaaaaaatagagaacaaaaatattaaatgtgtgcgtatttactattggatatggtaatataccatggtaggtattgcctttgtaagttggtctcccctgtcttttgttcctagagctttctcattttctcatctccaagggcttgtttactgcttcatacataaaaagaggccaggtatgatggctcatgcctgtaatcccaacactttgggaggccgagatgagatgattgcttgagcacaggagttcgagaccagcctgtacaacatagggagaccatgtctctatgaaaaattaaaaacttaggccaggtgcagtggctcacgtgtaatcccagcactttgggaagctgaggcagtcagatcacctgaggtcaggagttcaagaccagcctggccaacaacatggtaaaaccttgtctctattaaaaatacaaaaagtagccaggcatggtggtgggcacctgtaatcccagctactcgggaggctgaggcgggagattcgcttgaacccgggaggcggaggttgcagtgagccaagatcacaccactgcgctccagcctgggcgacaagagtgaaactccgtctccaaaaaacaaaaaacaaacaaaaaaaaacaattagttgagtgtggtgacatgtgcttgtagttcaaattactcaggaggctgaggtgggaggatcgcttgagcctgggaagctgcactgcactctagcctgggtgacagcaagaacctatctcaaaaaaaaaaaaacaaaaaaagagccctaatttatacatgtattctcagtttgaattaaatttagcttgtttacttaaaagtagtgttgaaggtatttttcatactatattttaatactagattaaagttgatactaattttatgcagttttaagtattaagactaatcatttgacctttgctttctttacctaaaacatggaaaatactgatttcatagattaaatgagatgatttgtgtgaagcacaagcacagagtttggcatctggtcaatgtgcaataaatgcttgcttttatcctcatagtgaccttccttgatcttaaaatggtagtaattaggctttaagatgaaatggcttatgctggttttaaaatatattgtattcggaatcctttgtaaagtaacaaaaatctacaatgcttagtaggcctccaaagggtatagaggagaaaagctaattttttatagttttataagcaaagttccggtatgtcaggagcttgcttaaaattatatgttttatgcttcttaatttaggtactttagatttctcctagatattttaaaacattgctggccactttgggcataaaaatctaaaatataatctgtaactatttcagatttcatggtaagaccaaactgcattataatttttgtaaggagctaaactcttagactttactatttatgtactctgaccattggactggaactgaaaacaacttaaagatgcaatttggcctggctgtgttaaattagtctgctttgcattgctataaaggaatacctggctggggcagtggcccatgcctgtaatcccagcactttgggagcctgagttgggtggattatttgagctcaggagttcgagacgagcctggccaacatggtgaaaccctgtctctacaaaaaaatacaaaaatcagctgggcatggtggcaggcgcctgtaatcccagctacgccggaggctgaggcaggagaatcacttgaaacttgaacccggaaggcagaagttgcagtaagccagattgcaccactgctctccagcctgggccacagagcgaggctccatctcaaaaaaaaaaaaaaaaataaaagaaaaggaaaaagaaatacttgaggctggataatatataaagaaaagaagtttgttttggctcacggttctgcaggctgcacaagaagcatggcaccagtatctgcttctagggaagcctccagaagcttcaaatcatggcagcaggagaagggggagccagggtatcacatggagagagagggagcaagagagaggggaagtgccacactcttcaacaaccagctctcagaactaccagagcgagaactcatgaccattcatgagggatcccccatgacccaaacacctcccacaaggccccacctccaacattgaggattatatttcaacatgagattgggagcggataagcatccaaactgtatcacgttttgtcaaaatgattctgattttgacatctacttttatgtaattcttctttcctgttgcataaaaagcctttttttggcttagaatcttactgcaaattctttatgtgtatttattattttgaaatacatttggctagtaaattatgatcagtttcagtcttactgaaaccaaatacgagattggctttcaaaagttccttccagagctaaaagagtttgacttctataaaggtcatgtccatttttatagtactttaatatatatattattataataagtgaaacatatctcatattggttagaatataaaatgatgccccaaatactataaataggaaatccaagatactgtacagattagctagaaaaaaaaaagtttagctagggcactgttctcaaaggataaagaaccctaattttaatttaagtgcttactggaagcattatcaaaatagattatttaaacccttctggataattaagaatgactgaattataacacttgctttgctttcaagaagtgaattttttagaaacatgaaatttgaccatttacgtttacagtatcagaaacaatgatccttttcccccttttcaattcagattatggatttcagcttatgcgctatacataaaaaaaaggattggaggcaacaacaacatctctttagaagataatggatagtaaatatagaaataataatcatacttggcttatctctttgtaacaaatattttcaacatatattcttaaggtaaaatttaaatgcattgaatttgcaatttgttagccacactatcttaaaaacaaaacaaaaaaaacagctaggccagacacagtggctcacacctgttatctcagcactttgggaggccaaggcgggtagattacctgaggccaggagtcgagatcagcctgacaacatggtgaaactccgtctctactaaaattacaaaaattaactgggtgtggtgacaggcacctgtaatcccagctacttgggaggctgaggcaggagaatcgattcaacccaggaggtggatggaggttgcggtgagcccagatcacgccacttccctccagcctgggcgacagaacaagagtctgtatcaaaaaaaaaaaaaaattaccagggtgtggtggcgggcacctgtaatcccagccactcgggagtttgaggctggaggattgcttgagcctggaaggtggaggttgcagtgagccaacattgtgccactgaaccgcagcctgagcaacagagctgaactctgtctccaactcaaaacaaaaaacaccttcatgggaaggaagtcactcaagataaccgaaatgaagaccaactacatttttcattttgtgtttgtcttactcagcacaatcaaatatgacttttaaaaattaaagtgggccgggcacggtggctcacacctgtaatcccagcactttgagaggccaaggtggatggatcacctgaggtcaggagttcaagaccagcctggcagagatggtaaaccctgtctttactaaaaatacaaaaatcagccagacgtggtggcacatgcctataatcctagctatttgggtggctaaggcaggagaattgcttgaacccaggaggtggaggttgcagtgagccgagatcgcaccactgcactccatcctgggtgacagagcaagactccgtctcagtggggggaaaaaaaattaaagtggaatattttacatctttattcaggtatttgatttataatattcttattattttcagctttaaaacatttgaaatattctaatattctcttaaatgctttttcccctatagaacagacttttgagaatcctgtcttaatacataaatatcaagatagttttcaacttcttgcttagcttgttagtgtatttttattgtagtccttaaactaggtagtacagagatttgatttttcaggagcagagttgatagagcagtctgctatattgtgaattcacattttaaaatcctttattgtcttgaatgcaggcctagtagctttgtgacatgtgcagctatactatgacatcataaaccccatcgtgagggaacctagctacgggtcagagctagtccactaggtgctaatcaaatgctgtgttacaacactgtgaggttttcccagttataagtgtcactattagggttttttttaattgcaaagccaaataaggctgtcaattgcatcatcttaccttatttcttcagattaagtactgtttatagtgggatttttggtggatgtggtggcatcagcataatctatgtttcaggcgtcctatagaagaggattattcttcaggggatgtggaagaaaaggtaaatgatgtctgctataagtaccttcacacttttaaagccttgtgaaaagaggggtaaaaattgtgaaatataaaataacatccattttatgttttagttttttgttcttgcgatagtttactgagaatgatgatttccaatttcatccatgtccctacaaaggacatgaactcatcctttttttatggctgcatagtattccatggtgtatatgtgccacattttcttaatccagtctgtcattgttggacatttgggttggttccaagttgtagcagcatgatttataatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgttgtttcctgactttttaatgatcgccattctaactggtgtgagatggtatcttattgtggtttagatttgcatttctctgatggccagtgatgagcattttttcatgtgtctgttggctgcataaatgtcttcttttgagaagtgtctgttcatatccttcgcccactttttgatggggtggtttggttttttccttgtaaatttgtttgagttcattgtagattctggatattagcccattgtcagatgagtagattgcaaaaattttttcccattctgtaggttgcctcttcactttgatcgtagtttcttttgctgtgcagaagctctttagtttaattagatcccatttgtcaattttggctttgttgccattgctttttgtattttagacatgaagtccttgcccatgcctatgtcctgaatggtattgcctaggttttcttctagggtttttatggttttaggtctaacatttaagtctttaatccgtcttgaattaatttttgtacaaggtgtaaggaagagatctggtttcagctttttacatatggcaaaccagttttcccagcaccattaattaaatagggaatcctttccccatttcttgtttttgtcaggtttgtcaaagatcagatggttgtagatgtgtggtattacttctgagggctctgttctgttccatcggtctgtatctttgttttggtaccagtaccatgctgttttggttactgtggccttgtagtatagtttgaagtcaggtaacgtgatgcctccagctttgttcttttggtttaggattatcttggcaatgtgggctctttttgggttccatatgaactttaaagtcgttttttccatttctctgaagaaagtcattggtagcctgattgggatggcattgaatctataaattaccttgggcagtatggccgttttcaccatattgattcttcctgttcatgagcatggaatgttcttccatttgtttgtgtcctcttttatttcattgagcagtggtttgtagttctccttgaagaggtccttcacatcccttgtaagttggattcctaggtattttattctctttgaagcaattgtgaatgggagttcactcatgatttggctgtttgtctgttactggtgtataagaatgcttgtgatttttgcacattgattttgtatcctgagactttgctgaagttgcttatcagcttaaggagattttgagctgagacgatggggttttctaaatatacaatcatgtcatctgcaaacagggacaatatgacttcctcttttcctaattgaataccctttatttctttctcctgcctgattgccctggccagaactgccaacactgttgaataggagtggtgagagagggcatccctgtcttgtgccagttttcaaagggaatgcttcccatttttgcccattcagtatgatattggctgtgggtttgtcataaatagctcttattattttgagatacgtcccatcaatacctaatttattgagagtttttagcatgaagggctgttgaattttgtcaaaggccttttctgcatctattgagataatcatgtggtttttgtctttgtttctgtttatatgctggattacgtttattgatttgcatgtgttgaaccagccttgcatcccaggaatgaagcccatttgatcatggtggagaagctttttttttttttttgagatggagtctcgctcttttgcccaagctggagtgcagtggcatgatcttcgctcactgcaagctccatctcctgggttcacgccattctcctgcttcagcctccctagtagctgggactacaggcacccgccaccacacccggctaattttttttgtattttttagtagaaacggggtttcaccatgttagccaggatggtctctatctcctgaactcgtgatccgcctgcctcaggctctgaaagtgctgggattacaggcgtgagccactgtgtctggccggataagctttttgatgtgctgctggattcagtttgccagtattttactgaggatttttgcatcgatgttcatcagggatattgttctaaaattctctttttttgttctgtctctgccaggctttggtatcaggatgatgctggcctcataagatgagttagggaggattcccctgtttttctattgattggaatagtttcagaaggaatggtaccagctcctccttgtacttctggtagaattcggctgtgaatccatctggtcctggactttttttggttggtaggctattaattattgcctcaatttcagagcctgttattggtctattcaggaattcaacttcttcctggtttagtcttgggagggtgtatgtgtccaggaatttatccatttcttctagattttctagtgtatttgcatagaggtgtttatagtattctctgatggtagtttgtaattctgtggggtcggtggtgatatcccctttatcatgttttattgcatctatttgattcttctctcttttcttctttattggagtttaacctattaactctaccagtataattataaggttgacgctcttgcttataagttttggcctaaccagtgagaatgtagaatgatagttctccagatataagagttttcttttttaaaaggagacatttgaattctacctccagatgcgtcatttatgcaggttctcagcctttattttagcattttaatgaaaaaattgtctcatgagcttttggcctgcctagagtttggacatatggaagtttccttgtagttacagaatctgtataacctatctccagaattgtaaggatatggtttatgttagcgggtacaagttctttttctgcagcaggtattcttaaccaagcctttttttttttttttttttttttttgttaaggcacagtctcgctctgtcatccaggctggagtgcggtggcatgatctcagctcactgcaacctcgaactcctgggttcaagaaattctcatgcctcagcctcatgagtagctgggattacaggtgcgcacaaccacacccggctaatttttgtatttttagtagagagagggtttcaccatattggccaggctggtcttgaactcctgacctcaggtaatccacctgcctcggcctcctgaagtgctgggattacagtcatgaggacttagccatttttgatagagttattgtttaattaaaattctgataattgtacttgaaagatgattaaagcaatgtaaaggatgatttatgcctatcagatgcccatgaatctttgttgaattgtttttctgttctccataataatctgatttctttgaagctgggcatttccccacaaaaaatgaatgtggacaccacctgccatctcaacccacaggtctagtttgtgagaatacttgtaggacccctgggtttcccccgctatagtttcaagtacattgtcttcagataccttattctatgtacttggaaaaaagagtaaaacattgagagccactgggatctgacaagctttgggagctccttaattctaaaaagaaaattattttgatttgagaaaatgtaatatcttcagaaatttccaccacccagctatgtgactgcatttttaaaaaaggaaaggaacagaggaaaatcaagtcactctaccctccttacttacctgtggcttgtccctacacatggtggtgggtgggagaagtggtggtggagtactgggtcctccagagagctcagtttggaatctggaactaaagatcatgtcccaatttcctgagctgatgggatagaagctggtcaatgaagtcttctttttgtgttaatttttttcctttgttttcttttgttttatgtagttataaagcataatttctattttgccagtctctgacacatgggctctgtcagggttactggatatgtttattttgtctctgctgctctactggagctgaaatctcagcctgtctgagcagttctttaagctgaaagccagggtgtaggggctagattagtgtggaatagctgttttcaaagtgtggtgtgcagaaccctgggggtgactctgagacattttcatgaggcttgctaggtcaaaaccattttcacggtgatgctaagatgttgtttttctttttctctgttttgatatccacactgatggtgcaaaaacagtggtggtgggggagtggtaaattgttgggtgccttaactcaagtcagtgacacaaactgtgttagtattaactgtattcttcactgccatccacttgcagttttttttttttaagtcagttttacttaagaatatctttgatgaagcagtaaaaattaccattgcattaaatcttgactctgagtacatgctgttttgatattctgtgtcctgaagtgggacagctgcagaaagcacccccccgctgcgtcctgacgacccatggtgttcttaaggaaaagcacgtgtgttatttgagtgccaagatgaattagctgcctgtttttccacagaacgtcattttcttcaaaagaatgactaatttccaaatgatggctattcaaacttgaagacatttcctcaaaaacaaatgaagtgagcttgtcagttcaagggaaacaactcatggtgtttattgtcacaagcttttaagccaaaactttgaattttggaaaatctgcatctgccattgtgagcttgacaatattcatagttttctgatcaaactggttatactttaatgaaatgtgatttataatactgtgtcatgaaatgtgtccacgtttggaagatctcctgaactcagtgagccagtattttccaaatgaatacttcaggatgttacaaaatcttacgtgggtaagagattcatccaaagtacaagacagatcaatggattttaatgtaactgatactgtctcagattgtatgttgcaattaatccttaagagacaatcagttgtcaagttttggtgtatccatgaagaatatccatgattttctacagaagctattataatattcctccctttttctaacacgagtctttgtgaggcccagattttcttcacataccaactaaagcaacatactgcaacagattcagtgtagaagtagatatgagaatctggctatcttcagttaaacctgacattaaaataatttgtaaaaatgtaaaacagtgctactcttctgatttttttgaaaatgtaatcatttttcataaaatgttatttatggtagcacatacttattattttaaaataagttactatttttaaaatttctgttttaatttccagtatgttaaatatcaacatatataaccagtggtgtgcacagctggcttgtaccagtgaaaaccaattgtataatctttatccggctttgtgttcaatgtcatccattggcagcttgaaatcagccatagtaggagtacttacatcacagaagtgagcaaacgctacaagtcagtgttcctccttcttaagatctagttaagtgtttaccagccctctactgaatatcaatcacagaaacaaaagctctttgaggtcatcagtaatttttaagagtgtaaagatgccctgagactaaaatatttgagaattagttgtgaggagaaagagttatcttttgagagttagtcactatagaggtgtataattcatacagagttgccttttgtgccggaaacatttgtagaataaatccaatgttttaaaacttgcagttgttaaatctactggttccataatgggaggatgtttttcttttccctggaatctaaactagatgataatactctgggggtaggtgagctgaattttccctgtgggctacatattggttgcctctgtcctggtttcacactatctgtccaactgttatctaggtttagatcaagccttcactcaagctctggcatctacataaagccctcacttactgtttgggcccatactgatctttctattctgtactcctgtgatattcatggcctctaaaatggagcaattcgttctgtactatttggtgtgccattgtttcttaggtgctagttttattaattctattttctaatagtgcacctagtacaaggctcaacacctaggttctcttacacggataaaacatgttttaacttttggattgccagagaagttagttttccaagggaatgatgatgtaaataaatcttagttatttgttataaacccagtttttaataattcttttcagatattaatataagttggaaatcattggtgttcctcaaagtgaagtcacacacaaagtcttccttgaaaaaattgttttagatgctgtggttctactaccactcatgatagacactggtgacttatttccaaggtctttgactcttgagtaagtcataatgaatggtgaatcttagtaaaatgaggcaaagtttctgcaattatgctagcctataggacagagttgtttactaattagaaaacctggcaggttttgagtccagaggagtggttagtatcgtgtttttctggtagggatctctgttgaaggaactcagggaagtagtgaggagatggctgttgtgctgatctctgcccaaagttaagtgatagttctggcctctctggatgctttagctagggagaggaaaagtgtccagaggcctcatcagccttcaaggcatgagctttctctgggtcagagacaccaggggcttgaaaggtcctggaatttcttcggcctatgcctttttagttattatgagggcataacagtgactgtgatttttatcagtctagagacaaagcatcagctcacatccagagtaacactagaatatcatatgtcacacatttaataaaaataattcactggccaggtacagtggctcacgcctgtaatcccagcactttgggaggccaaggtgggcagatcacaaggtcaggagatcgagaccatcctggctaatgggtgaaaccccgtctctactaaaaatacaaacaattagctgagcgtggtggcgggcacctgtagtcccagctactcaggaggctgaggcaggagaatggcttgaacctgggaggtagagcttgcagggagccaagatcacgccactgcactccagcctgggcagcagagcaagactccgtctcaaaaaaaaaagaaccatagttaagttctatctccaatttctctgaagaagttagagggtagtttatactctggcctaagaaaggcttcactgttagtaggcgtgaggtcgtagtgaggtagtttaactgctttagaactttgtgcttggaacattcttagccaccgaagtatgggcaccaaaagcgataaggagcatgtgttccttaataaatgtcacatcagaaaatgactgttccaggacagtaaccacctcccgatggtaagtatcctagatagtttgtcatttctcagcagcaggaaaaagagaagtaggccagtcatattagtgagtggtattacttaaaaatagcaaaaacaataacaaaaaaggtccagctttaatcctcaatggtgatcattttggcaggtttctgtggctggatcaggcaccagaagaggctccccagctgtaactctagtgcagttaccttcgggccaaactatacatgtccagggagtaattcagacaccacagccatgggttattcagtcatcagaaatacacaccgttcaggttagcttccttcctgaatggttttgtctttgactttcttgagccatttttttcctctttcactaattcatttatcatttttctttatgaagtgcttatacgcaaatctttttattagatatttggaggaatctcttctccttgcgtaaggtgctctgtgtcctgctaggtacgtaggtttcacttcagagctgcagctttgttgccaacttttcatttggggactgagtaattgcagatgagcagttcatgtcttcttcactttgttgttctgtgttcaaactcagatttatttagcaatgctccccaagggtgctgaaaaatattttgagggtgcatcagagaagatgtgtgataaacacagtaatataaagattatagtgctgatgctgttttctttttttttcttcttttttttttttttttgagacagagtctcgctttgtcgcccaggctggagggcagtggcatgatctcgggccattgcaagctccacctcccgggttcacgccattctcctgcctcagcctcccgagtagctgggactacaggcgcccgccaccatgcgtggctaattttttttgtatttttagtagagatggggtttcaccgtgttagccaggatggtcttgatctcctgacctcgtgatccgcctgtctcggcttcccaaagtgctgggattacaggcgtgagccactgcgcccagccagtgctgatgctgttttcatgaataatcaccttagtaggtagatataaatttataatcaccttagtaggtagatataaatttattttaaattcggtatacataattcttggtaagatgatattattaatgtatccctctcgattaaaccttggcttttgtagatatgattattattgtggttgtgatccagagatgtattttacccttaacatttcttgaagttaaaacattttttccatcaatagatgtaaattattaaatatgcattttttaaagtatgcatcttaattactgaatttatttttgttcatttttaaggtcagttattatcctttaaatgctgaaattatttgaacctaattgatgacaaaaaaaaaaatctgtgaggaaaatggagacacgtatacatagtatagtccttttcttgcgtgttcaagtagtttatcacagtagaatgataagagtggcgacaagatacctgatgtgacaaattcacatacattaaaagcttgattatctttgtggcatgggtattttctcctgtgtttcccagaagtgtaagaataattctcatcattatctttttttcctgtgatggcccctgattccaagagtttctaattctttctgacactaattataaaacaagaaagtctttccaacctcttctttgttttatgacttttattgaggtccacatatttctacttagttttaacctggctggtattggaagaaagtattgtctattattattatttattatttaatagagacagaattctcagtatgttacccaggtttgtgttgaggccctggcctcaagtgatcctcttgcctcagtctttcaaagtgctgggattacagatgtgagccacagcacccggctgaaagaaagtattctgttatattcagtagactttgtttggattttgttaagtgaacgatttaattgtccttgtagaaagaggtgccagtggatcttgtcctagaatacttacgtgttggatcatggtcaagccacttaatctctgtgcatgaactttaattttcacctttctaaaataggtaaattaatagcctacctcacctaagggagttgttatgattctatgacagatgtgtgacagcccggtgtaaaatgataaatatttaatatttggtggtgatatatgattatctgaggcaacaacatttttctcagtcctgttgattgggtgtgtgtgcttatgtgtggggcgttcatgagcaaaaacacgagtcatatgtggaggtgaatatacacctccgtgtacttcgggaagtatatattcttgcttgcattgttgatattttaataagctcttttgattttgtccaaatcaatttcccatgtaattataatatgaagtgagttttgtaaactctgctaccctaggccctcaaagtattaataattgactgaatatatcaaaatcagtcatgttgttgaagagattcattattttagttttctgacttctttaataatcatatcactgtattattacttgacttgaaaaatgaaatcatgcttaaaactctgatctttctcttaaggagaaatgctttatttggatcttcaagacccaccgccaccaagccctaacttactccttgtaatagaaatcctgattttacccaggcttgcttactgacttgcttatctacttaaatattctgtcttgggcctatctgatggctaatgtgaagacccagctcacgccagcgccagctgtgagagtgtgggaacagcagtgtgatccgggagctctcttctgcgttggcccctcgctggctccctcctggattcgtaggagcactttcaggttgaggagcttaggtcttgggtattttacattttgttctttcctgcaatgcctcatttgacatcccaaccactctttccctagtatttctgtagtatagagtacccgtaacattcctttccacacacatttgttttataactgaaatgtttgcgtctgcgcttcctttcttgagccagactccttcagtgcagattcactgtgttctattgctcagttgcttccacagctcctggctcagtgctgcacacacagactcttagcctcaattttttgaatgagggaaaagagcatatattttatgatacatttcagaaaatcttgtattataggtagcagcaattgcagagacagatgaatctgcagaatcagaaggtgtaattgattctcataaacgtagagaaatcctttcacgaagaccctcttataggtaagttaaccaagtttcctaatgtaaagatactttttccaaaatggtagaataattatacatcaaatcaattcttcctttatagcttttctgttttaagacttattcatgtatcttagtgacttaccttgttaaattgtattttaggaaaatactgaatgaactgtcctctgatgtgcctggtgttcccaagattgaagaagagagatcagaggaagaaggaacaccacctagtattgctaccatggcagtaccaactagcatatatcagactagcacggggcaatacagtatgtatgctgcaattcgatatgatacagtgctagctttaagtcttctctagttatattgaagcaactcaggttttggcattaaattgttccattttaaaatgcatcattaatacctaaactgtatcatagaatgaaagtatatgttaaaaagtgagatctttgtattgacagctgtcatataattttgaaaagtaaaaattttgactgccgaatatagaagaaaattttggggtaaaaaggagaatttttcctatttacatgtttatattaatctctagtaaaacattgtttttgttgtctttatgatgcatgcgaacataaatgtctgtatttcattcttgttggcttttgttacccacaattacatactattcttactaatctgagagttttctaaagtatgttttcaatgtttcactactctctactctgttaatttgtgctacagtttttcctaaaagagaatggaaaaatgatttaattttttaaactgtagcaattggatagataattttatttgaaattttacacactgaaagctctaaataaacagatacattcacattcagtcttgtgcattttaatggaccgttaattctgtgctttttgctctgattaaagcactagtttttttcccaaaagaagagtgtttgatacgtaaaaagcaagagctagaaagaaaagaaaaaggaggagaaaggttagggatatcacatatcctaagctagccccttaggtactggaataatgtgatattcctgtcctttctgaagtataaattgtccatggaagttgtctaaatcaatttcccatgtaattataatatgaagtaaagtgagttttgtaaactctgctaccctaggtcctcaaagtaattgaacaaatatattgacagcagtcatgttgttgaagagattcataattttagttttctgactttaaaaagagctacttaggtactggaatatatgtgatattaaataatgtgtttatccaaataaggtattaagattttagatatattctttgtttttcctttaaaaagtagcaataccaagaaaaaaaaactcaagtcttaatttaagtcctgactactaaaacaagctataatctttaatgtatgagaagactttatatagtcattatttttgtggagctttttagagtttttcttgtagcagtggtagatttgcagtagtaaactattaaatacattctctgttggtaattgaggggaactcctaccatgatacctagcagatccggggtgtagtgtattcacacgtttgacagggcacccagtagacttgtccaaagtcagtgttaggaaaagaaaatccccaccatctgtaagaaatagaccttgaggtttacattgtcatttttttattacttctctcgtttacatgctcttttgtctggcacactgggaatctctggtgggttttagaactgtaaaactgaatatgccagctgatgagcctctacagcacagcacgcaggttatgagagtgctgagtgcctcgtccccccgtccccagaggggctgggcagaagctgctggcgcctcctggctggtcagccctggccttgagcagctccatccactcaccccagtgggctgtacacatgtcatcatgttctgtttgtgtaatgacagggaaaaggttggaagtgactgctgaaatgacactaagacttctcaaagtgttgggaaccactaagatgctgtcatcgtaacatttctctggcatatgctaatgctacgtaggacttctgatagaagcagtgattcctttacaagttgatagggaagcagatgctgtagggttaacttgtctagattattagctgaaaatttgaaattgtgaaaatgtatggggttgaagctggagaggatgtggaaggaaccatctttgtgccatttgcaaactcaatgatcagagcaagaagctttattaaattcacatctcaggttttagtctttgaagtgggaataatactaaattgccaaactctggggttcctgtgaagacaaaggagataatgggtaaaagtagggggaaaaagacatgctactattggcatgaaacagagaaattaagttaggtgtaccattgtctcattcatgttcattgaactttccctccagccagccccaatggcttcattccctgtgtccttggtacctgctcacagcagggggctggccttaaacctcactctgtgtgtctgtgggggggatgagaggagcagagtcaggaattttggttgagaactagaaaactgcatctgtagaaattagatcttaggccaggtgtgatggctcccacctgtaatcccagcactttgggaggtctaggcaatgagggttgcttgaggccaggactttgagaccagtctgggcaatagagtgagaccctgtctctacaaaagaattttaaaaattagcagggtgtggtggtatgcgctcatcccagctactcaggaggctgaggtgggaggattctctgagcccaggagtttgaggctgcagtgagttatgattgcaccactgcactgtccaacctgggcagcagagtgagactctgtctcaaaacaacaaacaaaaaaaacacatctgtctatttgccacataagaggtcatggactatttcttactttggtttcttaatttgagtctatacagtatgatcctagaaattattctgatgagaagttatagttctgtatgtacagtctgcaggtaaaaattgccatttgttcacacaatgtgaatttcttttgttaaaaatgcattttggggacatttagtgaaatatatgtagataattctttgagaagtgaatactaacaacattcaaactttttagaagacgtttactttaattggagggtaaacatacttacacacacaacatccatttttattgatcttattttttatagaactaacttagcagatattaatgctttaatgttgtagcagaatgtctagaaatggaaacaattgccagtttcctttggtttttgaatagaggaacgtattttattagaatttctggagattttcctatttttttccttccctttgagctgtaaattttttttaatgctctttcataaccttttattataaaaaaaaattttaggtttaattgttcagcttttatccatggatggctttctcccaaactttgcttttatttctttttttccaatattttattagttatttttaatttggaataatgagttagctggtgtttaaaagaactaaatgtgtatcaaagttgaagaaataaagtatattcaagttttcccatatacaagcagttacatttttaatagttgaaagatatttggcagaagttggccttattatattgacttactattatcacaaaaactaaaaagtgaaagttggaataggctgctccctggggagtaggaaaaagcataaaatagacagggatccattattacaacaccaagtaagtgagctgtacctgcagaatcctcactggaagtacagatcttagtgataggtgtgttgcataacagttgagctggtcgaagaaagtcttttatttcagaagcatatacccgagagatggcgggagagagacagccttagaattaacaaagaatgttacttgctgcatgagacagttaagataggcagtaaatgagtgaatttgtaaaagcaaccgaggaaattaaaatgtttgaagcttcctaattcattaaatttcctcttgaaacaaaggttacttaaatcctccatcctactatacccaacctcttcctgtaccaattaaagactatcacccaagacttcagtttttttcccacaaatggcccttgtctctgcttgtgcctattgtattttacgaggaatcttattagagtattaactcatctttctggaattcttatacatgaaaggtaagtgggtcaatctaaactgcaccattatgaaaagaaaaatatgaactttgtggactccttataagaattcagaattctcaggaggctcacgaataagcaccaattcaacttcttcataaagggaattagaacataataggcttacacattcgaaagttaatccagttgcagttcttaatagtgacgttgtttacatttctctaaggcaactgtttcaaaattttttaaggcactacttaatgtaactctggcttttaaactttgatgttgctattgttgttatagcatgatttagtcttccttctgctataatgcacctcttggcttttaaggtacaagtactcataggtgctctcttatggtcactctgaatttaaacctgagaattcattggaacaaaggtctgtttgctgctgtttttaaagttaatgcagtgagatttcatttatgaatctttggattgcaatttggaacaagagtggttttaaatataaacatttacatgtgtatgtattttaattagctcatgtgtataaatttaggattagaagtatataacatgggccgggcgtgatggttcacgcctgtaatcccagcactttgggaggctgaggtgggcggatcacctgaggtcaggcattcgagaccagcctggccaacatggtgaaaccccatctctactgaaaatacaaaattagccgggtgtggtggtgcacacttgtaatcccagctactttggaggctgaggcaggagaatcgcttgaacccagcaggtggaggttgcagtgagctgagatcacacgattgcacttcagcctgggcgagaagagtgaaagtccatctcaaaataaatgaacaaataaataaataagaagtgtataacatcgccaggcttggtggtttgtgcctgtagtcccagctactcagaaggctgaggcagaaggattgcttgagcctagcagtttaagaccagctagaccaatatcaggatgtggggcaacacagcaagaccccatctcttaaataaatagctaaaatagaagatatgtctaaattcattcagttaatttcatcttattttttctatcttgatttatgtttattgaaagcacatgttatgctatccttgactattttgaaacctaaacagttttctcctcaaatctctgaatacagacaggcccacgtaaaacctatttccaggatcctgaggcactgggaaattttgtttattgtcagatgagagagaacattttcaatgggaaggtcctctgtcatttgataacaacaaaatcaagagcacctttggcataaaaatgaaaatgaggctgacgtgcctgacttaatcagtagaaatgttttctcactagagccagtgtgtgaggggtgtgtgtgtgtgtttgtttagcttttgttttccatatctaattatataatgacttccccagaaaataaaatgagaaacagattcttgatgtgtcagctgttcatattgtgaaaacaaagttttttgatcagaactgtggggaaacattactgaaaagaaaaaaggaaacgagtaaagcaaaaagaaagagaaaaaaggaagtaaaggtctttgttatctacctatttaggggttcttaccctgaggcagctactctcacctcagattgacttgatcgttatttaaaagcttgataatttggtgttgaaaaactaggttctatgattggaatttgaaaccatacctcatttaactctcctagattcacagggggcttaagttttttataatatcatctgtcatgaggaaatgatagccattcattcattcattcattcattcattcattctattttttgagtggctgctctgttctaggctttgtacttcttttttttttttttttgagacggagttttgctcttgtccaggctggtgtgcaatggtgcaatctctgctcaccgcaacccccgcctcccagattcaagcgattctcctccctcagcctcccgaggagctgggattgcaggcatgcaccaccacgcctggctaatttcttgtatttttagtagggacggggtttctccttgttggtcaggctggtcttgaactcctgacctcaggtgatccaccaacctcggcctcccaaagtgctgggattacagatgtgagccaccgcgcccggcctaggctttgtacttctaatacactgtggttacctgaccttgggctgctctttctaaagcactatttctgtgacatcaaactaattatcagctgaaaaatacacattcaaatatatgaaaacatacacaatttactcatgtctagccacaaggggccaagaaagcagtgtcttttgacattttcatacttgtaagaagttagttagatctctctcaaacccttttactatgagggctgaatcctgagacccatgaaatctttggaaagccatggtttaaaaataccctgtttttaaagtgtgtacagaaaataactgctctaggtgagccagataaagtgctgttacatcagggtgtctcaacctcagttctattgacattctgtaactgactcttcagtttctgccacactggcctgtcagtgaaataaaacacagagaacgcagcatgtggaagtctttttaaaaatgttaatctatcttcctgtgtagacactggcaccttaggtgaaagaagtgaaaatttgttgttgttactctttccataattctcataggtttgtcctatcaggttatcgcctaagtgcttttttgcctagatgcctttaaaaacgtttggaaatgacttgaaaatattcagagtgtattttaaacactactgttacgctactgtaaggtatttacattgatgtatagatgtcatgttattctggtgatgtgtttttaaaatcttcattgtaaagcctagttagctagtttatatgtgattttttaaaaagcatagcctctggtaccatttaatatctactgtttgaagcatgcagttggaatctttatgttaaaatatacagacctttcagatattttaaataatacttgtctattagagtgaaattttgaaacaaaacgtttgatcagttattctttggaagcttcaagtcaattaatatgttaacttttaaacatgactggcagatctcagtatttaaaggaaatctacttcctatttgttgccattagctgtagttacttgagatacttggtagaggtaaatattgtagcacaaatccttttagtaacagttactttttaaggacctttgcaacttgacaatttatatttcaggattctcctgacatagacaaaatggcaaaggttacagttttctagactttagctttataaccaaaatatgtttttatatatatttatatataaatatataatatatgtaaattatatagttatatataacatatgacatatataattataataaatatatattaaaaattttggtcatatatacaacatatataactatatataattatatatagttataattatatatagttatatataatatataacaaattatatataacataattatggttatatattaattgtacataacatatatacatatataggtatatatagctagatatgttatatataattatatattatatataaaatataaataattataaaaatataataattattaaaatatatgttatatataaatacaatataaattatatatataaatatataatttatatattatatgtgatatatattatatattatatataatataatatataatatatatcacatataatatatattatatataattaatatatataattaatataataatatatataatatataatatatatgatatatattatataaatatataaatatattaatatattaatatataatatatataatatatattatatattaatattaatatataaatatattaatatataatatatattatatatttatatatataaaatatataattatatataacatatataattatatgtatgttggtttttttttttagatggagtctctgttgcccaggctggagtgcagtgccgcaatctcagctcactgcaacctccaactcccgggttcaagtgattctcctgtctcagcctcccgagtaactgggactacagacacctgccaccacacctggctaatttttgtatttttagtagaggcggggtttcaccatattgatcaggctggtctcaaactcctgacctcaggtgatctgcccaccttggcctcccaaagtcctaagtttacaggcgtgagccactgcaccttgcctatatatttcttaaaaactactttcttttgatgacaaatcagaaaagtagttagctgaatgaaggtagaaattcattttaattgcaatattaaatgggaatttttcttttcttttcttttctttttttagagacagggttttcctgtgttgcccaggctggccttgaactcctgggctcaagtgatcctcctgccttggcctcccaaagtgctgggatcacaggcatgagccaccacacctggccttaaatgggaattttaaatggtagaagaatggtgtttataaggaaaaacatctgagagaatggagaaaaccaggaagctggactctccctgtctccttctccactcttcctcttgagtgatgtagtcagctggatgctaaggaggaggaacactccatgggctctatgaatctcaaacatttctgaatataaaatattttcaagtgtttataagcttttcctagagtatcgtcccatgacgaagctgatcttccttctcaattcagcatagaaaataagggtaacctgagaaagaagcaatggtaataaatagacccagagtatattcttccaataggggattattaaaaataaatcttgaaattctctaatatttcttttctttttctgttaagttgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaaggtatattttattaatctaatacatttagaatacctatggattactatatcacaccattgagtggtgattttatagttttttgaaatagatcgaaggtagatggtggggggttgggaggcacttaaaaaggcttacagaagaaatattttaatacattaaacagcaaattaagttttatcatttttcgccttttagcaggttttactggctctggagaaaggccaaattcagagtagcatgatagaaaaagagagatagaaacatgaatgaattttttttttttttttttgagatggagtctcgctctggcgcccaggctggagtacaatggcgtgatctcggctcactgcaacctgtctcctgggttcaagtgattcttctgcctcagcttcccggggagctgggattacaggcatgagccaccacgcctggctaatttttgtatttttagtagagacggggtttcaccatgttgggcaggctggtctcaaactcctgacctcagatggagtcgtcctgacctcaggtggaggcctcagcctcctaaagtgctgggattacagacgtgagccaccgcacccggccacatgaatgaatttttaaattaattagatatccttcatttgggggttgcaaatgttgtacctaatagatttctattacctaatctatgacaatttaagtattcaggctatgatgccccaaatttgtttttttccctagctgttactttcaagtctaatttctaggcaactcatttcaaaacaaatgctgactttgggttttttgtttttttttgtttgtttgtttttttgactgactgttcttagttgtttgaattctgaagtatccattctagctcttatggaagctgtcagtaatgaaataaaagttgagatgtagccctaagcttttagggttacctgagatttcaactggatttgcgttatacattattttaattcagttgtgcctatgataactgtaatagatgtatttaatacagctttcaaaactcctgtgttttaattgaattctattcctcttggtccattcgcttaggatttaggatatagcactattttttaaaaatttgcttgcttgtttgtttgtttgtttatttatttatttatttatttatttttgagacagagtctcgctctgttgcccaggctggagtgcagtggcgcgatctcggctcactgcgacctccgcctcccaggttcaagcaattcttctgcctcagcctcccgagtagctgggactacaggtgcataacgccatgcccggctaatttattgtattttagtagagacggggtttcaccgtattgcccaggctggtcgtgaactcctgagctcaggcagtccacccaccttggcctcccaaagtgctgggattacaggcagcactaacgttaaggaaagtaaaatcagttattttagttcgaatgtcttgcaggtatgataagcatattataattgatgagtctcttgataattatactcaggtattttgggggttaatgtggactatggtaaaagtgtgtgaagaactgaggtggtggcatttatggagtaaaaaatgcatagtacaaacccagtactttaatgttttcttgaaatgtaaaatgaaagccacctgttctattccccccatactcatggaccatatttatgtctaggtgaataatcttaaagaataattatttcttctcattttatctttgttacatggaagaatctactgcaaacaacagagttttgagaatttttaatgttttacacaatatgcacgtaagtttgtgccttggggtttttaagaattttcttccacaagtcacaaagatttttttccacattttcttctatttgctttatggttttacctttcacatttatgtctttaatgtatctgggcttcacttctgtatatagtatttggtgggaattcatttttaacttttttctccgtatatggagccactcccaagggtttgttgtttcctcactggtgtatggggcagccttaattagacagtgggtttgcttttgcacctggatctggccagtcttctgtctgattcatctttttctgaatcccagcgccatacatgtttgttatctcataaaacaagttccccttgtcttttttctcagtttgatacagagttagttttttgtgcactattattctttcatatgcatttggaataagtttgagtttctaaatagtagtagtaataataataataataaaaccaatgatgagactgcattaattttttttttcttgagatggagtctcgctctgttgccctgcctggagtgcagtggcacgatggctcactgcaagctccacctcccgggttcacgccattcttctgcctcagcctcccaagtagctgggactacaggcgcctgccaccatgtccgactaatttttttgtatttttagtagatacagggtttcaccatgttcgccaggatggtctcgatctcctgacctcatgatccgcccacctcagcctcccgaagtgctgggattacaggcatgagccaccatgcccagccaagactgcatttaatttagggagagctgaagtcttcataatgttaagttgacctatcccaaaccatagaaagtcttgtttattcagatctcattttacttcttttaacagttgaacatttttctttttatttatttatttatttatttatttattatactttaagttttagggaacagttgaacatttttcttcacggagatcttgcatattctttctttagttggttcctaagtactttatgggttttgttgccattacaatggtaccttattttgtattgtattttctaattgttgctggtgtagagaaatacggattattttaagtcgatcttttatctattaactttgctgaactctaattacttctaataatttactgattctttgtgattcggtctgtgatcctatgtgaatgtttatacaaatagtgatgttttgtttcctcccttccaatctttattcctgttttctttttctctttttttcttttccttaaataatcatggccaggagctccagtttaaacacagcaaggccagtgggcattcttgtcttcctgaacttagtggcagtgttccctgccctccttctcccttcatctcactgaagggccctgtcagcttctttgtggattctcagtgcctgtcttggctgatgcctcagcagtatttaacactgtcgacttctgcttcctccacttcctgagactgtgtcctccttgctcttctctctctgctgcttctctgtcagtcctgttgctgggctaagcttcccctgcccctgtcctgagtgtttcagtgatcctcaggctcactcccccaccctcttcctgctgagctccctccctgaaggactccctcccacgctggcttcagttcactgtgactatgtcctgactccagctggttccttagatggccacacatacctctgactcctaaaatccactcttcctatcttcagtgattgaccactactatccttgatgccagaaacctaggtgttgtccagtattcttcccagtctccattcaaagtcactgtgtagattcttctgcctggctgagccatgaatgcttctgccactccacagccctctgtcctggccctggccctggcctgggtgctatccctctgacccaggctacccctgtgggctacagtctccggcagccaccggaagctggctattgtggaacagctttctgatcctcctaatcatgccagaggcagcagctcccttcttggctcagttttttgggaattgttcctgaaagttcagctaaactcttcattcctcacagtgattctgggagccactgatagttcttaaaaacagcagtttcttgcccccaacatctccattactgcattgcacttgttttgttttgtttcgttttgttttgttttgagacagagtctcactctcttggccaggctggaacacagtgatgtgatcttagctcactgcaacctctgtctcctgggctcaagcatttctcctgcctcagcttcccgagtagctgggattacaggcatgtaccaccatgcccagctaatttttgtatttttagtagagacggggttacaccatgttggccaggctggtcttgaactcctgagtttaggtaatccgtccatctcggcatcctaaagtgctacgattataggcatgagccaccacacctggtgtctggggtctttttaataagggcactaatcctgttcacaagggtgtcaccctcatgacctcatcacctctcagaggttccacctccaaatactattgcattggaggtgaggatttcaacagaggaaattgggtggggatacaaacattcagtctatagcatccactcaaaagcatccatcaatgtctgtgacctgttagacaaagctccaaatctttcatgtggcccaaatctttgcttgatccaagccttgcattctttaatagctgcctacctctccacttctccctcttttgtaatacagctctttctttcatttcctgggataggccatgccctctctccctccagggccttcttcacacataccgattgcctgataagaatacgttccccgaggaagccttgcccatcctccacatctggcttaggcaaccttctgtgagttcctactgtacttccttaggcacatatcatgttgtgttgtggctctctgtcttgctagatggtaagttctatttggacaaatacctagcacagaccctggcatgtgataaatgttcagtaagcatttaccaaatgaaagtgaactgttcttcctctgaaaatgtgatttgttctgtgtgctgattgacttgagattaactggtccagggaatacattaaaactactaagagcagtaatcaactaagcaacccatttcccttctttctttccttccttgccttttttttcacaccaatatttattgagcatctatgtgccaatttaaagaaatgctgacataaaaatcaatttcttattgattttctgaaatttgaaataaaatttactaatagcattcttggacccaaaccctcaggtgtgactgggacagcaaagagtccctgctggagccccagattgaggttgatgtctaggtgaccatccagggttccttactcagccaagatatcttcagctgaattgaaaccctaaccccattgtcaggtatcctggagaattactagaaacatggacactccctgaaactttacctcctgagcatctgaggtgtaaagtccttacctttactggaagatgattaaattaaatacagctaaaatgtggtgggatgtcctttcattgacataaggttgggttgaattctaatcatacaagggaaagggctttgggtgcggtggctcacacctgtaatcccagcactttgggaggctgaggtgggtggatcacctgagatcaggagttcgagaccagcctggccaacatggtgaaaccccgtctctactaaaaatacaaaaattagccaggcatggtgggcacctgtaatcccagctacttgggaagctgaggcaggagaatcatttgaacccaggaggcggaggttgcagtgagccaagattgcacctttgtactccagcctgggggagaatagcgagacttcatctcaaaaaaaaaaaaaaaaaaaaaaaaaaagacaaaaggtctcagtggcatgtcacttatttttttgcagtggaaatgccaataatttttttccaggctatggtctgttctatggttgaacattcgcccatttttgtgtctaaccttataatcactgaatttcctataatgatccagctctctatgtgccaagccttcattaagtgatccaaataaaatttgacatttaaaaaaaatgtacaaatagtaattttgatttatttatgaattttaaaaatcccaaatgtcttttcagggggttttaatctgggaaaataaggtattagattgaatcacatgaaactgctatttttgtaggccagaaagttcaaatatcagcaagttcatgtgattcaatctagtagttatgggagaatactacataatacttgctccattggcacagtgaatttttaaaatttaattatctactccctttaagtgaaagtagcaaattctgtatcaccttaggaagagttggattttttgatggtgtagcaaatggctcagcaaataaaaatgttaagtgaacacaggtggctggatatttcttggtgagtttagaagtgactatgaaatatggtatttctttgctgatagtcaatgtgtttttttttttttaaatctccaagtgttttttctcttatgagttaggaaattatgttgggtttattctcccttagtttacctagaagccttggacacaacaataataaagaagtagccctgtaagatacaatcatgtaacttttaatgctaaaagagacattattattattattattattattatttgctagagcccacctcaaacagatttctatgtaaaaatgagaaacaagagcattaagatggtttattacaggaagagtttttatagggcttgggtttcagtgagctcgcctgtgacaaagcaaattgatggcagtgataggctagtgatgtcattgtgatgtcagtcctcctgcttatcctgcacatgcttgctaatttggaacactttatgttgaactgtggtagaggaaacaagacagttctgtctgcagaagcccattatggctgtaactggagatgacacaggtaagaatgttaaagaggggttttcagttaattgtgcagattgttttgaagtttaggaagtattcaggaacatctgagtgtttcagaaagtgttactctcctagtcacttaggtgtaagactttttttgaaatatacatctatatattcagctcactttgttagggcatcttagtgtgattgtttctttgctcaatattctattgcttgcttgactgaggcactaatcctctcttcctccctctatcctccctcccctcctccccactcttcccctcctcttctcttcccctctcctccatctctgtgtctctctttcatatgcataccattctgccctactaaaataagctgttacttcataggcaacctgttgcaaattcaatctagccgcagattaaacatacagtatataccgttcatgttctgatttcattactgtggacaaatgcagctccaaacagaataggaaaaacccgcgtgttatggatgtttgtgtgcctacttgtttctttcctcctgtatttaaaatggtctgttcagctaattgagttcaaaaggctgatgtcattacatttcctggaatcgtatttcagcaggggaagtggaaaagttaaaactccaagcgagctgcacattgacgtcagctccgagtcatgttgtgatttagtcagttcctttccgctttgtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtggtaagatcgagcctcctactgaggccgtccctgcatgcgcctggtgagaaatggattatgtattgtataagctggcgggttctttactcttactccatcctcttactccatctataggaacttgcgattcagagctcctctagtgttcagtcagggaagtgcttgtcttttacttgttctcccagcctctggtatttaaatttgtaatcggtaatttttcactaggtttgcttttctcagtaacaaagagtgattttggaagacttagttactaataacctttgtgtgcttgcagtgttgtttattcagtggtcttgtttgtaatacagtactgaatttgcagttgaattaagagttttaaacaacttcactacaatttagctcttcgaagttaatgggtctcagccctctttgtggataggaacattggattgtcttgagtaagtaaaacctgtattacattgtttttaaaactgtcttgaggaactatttttttctcgaagttttgtgaagttctagagatgctatagactgcagaactcaaatgatgaatttattataagacatagatgaacttaaaatcatctcaaacactgcatgtcatatgattcttagaaccagaaggcacttttgtacatatattttctaaaaattattggttaatatctttctttaccaagcctttcattcctattacccctttgacttgtctaagcataagactcataacaaaaaataaataaaatgatgtgaaaacgctgtgtacttttttttttttttttttttttgagacggggtctcgctctgtcgcccaggctggagtgcagtggcgcgatcttggctcactgcaagctccgcctcccaggttcacgccattctcctgcctcagcctcctaagtagctgggactacaggcgcccgcctaattttttgtatttttaatagaggcggggtttcaccgtgttagccaggatggtctcgatttcctgacctcgtgatccgccctccttggcaatgctgtatacttttaaccactacatataaataaacaaacatttttgacatttgtttttacagaatgaacataacatccttgaaagtttttttcacagttttaccaataatgctacacatgattgattttccttttccaatttaaacttttcaaaatgctgaaactttaaaatgtcaaacaacttaaaacactttttcacaagacctgattttgcctttggaaatcatatttttaaaaatctggtcatttcttacagaatcagtgctatttgaaaaatgagtaataaattttatttcattttactttatttatttatttatttatttatttatttatttatttatttatttattttatgagacggagtctcgctctgtcgcccaggctggagtgcagtggctggatcttggctcactgcaagctcggcctcccgggttcacgccattctcctgcctcagcctcccgagtagctgggactacaggtgcccaccaccacgcccggctaattttgtttttttgtattttagtagagacggggtttcaccgtgttagccagaatggtctcgatctcctgacctcgtgatccgcctgcctcggcgtcccaaagtgctgggattacaggcgtgagccaccgcgctcggcctcattttactttatttttttaaagccagaagagcacagggttaagggacttttttgaaggtgtagtagagtagctttaggaaccagacctctgggctctcagttctgaggtaaccctatggatcggcagaccaagtagatctagattagtggcttgcaaacttttcaaccatgacccacgttaattatcacggcaaagtggacctatgtgtgtatgtaccctacatttatataaaacaagtttcagacataattcttatccttacaaaatatgatgtacccataattccttttctgtcctttttttaaaatgctattcttgacccatgaaatttgctttttgacccattaatggtctacagcttacagtttgaaaaactttgatctagaccaaaatcaggctcctagcactaatggctggcctggaaaagatattagcagcatttacctacaggatcatgaagtgaaatattaaaagcaaatgactggccgggcgcggtggctcacgtctgtaatcccagcactttgggaggccaaggcgggcggatcacaacctcaggagttcaagaccagcctggccaacatggtgaaaccccgtctctactaaaaatacaaaaattagccaggcgtggtggcacgcgcctgtaatctcagctactcgggaagctgaggcaagagaatggcttgaaaccgggaggcagagattgcaatgagccaacattgcaccactgcactccagcctgggtgacagaacgagactccatctcaaaaaaaaaaaaaaagtaaatgactatagtttatgggattatattattgattttgtggggcataatttacatttttattagaaattgcctttgttttattcataaactgattctgttaggagcataatttcctatcttttagactctgagtctgacgttgcattctgacgttgcattctggctggatttctgcattgtttaaaacaaactttccaacaaatttggaaaactagtgtcttagttaatatttgatgcatgagaataaggatatatatcacctttgtgaaaggaggctattagcaattatttttgcttaaaaatatttacataaaagaataatttcgaggctgggcgtggtggcttacgcctgtaatcccagcactttgggagaccgaggtgggctgatcacctgaggtcaggagttcaagaccagcctggccaacatggtgaaagcccatctccacaaaaatacaaaaattagccgggcgtggtggcatatgcctgtaatcccagctactcgggaggctgaggcggaagaatcacttgaacctgggaggtggaggttgcagtgagctgagatagtgccattgcactccagcctgggtgacagagcgagactccgtctcaacaacaacaaaaaagaataatttcatttaggtgtgacagcttcttgaagttggtaactgaacaagttataatcactttggaagtgaaaataacaaggcatttatctaccttaagattcagtaaaccaaatctgcagggtgaaattggaaattactcatgttattttcctactacttttgaaaaatgcataacgaaatgtaatttgggatatttatttcactttgccctgtttatatgaatatattaggcaaatatatttattcatttatattctaataaaatatactttgcatttatgtaaactttaaaataaaaaaatcacttaatgttacaaataaacatgaataccaactatagaaagtgctgtcaaagaaactatcagattgtgactgacacagaaacaggacatacaggttaagggatcaggtaggcctcactaggaaaccatgttcaaatgctaaaaaaggcagtttacaggcattctcactgatacatgcccaactacacccaggtcagactgggtaaatgacttccaagtttacaaagctagcaagtagtggacccgttcgagtcttcagaatcctcgggttctgctcatagcatattaatgtgactcctcaaaagtcacctgacattgacacatgaatgcagtgtcacgtgagtacatgctgctacacactgcttataaaacatataaaatgaggttaggttaatattattttaagtcgttaaaatggcttttttttttttttttttttaagacagagtttcactcttgttgcccaggctggagtacagtggcgtgatcttggctcactgcaacctctgcctcccaggttcaagcgattcacctgcctcagcctcccaagtagctgagattacaagcacccaccaacacacccggctaattttgcatttttagtagagacagggtttcaccatttggtcaggctggtctcgaactcctgacctcaagcgatccacccgcctcagcctcccaaagtgctgggattacaggcatgagccaccacacccagcctaaaattgaattttttatagattattattactctcataggacagtagagcatatatttgctattatatggaacattaaatttcagtgttcgtaatttcccatcttttatatagactgacttatagattttcacatactgaactttaaaaggtcccttatgtataacttacttagctggattgtaataatttcataatgtatgcatatgtgaaagcatcacattatacactttgagtatatacagtttttgtcaattatacctcaaagctgaaaatattttggtgagttaattctatgtggtctatgtgttatagtgattgtagcaaatttgaaaatgatcagtgcttaaatagccatttttatgtagggtttaattttcacagagaagggaacgtttttggcagtgtgggataccaggcatggaggtgtaggatctgggtattaggagcaggtggtggtagacaggaagagaaccacagcagtggtggtgatgtcagcagcttaccagagctagggatagaagccccccacttagaagtgtgacatctaagttaacctctgctgcttacttaaaggtgtatttaggattagtgccatgctgtgaaatggcatatgaaaacaggaactctctatataaaaatgttttttattcagtctttgtgctcagtactacagatatcttaataaacaattgaataaaatcaccatcatttggggtgttgagaaatcgtttcactttggaagttaccaacataggtacttggctgggtttcttatttatttctttgtttcctactctcacttgtgggttttttttttcagttttcttcttcccagtctgatgagagtatatctttggccatttggggttctattataaatgattgcatacattgaaaaggatatcttacattatctttaatgtattctctaaaggaatataacgatatataattttataagtttttaataggcatattttttaacaaaataaggaataagagccataaatttggattccctgggtttgtcagaagggaaactccagggggaaatgtatttatggatgttatatgcgttttaactaatatacggtataagcataacttggaacgttgtctttcagaacttaaggaggggaagaggaagggaactaacatttgtggagtgcctgccatgtgccaggcactgtgctagacactttgacatacattgtagggtttattgtgagtattaaatgagatactgtatccccattttacagatgaggaaactgaacttgccccaagtcacatggctggtaagtggcagagctggactagaacccagactccaaaccccatgctttttctgctgtaccgtgtttaaagcttgcaaagagagatatgtagttaatgaccaaaattgagagttctaggaattttcttttcccatgaaatatttgatactgaacctaaaaaaaaaaaaatgctttcatgtcaggagctagatggaagcacatcataatgagaacgcctttgcttttaaaatgctatgttagacttatctaaagtgcatctaaggaaaatttaagaaataatgccttttatcaagaaaggccactttgaagagacacatcgcatcttgtagggctttccatgtcttagaggtaaaggtttagctataataatgtaagtttataagaaagactgcttattttaagcattctaaatgacagcaggcttgtgcaaaacccgaggaagttcaaattttacttcatacagcacacattaactcatgaaacacccattatatgccaagtatgtgctagattctaggggtttctggggttaaaaagatactatccctgatttgtcttaaagtttttgctttcctgagaataaagttagtgtacaaatatcttataatctttcttcaatcatgattgttaattccccactgataacccatatattttcaaaatatgaaaattctagaataaaaagtaatttagacactttcagtagttaaatgggacaggaagtggcctttataagaatacaggaatagcagtgtgtcatcagagaatgcaggatggtctttgaactgtgatccttggtgtcttatctgctttaaatttccactgagttcataatattggaaatttgaagctaactaagataaatactttttataacttgttttaaaattaaaacttgtgacatttagattttctcaaaacaagagattatctttgtatctttatttttttaagagacaaggtcttgctatgttgcccaggctggacttgaactcctgggctcaagtgatcctcatgcctcagcctctgaaggagctgagattacaggcatgagccactgtgcacagctgtctttgcccatatctttttaaatgtactttactaataagattatatttgagtatatggaatttgtccatcgaccattagaagtataccaccatatagatcctttgggatattatagaaatttatacaaattcctactaatttatactaactcctgtttctggcttgaactaatgcgcttgtcattttgattttattgagggaagtaaaatgaatatatgatacctctgaaaaattataataaaacccagtcacctaacatctcagaactaatacatctgaatatatcatccccttccaagttattttaaagtggtatttttttctgagctatcgctcaaaatgtttttaagaattcttattttggaactgccattatctttcatggtgccaaatttggtcccttgagggtggttgttgcttctggaaacaggcaagagttgtttggaagcatttctgataaatacaaggccaatgaatgaacgtctttttttgcttttttcctttttttttttcctgagacagggtcttactctgtcgctcaggctggagtgcagtagcataataacggctcactgtagcctcaacctcctgggctcacatgatcttcccacctaaggctctggaaccacagacgcacgccaccacacctggttaatttttgtatgtcttgtagagatcaggtttctccatgttgcccaggctggtcttgaactcctggactcaagtgaacctcctaccttggccttccaaaatgctgggattataggcgtgagccaccatgtctgcccttgaacttcattgttcacctgtgactattcccacccaccctttttttaaaaaaacaagttttttgtggccgggcgcagtggctcacgcctgtgatcccagcactttgggaggctgaggcaggtagatcacgaggttaggagttcgagaccagcctggccagaatggtgaaatctcatctctactaaacatacaaaaattagctgggagcggtggtgggcgtctgtaatcccagcaacttggaaggctgaggcaggagaatggcttcaacctgcgaggcggaggttgcagtgagccgagattgtgccactgcactctatcctgggtggcagcgtgagactctgtctcaaaataaaaataaaaagtaaaaagtttttttttttgttttttgtttttttttaaactagcttttgtatatatcatggaaccatcctgctctaacttcatattacaagaaaacagcaaacgtctacagaactagagtgtaatgagcccctctctacccattaattttactacacgtctgtgtgagcagtgtttggaaagaatgatcctagaccaaggtccatatccatgctgcctgcatgtgtcaacctggtgtcatgtaaacttctcattcgtcactggctattgttccaattttagaagacctaggtgaccaccagctgttctattgtttcagcctttattaccccataaccttcttccctggatgtgggtgaagagaaaaaagaggagagctatgttattctctgctccactccatctcttctgacaatacgatgaagatatgttaaacaatctattaagttagtttataactggcttaacgtgaccttgttaactatctcaaagctatacagttttgtacgactcattgagttgtctgtgtatacattattttgtatagtcacaaaaacaaatttaggacttttcccaagtttattcatatgctggtgatcattaatcacaattaggccaggcacagtggctcacgcctgtaatctcagcactttgggaggccaaggcaggcagatcacgaggtcgggagatcaagaccatcctgggcaacatggtgaaaccctgtttctactaaaaatacaaaaattagctgggcatgatggcgcgtgcctgtaatcccagctactcgggaggctgaggcaagagaatcacttgaaccagggagtagaaggttgcagtaagccaagattgcaccagtgcgctccagcctggtgtcagcaaaactacgtctcaaaaaaaaaaaaaaaaaaaaatcaattattccctatcaccaatgttttaaaattacatgtagaaggaaaaggcagtacaaccttataaacaatatttttattaattctatgaaaatctttaagtgagcttccttgaaagccatgtttttaactgttgtattctttcacctaattctcaagccttagaaggcagaaatctggcatatacccaaatagaagcacataaatcagttaatctttgtttaacttttttaaacaaagtttcagtgataatatcctatttagctgacaaagtatttgtctcccatgggtagcatttcacttcttattcattgggtataatacattttcatgaaatacagaaatgctgtgttttcctcttttgattggaatttagttcaggcaattgttatagaatttgataactttttaaaaaatcttttttcttgcacttagctttgagagagcatgtattttgtaatgtctcatcagagtgacaaactaactctggaccatacgttctcaatgttgaagcgttggtggtagaaatgttttatcactcgaatccatctgtcttttctaggaagctatgtttcttgcagtagacaaattttgaatataaattaggaaactttgagaacttacttttagtatttgatctgaatactaagtaaatattaaacgctgtattttaactgtatgattatactatgcttagacaatacttttaaatgaatatttacaaatgtattattttcctagaaacctaagaaagaaaaattatctttccccagagaaactaggtttaagcagagctttgctgggtttttattgttgttttttgttttttttactgaaactgcagtgagctcaattccttccagtgcttcagtgattttctagtaatgagaattgcacttaaagacattcagtgactgtttcaggcatgatatggagtataggaaaatctctaaactgaaacattcagaggatggagatattctgcttaatggaaatttttgcagtggtgtgctacagtcagctcctcctggcttgctagagcctattattaaattttcaggccgggcgtggtggctcacgcctgtaatcccaacactttgcgaggttgaggcaggcagatcacttgaggtcaggagttcaagaccagcctggccaacatggcaaaacaccatctctactaaaaatacaaaattagccaggtgtcgtggtgcacgcctgtaatcccagctacttgggaggctgaggtacaagaatcgcttgaactggggaggtggaggttacagtgagccaagattacaccactgcactccagcctggagccacttagtgagactctgtctaaaaaaaaaagccaggcgcgatggctcacacctgtaatcccagcactttgggaggccaaggtgggaggatcacgaggtcaggagattgagaccatcctggctaacacggtgaaaccccgtctctactaaaaatacaaaaaattagccaggcgtggtggcaggcgcctgtagtcccagctactcgggaggctgaggcaggagaatggcatgaacccaggaggcggagcttgcagtgagccaagatcgcgccactgcactccagcctgggcgacagagcgagactccgtctcaaaaaaaaaaaaatatgtgtgtgtataaatatgtatatatatacatgcatatatatatgcatatatacatacacatacacaatttacacattaaaaacattagtactcaaaactcataatttccaagtattttctctgtgctctgtgggtattggcatctgttttgtctgtatgctgtgctgcttaccacgtgtgtgtctttccaactctacgctcaggaaagtcaccttggtagcttgaaactggccatggtggaagtatttacatcgtgagaattactgaacactacacatcagggctttttcattgttttgtcctgaggactgtttcttaaatatttattagcacaccactgactttaagctaaatgagcatcttaagcttttgcctttgataaaaacctgtctaaaatgcattaggatgcttttctaccttaagtgtttagagcatgctaaatatcattgttctaagtgctgaagaagatctttaatacttgagattgctataatgctcagaataattatcttaaacattacaagatcacctcttatgagatgtcaaaagtatatcatttccagatcagttttatgtaaaatgccaaattatgaattctttatataagctcaaaatattttgttttactgcagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacaggtgaggtgttgcacagggaatcggtaacttctaggacactttttaaaaattacagttttcaccgggcgcagtggctcacgcctgtaatcccagcactttgggaggccaaggcaggcggatcacagggtcaggagatcaagaccatcctggctaacacggtgaaaccccatctctactaaaaaatacaaaaaaattcgccgggcgtggtggcaggtgcctgtagtcccagccacttgggaggctgaggcaggacaatggcatgaacctgggaggcggaggttgcagtgagccaagatcgtgccactgcactccagcctgggcgacagagcgagactccatctcaaaaaaataataaaacaatattaaatattaataaatgataataaaataatgataaaaataatatcaataaataaaaataaaaataaaaattacagttttcagctgggcgcagtggctcccgcctgtaatcccagcactttgggaggtcaaggcgggcagatcacaaggtcaagagattgagaccatcctggccaatatgacgaaaccctgtctctactaaaaatacaaaaattagctgggtgtggtggtgtgcacctgtaatcccagctactcgggaggctgaggcaagagaatcacttgaacctggaaggcggagcttgcagtgagctgaggtcgcgccactggactgcagcctgggtgacagtgagactccgtcttaaaaaaaaaaaattacagttttcataagccatttctcccaagttacatgttgtgtggcatttcatgtaggtttgtgctctgtgtgtgttattagattgtcttccagtcagaattcctggctgttaaactatttcatcagcaggagttacatccctatgttgtaagggtgatgtccaaaagatacagtaatttttaaaaataatgattaaaggactttgttagaaacaaagagctattttgtatttaatatttgctgtgaagtaggtgataagtcgaattttttagcttctctctgagaaaaatgaagtgtaagtgaggcgttacttttcgacattttctacatgtagtttccttttgtctattttttaactttttttcctctattacactgaaatacatatttaatctgataaattctagtcaagtgcaaatacaaaataacaaaaagaattaaaatcatccatggctctaaccacttaggatacctcctattatagtctatgtacttccagtcagctctcattttctctcactttttcttgctccatatctctgtcattttatttttaagcaacatattataaaatgctattttctaaaactttttaaaaatttaaacataaataaaattttatttaacttgtatattatttattggtttagtttttattatgaataatggtgcaaattaatctgattttcaaaaggaacagaattgtcttagagtttcccagtagtcttgtcaccttagtcctaatgtcaaataatgtcctcattgtgtgcagccaggacagagattcagcagtgttatcaagggcccagactcccgctcccggctgtgtcatcttcagcatgtatcattcattctcatgatcacagcgcggctactgaacctctaggcattgcctcagacaggaagaagggctagagccaaaaattggggctagctgaggtctggcccaactgcaaacctttcctggaagatcctcccagcaactttcacctacatttcattggctagaaataggtctttagtccctagctgtacaggattctgagaaaggtttattttcgctttctaaatctcagtttcagagcaagacaagagaaatgcagatgatacctggctgttaggttgctcattatctgtttagcagattttaagtgctttatttctactgtgtgtttaatgcttacatgagaataggtgattattatgcccagtttacagatgaggaccagaagttcagagatgttaaggaataagttggtcaagatcacatggcccaaactgggcagaaccaggatgggcaaccgggcagtctttattccagagcctgtcctctataccagcatcaggcatctcaaaaataccccatgataacctgcaaatttcacttcctggggaagtgtgaggctttagtcattcacagatagatctcttacatattttctttttattctttgattggcatctataatcgatatctcattatatcgtatttctgccaatccagcaacagtttttatttctttccagccttgtcagagtttcttccttgccttgcacttcctctccgtgctgaggatacacccagacacatgcaagcctgaaaaccgagctcactattaatagaagaaacaggtgttttccatggctgaggagtgcttaggaatgtaccatctactgatgtgatcggggaaagctttgtgcctgcaacattttgactctagtaatatgtgtgtctgtgcatgcacacacacacatgcacactcaaatgtagaagatgaagtatgagtatttataatagcttattaaagaaaatgtttaaacacccgcaacaccgctattaggtctttaaatttttcatttaatggtaaccatgttttgtaaaatgactatcttccttctaggtctagaatttaatataatttaatcatgaaaacgttggtattcataaatgaatttcagtgcctttgtggaaaagagttaaattatgtccccaaattggcaaatgtgtgtgtttggatttattcttaacttttccaattgcatcatttagattaaattagtcactataacattcttttcaattttacattttaaatttcttttgttaaccagctgagaagtctgagaactttgtatgttcacagggtgagtccattgttcctggctaggaagcaggggttgatcttttcctgcagttcatttggattgaaggttcttctttgctgactcttgcttccatagtgaaaacacagatatccactcagtgagagtcagctatcttaaaaaaaaaaaaaaaatcatgtatacatcacatgtggttcaggatgctagctggcattacagaaactggtgtttagacattcaacactgctttttttaacatatttgaatgatagtgtctgtttcagtgcaggcttttttgacatgaagggtgatctacctcaaaggcagttattctggaattgaatcctccaaaatgaggccaattaaagggtgtcttctacataggagttaagggaagtggttgccatccctcccaccctgaaaaaaagaaaaagagaaaatgttggctctatttattgttttggtggggttatgtatgaaaatgactaagtcaactcatctgtttgtgttgttgctttggctactggtctgttctttcattttgggcttatagtgctttaaaattcaatatattggatattaaatgcatgtgattaggaaacagtcttgaaatatgcccagagttactcagtagcttcttttttataattttaattgtggtggtctcacatttgtgggtttaaattgtctgagttattgagtgttgtattttgtagcccccttctttaattttcagaagcactgtccatttcatttcggtttataaaaatgcacatcttttgtttattgttatgatttatccatgtgtgttttctagccaataaactgtgtcttgcagtcatgattgatcttgttttactgagatttagttttgaagactaaaaatctccagtgttgatatttaaggtttttgaggattaattcttataatcatttttgatcgaataaaattaactcattatgtcggagtatgtgccttttgggagacaaaaataattaagagaattgaaaggatctataaatgtgtttgtagaaattccacttggggatgtggtcctattgtagtttactgaaaacagttgtgggcattgttaccagtggaatgtgtgccctaagaaaacaccatttgtgatgaatgctgggcgaactgtgttctcaaatcattcctgttgtctaatggttatcttacaaaaagcatgtgcctggttatgtttgttatgtggctttgtacagtccttacctaggatcgattggctgttgagttcggggggcagaagtgcactgacccactgtggattgtgttggaaggctgttcctgtagtcatttgccttgtgttgcttccagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccacaggatgctgtgtcccctcattccctgacgtttcttgattgtctgccgcgtggtggactctgctgtgtttcctgctgtgacttctgctttaaggatgtccctgccccaccccccagtttcaagagtggatctgatcagtgtgtggtgggagacagaaaattgggagctggtttgcggagcatccagctgctgctttccctgtaccactggaattctttcccttatctgtcactcccagtaagtagggcatgtcattgttggctttctttaaaaatatttattcttccttcagagtcggagctctgaatttcttttttctttttttcttttaagacagagtcttggtttgtcactcaggctggagtgcagtggcgtgatctcaactcaccacaacctccgcctcccgggttcaaacaattcttctgcctcagcctcccgagtagctgagattacaggcgtacaccactacacccagctgatttttctatttttagtagagatgaggtttcaccatgttggccaggctaggctcgaactcctggcctcaagtaatccacctgccttggcctcccaaagtgctgggattacaggtgcgagccaccgcacccggcctaaatttcttttatctcaatttttgtcttctcttctacagagaagatgaggaaagaagtcaaggaagaaaaaggaaaggaaaactccaggtttcaggtgcaggacagtaggaccttgcattcactcatctgcccagtcagttgctgtgcgccagtggtgtggctggggtgggtggacacacagaggggacacgaggatcagcaggcaagatgtacaaagttggagacgatgcacgctacatgttagaattctagaaagatgca

SEQ ID NO: 13704 - DNA, 4451 bp, Human
atggtggcgcatgcctgtaatcccagctactcgggaggctgaggcaggagaatctcttgaacctgggaggtggaggttgcagtgagctgatgttgcaccactgcactccagcctgggcgacagagtgagagtccgttgggtatcacacccccactcactcagcccctggctgagtcatagcaggtggacactcatggggaccaagacgccgttgagggacgggacccaagagatgcggctataagtggggtgtgctgggtcactggagatgcctggcttgcttattgacgaagcctcaggctctggaggtgggggaagccgtgggggagggaaggggagaaaaaagagggatggagagataaagacaccgagacacagaaaaagagagattcagggagaagagagacagagactgagacacagagtgaaacagacgcacacacacagggacgcaaatagacaaaagcagaaacagatgaacccaggacctgcacagatgtggatctgcacttggggcagccgggccctctactccatgtgcccactaggtggcgcccaagagccacgctctgcaacgcagccgacccggttgggcccctcctgccgcggaagcccccatctctctgcccgcccagcgtttcccccacgggcccaacaccacctttgtgggaggccctggaggcgcaggtggaggctggaatgggggcttcctcaagggtcgagggtctccagagcctcccaacccggcccccggtaggcgaaggccctggttgtgtctgtgcttctcttagagtgagtttgtattggtctcaggagtggacgtgcctgcttctgtcttggggtgtggatctggtgaatctccgtgtgtgaggcttaaggccgtgtgtctctctgtgtgcatctgtgtttgtcatggggcgtgtgtccgtgtgtgtctgtgtttgctctggggggcatgtgtctctgcgcatgtgactacgtgtctcatttttctcttgctacatatcatggctgtatttgccttgggtgtgtctgtgtctctgtgtgactgacttctcctcatgctgtgtacattttggtgtatccgggctggcgagtgacttgatgtgtgcctcatgtctccgccccccttggaaagctgcctctcccgcccctgctcacctttcctggcggctctgtatagagtcaccaaagaattcaagaactgaaatatttatgaagtgcttcctggggtcccctggagagacaggagcgactgttcatggagctgtgtgtctgtgggtctgaccaaacgagatttagatcctgctcaaactaagcacctactatgtgccaggccttggctcgggtactgccttcatgctatgcattcagtttcctcatctgtaaaatgggcctgatattcggccgggcgcggtggctcatgcctgtaatcccagcactttgggaggccgaggcgggcggatcacaaggtcaggagatcgagatcatcctggctaatacggtgaaaccccgtctctactaaaaatacaaaaaattagggccgggcgcggtggctcacgcctataatcccagcactctgggaggccgaggcgggcggatcacgaggtcaggagatcgagaccatcctggctaacacggtgaaaccctgtctctgctaaaagtacaaaaaattagggccaggcgcggtagctcacgcctgtaatctcagcactctgggaggccaaggcaggcagatcacgaggtcaggagattgagaccatcctggctaacatggtgaaaccccgtctctgctaaaaaaaaatagctgggcgtggtggcgggcgcctgtagtcccagctacttggggggctgaggcaggagaatggcctgaacccgggaggcggagcctgcagcgagccgagatcgcgccactgcactccagcctgggcaacagagtgagactctgtctcaaaaaacaaaacaaaacaaaataaattataaaaaaaaaaaaaaaatgggtgaaattccaccatggcgtaccgtggccagggccagaaagtgcagaaggttatggtgcagcccatcagcctcatcttcagatacttacaaaatagatcgcggattcaggtgtggctctatgagcaagtgaatatgcggatagaaggctgtatcattggttttgatgagtatatgaaccttgtattagatgatgcagaagagattcattctaaaacaaagtcaagaaaacaactgggtcggatcatgctaaaaggaggtaatattactctgctgcaaagtgtctccaactagaaatgatcaatgaagtgagaaattgttgagaaggatacagtttgtttttagatgtcctttgtccaatgtgaagatttattcatattgttttgattaccgttgtgttactacaagatggcaataaatactatgggattgtttgtgttaaaaaaaatgggcttgatattagcatctatctcatagcattgctatgaggtgagttgaggtttataaaaccttgaacactcctggagcatgctaaagactcaatgtgataaattatctcaggctgggtgtgatggctcacgcctggaatcccagcactttgagaggccaaggtgggcagattagttttgagcccaggagttcgagaccagtctgggcaacatggcaaaaccctgtctctacaaaataataattataataataataacaataacaacaataataataataatacaataattagccacgcgggatggtgtgcacctatagtcccagctactcgggaggctgaggtgggaggatcacttgagcccaggaggcggaggttgcagtgagctgagatcacgccgctctgctccagcctgggtgacacagagccagaccttccctcaaagaaaaaaaaaaaaaaggaaaaatcacctcatttaattctaataactacaagcacatctattaacctatgggtcagtggggagcccctgagaattcttcactcactgctaagaacttgagggttgtcaaaaaggcctaaatagattggatgcttggacgtctgtctgcataaaaactttccttttagctcagctcagcggttctcaaacttcagaaaactgagtagacgggatcatgctgggtataaaaatcaggggcatgagttgtttcagacattgggaactcagcggtgaatagaacagacaaaatagccgttggggagtttctgttctgatggggaaaagataataaatgaggttgtcactcaacaaatgtgagtcattatggttattttccatcaaagactttcaatatactttgccatttcgccctccagaaagatgggacttggtactaacttatcccagcaatgtatgcaagtgctcactgccttgtaccttcacaaaaactattattggatctttttgtcaaatattagagtggtgaaattctttttttttttttgagacggagttcactcttgttgcccaggctggagtgcaatggcacaatctcggctcaccgcaacctccacctcccaggttcaagcacttctcttgcctcagcctcccgagtaggtgggattacaggcatgcgccaccatgcccggctaattttgtatttttagtagagacagggtttctccatattggtcaggttggtctcgaactcccgacctcaggtgatccacccgtctcagcctcccaaagtgctgggattacaggcatgagccaccgtgcccagcagtgaaattcttttttcaagtcttttacaatttcccacctatgtcttttgtgtgtccaaagtgtatgcacgttctttgcacatgttgctttatttttattgatttctaacaactctttatatatgaggaatgctactttgtttaaacatgttggtggcagatagcctttgtttctaatagaatgaggctagaaaaacacaacttgccaatagggaccaccataaaccttcatttgcccaacaaacatcctgcgtgtgaatcaatcaatcccttccttccttccttccttccttccttccttccttccttccttccttccctccctccctccctccttcctttcttttctccctccctccttctttccttcctctcctcccttcctcccccctctcttccttccttcctttagatggagttttgctcttgtcgcccaggctggagtgcagtggtacaatcttggctcactgcaacctgcgcctcctaggttcaagtgattctcctgccttagcctccagagtagctgggattacaggcacccgccaccacaaccgggattacaggtgtgtgcctgtagtcccagctactcaggaggctgaggtgggaggatcgcttgagcctgggaggttgaggctgcagtgagccatggtcatgccactgtactccagcctgggcaacagagtaagatcctgtttcataaagtaaaataagataaaat

SEQ ID NO: 13705 - DNA, 42234 bp, Human
  misc_feature (1)...(42234): n = A,T,C or G
ttttcttgttagctagaacacccagtaccacgttgaaaagactggtgagaggggacatgcttgccttgtgtcagactttaggtggaaagaatgtagtttctcacaacagaaacaatctattgttagctgcagaatttttgtagatgctctttatcaagttgaggaagttctcctttattcccagtttgctgagtttttatcatgaatggatgttgaggatgggcacttcttttatttgtgtgtgtgtgtgacaggatctcactctgtcacccaggctggggtgcaacctcacctctcaggttgaagcgatactcccaaggagctaggactacagacgccaccacatccagctaattttttaaaaaacttttgtagaggtggggtctcattatgttgcccaggctggtctagaacactttggcctcccaaagtgctgggattacagccgggaaacactgcacctggccaagggtttgcacttttaaaatgttgctttaaatcaatctattccagaaattgtaagcaacataaaacgtaaagcaagggaagtgagtatgaaatagcaactgttacaaaaactgcctactataatcaatattcttgtgcaatgcagtatgctgagcgtgggagccccataacaatcacttgcctccatggtctttggcaaatagatattactttattttttattttcgagacaaggtcttgcactatcgcccaagctggggtgcagcagcgagatctagctcaccgcagcctccacctcctgggctcaagccatcctcccacttcagcctcgggagtagctgggactacaggcgcgccaccaaacctggctaatttttgtatttttggtagagacggggtatcgccatgttgcccttgccctcgaactcctgacctcaagtgatcggcccactggacctccccaagtgctgagattacaggcgtgagccaccgtgcccggcctccaaatagttaagactttaaacttagaaaccctattcacaacacaaactccgagtgaagctcagtggcattttcttacaggaagaaatacaggagttaatcaacaggtatgtgggatgttcccacatcaaatcctaaagataaaattttaactcagttcctcctgcactatctgattctccccaaccttgtctcgcagaaaccacagcgcagcctgaaaacacgccccgtctagattcaacacctcatttagaaattcaatttctcgttgctagttggatagcgtttgccaagtaatttgaaaaaataaaaataaaccaagtggtctgggatttaaacaagataatgtagggtgaaaaaagcactcaggtgcggacagccatggagcgtgacttcctgtgcactctttccccgccagctcaacgccagagccgcgcgctaggcggagactgttggtggcggaggccggagtcgcacgcctacgagactgcgcggacccgcccaaaaggaaaatggaagtagtggcgtgaggctgcgacagtgaaggttatttttctctttttaaagggccgctagacctcccgtctaaaggaagcgcccgacgggcctccgaagtacacgcccaggcccccacagcgcagccgcccgaccgcctctcttcacaccggccagagtccaccctctcccactttcccctcccctcccctccccgccccttccctccccaccccttcgccccgccaaccctagacccggcatgcgtgcgccgaccttttccttccgagccgacctctccaccttcggcgcctcccaatgacaagcggcgcggagcattgtggtcccgtgcgcaagagcgaggccgagggcagaaaaagaaagcaaaagactagggcgagtcggtagagcgggccccgcgcatgcgcaagggcggaggcggtggtgaaaaagggtggtgcgtggtctacggcgagcggagtggggcggggtcgcgcgccttggcggggagtccgcgagccaggaggggcggggggtgaatgaaggagcgggcggaggaggaagtgtcatggcgtcgggccgtggagcttcttctcgctggttctttactcgggaacagctggagaacacgccgagccgccgctgcgagctggaggcggataaagagctctcgtgccgccagcaggcggccaacctcatccaggagatgggacagcgtctcaatgtgtatccttttctgttcgccgccgctcacgccctgtttcccttgcccggtcgccgggcctggtgccccgcgaacatggcgccgccggcctcggccttcgctgggcctcggcgccgcggtcagggaagtaatgttccggctcgggcagtcgcgaggggtcagcagaggaagggaggaggagataggaccccaggaatgcgggccaggagcctgcgttgtgtaatctgtttggggcagcgcgtggtggtggcggcgggggttgggagtgtggctcaggcgaaagaggaattttagggattattgcagaaaaggggcggctccctggacttgtccctgaccccgaagggtttgagaggtaggagggttagcgatgctgaaaggcctaagtgtttgccgcagcctttcccggctctcgtcgccggcttgatggcggctctcttctaccttgggagcgtactggagttctttatgttcttggcgtggttttgtatgggtgtgtgcgcgcgcgtttcaactgtttcattttgagtttagttagtcgtagccattgataaatagttccagggccctcagcgctgttagagtgaaaagatcagcagttcttattcccatttatttggcgtcaagcctattctcttcctgccgccccaccccccgcgggcatttatttctttatttccagtttggggtttggatttgaatgggaggtattggaaaagaacctgggaattttccatcaaaattgttctgggaatgagatcttgcttttgtcagatatttcctaaatattacgttccagctctcagcttacaataaacactgcgattgtttatatgcacaggttttatatgcaccattctttcaccaaattcaacaaaaatgtaagtactagttgtctgtttttactgtccgcaaatttgagggtaaatcgatacgcagaaaaaaagttggtcattgcgttgttggatttagtgttctgaattaacggtaaacgtatatcacgtgataaatattttgcttcagatgcggtgtttttgtgtttttaaaatttatgatgaattaaactgcaaggcactgttaagctctgccaggccttttaagctaaaaaagaaaaacatttatttctttacagagttattacataggttttcttcatttaaattctatacttaacatttgaataatttcagtagtgatgtacagtggaattgggcaagcctggtcgttctgtgatacatcttaattatgttggactcattgtttaaaagactgtcaattgagattaaattaattatgacattcttttgaaagagctatttagtagaaataattcatttcttcatttgctaacctagtaatttcttaagatgtcaacgtttctgtttatcacgttagcatcagttgtctcctaaaattttgggtgattcaaacgtccactcttgcttcagatatagtacgtcaggagtatgtttatgtattattagtaaaatttacacctgaatattaaggtatataacctgtaaaccttgacaaatagagtaatggcattttgttgaaatgttaatttcatttatgaaagatacgagtttggtgtatgttgagtaacacgcatactgtgttgtgtgtgttaaagaaaattgcatattgtttagaaatgtttaactctgctttaattctgtctttatttgttactttttatcatagttatttttagaatattattctgaaaggtatgtgtagaaaaatggaccaaagaagactttctgctatttgtggatagtcattaggacttatttgctaagaaaacaatcctaggaaagatcctcagaatattatttttgaaatggaaggaaaggcttcatggtttagattgagtcctaccttaatctcttcggatcctatttcatttatcagtttggcatacaggtttatcttggaccacaagtattttaatatacattttgatctcttgaagacttcttctatttcttttttaaatctgcataattcttgctctgttgcttctagtttcctagttatttcttgtgcataacatttaggtcagtgatagtgttatggaagagaaaggaagccattggtgataacatttagattaagggaattcattataaattgtctccaaaggcagtagtgaactaatgaatgttaatataaatttggcattccttacgtaaccctggataataatggtagaaattacaaatcaaaatagttctgactattctttatatggctacagatgtcccatttgccgaatcaggcatacttttgtacttccaataaatgatctagccacaagtcttcacttcttttatttattaattttttttttatttttttgagacagagtctcactctgtcacccaagctggagtacagtggcgctgtcacagctcaccacaacctctgcctccctggttcaagctattcacctgcctcagcctcctgagtagctgggactacaggtgtgtgccaccactcccggctaatttttgtatttttagtagagagggggtttcaccatgttggccaggccggtcttgagctcctgacctcaggtgatccgtccgcctcggcctcccaaagtgctgggattacaggcacgaaccaccgtgcccggccatcttcacttctttgttttgagccctccttataatttgtctttatggcgtggttggcgtgctttacaacaaataccctgcttaaagccagaattcacaactttagattgtcatttgcattctagctttcactattttacttaaatgttttccttcaataaaaaggccaaggtattaattttttattaccttctttaatgtcttattgtgtatgaaggtaaacttcagcatttttacgtagagtcagtaataattgaaatctgttcatttctgttttgagaaatattattatacccttcatatctgttgtctttttttacctttgctattataatatcaaaagtggtttttatatttgtgtcagtgcacttgcatcaattgcaccgcctcacttttatctttcttcccccctgttcttttagggcaaagggggtggtctgaaattgaatgtgagtcgcttttaaatttgtattattccacaccagtgggaaatttttttctatatactgaaatgtcatggtaaactttaaaaagcgtgaatcttcaccagagtaaactgaacaccgttcagcaaattaaaccctatgaaataacaagcttaaataagttaagatgctagtgacaaactatatctagtcttatagtaaatattaataacatccattaactgtgtgaaaatatttttaaatgttcaggtgacttaattgtattttcccacattgacatattaaaagttttaaaacccccaaaagtaatgtgctgctgtattaatatttaagaataaaatcagtatcagcatgttttggtgacccagaaatggtctcttatcattgagttcttttgtcagttactcagagttgaatagctgtcagcagtaaatgacttttatatgtagcctaattagataaatctacactttgttcactagatgcaatgaggttcatgtaattggaattaataaagaatggccttgctggatcaagctcaaaaataaatttagtaaagtgtaaaagccctggagccaaaagtgatgccaaggtatatactgagggaaagcacccaccccccaagtcacacttaagtagatattgacccagcttctcttacaaactcctaatttggtcttttgtgatgcattttttttcttataccagttccaggtctcttaagattaggttgtaaagagcacacccttttctaagtatttttgttggtcatggtctgttctcatagcacatctccaatttatttgatcttttccatcttctcttacttccattgcctctttcttgagctctagcaatcagaactccatgtataatatgcaagatttaaagctattgtagggcctggcatggtagctaatgcctgtaatcccggcactttgggatgctgaagtgggcggatcccttgaggtcaggagttcaagaccagcctggccaatatgatgaaaccccatctctactaaaaatataaaaattagctgggtgtggtggcacgtgcctgtaatcccagctactggggaggctgaggcaggagaatcacttgaacctgagaggtggaggttgcagtgagccgagatcacatcactgcactccaacctgggcaacagaacgagactctatctcaaaaaacaataataataataataaaaataaataaattttgctttttctcctgttcatttcaattcattgttatactctggtcatgttttacagaagtcaaatcagcatatgtttcattgtgaagtctaagcaggtgtttatagcttacttctctttctgccttttagtttaataaagcaataattaatccaacaataatcttatgcccaagatccattagcattacttggaaatactgcagtgctgtccagtagaactttctgcatagcgcaagttttgtgtatctgtgctcttcaatgtagtaggtactaacctgtaaatttgagacgattagcctagatgatttttaaattccttttaaactataaattacctggttgaaattttattaagatctcactatgccaggcactttatatttgtcttgttttctcaggtaaagtattctcctaaggaagcagacgcagttaccaagtgacttgtccgaaattaaaactattacgtggctgggatttgaacccaagtcctttgcttaatcccaaactgtagttctcactttttcctgttctagtatatttcagaagtagagcacagtagcaatttatgccagtgatttgtaagatttataaagtaaacaatgaaaaaacctcagatttttatttgcccgcctcattgcactaaatccaatgaggtcctctttataagtcccaaattcctctttttcaactatacatcagtgttagcatttatgcattgtgtatcactgtttttccttagggtgctttctctttgctttcatgtgactgtgctctgtcaggttttaagactcagctgaagttgctactctttcataaagcattccccagataactctcttttccatttgtgaatttatctctctgatcttacctttgaatcttattcacatccagttgtattccatctatttgggagtttatagtgctgtagtgtaactgtacatatatgagatgagtgttttctttttaattgtaaaatatataaaaccaccaaacaaatgtatagtggattattataaaacaaccttgtaatcaccaaccaagtcaagaaatagaactttgccaactaccccggaatgtctccacgtgctcaactcagtgtcgatcccctccctccaaaagtaaccagtattcttttttatttttttgagataggagtctggtcttgtcgcccaggctggagtgcagtggtgcaatctcggctcgctgcaacctccgcctcctgagttcaagtgaatctcctgccttagcctcctgggtagctgggattacaggcatgcaccaccatgcccagctaatttttgtatttttagtagagacgggttttcaccatgttggtctggctggtctcaaactcctgacctcgtgattccccccacctcgacctcccaaagtgctgggattacaggcgttagccacctcgcccggccccagtattcttactctaatcactttctttatagttttagcacccaactctgcattcccaaataccatagaccttgctcattattaaaaatttggtaagtctttgaagtctctcagtatgcatgtttcccctccatctttttatgtcaactaagttgtagctgttgaaggaccctagagtgtgtgacctgtagagtttccaactgtctgaattttgctgattgtatactcatggtgcagtttactgtgttccttttttcttgcattcctggaaaaattgatgattagatccagaaacttaatcagactcctgttagatcccttaggcaaggctatagatggtgttaatgttctttggtcagaaggtctaaagtctggttgtctctctttgtagtgttagtggctgctgatattcaatgcctgggtcctttcattcattggtgatactctaattctgtcatttctttcttacaaattggtatttttgtattggaattcttgattcatctcatatggacacccagtggcacgtatcatataggataattactggatttttgccctttttgtgatataattcacatattgtacatttcacccattgaaagtatgattccgtggggtttgtgggtttttttaagaatattcacagaggtgtgcatcaatttttagaagtcttcactacaccaaaaagaaacccccaaccccgcagtcatttctccctatttttcccccagcctattaatagacatttcattaatggaatcctacagtatgttgtcctttgtgactgacttctttcacttaccgtgttttcaaggctcatctatgttgttgtatttattcagtaggttgtttacttttcttgctgtactacccattattccactgtatggctagaccacattatatatatatgttcatcagttggtgggcatttggattgttagccactttttggctaatatgaatagtgctcttaagaacatttgtgtacaagtttttgtgtagacttgtgtttttggtttctcttgggcttatacccaggagtagaattgctggatcatatggtaactctagattccaataatattggaaacttggatagctgccttttttttttttttttttttttttgagactaggtctccctctgacacccgggctggagtgcagtggcacaatcatggctcactgcagcatcaacctcctgggttcaagtgattcccccaccttagcctcccaagtagctggaattacaggcacatgccaccacacagttaatttttttaattttttgtagagacaggggtctcaccatgttgcccaggccgttcttaaacccctggactcaagcagtcctcctgcctcagcctcccaacactcagcctaaagcagctctttccagtgtgatttgtcactttaagcaccactcttctagtcttttcttacagtctttgtgtgaactgaatactcttcggttactcatttttgtgagatattagctttcctgaactttaaaaaggtgatgtaccttcagagtgctttaataatttcacagagctcccttttctgttattttgtgtaatgttcagaagtgtagcagcttactttctgggagtttctggccctcttcccctccacatttttagtttctcttttcccttcttcctatcttgctgattgtgcttttcctcccaatggtttctcttcaaactggagtcttggaagagaaccttggaagatcaatttcaaaagttcgtagaagttagcttcggtcttttaatccttactgtaggtctcttgcatccatctacttattggactggcaaaactcccagtgctagctgctcttctcacattggcctgccatgatttccagtgaatgtcttttggctctttgaggttcttcttatatcaagtccagcacatgccccattcctttgcatcttgttgcactgtgctgtgtatgttgacatagtagcctgttttttcctcattcgtatgtgttaggaattccctaggaatggcttgtcatgtgatttggttgtagctatccatggggttttggttttgctatcttgttgctctgtttttctgtggggatttaagtatcccctctgcagccatcaactcagaattcttcaggtaaatcactaaaagtttaccttcattcagaagatgatacactcatttccagtgggacttcatctttccagaagtatttataagtacatttaaatgacagcctattgtggtcccactggaaatgagtgtaagatgaagttgattttttaaaaagaataaatcacttgaagtttctgttaaataaggaagctgtgggagagttcatttattaataggcattacaaagaatatatgatatttttgattgattttctcaaattaattctgaaagctactctagaacttccccagaaagctttaaatgttattttgaaacatgctgctcttatctgcctaattacagggatactgacttcagtgactctgtattattatagaagtcttatgaagtattcctgaagcggcttaaaatttttttttgcaaaattaaatgattgtgaaataactcataccttttctctgcacacacagatacatgtatattttagccttggtaatttatatgcttctctgtggtcctggctcatcctttttgttgagtcatcgcatggcaggagtgcaagagagtgaacccagtcctgcaagatccaaggcgctttcaaaccataacaaattctaaacttaggtgtatagagtagaataggttaatatattaacaaatgtgcattgagtgtttgcattggccaaggcatgcaaatgtctcagtataaaatcagacagattttatatagtttataaactgattttcaaggccattgcagaacaggagttttgtttttagtattaatagctaaaattggttaaggtaattttttaagtgaaaatccaattagataactgcattttattataaacatacatatacattctagggagtacatatttacacatgttctagggattaggggaaatgatggaatctccttaccactctacattttctggtgttaacctaatattttacccctaaataagctaaggctctgattgttagtgacatattacatactctttatatggctatacataaggaaatacatgtaacgtgaatttttctctaaattatttggagctgatacagaaaagaaatggatgagaactgtagaagttcacctatttgttattaaaagttaaaagtgaagttaaggcttgtgcttagtgacaatatgcagttcaagcaattctcctgcctcagcctctcaagtagctgggattataggcatgtgccaccacacctggctaattttagtagagacggggtttcaccatattggtgaggctagtctcgaactcctgacctcaggtaatccacctgcattggcctcccacagtgctgggattacagcatgagccaccatgcccggcctcacattgtatttctttttttttttttttttttctgagacggagtttcattcttgttgcccaggctggagtgcaatggcgcgatctcggctcaccaccgcctctgcctcccaggttcaagcaattctcttgcctcagcctcccaagtagctgggattacaggcatgcaccaacactcccggctaattttgtatttttagtagagccaggttttctccatgttggtcaggctggtctagaactcccgacctcaggtgatccgcccgcctcagcctcccaaagtactgggattacaggcatgagccaccgtgcccagcctatatttctatttgacagtgacggtgtgggctatagtcatttgtatccaccagcaaatagaattactattggccattcacactatagtaattccttccaaaggcaaatgtgcactttcacactaatcttaaactgagggttcatttagaagttgaaaaaaaaaaatgggaaagatgtttcttctgtggccaaaaatcggaagataatgaaactttatatagttccatgcttaaaaagaaatacctgagagggcaggaagagaaaattctgagggtttgggggtaatctttaaatgatgcaaggattcagagaggataccaggtatttccacacccccaccccaaggtagatatttcagttactttgtgttgctatagctccatgattggggttttgaatgcctagtgtgagtaactgtttgagttgatatggttcactttatgtagacttaaatatctgttaaaattatttttgttacccaaacaaattaataattttatgaaacaattgctttttaaaaaataatataattgcataatgtaaatgccaaaaagttatttgctgtttaagaaattgatattctcaaaacaaaacctgattctacttttaaattaacaaatgtgtgataaagttacacatggttaagatgcatattgtttattaagtatttgttacgttatgattaggctttcggtttccttgaaatttcttttgttagtgcatgcacactacatctatggagatctggccaggcatggtggctcacacctgtaatcccagcactttgggagacagaggtgggaggattgaaaccaggacttcaagaccagcctgggcaacttggcgagaccctgtctctacaaaaattaatttaaaaaaaaannnnnnnnnnnnnnnnnnnnnnnnnnnnnnnnnnnnnnnnnnnnnnnnnnnnnnnnnnnnnnnnnnnnnnnnnnnnnnnnnnagggtgaggcaggagaatcgcttgagacccaggaggtggaggctggagcgagctgcgttcacgccactgcactccagcctaggtgacagagcaagaccctgtctcaaaaacagagagagagagagagagagagaactaataaatagatgccttttttttttttttgagacggaatcttgctgtgttacccaggctggagtgcagtggtgcaatctcagctcgctccagcctccacctcctgggttcaagtgattctcctgcctcaccctccctgagtagctgggattacaggcatgcaccaccatgcctggctaatttttgtatttttagtaatggcagggttttaccatgttggccagcctggtctcgaactcctgacttcaagtgatccgcctggcttggcctcccaaagtgctgggattacaggcatgagccaccccgcctggcctaaatagatgtctttaacgttagctccttaaaaaaaaaagagagagagagagatacaattcatataccgtaaaatccacctatttagaatgcataattcagtggctcacacgaagttgtacaactatcaccacaatctcagtttagaatatttttatcaccccaaaaagaaacctggttgctgtaagcagcagttcaccagtcccactccccttcccaaccctgggcaacccctaaattattttctgtctccatagatttgcccattctggacatttcatataaatggaatcatgtatatatggtctttcacgaagcatgttttcaaggtccgttcatggtgtagaatgtgttagtacttcattcctttttactgcagagtaattaatattctattcgtcatgtggctgtacctctttttatttatccatttatcagctgatggacatttgggttgattacacttaacagccattccactggctattatgaataatgctgctatgaacattcatgtacaagtttttatgtgaacatatgttttcatttcttacgggtgagagttacatgagagtggaattgctggattggtatggtaactttagactccaataatctttttggatagcttttaagaaacattttgaggaactgccgaactgttttccaaagtagccataccattttgtgttctcaaaatgtgtgagggttgcaatatcatcacttttctcgtcttttttttatcgtagccatcctaacagtgtgaaatgatatcccctattctatgcattgtcatttttatgttcttggtggtatttgcagcacaagcatccagtttattaatatttttcttctgtaacttgtgttcttgatagcatatctaagaaacctttacctaaactagagtcataaagatttatttgtcttttcttccaagagttttatagatttagctcttacatttaggtctgtgattcctttagagttagtttttatgtatgatgtaaataaggatttgaattttttttttttttgagacatctcactctgtccctcaggctggagtgcagtggcgccatctgggctcactgcgtgctccacctcccaagttcacgccattctcctgtctcagcctcccaagtagctgggactacaggtgcctgccgccacgcccggctgattttttgtatttttagtagagacggggtttcaccgtgttagccaggatggtctcgatctcctgacctcgtgatttgcctgccttggcctcccaaagtgctaggattacaggcataagccaccatgcccggatctttttttttttttttttttttttttggtatttgaatatacagttgtcccagcaccatttgctgaaaagagttctttctcccactgaattttcttgggattgttagtgaaaatcaatggatcataaatgtaagcatttatttctggactctggattctattccatccccttatgcagaccacatagtcttgattactgtagctttgtaataacttttgaatttaggaaatatgagtcttccaactttgtgctttttcaagattgttttggctattcttagtcccttgtatttccatgtgaattttaggatcaagctcatcagtttctacaaaagaagctgggatttttatagggatgacattgaatctgtagataaatttggggagtactgccatcttcgtgataatctgttcgaaggaaagtggccttttgtaacatttatgtagtatatttgaattcctgtgcaatgttaatgttcttgtttcacaatacaagtcattttttgtccttttggttttttaagagaagggatctcactctgttgctcaggctagcctcaaacccatggactcaagcagtcctcccacctcagcctcccaggtagctgggacttagagtggtattttttagtatttattgtaggctgttaggagctgtgtctatataagagagagtagatagagccttaactatgaaatactaagtatactttataagttggtttttttcattttttcttttttgttttttttcagacagtctcactctgtcacccagcctggagtgcagtggtgctcgctgcaacctccgcctcccaggttcaagcgattcccctgcctcagcctcccaagtggttaggattacaggtgtgtgccaccatacctggctaatttttttgtattttagtagagacggggtttcaccatgtgttaatcttgaactcctgacctgttggtctcaaactcctgacctcaggtgatccgcccgtcttggcatcccgaagtgctgggattacaggcatgagccaccacgctcggctgatattttttcttttttagaaacattcataatgctcaggtactccccactaaataattttttaaatgccggttatgttaaccattttcagtatattgtttaagtataatgtagttactctatggaagtcaagccttattctcttaatcagtactgcttttcagcaatattgaatactgatattttggggccgttattaacccagctttcttttaaatgtaattaggtatcttaacatccagcttgaagattttttttaattttttaatataaatttgctttcatgtcagtctttcactcacataattatttgagtaagaaaactaaaatgccacactgggttaataacattttctgcaattccttagtgctggtgtttctagtgcagcaaaattaaggatttaaaccactttttaacaatgtgctggaattttggtttgataggctcacacttggcaaatgccaattaacaaatgggcattttgacttattccacttcctttgtcagtttgttacctctcttgtctttcctctactttccttttcttattctaagaccttctttctataagcctgtagtaaggttatacaactatcccttctcctgaactatagccttagcaagaaagttccaatttctgagctgtaatagtctgactagagcttgctgaatatttattaatgaagtccgtttcaaggcactgaaaatagttatcctagtgttagtcagggattggataggggggtgtttagggcaatgggagaaatggcatcactagcctatagaacctaaagatgaaacacaagaacaggttagaatgaacctgttggtaatagtaagtgaaaagcaaacttggaatccttttctttgcttctgttggggttttcctggattgggagatttaatgttgaagagtaatcagatagctttggctagttcttaaatacaaatacacccacaaagtgtttgcacaggattaattattaatattaagagaataaggactagaatgattcattgaaactgaatacagccatcttgggtgacttagaaattacccagactttttgttaactcagcctgaccttgcctccgctatcaaggttgaagccagcagcggagagtgaagaatatcagcagtaagggtatcaggagcagagaggggagacagcagccaggagtgggcaggaggagaaaaaatggagaaggaagggagtcagatcaagaagtaggaatggaaacaaaaaggaataaaaaagagaaggagtgaaaggaatatggatgtaaatcactgaagtaatgtcaaatatcataaattcagtgtttggatatgcttgcttagactgcagcaggaccctccaagaattaagtttacctgtgaaaggaagaaggtgagcaagagagaagggaatttaaaaaatacacttgttaaattgttttttaaatttaaaatcaacattaacatgcacaattttaaaaatttttcaacataataataatatttgagtcatattactagggagcactattctaagtcctgtgtatattggttcatttaatcctcacacaactttacaagcaggtactattaatatttctcccattttacagatgcagaaactgagccacaaagagaataagtaaattgtctaggctagtcagatcacagagccaagattccacttgaggcagcatggctatggctggctctgtcatctctacctccccgtctccatgatttgtatgatatatttctatagagaaattccacaaatatctatttgtctcattttgagaatgttacatttccttgaaatagttatatatctgctagagtaacaaactcatgacactattcagagttcaaacaattctaaacactattcgcatcaacttccttttacttttttccctttaatttgagaacgtttattaaactaggtccaaaatacaaaaataaatagtgcatggtccctgtcctcagtgaactgaatctcagtttgtaattgtttgattacttgaaccaaaccagctgtactcctccaatactagtgtgaattatttggcttgaaccaagcttgcatgtgccagtgaatgtttgttggcttcaaaagtatgctcacctttaaaagctttggaccaactagtaatatttctgttacccaaaacatttggaattcttttaagcctcacaacaaaatcaccttccatacaaaaagcagtagtacctagtttgatcaccttccttaatcatccttgaaattaaagcctcacatggatactcacaaaatatttatctaaaaaggtgttttgttttgtttttacagccttgatggaggaaaatatttgcaggttatagagaaggaaatgtgaatggaattagtggatttcaccaggaactttggaagagtgttgggaattagtgtttagctggaaagtatttcttgatcagtgtctttcaggcaagtaagagaaattctggatcatctgacaggaaggaagtttaagtactaaattcggtctaatttgacttttgacctgagcctctattgcttcactctgacaaatagttttagcatttgaaggcttgattaaccattcccctgttagacatgaataatgacaataaatgagagattgtgggaaactgagagtgtcttcattttcttgaatgtcttatgtgggcatcagctctcagatttttatagtggcatttggaatactttgaatttaatattagtgccactatatattatacatattcattcaacaaattgaacaacagccacatagtgctaaatcctaggaacacaaataaagaactctgttctgtgttcaagctacttccagactaaattactcttttgagcattctcaatttttctaatcctttccttgttgtaattttaaaaggaagaaataagttgaaagtgcaaattaaaattattcactcattttaagttaacattatttctagttcttgggagccaaactctattttacatctgttataaagatttaccagaaggaaaacttcttaaagtcatttttacttcatttacacatctgcaaatgcagttggactagaaaggtccttttcagatcctaattccagtgattaagtttcatattacattttaaaagatctcatactgaaaggatccactgtccctctgtcagaaattttcttcacctccagtttggcattgtttctgtacggtaattgttgacgccccctgcaagacatagtgaggctcaaatgttcatctcttgaaaaatgggtactcaaatcttgacatttagaaattgtcttcccatgggaaatttcttgaatgtaatcttaaaacattatttgagtttattttatgcctattttctaagtccacagttacttgatttattattaacttttggggtacatattcaaacttcatgtttctctgtcttagtatctttgtagtgcttgtgttcttatatttctgtcccaaggacctaatttactaagctaaaaaaaaaaaattgctaatttatggatctctgattggcaaagtttctactatattggtttatattacatgcttataccctggtggtgtagctgctttcattattgctatagttaagtaatagagataattaagtaacagttttatgttcagaatcctccttactttgccctctaggtggtttttctgttccttcaacaagatagtgaaggtatcttcactatcttgtgtggtagttatagccacacaatgaatcattgcttgattttttaaaagagtattagaaaatggtgactctgtgcctagaaaaggagtatagtgggtatacttgatccgcttttcatctttttttttttttttcaggtatagcatcatctttttgcttattttcttctttgcctccacaatgtgcaaattaatattatttaaactttctctttagcatttttagtatgttcagtcaacttacttagtatgtcttttcccttttcccctttgttctatgtgcaaaacgagtaaaacagatttatagattagttctatttaatgaataactttattaaaactattacatcaatcttgtcatagcccaactcacagttcatactattaatattgcattccttccttgcacacccgcccccccttaaaaaatagaaggtttgggctgggtacaggggcttatgcctgtaatcccagcactttgggaggccgaggcagatggatcacctgagctcaagagttcgagaccagcctggccaacatggtgaaaccctgtctttactaaaaatacaaaaattagccagtgtggtggtgcatgcctgtaatcccaccttctcagggaggctgaggcaggagaatcgcttgaacctgggaggtggagctttcagtgagccgagatcacaccactgcactccagcctgggcaacaggagcgaaactccacctcaaaaaaaaaacagaaaagaaaagaaaatagagggttttttgaaatgtatttgttcttaaatgaccagagttttatcttttctgcagataatatcgtctactgcattatttttggctgcaaaagtggaagaacaggctcgaaaacttgaacatgttatcaaagtagcacatgcttgtcttcatcctctagagccactgctggatactaaatgtgatgtatgtaaatactgggttttttatttttctttgtaaatttgaaactttttcataatgtaggcctaacaaaaatacacagttcaattagtggtgccttccaaatgctgcttgttttattacctcttaggaatgcaatgccaggaagcagtctggcagaaaaacatataatgtatgttcatgaatttggatgtcattctgaattatagaaggctttgattccaggtgctttgttgattcaaagatacttttgtttcatattttgttgttcagagttatgatatatgtagagggtaagtcctatcacctccgctggaagctgtatttgagaccagaatataaataactccttaaattgtcaacagatgaaggaacagaaaatcttctgaatttacccctagatgagtagtctttttaaagtattgttccttttttaatgcatgtactactgcttatctctctgatacataaagctgcattttattttgctttcatgagcagcatttttttagtattttaattttcctagagtaatgttcctttccagacaactttatcatcaacattgtaatagaccttatttgaaagaactgttttaaatttttctgacatcttaagaaataaggagaaataaggaagttagaattatggccctttaaaaattttcggccaggcacagtggctcatgcctgtaatcccagcactttgggaggccgaggcaggcggatcacctgaggtcgggagtttgagaccagcctgatcatatggagaaaccccatctctactaaaaatacaaaattagccaggcatggtggcacatgcctgtgatcccagctacttgggaggctgaggcaggagaatcgcttgaacccaggaggcagaggttgcggtgagctgagatcgtgccattgcactctagcctaggcaacaagagtgaaacaccgtctcaaaaaaaaaatttttttttctagcatcctgagttacttaatcaggaacctttacccattgaatgactaacagattatattaattcaaagtcccgattaatttaagcttcaatggaactatatctgattttattaatggcaagttttatcataatgttggctttaagggagtaaactgttaatgtagccattaaataataggttgtcattatttaaagataattcctacagtttatattaactgtacaaattcagaactatttcttggggtactgtttaaataatagaaattgactgttttaaaaatcagctcaatgacctttcaaagtagagcataaataaaataaaaggtacttttactctctggctttagaaatatgtccttacaaaaatgaatataggtatattcatatcagtaatatagtatttccttatcactttggtcaattgtcatgatttcagaataggacagcagtaatttttcatatcctttatttccagagtaactgtaatagagggataatttcttgaaattgaataaggaggttctctggtatttatgtccccgtgggtatgagatacattattttggtatgtttggtcatttctaaggtggcagggaagttaattctaaaatttactcagtgacttactgtgacttttgaggaattaccacatgaaatgtcctagagtgagtttgtaagccaggtttgggttaaaggcaggtttgagttggatgtgtttaattgacttggtgctacctgtctttaatatctcttgaagcaccagtgcctaggttgtttcactttacagactgtgcacatctccttatttcaattaacttaccctctttcatattggttaggtttttgttttctggtgtttgtttcctgttacagaaagtaattcagtttaggcttgccacagaatacaggctttctctgtcaccctcagtttattttctccatattttcaaactactgtggttcttttgtaatcaacctgtaattctcacaagatgtaacagtcatgcagtctagtaatgttatttttattttaatcaatttgataatatttttatctgacaggcttaccttcaacagactcaagaactggttatacttgaaaccataatgctacaaactctaggtacgtacttacatcagataatggctttttgtgtgtatttcactaaagcattctaaataagtgaaaagatttctgaaataattgtattattgaagaaagttattttaaaacaggttttagacagaataaggttgcctggttataaggaaattacttttctagaatttaatttcatttggcataattaaattgaatggtaaacgtacccttcagtatgatttcttaggttttcaggtagttgaagtactgtgcttcactctggatttgcactggagagtaaaatggtcctttagggttgttttatatgattatgatgtatacaaacctacacagcaatccttattctcctcgagctgccagtcagtattttatgagtatatcaccttttttattttatttatttatttatttatttatttttaagacggagtctcgctctgtcgcccaggctggagtgcagtggtgccatctcggctcactgcaacctctgcctcctgggttcaagcaattctcctgcctcagcctcccgagtagctgggactacaggtgcatactgccacacctggttatttttttgtaatttagtagagacggggtttcaccgtgttgcccaggctggacatgaactcctgagctcagggaatctgcccactttggcctcccaaagtgctgggattacaggtgtgcgtcaccacgcccggcctatcatatgatttttaatgtgacatagtaattatttaaatgttggtcatccttttctaaaggttatatctttgtatgcaagttcatttactgtcaccattcaccttactcaatttactgaaattgaggcctaagaaagtgatggcttatctaaagtcatatgttagttctggaagaacctactaggatgtggtaggaagaacatgggctttggggagatccaagttaaaatctgtaggcctctgacttgctttgtaaacttgggcaaaagttcctttacctgttgtacctccattctgtagaggtggaatagtatctgagtcatatcgtgaatttgtcatttttttaatttcattactccattcccagatgttgaatagaagtgcgataaatcagtcacaatttcccattgtgacagactcttcgttacaaaactagtttgtgtgaaatacatatgcagttgaccctcaaacagcacgggtttgaactccatgggtctacatggatttttttcaataaataatattggaaaattgggaatttgcaacaatttgaaaaaacttgtaggtgagctgtagcctagaaatattgaaaaaattggatatgtcatgaatgcataaactatatatagatattagtctattttatcatttactgccataaaatatacataaatctatttttaaaagataaaaattttaaaaagttaggcacacaaacagacaatatgtggctctattcgcagttaagagaaaatgtaaataaacaaatgtaaaggtacataaaattaattttaataatacgtaactgtactgctgtgataattttgtagccacctcctgttgctattgcagtgagctcacatgttatgagtatccacgtaaaatgctgtgtgacacctgtcatctctgaacagtttgtctctccagtaaattacatattgcggtaaaagaggttctggcatatttttaccgtatttagtgcgatactggaaacttggattaataccatgggacccatacaaagtgcctctagtgatgccagaagtgctcccaagaagcagatgaaagttgtgatgttacaaaaaaaagttgaattgtttgatatgtactgtagattgaggtctgtagctacagttgcccatttcaagataaatgaatccagtgtaaggttcagtgtgaaagaagaaaaagacatttgtgaagtcatcgctgcagctataccagcaggcacaaaaaccttgcactttatctcatattgaaaatgaagcttttatgtgaatgcaggattgctgtaagaaaggcatacctatggactctaatatgattggagagaagcttaaagcaaagggaaggtgaaggatctaaagccagagaatttaatgccagcgaaagacagaaattgtggtgtatttctgtaaagttacaccaggtgttgcctgcctctcctgcctcctcttttgtgtcttccaacctgagacagtaagaccaacccctcttcctcagcctactctgtatggagacctttatgatgatccacttccacttaatactagtaaatacattttctcttccttatgattttcttaatagtttctttagcttactgtgttgtaaaaatacagtatatgatacatatacaaaatatgtgttgattaactgtttatgttaccagtaaggcttcagcggtaagcaggttctgatcaacgatagttaagtcttaggggagtacttggattttcgactgcatggggatcggcacccctaggccctgcgttgttcagaggtcagctgtaaattatttgaagtttctataaaataaaaagataccaaaaaagtgagggtcttatttcttccaaatccaatgatttagcatgttattgttttactatacaaaattatataaatttcatttaagtaaaaaattgaaaatgaaaaatcataaatcattataaaatatttagttgttatataaaatcgtaatgtaatatccatattgtttatgacatattcttaagcacagagaatgaaaagtgttattttaaggggaacattagaatttagaagatatgcctctatggctttaaagtattctgcatatttaattacagtagaactatatatagaccacacaacaactttataaatctagattacccatttgttaggattttatttacttactgcttctgaagacaaccaaatgtgatcttcacttttaataaaaacagaaaccctgccacacctaagggttgattgcacgttgatagcttttaaacatttcatctttggtattagaaacagtagtttaagcagtcatgagacctctatggtttgtcatatgattttgattattaatgaagtatggttataaggtaactggttgaaaccctttgatctagagtgccgtatcatttaaaagctcgtttctaccactgtggcccaacagttatgtttatgaaaactgcacttttcatgtcttctgaaagaaagctttggaatattaagaaagatattacgtagttgaattccgtccttaaattgtgggaccagcttaacagttgtatttgccaggaatttaatttgtttttaagataatcccgaatcatttataattcagaattttgaataaatttacccttggtcttttaactttattttcataattgagacattgtatttgaaaaattatatcttgtcattggaaaagtaatgagaatgtcagtgatgagaaacttataactttggatttttcttaataatgaagaatatattatacgtttatggcatttctcaggcaagtactgtagtggtaagagattggaaaaaaaagtgcttatcatttcaggttttgagatcaccattgaacacccacacacagatgtggtgaaatgtacccagttagtaagaggtaggtgatccttgaaacttttaagataagtattaatgctttttattatctgtaattgatttgggtgctattttgtttttctagccttttgttaggtttcattaaaattagggagaaatgtcattttttaagcattactttttagtgttctacatctacttctatttgtgattctacctggtatgttagcttcctttaaacataggtaagaatctcatttcactaaaactccggagggcttccaagtattaggactctatccatcccccattgagctttgctagtcccatttcagtcaagtgtgggccaatagtgcataggttcagaaaataatattaattttgggtttgtgtcaaactttgactttttgaaaagtgataacagttgaagaattttgaggccaacctcagacctttcagataaaaattgcctttgttaaaagatttgtcagtacggtggctcccacctgtaatcccagcattttgggaggccaaggcaggctgatcgcttgagctcaggagttcgagaccagcctgggcaacatggtgaaaccccatctctacaaaaaacacaaaaattagctggttgtggtggtacacgcatgtagtctcaactattcaggaggccaaggtgggaggatggcttgagcccagtagttggaggttgcagtgagcccagatcatgcccctgcactctaccttgggcagcaagagtgagaccctatctcaaaaaaaaaagttatttttgtggggggagtgttttgcccatattcatttgggcaatctaaaattgatttaatgtatttttcgagggtctttgacattactaaaagtggtttcctttttgtaacggagaaataattatagagcataatacatttagtttgtgatgtgcctgttaagcgtcttgtttataaacaggagtactttttaaaaatattgctttactgcttgtaaagtatctggtagtatctgatacagcattttctactcctaaatgaatcctatatatctgttgtatccctagaaatattttttacacagttgcatgttgttctgcttcttacttccactttcctgtttccatttcaagtgttaatgtattcatagcaaccacttgggacttgtaatgtgccattttctgttacttcctttttgaaaatagaattttgcagtttcattcatttactaccaagtttttttagatttatcctaaacaaaatgagtacgacttttgaaaatcttttgtttttagtatttacctaagtattctcacattttattcattctaaattgaattcattttatacctagtgatttattatgttagtggctacaattttttaaaaactgtctgatagtgtcattaggaagtagacatctgaaaatctaatttgtatttttttgtagtagcacacgttatcatttgtaagctagaacatatttaactgtggttcctgttcttcatggttatatcagcgtgttttatagcacattttcatctgaatattacagtatagcatagaattatatgcataactagttgtagttgttgaattaaggaaaaagggttagttttttctaagaacttgaaaaaggttaagctaaactttgtaagcattgtagccatataatttgctttaaattaagagcctattgaagaaacattagttgaaggaagtactagtatatgtttaaaaatattacttgtgaatattaacttaggaaattggattttcaggttactgttgtgaaatttgagtcaactttaaattctttatcagagattaatattttttgtacaagttctcctacaactaaaaattctagagacatgaagtcagtttacttgaaaaatgaaatagtaacttttaaaacatttacaaaaactacaaatttgatatgtcatccaaaacaaatatttagaccagattatttgttgttgttaatgttaaaatgtgactgattctttgagtacaaaccatatatatgtttaatgtcattttgtctgactaacatttcaggtaactagaatatatctcactccattttaaaagtactgtttcatgttttagtgtctttttgttttctttgctcttttacaacttttagctaacagcatttcccctctattctctgttgcacagtgactgtttctggatcactgaatttagatacatgcctaggtgaaaactgctaatggcattttttaattattattttttccttctctacgtatttttattcggagggggaggggaaaataaatttgatttctgtgaagtctttttctcccctctggagatgagaaagttggtattatgctactttgctgcagaattggctaatgtcattttacagggaccttcacttctgtgatttctccttccctccccaccaggaaagtcacactgcctccaagacatctgatgctttgacactcttccttagcacaactctgctaaaccccaatcccttttgtaaaacctttatgttgatgatccacatggggcagcagggattacaggtgccatgaataaaaaataggggagggggaaagaaatttgaggacggttagaggggtggagttgagataaactgatcctaggtgagcagaggggaaagatatgtcagtgcttgtggatgtaattgggaaaaagggaaactataacaagagcatccctgttgggaagactaagaggcagaataaggggagggaaaacttttcagtgtcttaagctaattaaaaattgcctttctgttgggtatcagtgttgaagcattctgatcctccctagaatacctgtatctttcctaagttagtctttaattagattctgtaatttgaactaaaatacagtggagcctcctgtatctgtacccgtatgctgtttctaggtttattctctgttgatgcttaatagcatgatgaaaaactgagcagtttgtgctctgtgttttgtggggtgggggtttgttttgttttgtttttgatggaagtatttaagccaacttaaatatgactgaggattaagtctggcaggcaactctttgtattttgtattagacttcaaaatcttttcttcttcttcttcttttttttttaaatccaggagaatgctttattgcaacttttagctgactagatgcttaacttagtaacaagtttagcccttgtaactggctagctaaaagcaaatcggcttgtttctcagatctttgggggatagcaagaaacatttgagtgaatgttgttgaagattttcagtagtatagaaaatgatggcgctcttgtgatatttgtaagtagtaagtaaaatttactttttgtgtacaaatctttgaagtttttgttgtgttgagaactttttgattgtagcacgttaaggctgatagtattgtcttcgtttttttttttttcttacagcaagcaaggatttggcacagacatcctatttcatggctaccaacaggttgttatcctgaccctctttgttgcactgttgtagcacactatagcttcctttaatgcagggccccctcaatgtgtctcttacccttgttgcgacaggagactggaccatctactgtggtggtaccttcctgtttgctttgcggtgtattgtacaagggactttgggcacagaggggttaaatgcacaatgtgaagtgtagtggtgctttctgatgacatattctcgatttgtgagtgcataagtctaaaattggtagcctgaatagcagctaaagattacaaagagctaaacttaacgtagaaattcgagcaacttggtaagtataaagctatttccagtttacaattatagttaaatgacaatttttaaaatttcacgttgatccagtcttaactttaaaatactcattaaagtttttttaataaataaaatttatgtaatttgaaattttttttcagataatacccactagtagcaagttaaaagtagtcaagtcctatccatgcctggatttgcataaacacaatttttcctttttttttttttttaaacaaaaaaaccttccttttcagtttatatagagtaaaaaatggtatgtgtttatggctgaacagataacatttccatcattgaaactgaactggaagaatagtcttaaggagcctttaatatataattctgttctagatttattaatgatttaaatttgtctttttgagtggatcattggggagaagggaccaaaccagctttgtatggtccctaatttcttgtgacactgataagttttatttacaatttcacattggcaaatactgctatattttctcaaatatctgttgttggtatttaacctctatccccagtaattctgaacagcaacataaaaagacttaaatttggaactttgattagaaaaggctagctgtgacacatatttcatgccccatatttggcatatagtggaaggagaaaggtagtatttttgcagtatttaataacattgagccttgaagctgtttggcaaaaggtaagtttcctttgtggctttgctgaaaaacaaggcatagatttacatagatacgtgtttaattctctgcttcactaaagaaagcaaatgcctattaagccacttcagttgggataatccctgattattgtgagattgaaattactttgtcaattttacaaatagtttttatctttccatttacatatttaccatgacattacaaaagaaaaataccacaaaaaatttacagtgttatctatatagtgattattgcaaatatactatcctcctctccttttataaaatacttcaattttagatgtaaaaacaaaattttaaatattaatatattagtaatatactcgggagtgagtgaggggaaatgttcattttatgtagattttttagtactagaattttataacttagcttttaatttaataaaataaggttttatactctagacttaaagatagagtttaaattttgctctaatcttactggtaaatgtttttctttgttttacatacttgaatttttatggctctccattttcaaacctgctctgcaacagtctgcatcttacaaccttctgtcttcagtacaaaccaacagtgatagcatgtgtatgcattcatttggcttgcaaatggtccaattgggagatccctgtatcaactgatggaaagcattggtgggaatatgtggatcctacagttactctagaattattagatggtaagtagagaaaataaatttttaagtttggaattatctaagttggcagttgtctgaattgacaatagaaagtgtcagtacactatcagatgaacagaatgaaaacaacaattcatcagcctaaagaaaaaaaaatagagtctggaagctgtgctcatacctgtaatcccagcactgtaggaggctgaggcaggaggatcacttgagcccaggagttcaagaccaggctgggcaacatagaccctgtctctacaaaaaaaaagttaaaaattgactgggtgtggtggtgcgtgcctatagtctcagctacttgggaggctgaggcgggatgatcacttgagcacgggaagtcagggctgcggtaagccttgaaggcactgctctactccagcctgggtatatattaactaccaccaaatatctaaagctttttcaggacttaaaaaataaataagtaaggtttagaattccataagctgacaagataagaatagtgatttaaagtatactaattctgttgagttttaaatgtgtatactgaaagttgagtgttaactgtgaagcagtaaacgaaagggattttcaggggattgtgtttcttgctctgtattaccattgttgccttacattgttaaatatgaatacacaaggagaaattgtgggtgtgtgttctgttaattaggaacgtggaattttggggatgttttgatgagaaattcctctggttgagaagtaaaagaagccggccagaaatgggagattcttgggattagggcattttaaccacgtactgtagatttcagcaagaaaatagataacacttttttttttttttgagtcagtctcactctgtcgccaaggctggagtgcagtggtgcaatcttggctcaccgcaacctccacctcccgagttcaagcaattctcctgcctcagcctcccaagtcgctgggactgcaggcacgagccaccacacccaactagtttttgtgtttttagtagagatggggtttcaccatgttggccaggctggtctcaaactcctcacctcagatgatctgcccaccttgtcctcccaaagtgctgggattacaggcttgagccactgtgcctggccttgttttgtgttgttttgttttttgagacagatactcactctgccccccaagctggagcgcagtggtgcaacctgggctcactgcaacctctgcctcccaggttcaagcgattctcctgcctcagcctcctgaggagctgggaccataggcgcatgccaccacgcccagctaagttttgtatttttagtagagatggggttttgcagtccacctgtcttagcctcccaaagggctgggattacaggtttgagcctctgtgccccacctgatgtttctttaagataggggtctgcaaagagtaacactattttagagtttgtgaactataaggtctctgttgcaactatacaactataccattgcagccagaaagcagccataggcaatttgtaactgattgggtgtgactgtgttccagtaaaacttttgttgacaaaaataggtggccagccatatttggccaattatccatagtttgcctgttcttatttgtgaaatatgcttctttgtttcatccttttctattttgttttccacctggaaaaaattatcccagaatatatatctcatgctgtattattgctgcatgattataatgtttttcttaaattgttagaggctttttcagagtttatccagaggaaaggaagtcttcaatgagttgaaatgacatctaaaactcagtgagggcttatctgttctatagcttgaaaaatcaggttatctaggtcattgttttagtttaatagtcactagattaagattaggtaggcaaaatttttttttcggggggggggtgggggacagagtctcagtcgcccaggctatagagtgcggtggcgcaatctcggctcgctgcaccctccgcctcccgggttcaagcagttctctgcctcagcctcctgagtagctgggattacaggtgcctgccaccacgcctggctaatttttgtatttttagtagagatagggttttcaccatgttggccaggctggtcttgaactcctgacctcatgatccacccaccttggcctcaaagtgttaggattacaggcgtgaaccaccacacccagccagtaggcataatcgtaataaaaatagtttatatacctggtgctgaagtaaaaagatcacagaaaagtaatctgccttttatcctgtctttaggtcagaggttaggttgtggtttatgtggggttttttgacacaggaggagctacctcatttccattctgaaaagtaaagtttgttaatttggagagcaattgaataggaatcttggagaactgatatgttaagactttcaccatgttttgcagcagcttttttttctgtgtcagtcacaaaaaggcaattcaaaattaaagacatgaaggtgtggccgggtgcagtcactcacatatcttgagcacaggagtttgagcccagcctgagcaacatggcaaaaccacgtttctactaaaaatacacacaaaccgggcatggtggcgcactcctatagacccaactactgtggaggctaaggtgggaggatcacctgagcctgagacgtcaaggttgtagtgagctgtgataatgctactgctctccagcctgggcaacagaggaaaccctgtctggggggaaaaaaaaagacatgaagatttatctgaattgtagagtgaagtgatactactattcttattacttactgaaataattcacttaatgattgtgttccagaaaagaacattggcttagacagtagctttgagagagaagggcctctattttaggcacatactgtgatttttgtgcatatagctaattaattatgttaatggattatttaacagattcttttgttgttctgctataaaatttaatacagtaggatacttaagaaaaacaaagcttacattttgtgtacgagattttggaccagaacttgaagtgtatttaatgttttacaaccaagttgttaacagaaattgagtcaaaacagttttgttaatgttggacccaaaagtagaaaaatagtctttttttttttctttttttttcaaatgaggaagtaaaggtctgggcattagggtttttttcatccaaactggatgaaaaagctcatgagactttagcagggactagtcatgacattgtcaaggaaattacatcttgaaagattaatggttaaattatagcttgtctgaagtgtcgatcttaacattggcttagaatagtttacaaaaaagcttgctattacaaaatgaacctgtagtctctattaatagaggttcccccagtattgaggtggaattggcattattaatattatataatattctgatgtatttgactgatgaatatttgagagtggctagtaactattaatgacattattagttcatcaaaaccacactactttggaaaagtgggtcatttgattgtaatcagaattttaagaaagttggtagaaatttacaatgaagatagtttgctaatatattaatagtgttgatagctaggaagtatatttggaggaattttcccctttaaaaaaaaagtctgggtgtggtggctcacacctgtaattccagcactttgggaggccaagataggaggatcacttgaggccaggagtttgagaccagcctggtcaacatagcgagaccctgtctctgttatttaacaaaaaaaagaaagaaagaaatgcaaaatattgcatagttccctgtataccctttagcttctcctggtactaacatcttacataacaatatatgattatcaaaactaggaagttaacattggtacaatactgttaactaaaccacagatgttattcagtattccatatttttccctattctaggatcccatgttccatttagttgacatgtcccttcaagtcttctccagtctgtgacagttctccaatctttccttgtctttcataacactgacacttaggagaataatggtcattttatacagtgttccttagttggggtttgtctgatgatttctcattattatgtcgaagttatccattttgagcaagaataccatagaagtaaattgggtcttgcttggtgcatcatatcaaggggtacagtatgttgatacgtcttataactggtcatgacaaccgtgatcacttggttacagtggtatccttaaagtggtttctgcactttaaagtcactattttttttctctttgtaattaatacatttcatggggaagatacgttgggattatacaaataacgtttttcctcaaacttttgtccactaattttaaagaatcttttgatagatcttgtctgtgacaaaaattattgtggtgtttgcctaatgaagattttttttttattgggggggtgattatttttaatgctactagattttctagagattctaattaagcaagtaaaatcaagagggaaagtaatcgttacaaaaggattcagctttgaaaatgccggttgagagttgtgtgtacttctgtgtatgctgaggatttaataggagggtaaaagtgaagtagatgaactcctagcattcctttttaatactgcccacttaagagaaatttaaatcctaaaggcaccttctaagtttcaaatttaaattttatttttagagctaacacatgagtttctacaaatattggagaaaacgcctaataggttgaagaagattcgaaactggagggtaagagaattgacagggtttaacagaatttcagtcttttatgtaacatttacatagctaaccagtttgaatttttgtggttaaataatctttgcagtattcctgaataattcaacgtatctcaagttacatatactcacatattcaactactgagtccagtggactttgctaaagtacattatacttttaaaaaattttttgcagtgattatgacaaaagtatcctcttcattttacaaatggggaaactgaagcctagacaagttaaattactttctgaagtgctgggctaggatttaacttgtatctgattctaaaatgggtgttttcaattttttatagccttttatgcctctaaggcatttatttactgacaacataaaatcttgaaccccaggtcattttatttccatatgtttaatatataatgtttttaatatataacttttataagacaagaaatttgcattaaattattttgctatatcactgcttcttctgtgttttattttaataggctaatcaggcagctaggaaaccaaaagtagatggacaggtatcagagacaccacttcttggttcatctttggtccagaattccattttagtagatagtgtcactggtgtgcctacaaacccaagttttcagaaaccatctacatcagcattccctgcgccagtacctctaaattcaggaaatatttctgttcaagacagccatacatctgataatttgtcaatgctagcaacaggaatgccaagtacttcatacggtttatcatcacaccaggaatggcctcaacatcaagactcagcaaggacagaacagctatattcacagaaacaggagacatctttgtctggtagccagtacaacatcaacttccagcagggaccttctatatcactgcattcaggattacatcacagacctgacaaaatttcagatcattcttctgttaagcaagaatatactcataaagcagggagcagtaaacaccatgggccaatttccactactccaggaataattcctcagaaaatgtctttagataaatatagagaaaagcgtaaactagaaactcttgatctcgatgtaagggatcattatatagctgcccaggtagaacagcagcacaaacaagggcagtcacaggcagccagcagcagttctgttacttctcccattaaaatgaaaatacctatcgcaaatactgaaaaatacatggcagacaaaaaggaaaagagtgggtcactgaaattacggattccaataccacccactgataaaagcgccagtaaagaagaactgaaaatgaaaataaaagtttcttcttcagaaagacacagctcttctgatgaaggcagtgggaagagcaaacattcaagcccacatattagcagagaccataaggagaagcacaaggagcatccttcaagccgccaccacaccagcagccacaagcattcccactcgcatagtggcagcagcagcggtggcagtaaacacagtgccgacggaataccacccactgttctgaggagtcctgttggcctgagcagtgatggcatttcctctagctccagctcttcaaggaagaggctgcatgtcaatgatgcatctcacaaccaccactccaaaatgagcaaaagttccaaaagttcaggtagttcatctagttcttcctcctctgttaagcagtatatatcctctcacaactctgtttttaaccatcccttaccccctcctccccctgtcacataccaggtgggctacggacatctcagcaccctcgtgaaactggacaagaagccagtggagaccaacggtcctgatgccaatcacgagtacagtacaagcagccagcatatggactacaaagacacattcgacatgctggactcactgttaagtgcccaaggaatgaacatgtaataatttgtttaggtcaatttttcctttacttttttaatttaaaaattgttagaatggaaaaattccttctgatctagcagtggtaacccctgctgttgctgccactgcttcaatatttgtaagtgctgctttattcttcattctgaaaagaagagattatagtaaacaagtctttatctccacatatgatagtgttataaatactgtaaaagcatggaaggtgcaaaactcagtatttctacaattgcagctaagaacattaggatgaatggctggctgcttctaggaatataagatgcctcaagcattcattatttatgatttgaatactgtagctattttttgttgcttggcttttgaatgagtgtaaattgttttcttttgtgtatttatacttgtatgtatgatttgcatgtttcaatgataaagggataaaacagtatactgacaactgtttacaagaaagtggagaaaaatgtacatacatttttgtatgtttagatattaccgtaaatactcaggattggagctgcttgtaagtataacaatatacagaataactttattttatcttgtcagagtccatcactaatctaaaacaaaggtggcacttttttatgttaaccttaaactctaggccttactggaagccactgataggggacacttcactaccagatgtgtgcagtgcaacagatggtcatatacactgtgaggcactgaaattttgccttcagaggttctgaccagattggctgctgaaatagcccctaactttctgaaggcttgaagaggaaaaaataaagtttacatactcttgatgtgaagtgcatttaaatgtttgttggcttgttgcagttctatgaaacagagctgttaataatggttatgtggattactgtgatttgaaaactaaattcacaataacttacctagtagagatttagtgagttgtttcctttaaagaattttacactacatattttaatagtaaacagggatcacttttcctttagcattcagaatgacaccatattcttaaatatactccttccctgaagcgtgtttgtgtgtgatgccatatttctttttcaggtaaatgtagtcttccttataaaaatgaaattaaacctatgctctcaattcttttatattctaacaataaataaaaaagaaaagattactgactgtgcattgtacctgtatttatagtttatggttatcaggaagctctgtaagaaagaaaaggtcagcctcccaggcaaaccagtagtggaggttttacatttgtttgcacatctcagtatatttctgttgaggtaaagtttgcacagtcatctgacttctgatcaagcattagattttaacttgtttagattttgtcttaaacaccagtaatatggctcttgtttatcagctaatcttgaatttattctgtggtaaatcttttgagttgttgagtatatttgagattgattggattcgacctcttgttgaactgaaaacttaattttttctctgtatttttgttacaaagccactgatacgtgcacaattgtaattaagtatgttgcagttgtaaatattagagtttaatctcatgctctacctttatttagcaattacctaatttgccagtagctttataatttttaaagataattgttcattattttgtcaatgttatttgaacttggggtacttaggagcctctttgtagggactgtgcctaggtagcatgtcctaacatttgttctggtcttgcataacttcagtaatctttgtcattatatgtaactttgttgctctgtatggcataatattgtatccataaacatggtaattttgatacagttatacttttacagtggtacataatccaaggactagtatagaattaagctgagtgcaagatgagggagggaagggctttcttggtaatttagatgtgaaacctctacagagctatcatgtaaaaactacataaggtggttgtgctactgtataattgggggtgataataccaggaattttaataagattttgtaaagaatatccagaaaagtagtgaacttattttcagtagacatagaaaacaatgtgaatatttaaggtctgtgactatagttaaacttcactaagaatttgcagaattgttttgagatgtgtgaataaaggtaattttattgaatcttcattggtgctaatgatggacagttaaaaagatagctagtgtatattgttatgggtcagtacttattagtacttccaaaattgaatttgaaatgctatgtattcacttttcactctgtaaatgtaattctttacaatgactttatttattaaagggcagccagttgtcatttttacaggattgtgtgagctattcaaactcttcaacccctgaacagggtattaagcttccaaaataatgatggggataaatatggaaatcctttttaagttgtatttccattaaacaaaaacccttataattcatactatcatgaatttgctttatccatctcatttgcataacagttcatctgtctggtcccattaggctctaccaaagaaagactctgatgagtggacattattactgtgactcttgtaagtagccataaataaaccaaaatagtatcaaatttaggtatgaaattccacatgtgcaaagtactgttaaggtgataacatttttgatgagatttaaaaaaatatttgaaatattaaaaagcattatctttaaacatcctataaaagagtgagtcatttttaagttgtgttttccctagatcactgatttgttacctttacacagaagcacattgcaaagaaaggctttatttctacctcttccattcagttttccaatattgagctgtgtccctctgaatatttgccttagctatttcaaaataggtattttcagaaccaaagcaaagggtggtttgttcactgaaacattcttagaggcctacttaacgggcggcagtatccggtagtggtaaaacctcacagtttcctaattgcaggtatgtaaataccaaaaaagtcctgttgtcagccctaggtttatctttgaaagcagttaaatgtgcaccttggtcttcctccgtgtgttcagattccttctggttaaagttcttattcagagtcatctaaaagaaatttctaacatgatgtatggtttcttgaatgtcatgagtggctgcgtatattgctttgtagcaacagattgtattaataattaatagaatacctaatttttttggcctatcctctttgaactagaaatgactacttgagggctatttcagagaaccaatatgaaatgtttttgttagtacaaaataccattgccttaaaaggtttcaagcacattttcttttctatttgagaacttaaattgctgacttgtattcgttaagcaaccttagaaataaaccactgcttatatctgcatgaatattatgcatttcatgagtacagttagttgattagatatttcagggttttgcattttctatagacatggggacttttttaacatggtaacgtcttaggaaaaccattctctcaaggtattacaccatttccaattttatccaaatgaaaagcatatctgcttaaatttaggatgtctttgctgagaatatttggaggctcttgttaggaagaatcatggattcagtatttctaacctgattactgcctcagaggctgtcttgaagggagacagtaggattcactgactacctttacccagatgagggatcaacaaatctcacacttaaactaaatgagttgacaggacaataggtgctaatctcatgtgccctaagatggacttatttagatagggatttttgcattggaaaagcagcacattctctgaccttgggtaccaagctatgatactaatttgagaatcacattctgatacgttaatatcagaaatcagtgagcaacctaattgctgtaagctgacatacatggaagccgaaatcaaaaggttgcttttgttagtttccctggagcatctatttttgtaatacattttgccagtgggactgaaaagctcaaaatgttttagacctaatatcatacattaattttctgctctgcagtgtcaatttgggcacagccagtttttacctctgtggcaccttctttataatttactgttacctattctgcctgacagattgattaagtaggttgataagatccatcgaagattgaatggctaggagtaattctgttctcgtataggcaacttaacttcactgtggaatccatttatctcaaagtttgagggctgtctactttattttcaagtttggggcggaaactcaaaatcccgagc

SEQ ID NO: 13706 - DNA, 49603 bp, Human
  misc_feature (1)...(49603): n = A,T,C or G
atcttagaattgaaactactaggtgaaaagatctgcattctttaagattttaaagcatggtactaaattattttccagaaaagttgtaatcatttatacgaacagttataaaattactctctgaccccattctgtcagtttcaaatgctatattttattactaatttgacagctgaaaacagcttattttcatgtcttgttaatttgcgatgtcatttgattatagagacgttaaacatttttttcttcttctttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactaaaaatacaaaaattagcggggcatggtggtacacacctgtagtccgagctactcgggaggctgaggcaggagaatcgcttgaacctgggaggtggaggttgcagtgagctgaggtgcgccactgcacgccagcctggtgacagagcgagactctgtctcaaaaataaatgaaaaataaactaggacatcatagctgccttattcacaatagccaaaaggtggaagcaacccagatatccactgatggatgaatggataaacgagacgtggcatagacataaaatggaatattactccacatttattaaaaagggaagaaatcatcacatgctacaacatggatgaaccttgaggacattatgctatgtgaaataagccagacacaaaaagacaaacgctgtatgattccatgtataggaggaaactagagcagtcgaattcatggagagaggaaggagaatggcagaggccaggggctggggtaggggagaaatggagagctctttaatgggagtagaatttctgttcagaaaaatgaaaaagttctggagattggttgcacaacaatgtgaatatacttaataatactgaactgtgcacttaaaaatagttaagatggccgggcgcggtggctcacgcctgtaatcccaacactttgggaggccaaggcgggcagatcatgaggtcaggagatcgagaccatcctggctaacccggtgcaactccgtctctaccaaaaatgcaaaaaattagccgggcgtggtggcgggcccctgtagtcccagctactcgggaggctgaggcaggagaatggcgtgaacgcgggaggcggagctttcagtgagccgagatggcacgactgcactccagcctgggcgacggagcgagactccgtctcaaaaaaaaaaaaaaaaaaaaaaagaagtttaggaaggagttctctccttgccaactctccaactgctctgcatttcatagtcctgattttcacaaaacactctctaaaggaacattatttttttaagccaccttgtcttctaaaatctttcagctagagtaaagtcatttggatgatttcttcaggtccataggaaatgaatcccccagtggtttccacagtcagagcctcctgccctcgctcacctgctgttcgtgtctctggttggtttcaggcggaaaactctctgttgtcctgcgagctgaagatatcccggagctcctgctagaaccacccatatctgcgcttgcccaggtgacagcagcccaaaaatatacctgtaacatctgaggagagtttgattttaattttttaaaaacaagagaagttttggtctattggtttgacatttctgtaaatgcctcagaatgagtggtgtatgttctccaggttcataattaccttaaaaacaaaatcttgaagctgcagctcctgcttggtcaagtgtcagcttccctgcaggaagaagccacttgcctctgctggctctgatttttgagtccaaaatagcttataggataagagatgagattatggcaaaacaggtactagggtaaaggggtttttcaaaaatgtgcacctggccaaacacggtggctcacttctgtaatcccagcactttgggaggcggagatgggagggttgtttgagccaggagtttgagaccagcctgggcaacatggcaaaactccttctttgctaaaaatacaaaaattagcaaggcatggtgatgcatgcctgtagttccagctgctcgggaggatgaggtgggaggattgcttgagccctggaggtcaaaggctcagtgaactgtgatcatgtcactgcactccagcctgggtgacacagcaagaccctgtcttgaaaaaaaaaaattaaaaatgtacgtatatcctctatcacattttattttttatttttatttatttatttttttacagacagggtcttgtggccttgctctgtcacccaggccagagtgcagtggcatgatcacagctcactgcagcctctacttccaactcctggccttgagcaatcctcccacctcagcctcccaaagtgtcaggattacaggcatgagccaccacacccagccaactatcactttttaactataatttatattttttattttattttttttttgagatggagtttcattcttgttgcccaggctggagtgcagtggcacgatctcggctcactgcaacctctacaccctggattcaagtgattctcctgcctcagcctcccaagtagctgggattacaggtgtgcaccaccacgcccggctaattttgtatttttagtagagatgggctttcaccatgttggtcaggcttgtctcaaactcctgacctcaggtaatccacctgcctcggcctcccaaagtgctggaattacaggcttgagccaccgcgccagcctttaactataatttttaaaagaaaaattaaaataatctgggaagtgaacagctttgggcccccttgggcagctgggcagtctggaagccatgggaaccaccgccggtctccgtagttctgcagcatcgccctggtgctgtagagatgttgtgctgctcattggcgtctgtgcgttgatgggggccccaggagtcagggtctggtcttcagattttccatttcaaacatgatggaaccaagactgataaggttctggagggacaactcccaggctgattgcacggccagaatggcacctaaattagtttacagagggcgataactgctatcagttatgaacgcaggagaccaaagtgctgatcagaaaaatgcttgtcgagaaatagcctttgtactggtctatctgccccagtccatgctgtgcaatgcttctgggtcatctcccaaaagcacagttctgaccagttacctgctgggaagccacacttccgagtgggacgaatcccacaggaccctccagtgcatgaacgtgtgggcgtctctctctgtctctctctggcctcacctcctattttgtccatgtgagtgctatgcttgcttcctaccctcctgcatcccctactggacgtccttcctgtcttcctgccttcctcaaatctccttccagcaaaattttctccattgttaatgtacacgtaactgtgctctccagctgaggcctcgctcagtaacactccctcactcaccctgatgcactctgtccccacccggacccttagccattgctttagaccagtggttcccaagcttgagtgggcatcagaaccacctagagagctaggagagagcacggagaccaagacttaatgtggtgggacccacctgggcctgcacaggcatccgaagtccccaggtgagtctaatccccagcaaggcatgagaaccactggtgtgggcttcttacagcacttctaaatttctgtcttctcctcgtgtgattggtgcatttgctaaccctccctattaaaggtgtaaacctctgtggatattatttatctctaaatgtgaatccctacccaccatccccacacagtgtgactttcagaggtaggaactcagtgacgatgtgttgtgcagaactgacagacataaggaagagctgcgagagtgggcagggaatgctggagtgatacctgccagtgtggtctttagtgaacactgatgacaacttgactgagaaagaaacagggagccagtagtgaaccacttattaacccatttatgcctgaggctgcaattttttgaacttttgcaatcagaccttagcgaagaccttgagcagtaggatataagtaacttccacaggcttagcattcccataatggaacactaggcattcacagagcacttggttctgaccaggtgacagtaaccattagtccttgtcttgaagaagcagatgatcagtgggagggataagacaggtaatgatctaatcaggccaagggtagacaggtacggccagccaggctcgtggaggggagcgcagcactgggggtgttggcatggtcctgtgtagactctgtgaatctgaagttctttgagcacatgcaggccagagacagggcagaggggacatcctcatcagaagtgtggatgggggtgtcgacgaccaggaccatgagggttgtctctgctaaagaggaagtccccagtgcgtactccacaggccctagctcttggcctggctagggataactgggggtggacttcaaacggtggcctgaaatttaaaccaaaaccaaacacccggtaggattcacagggatgactgtggagccatgcgtggctgaaggctccaccacccccatcctggccaaatgtgagggtctatggaggaagcaccaggggcagcactggcctctaactgcctcccatttctggcatacacactccttcacgcattcatttagccatcaacactgcgtgctttctgtgtgctgagcacagaggcgcatggatgagcacataggtgatgcattcccaacaacatacaggcacaggcaccccccgccccctacacacacacacacacacacacacacacacactttctcattccatctccatcttttcctttggaaaatcctgctttggaatatttggtttagtgataaggggagaaacaaaaaagcgtacttctgagaggctgttagtcttgacagtgcttaggttctaatgaccctatttaactactattttcaggacacggtcgatttcctctctcttgatttgtcttatgaatgccaaaatgaggcaagtctgcggcagaagctgagtaaattgcaggtaatttgagcccttttccacattaatgatgaatgcagcgaaggtttcagagagcagattagacatttaatgctttggctactgcataaactgaacttccatcaacagcagagaccggctgagttgtgtctggggagatttccattgcaagcatccctagagaacatcggatgttaggcagtctttcctagaagggatacaaggtttagcttgttaaggtgaatatttacatagatcctctgcttgcttgtgtagaaatctgccgagaattgagattctggggttcattctgagttttaaaaaggcaactcatcaatgggggtgatggttccataacgataagcgtccacttaacaccactgaactatacatttaatggttatgatggtaatttttttttttgagatggagtcttcctcggttgcccaggctggggtgcagtggcgtgatcttggctcactgcagcctccacctcccgggttcaagcgattctcctgcctcagcctctccagtagctgagatgacaggaacacacaaacacgcctggctaatttttgtatttttggtagaggcaaggtttcaccatgttggtcacgttggtctcaaactcctgacctaaagtgatccgcccaccttggcctcccaaagtgttgggattacaggcgtgagccaccacacctggcctgtaaatttcttctttatgtctattttaccacatttttaaaaaaacaaacatttcacacccaggtctactaaatcagatcccagctgtctggaccttccagtaagctcagtactccctcctgtacccagtactgcttttctcaagtctaatgatgcgggctcattagagaaagtgtgttaggagcctcctatccaactaccaggtttctctcttaggcttggtcactgctgtgtgacttacttgcttcattccctggagtcccaactattctcctgtgacaaggtctatctgatggtgcccacgttttctcctgcaccttccgagtgctggcagtattcctataaccctggagagctgccttcctgtgggcctttccaaggatgtctggccactggtatgcacccacattggaccccctgcctcttcaggtttgggcacaaaaccactccccgctgctttcagcctgtgcctcccatgagggaggcagagcagccccctacactcacctgtggttttgaatcccaccatctccgtcaccaaggaggatggtttacctgaggaattatccctttaaaggccaagtttggctaggcacagtggctcatgcctgtaatcccagcactttgggaggccgaggtgggtggatcatgagatcaagagattaagaccatcctggccaacatggcaaaaacccatctctactaaaaatacaaaaattagatgggtgtggtggcacgcacctgtagtctcagctacttgggaggtggaggcaggagaatcacttgaacctgggaggcggaggttgcagcgagccaagatttcgccactgcactccagcctggtgacagagcgagactccatctcaaaaataaaaataaaaataaaaggccaagctcaggaatgtcaaactgagcttcagctacatggaccctccattttacctgaggcagagtgcttgaaatggacaaattagcaccagtcctatcccaatgtctgtgtgtttctagctgtctgtgtagtagacactgctgcttttgttatctacaaataataagatgatctaatttaggggtccccagcccccaggcggagcaccagtactggtccatggcctgttaggaacctggctgcacagcaggaggtgagtggcaggcgagcaagcattaccacctgagttccacctcctgtcagatcagcgaccatattagataggagcacaaaccctattgtgaactgcgcatgcgagggatccaggttgcgtgctccttatgagaatcaaatgcctgataatctgaggtggaacaatttcatccccaaatcatccccatcatcccccctacctcccccaagtctgtggaaaaattgtcttccacgaaaccggtccctggtgccaagaatgttggggaccactgatctaatcaaaggtgacagatgcagccacaaagacatctgagtaacagctattttagtgcttgcttatcccagacacctgggaggcacttcattctcacatcatctcaacctctcaaaacacaccctaaggtttaaacaatttaaccaaggtggtgagctccagggttgggatttgaactagggctttctcattctaagacaccacactgtcttttcaaaagaaaaataagtctcacatctgtaatcccagcactttgggaggttgaggcaggcggatcacttgaggccaggagttcaagaccagcctgcccaacatggcgaaaccccgtctctactaaaaatacaaaaattaaccaagtatagtggcacgaacctgtaatcccagctccttgggaggctgaggcacaacaatcgcttgaacccgggaggtggaggttgcagtgagccgagatggcgccactgcactccagcccaggggacagagagagacttgtctcaaaaaaaaataaagaaaaagaaaaagaagtccaagggtttggaacatgataatgagggtggtattttttaaatcacatatgatcagtttcagttgtttttgtgaatgcctcacctgaacctaaacttgcttgctgcccagggcctgtgcttgcgggctggctgacaaggtttctgggccttacgtaacactctagggtcttcgaggtctgcttgtgcctgtgatgactaaagctgccttttgtcctcctcatggaattaaaccagagcttgttgctaggctaatgggttcagacaaagctgccattttaaaaccatctctgttgtgcggaggtggcgtgcctctgacaggcagcagaggcactgcatggctggtacttgaggatgtgattttcagtctcttccctttttccatcacaacattttttttttaagatggagtctcgctctgtcacccaggctggagtgccccgtggcatgatctcggctcactgcaacctgcacctctggggttcaagcgattctcctgcctcagcctcccaagtagctgggactacaggtgcccgccaccatgcctagctttttttttttttttttgtatttgtagcagatacagtgtttcaccatgttggctaggctggtctcgaactcctggcctcaagtgatccaccacccccctcgacctcctaaagtgctgagattacaggcatgagccactgcacctggctaccacattttcaagacacttctaccagtgtctgggtaaagcactgaaacttcagtctgtagctggccagccaaatagtaaaactctccctggacaaacttagcagccatttataaatgttctgcaatggttatctattccttttacttccttgggtagggttggcccctcagaggcagcctcaaagattcggaaatgacagctgacaacccctgagctggagagcacactgttccttcctgggattgtggtctcatgcctggtagcatttcccatgcacagttaccacacccaggacagggagaacagctgagcctgccctgagaacaggggctgagttgtgtccacaggagcctgaatcgtgctgcccaccttcccagtgtcccctccctccctgtcctggaaccccaccctccccttgaaggggcctcttcctgtgggctgcgagggaagagggcgaaagcagggcagggaggagcaggcacctgcccccattcccaccctctccccggagcacctgcacagccctctctgagcctcaggggccctcagcggccactccccaacggcacacagctgtctgagggcctgagaacagcctcaagcccagaaatgaagagctgcggcacactccagggttctcggttctgtaggaggcacacgaggaggtcccccatccacttatcagaaaaagctgtgctcccagggagttctccgcttggcagaagacaggctgggggcctccgaggctcctctagctctccagccctgggacatcaccggctgcctcatggcatatccgtctttcaggaaggagaaaacccttgcttccctaagcacgccaccctgggtcatttgtccccactgcattgacccagcacagggagggatgaggactgtgtggagtcacagctccactaactgcgcagtcatgggcaacccgctcggcctctcgagcttctgactccccatctgtaaagaaagtcacaggtggctatgagaaagtaaagactatgcctggctccttttaaagtggttactattggtatcttttggtagcttttagttgctcagaggaggaaaaagttactgtgagtaaaatgaccaaactccaagccccgcaaaaaaggtaatttaaagtgaagtcaaacagcatgtcagccctgagacgttttccttgatactgaaatggctagaaataagaagaggaaattacatttgcttccattttaatgataacagctaatataacttttctttttctttttttttttttttttgagatggagcctggctcttgttgcccagactgaagtgcagcggttcactgcaacctctgcctcttgagttcgagcgattctcctgtctcagcctcccaagtagctgatattacaggcgtgcaccaccaagcccagctaatttttgtatttttgataaagacagggtttcaccatgttgatcaggctggtctcaaactcctgacctcaggtgatccgcccgcctcaacttcccaaagtgctgggattataggcgtgagccaccacacccgctgggctgctgtaactttttgttttggaaaatttctaacatccaaaagtaaaaagaatgatgaacccctacgaagccatctccagctgcaagagctattattggctcatagctaatcttctttcacctaacctataacttctatctcccaaactagatttttaattaaaaaaaattttttttagagacaggatcttgctctgtcacccaggctggagtgcagtggtgcaatcatagctcactgcagccttaaactcctgggctcaagcgatcctcctggctcagcctcccaagtagctggaactacaggcatgcaccaccacacccagctaaccaaactggattattttgaagcaaatcccagacatccatagatggtggcctcttaactaagcttcttaagtagcacaggctctggatgtgagcagtggccttgttcctgatcctaacaccgtgcctggctctaagaggtgccctgtaagcctgtgatgaaagaagaggtgaaggtgggggttggtggggagggtagactatgttattgaaaattgtagatctttctccttcagagtctagagttgactcctttaattaactgagatacttagaggtcatttccaaagccagagtaagtgccacagcttctcatcttgaaactctgtccctgttatcaagatgctttccaggaggcttcagttcacttgctggtccttctctttttcagaccattgagccaaaagtgaaagttttcatcttcaacctaaaactcccagactgcccctccaccatgaagaacccagccagtctgctcttcagcctttttgaaggtgagtgggccattgctgaagaggttttgagtgacatctggtgcactggtgtgctaggtagcagtcttgaaagtccggggttccaatgggaggaggagcatgggaggaagactagtataaaagcccaccccagactgggttagtgtactatgccttcctactgatggtcccttgcaaccatcccccattgacccaagaaagaggagaggttcgacacaaggatgcctcttatggacataaagatagttaggcctcagctgtgagttgtaagcatggaaaatcatctttgcctccttttattacctctccctccaaggtctctcatctctgctcctcttggcagggctttcctctgcccgtctctctccagccagccctctccacttacccttgttccatgtccccattatctcagtttgcacatggccctggtgggtacctgaccaagatgctaagaactttcaagtgtaggactcacagctcaagggccatcttcctagtgtctcttagttcaaattcttgaaagtgaatctgattgttggccatggatcaggaggctgcttctggtccaatcaagtcaggggaaaggtggggtctatgatagcattgaggctggcagtcactggagactctgcaagaagggaggaaggggcagagaggaatgtgcctgagggccctgatattcactcttgtctgtctgtcactcttgtccataggccagagtatgggagaagtcagtagtgttctttctaccactgtgtcttagtctgtcttgtgttgctataatagaatactctagactgcgtaatttatagagaaaaaaggtttatttagctcatggttctggggactgggaagttcaagatcaggcagccacatctggtcagcttctggtgagggcctcatgctgcatcctaacctggcagagaagtggaaggggaaggaagtgcctgcaaacagataaaacaccagaagcagcctcactttataacaaccactgtatggtaactaatccagtcccactagaatgggaactcactcactccctggagactgcactaatccctgaaggcggatccctcatgacccaaatgcctcttaaaagtccataacctctcaataatgttacactggcaattaaatttcaacatgagtttttgtagggacaaaccacatccaaaccgtagcacacctggaccccatcccagcaatgggttggctccacagggcccctgaagtttatccatagataccatttaataatgcttatctgaactcacctttgatggcataacaatttctgttcttagatcccacctctctctaagtggttaaaattgtaccttttctgtttatgcgtattttaccacaattttaaaaatattccacccctttctgatctttgagttcttctaaatcaattgttcccaaagttgtggtccccagaccagcagcatcaacattagcatcacctgggagctcattagaaatgcatattcttgagccctacttgagacctactgcatcagacactcttggggtgggaccagcaacctgtgttttaacaagctctacagatgattttgattcaccttgaagtttgagaaccacttttaagtaataagtaagtagaattcacttctaagcttttaaagtcgttagcccatggtattttccaaaggggcttggaaccactgcttggagtttgggtgtgtcgtatgagcgaggaaaactgttgatttcagacttgcatgttcttagttggcatttacatagagttaattcaatttcttctcttacagccataaataaagaccaagtgctcaccattgggtttgatattaatgagtttctgagttgttcatcaagttccaagaaaaggtaatgtcaggttgcctattgaactatcaataactgatatttgtagaatactctgtttcttttacatgtataatcttataggactgttgtcatcaactcttgggccaccaagttgtttattgccattcaattgatgagaaacaaagactcagaaagaaagtagggagtctcttactgagtgggactcacgaggttctgctttctcatctgtcagttcgcccaactgtgcgcaactagcatgatggctcacacctgtaatcccagcactctggtaggcaaaggtgggaagattgcttgagtccaggagttcaagactgggctgggcaacatggtgaaactctgtctctacaaaaaattacaaaaatacaaaaattagccaggcatagtggtgcatgcctatggtcccagctacttgggagactgaggtcagaggatcgcttgagcccaggaggcagaaggtgctgtgagccgagattgtgccactgcaccagctaggatttgaactcctgccttctagtttaagatcttgctggagacagtgtgagcttgtggaagagtggccaggttaaagatagatctgaccatcccactgaagttacatgatgagtaagagaaatgggttctctgtgcccatttcctcaatatgaagggtgaaacatcctccctggaaggagacagcatagacaggaaagccagctgttgctgcaagccagatgcctaacttgacaacattctagggacagaggtttgaatctatggtggggttgtaaataatatcttactgagtgactcaagtgccaaagtttgcaaatgatatgctttaaaaaattagagcagattgccgggcacggtggctcacgcctgtaatcccagaactttgggaggccgaggcgggtggatcacgaggtcaggagatcgagaccatcctggctaacacagtgaaaccccgtctctactaaaaatacaaaaaaattagccgggcatggtggcgggcgcctgtattcccagctactcgggaggctgaggcaggagaatggtgtgaaccctggaggcggagcttgcagtgagctgagatcgcgccattgcactccagcctgggtgatggagcgagactccatctccaaaaaaaaaaaaaattagagcaggttttgaggttgtgcccataattacattgctttcatgcacgcatatcccaatacgctcttgagtgaatgagaaaagaatggcatggtagccagcactgggaattgcccagaacctcagcgctcctggagggatgttacatgcatgaagttcatgcaccatcccttagggtgggacaaaagctggagacaataattgacttccagaccttcaactagagttctctttgtcactcacctctgatatttccagtgcagccctgttcagggtcattcagtgccaacacctctttgtacctttcctcttccagtacttgactgtcctgagccatatcctccttctattgttccatcctctcaatccacttcaaatcagcagttcagatcaacagacccgcagcagcagctgtacctcaggctttgtgtggcagtgtagacttgcaatagacagacatgggttaccactgcttcctgaccacacttggagtcagccaagaaggactggctgtggcttcacaaaagaaaactcaagaagccgtaataaaatgggttccctgaaaagccagtgattacaagtgacaccagctcggagattctctcagcacttggtggtgctttgcctgaaggggagggccaacacaggcttacattaaacggacagccaggggcccctactcaggaggatgtggttggagaacccgctgaatgcaggggcggtgggtggggagtgattcagaaatgactaacgtagttttctccttcagaattctagaccttataggggagacagagcggcccctgaacaactctcacatgagaatgtggcaggagacacacagcactgcaccctaaaaaagggagaacttaggagccctgggtgtggagcctgaggtgccgtcatgtgctaaatccctctccatggccggcaaacccagggttcccagctccaagcctgtacagcaagttctgtttcatcccagggcagtttatttgtttccttaaaactcttcatgcaatccaggaggacagtcagggccaggagggctgggtaagagcgaggttcggagcagcggacgctgtgtttatgggcaccgtggatacgcagaggctgagcaccgaggggacgcgacacatccccagctgcgatccacagtcgcatatgttttgggatcatctacgaaggaaaggatcatttccctttccccctaatctagcaaatgtcagggagttgatgctgagtgaaacagaaggctcttaggttcggaagacgcctcctgctgggtgacccggccccaggcttcgctttttgagaggaagatccctgtgcagtgttcctgtcacttctcccagttctgcgctgtgggccagcctggtataggtgccatcggctctccacacgatggctgtgtgacagggagatgctcttgtactccacgtccttttccccaggcatgtgccacactcctcaaggccgacctctgctggctgtaatttgcagcatgcatgctttcctgcctgcatgacatgactcaatttagaagttggcaatcacaattgaaaaaaaagaaagaaaaaagaggaaaggagagtgggagggaggaaaatggactagaataaaatagaaaaatcagaccacattttgtataaatgcagcatgcacttttatgtgatgttttatttcatatgcatatacatatgtacatgcatatacatgcacataaacatgtatgtgtatgaggttaaaagcacagaatctgctccaccacctgcaagctgtgtgcaaggagaagttactcataatcaccaggaatccaggctcctttgttgttgctttgtcacctttaacaaggtttctacctcatggttcagggtggatgcttgagctcctgccattatgtcagaaatccaagcagcatgaagaaaggaagcagtagccaggactgatattcaactggtccacatcagtgtacttctgtaccagctgataaatagctgctggctccctgaaatcaggaagttttccatttctttttctttttttagacggagtttcactcttgttgcccaggctggagtgcaatggcgtgatctcagctcaccacaacctctgcctcccgggttcaagtgattctcctgcttcagcctcctgagtagctgggattacaggcccccaccaccacgcctggctaattttgtatttttagtagagacggggtttccccatgttggtcagtctggtctcgaacttctgacctcgtgatccacctgcctcggcctcccagagtgctgggattacaggcatgagccaccacacccagcccccgtttcttttagtctcagtttcctcctgtgtaggatgaggataaatcattgtagtacccatctcataaatttgttgggaaaattaaatgagataatacacatccattcttattacagtggccagcgcagaatcaaggctcaataaattggagtcattgttattattagctatgttttacaaataatgaattataagaagaataaagtatggtactaacactgaagacaatattcaagggcaatctaatacagagaacagtagcattgttcctgttttaaccatgaaagagcaagaatcactcacctcagaaggggtaataataataattttcccatctgccagttacttcctgcccatggctttgcagatatgacttttgactcagtgtttctggaatcttttctgattaaacacagtagtcatccgtagggggcatttgtaactgccagcgtcattcattattatgtccctttttgtcccttcaatcctgcagcatgtcttgttctctgactggcagcctggcccttcagcctgaccagcagcaggaccacgagaccacggactcctctcctgcctctgcctatcagagagtctgggaagcatttgccaatcagtccagggcggaaagggatgccttcctgcaggatactttccctgaaggcttcctctggggtgcctccacaggagcctttaacgtggaaggaggctgggccgagggtgggagaggggtgagcatctgggatccacgcaggcccctgaacaccactgagggccaagcgacgctggaggtggccagcgacagttaccacaaggtagcctctgacgtcgccctgctttgcggcctccgggctcaggtgtacaagttctccatctcctggtcccggatcttccccatggggcacgggagcagccccagcctcccaggagttgcctactacaacaagctgattgacaggctacaggatgcgggcatcgagcccatggccacgctgttccactgggacctgcctcaggccctgcaggatcatggtggatggcagaatgagagcgtggtggatgccttcctggactatgcggccttctgcttctccacatttggggaccgtgtgaagctgtgggtgaccttccatgagccgtgggtgatgagctacgcaggctatggcaccggccagcaccctcccggcatctctgacccaggagtggcctcttttaaggtacttcccaaccctgcagctcctactaattggaggagaaaggacattggctggaagaaagtcattttctctgttttcttccatcagcaagcctttactttttgttctttctttaaaggaaatcggggagggaaggaaccataaattgttaattaaattgttaatcacctggccaggtgcagtggctcatgccagtaatctcttcactgtgggaggccaaggcaggcagatttcttgagtccaggagttcgagaccagactgggcaacatggcgaaatcttgtctctgcaaaaaaaatacaaaaattagctgggcatagtgttgcacgcctgtgatcccacctacccaggagactgaggtgggaggatcgcttgagcctggtatgcagaggctgcagtgagccaagattttgccactgcactccagcctggtcaacagagcaagaccctgtctcaaaaaaaaaaaaaattgttaatcaccttattttgtccagaccctctactggtacttttaaaatataatagttattacatactcagaatagcactgatggatgagtgaggctcagacaggataaacaatgtggtcatgatgacattgctagtgagtagccaggtggaagtcaggatttgagtccgagtcttcttgactccaaatcaagttcctcatgtcagtgacaagtgacagaaagctcaacccaaagtgacttaagcaaggagagaatttacacattcaggaggttgaaaattcttcatttagcctgatcagggtggaatttgatcagagcacaagcgatgccaccaggacccagttcctctcctgttcccctcgttggctttattcttgggctactttgcagccagatggcagcagccctgtttctgttatttcatgaccagtagggaaaaaagctcggctcttttctgtccttcccaacagaagtgtccctgtgtctcatggtctctcagtgggtcgcatacccaccctgaactcattgctgggtcctggccaggaggctgtgacaactgactggtgtgggccaaggacccatgctttactcctcaatacgctcactgagagctgaggaggcagagagggaagaggcaaggaggcattggctttccagacgccagtcagggcatcgtttcaacaagaaggggatgtatacacttggcacaaaattttaaatggctataggtcttttccattatttccctttttcttcggaatctcccagaaaacccaccagctttctttggcagcgttcttcaggatggacatgttagtctgccttttccctgtcactgtttgggttccattcttaaagatgagtatttccggccgggcatggtggctcacgcctgtaatcccagcactttgggaggccaaggcaggcagatcacctgggaggtcaggagttcaagaccagcctggccaacatggtgaaatcctgtctctactaaaatacaaaaattagccagatatgttggtgggcgcctgtaatcccatctacttgggaggctgaggcaagagaatcacttcatcctgggaggcggaggttgtagtgagccgagattatgccactgcactccagcctgggcagcctgggtgacaaagcgagactttcatctcaaaaataataataataataataatactatttcctgtgtcccgtgctaggtgttaaagaggggtcacagccatgccctggacatgttataaccttttggggaagatgacactaacacacgtagcaaaattacagaactcttcaaaaagaccattactagggtgagctggaacatcatgaataaataactcaatgaaatgtcaaacattgtagcacgtaagtcagagtttccattcagctcttgagcagcaagtgactgcacatatggagccattccaccacccaccttctgaaaatggaaggtttgaaatcttctgtttcactccttgttgtaaaacttatctaaaccttttcttcttaggcttttcttcccctttgaactgtggctcttgagatatctttacagagactttgatgagaaagtccccttcactcttctccttcaattcttccctttatttattagttcaatgttagaatgccattgtcttagtgagcttgagctgcaataacaaaacaccatagactggtggtttaaacaacagatatttatttcccagcattctggagctggggaagtccaagatcaagggaccagcatgtttgggttctggtgagggctctcttcctggcctgcaggcagccaccttcttgctgtcctcatataggggtggttggaagaactcactggtatcttttcttataaggacactaataccaccaccatgagagtcccaccctcacgacctcctctaaatctaatcacccctcaaaggccctatctccaaataccatcacattggggattagggcttcaacatatgaattttgatgggggaactaattcagttcatagcaactattaaggaaaaaatttaaagaaaaaaatgtcttgggccaggcgcggtggctcacacctgtaatctcagcactttgggaggccgaggcgggcggatcacgagatcaggggttcgagaccagcctggccaacatagtgaaaccctgtctctactaaaaatacaaaaattagccaggcatggtggcgggcacctgtagtcccagctactctggaggatgaggcaggaaaatcgcttgaacctaggaggtagaggttgtggtgagccgagattgcgccactgcactccagcctggtgacagagcgagactccatctcaaaaaaaaaaaaaaggtattttattattttagagtatttccttccagtcttggcttctttgcatttatgatgttgtcacagggcacctcagattgttgctcactgtttacttgatatcatgtcattagcacttttccctattattaagcagttgtgatgactgtttttgatggttgtctaatattccactgagctcccttcctgacactggctaatttagaagaaagacatccttgcttttgggaaaggagcacagtttgccattcgagtttagaactcaactaaagacgaatatttgggatgtgagaagcagccaggcgttttagtgattatggcatattttgacatgaaattcttcagaggtaagtgtcatcctcttcagatgataaaaaggaaaaaggaaagcaagctaagatttagcaagctcactcctgctctctgagtttctgctcaatgctttatatacacgtatttaatcatcccagatggatccataattacccacttcttgccaacaagtaagctgaagttgagagaataaattgtccaagttaacaagttagtaacagagtcaagatttaaatctaggcttgttatatttcagacaccctccttttgcccctacttcccacaaaaagctgttgctgtttgtaagagcatgagttaagtctacaaagaaactcctagtttggtttttcttccgagattccattaaatagaaagaagaacaaataagcaagaaagagccctcctctcccttgtgtgctaattaaaataatcctccccatggactaatttctcaaaaagcacttattaaggacagaggcagaatagcagtgtgggtaacagtaacaggcttggaatcagactgccaggggcttgttctcactttactcctgactcttggccttgtgaagttactacacagctctggatcttgttttcaccatctctatagtggtgataataattgtacctgccatatgaggttgtggtgaggattacatgagagaattcattaagtagtaggtgcccaatatatgttagttgttattgttaatgtggttgttgatgctgttattttgttgacaattttgaagaattgctgttgacttgttgactttgttgatgatattggtgttgacttgttgacattgttgacttgatattgttgaccttttcacattggtgttcacttgttgatgccgttcatgttggtattgatgttgttgacatcaacatcgttgatattattgacttgttgacattggtttggatttcttgacattgttgacttgttgacattgttagtatcagtcttaacttgttgtttatgttgttaacttgttaactttattattgacttgttaacatcattgatgttagtgtcaacattgttatttgttgatgacttgatgttaacattagtgctgatgttgtcaatattgacaatgtcaatgttgttgttgtctttattgacttgttgacattgttgttgacttgttattggttcattagtcctgttgttgtcattgttattattactaatcactgtatttccttcttactttttcacaaggtggctcacttggtcctcaaggctcatgccagaacttggcaccactacaacagccatcatcgcccacagcagcaggggcacgtgggcattgtgctgaactcagactgggcagaacccctgtctccagagaggcctgaggacctgagagcctctgagcgcttcttgcacttcatgctgggctggtttgcacaccccgtctttgtggatggagactacccagccaccctgaggacccagatccaacagatgaacagacagtgctcccatcctgtggctcaactccccgagttcacagaggcagagaagcagctcctgaaaggctctgctgattttctgggtctgtcgcattacacctcccgcctcatcagcaacgccccacaaaacacctgcatccctagctatgataccattggaggcttctcccaacacgtgaaccatgtgtggccccagacctcatcctcttggattcgtgtggtgccctgggggataaggaggctgttgcagtttgtatccctggaatacacaagaggaaaagttccaatataccttgccgggaatggcatgcccataggggaaagtgaaaatctctttgatgattccttaagagtagactacttcaatcaatatatcaatgaggtgctcaagggtaagaacaatggatgtgccagtgattggaaggtgggtggtacttctccaagtcttcaaagtttcgtttaataagacaaagaaagtctcctagagaaatggagccaaagaaagcataatagtggggagtccttcacgtcagctccctaactctctttcccaaggttcattcatgtcattcacgtctttgctcctgtggtttttttgttttattttgttttgtttttgagacagggtcttgctgtgttgcccgctggagagctggagtgcggtggcataaacatcgctcactgcagcctcaaagtcctaagctcaagccaacctcccacctcagcctcttgagtagctgggaccacagtgcaaaccactatgcgtggcttattttttttttttttagacatggggtctcttcacattgcccaggctggtctcaaactcctgggctcaaacagtcttctcacttcaatcctcccaaagtgttgggactacaggcatgagccaccatgcctgacccagtgtccttattgcctagaatacctccctctacattctgcccatctgagtcctatgcagtcatcaagcctcattatctttttttttttttttttttagaatcagggtcttgctttgtcacatagactggaatagagtggcatgttcatagctcacttcagcctcaaactcctaggctctagtgatcctccggactccaacccattaactcttccctcattgctccagccacactggtcttcatttcctttaattggctataaaatctacattctatgtcattgattttgatccaattgatccacatctacggtctcattcttacctgacatactatttcatatgtctttttattccaattggaaaggtatggcaaatagatttcatctcacaggtcagtcctcagttaacccaggatgttcttatcttgagctcattaacttaattacatctgcaaagatcctttttccaaataaggttatattcactggcaccacgggttagaatttagacatatctttcgggggtcaccattcaatgcactgtatcagggaatatatgttttaggctttatttatttatttattttaattttaatttttttagacagggtcttgctctgaggagtacactgacctgatctgagctcactgcagccttgacctcctgggctcaagcgattctcccacctcagcctcccaagtggctgggactacaggtgcacaccaccacaccaggctaattttcttttcttttttctttttttttttttgagacggagtctggctctgtcgccgaggctggagtgcagtggcgcgatctcagctcactgcaagctccgcctcctgggttcacaccattctcctgcctcagcctcctgagtagctgggactacaggctcccgtcaccacgcccggctaatttttttgtatttttagtagagacaggttttcaccatgttagccaggatgatctcaatctcctgacctcatgatccgcctgcctcagcctcccaaagtactgggattacaggcgtgagccaccacgcctggccacattttttttttttttcaatagagacagagtctggccatgttgcccaggctgctttatttcttttttaaaatatgaaatatgttgtcacttaatgtcaatattactaaacataaacaaggaaaagcaaaagcatattgttaaaagattgatttatgtattttatataaaaccaagacaccctggtggtaacacatgggacacatcccctccactatttatttgaagatggggatgctcctttggtttgagatttatggccacaaaagtggcctgatgttttgtgaggatcttgtggattttccttttatccattctgaggaggaaaaaggatgaacatttggggggtaacccaagtcacccccaaaactttcatgtcaaaaggaacactttttaaaagcaacattagtaacagagactatacttctaatttttcaataaaaactattttattgaaaaacagtcctcgctggtccgaggtaataacttatctcagttgactgttcacaaccagttacagatcaaacagcttctaatacccttctcccccttctcactactgcactgactagtctttaaaagataaataaataaaataatggtgcactagctcactcctgtagtcagtcccagctacttgggaggatcacttgagtccaggagtttgagaccagcctgggcaacacagtgagaccccatctcaattaaataaatccataaataaataaatctaatttttatttttcttcacagctatcaaggaagactctgtggatgttcgttcctacattgctcgttccctcattgatggcttcgaaggcccttctggttacagccagcggtttggcctgcaccacgtcaacttcagcgacagcagcaagtcaaggactcccaggaaatctgcctactttttcactagcatcatagaaaagaacggtttcctcaccaagggggcaaaaagactgctaccacctaatacagtaaacctcccctccaaagtcagagccttcacttttccatctgaggtgccctccaaggctaaagtcgtttgggaaaagttctccagccaacccaagttcgaaagagatttgttctaccacgggacgtttcgggatgactttctgtggggcgtgtcctcttccgcttatcagattgaaggcgcgtgggatgccgatggcaaaggccccagcatctgggataactttacccacacaccagggagcaatgtgaaagacaatgccactggagacatcgcctgtgacagctatcaccagctggatgccgatctgaatatgctccgagctttgaaggtgaaggcctaccgcttctctatctcctggtctcggattttcccaactgggagaaacagctctatcaacagtcatggggttgattattacaacaggctgatcaatggcttggtggcaagcaacatctttcccatggtgacattgttccattgggacctgccccaggccctccaggatatcggaggctgggagaatcctgccttgattgacttgtttgacagctacgcagacttttgtttccagacctttggtgatagagtcaagttttggatgacttttaatgagcccatgtacctggcatggctaggttatggctcaggggaatttcccccaggggtgaaggacccaggctgggcaccatataggatagcccacgccgtcatcaaagcccatgccagagtctatcacacgtacgatgagaaatacaggcaggagcagaagggggtcatctcgctgagcctcagtacacactgggcagagcccaagtcaccaggggtccccagagatgtggaagccgctgaccgaatgctgcagttctccctgggctggtttgctcaccccatttttagaaacggagactatcctgacaccatgaagtggaaagtggggaacaggagtgaactgcagcacttagccacctcccgcctgccaagcttcactgaggaagagaagaggttcatcagggcgacggccgacgtcttctgcctcaacacgtactactccagaatcgtgcagcacaaaacacccaggctaaacccaccctcctacgaagacgaccaggagatggctgaggaggaggacccttcgtggccttccacggcaatgaacagagctgcgccctgggggacgcgaaggctgctgaactggatcaaggaagagtatggtgacatccccatttacatcaccgaaaacggagtggggctgaccaatccgaacacggaggatactgataggatattttaccacaaaacctacatcaatgaggctttgaaaggtgtgtgagggttcagttccccttaaagaaatcttccaacattccctgggtcatatgcctgaaatgttttgccgggatgatttatgaaccatcaatagatctctctcttaggtcccaactccataattctttatctgtttgggggttatatgttccttgagaagctgggggaaaaaaggctatggttgtctctgcagaggaaaaatacaaacactacacacacagggtccctagcagaatattcatattgtcatgggtccattcattcattactgagcaagttctattttaggtgctgggaatacagcaatgaacaaaacacaaatttctgccttcgtagagcttatcccatgcaccccagaacaagaaagttgtgttaattcaaacttccttttttttttttgagatggagtcttgctctgttacccaggctggagtgcagtggccaccgtgcccggctaatttttttgtatttttggtagagatggggtttcaccatgttggccaggctggtttcaaactcctgacctcaagtgatccacctgcctttgcctcccaaagtgttaggattacaggcatgagccactgtgcccagcctaaaaatcaactttttgtttcattgattttttttttttgagacagtctcactctgttgcccaggctggagtgcaatggtgtgatctcggctcactgcaacctccatctcccgagttcaagcaattctattgcctcagcctccccagtagctaggactacagatgcattgggcttaacttcctaagtgggctgaagatcttgaatttggggcatgtttctttaccccaagagaagaatttgatttggagatgatcagtcattaatgcttgctgtggggtcataggtactggcagaaaagtaagatcaacagatgatctgttggtctctcagggtgtatgtcacttttaggaccacaaccttgaattgaggagctggcagtgggttggctgcatggaggtcctgactcctggtgtcaagctctcctctgctccctttgggatgttcccagcctacaggctcgatggtatagaccttcgagggtatgtcgcctggtctctgatggacaactttgagtggctaaatggctacacggtcaagtttggactgtaccatgttgatttcaacaacacgaacaggcctcgcacagcaagagcctccgccaggtactacacagaggtcattaccaacaacggcatgccactggccagggaggatgagtttctgtacggacggtttcctgagggcttcatctggagtgcagcttctgctgcatatcaggtgaggagttcaggatggtgggacaccagtgactgcacacctgccctgtgccaggctctgggctcagtgctgggaagggcagatgcatgaacaggagattccagcagacccatggaggggcagcatggggtctgggaggtcctcttccagacagcctggcttcttcacacccccaaatttacccagaccagcatggtgaggctcgctgtcctgagatgggtgcttgcagggccagatggagcagggggagcctgggcagaagtacttgggcaaagacacacaaatacagtcacgcattgctcacaacagggatttactctgagagatgtgatgttaggtgagttcatagttgtgtgaacatcacacagagtgcacttacacacacctagatagtgtagcttactacacacctaggctacatggtatagcctagtgctcctaggctacaaacctgtacagcctgttactgtactgaatgctgtaggcagttgtaacacagtggtatttgtgtatctaaatgtatctaaatgtagaaaggcacagtgaaaatatggcataaaagctggacagggtactcaccatgaatggagcctgctggactgggagttgctttgggtgagtcagtgggtgaggggtgagtgaatgggaaggcctaggcattactgtacactactgtggactttatgaacactgcacacttaagctacactaagtttattttttaaatgtttttctttcttcaataacacattaaccttagcttactgtaacatttttactttattaactttttaattctttaaacttttttactcttttgtgataatgcttagcttaaaacaagcacattggtccaggtgtggtggctcatgcctgcaatcccagtgctatgggaggatcgctcgagacgaggagttcaaaaccagcctgggcaagacatggcaaaaccctatctctataaaaaaatcaaaaaaattagccaagtgtggtggtgtgctcctgtagtcccagctactcgggaggctgaggcaggaggatcactcagcctccccattagctgggattacatgcatatgccaccacacccaatgaattttttatttttaatttttttgtagagatgggggtcttgctatgttgctagggctagtctgaactcctggcctcaagtgatcctcctccctcagcctcccaaagtgctggaattacaggtctgagccacagcacccggcctgcatgtgctatacttttatactgctggccatacggtagatttattgacatgagcactgccacaagcatgaataatgcagtgctctacaacgttatgatggctgcaaagcactaggcaataggaatgtttcagctccattataatcttatgggaccaccatcatatatcaggtccgtcattgaccaaaacactgttctacagcccatgactatgacgagtccctgttggacccctttattccccagctagatccttccaagcaggcagtttgctcacattggctctcagcatgggcctgagcttattctgatgtcctaaaaacatcacaccactactgtattcatgccaaaatgaggcttactcatacagaaaataggatggttttattttgtgcaagaaaaatggaaaaggcaagagtgacttgcctggcagttagtggtggttcctgctttccatcttctgtctgcgtctgtctctgtgcaagagtgggcctgccacatgcgtagagaaagccaggggagttccgagactgagcgggggccagagcaggctcccagaggaggtaaccacacttggctaatttttttgattttttttatagagatggggttttgccatgttgcccaggctggttttgaactcctgggctcgagcgatcctcccatagcgctggggttgccggcgtgagccaccacacatggaccaatgtgcttgttttaagctaagcgttatcacaaaagagtaaacgtcctgacttgagactcacccagtgaaagaaaggaggctgtgagtgcttgactgaatgacttaataagaccatgtcttgtcatcttgagattgaaggtgcgtggagagcagatggcaaaggactcagcatttgggacacgttttctcacacaccactgagggttgagaacgatgccattggagacgtggcctgtgacagttatcacaagattgctgaggatctggtcaccctgcagaacctgggcgtgtcccactaccgtttttccatctcctggtctcgcatcctccctgatggaaccaccaggtacatcaatgaagcgggcctgaactactacgtgaggctcatcgatacactgctggccgccagcatccagccccaggtatggtgggtcctggcaaggccttgggaaagtccacatgcaggaaccagcagggctgggggagcacatttatcatgtaaacaaaatgctggtttcaaatttagcttttgttgttattgttgtttttgagacgtagtctcgctctgtcacccaggctggagtgcagtggcggatctcgtttctcagcctccagagtagctgggcttataggcacgcatcaccatgcccagctaatttttgtatttttagtagagacggggtttcactgtgttggccaggctggtctcaaactcctggcctcaagtgatccacccgcctcggcctcccaaagtgctgagattataggtatgagccaccgtgctcgacctcaaatttaactttttaattgtcagtgaattcatatgatgcagaatttgaaaagcataaaagagtttccttcccaaccttgacctcagccatctagttctccctgaaagcaatttacccttttcccaaaagaaaaagaaaaaaatctttgagcctttttgtctcataagtcactctcaggatttgcagcagacgttgatgctggcacatctaacctagggcttcccatggaaagcatgactgatgcaacagctgatctggcttcttcccaggtgaccatttaccactgggacctaccacagacgctccaagatgtaggaggctgggagaatgagaccatcgtgcagcggtttaaggagtatgcagatgtgctcttccagaggctgggagacaaggtgaagttttggatcacgttgaatgagccctttgtcattgcttaccagggctatggctacggaacagcagctccaggtaagtcccagccctggctcataggctctttgaatcatggcattcttagcacatcaagagttgaaatccagatggcacaggacgaggcaaccaagaaagccccatggcagaaaccctgcctcttgctcagggctgtagaggtttccctcctggcattgcattgttaaacatgaatttcacatctcaattcctcaaggtgggttcatttctttgctctgtgactctgatcggcctcaggtgggaagctctctgagatcagagatgtgggcaaattgatgtggggaaggacagtttgtcaggctgtacaggtctacagtctatttccacaattcccaaaccccaaagtttctgacaattggtttggctgacctgagctcatttaatagtagtgaaacctgactcaaaccaacaggaggctgctcatggtctttatcgcactgagcaaacattcctaagttctgctgcagagatatcagtgtgcttgactatggagagctagctgtctgcggcccatggggctgataggtacttttctcaaaggaaacatttaattccaaaacacatctgaccctaaaagattttttttcttttaactttggttgacatgcaataattgtacatatgtatggagtacaaaatatattttgatacatgtatacaatgtgtgatgatgaaatcagaataattagtatattcatcacctcaaacattcatcatttctttgtgttgggaaaattcggagtcctcttttctagctttttgcaaatatacactaaattcttttgtatcattattttttattcattttttatttttttgagacagagtctagctctgttggccacgctggagtgcagtggtatgataccagctcactgcaacctccacctcctgggctcaagcaattctcctgcctcagcctcccaagtagctgggattacaggcatgtgtcaccatgcccagctaatttttgtatttttagtagaaatggggtttcatcatgttggccaggctggtctcgaactcgtgacctcaggtaatccgcccgcctcagcctcccaaagtgctgggattacagatgtgagccactgcacccagcctaaattattgttaactacattcactctacagtgccacacatcactagaacttcatcttcttatctagcttaactttgtatccattaaccaacctctccctgtcctccctccctactacccttcccatcctctaataatcacaattctattctctgctgctaggagctcatctttttagctcccacatgtgagtaagaacatgcagtatttgcctttctgtgcctgacttatttcactttacataatgacctccagttccagcgatgttgtcacgaatgacaagattcatccttctttatggctgtatagtattccatcatatatagatgccacattttctttatccattcatctgttgatggacacttaggttgattccatatcttggccattgtaacagtgatgcaataaacacagaggtcaaggtattgatttggtattctgacttactttcctttggataaatacccaaaagtaagattgcgggatcccttagggttttgaataagaaattgtggacctatttttgtgccttgagaaccatccagtttcccttttatctagttctgagttaataagaataaatttgtgttcattcatgtgattcctcagaacactgtgtaacagctggaaagagccaccaggagatgtgcctcaaatcgttatcagaggcatctccattggtcctagttcgcccctttggtttacactccttcaacacatgagaggcgcctctcttgcagcattcactatcagggtatctccgtgtcagctggttgcattagctacattctccaaccctaatgatcacaatgggtccccaaggagctccagattatcaactcctgtcaattcatttgagcccaggagttcaaggctgccgtgagccatgctcatggcaccactgcactccagcctggatgacagtgcatgaccctgtctcaaaaataatcataggccgagtatggtatctcacgcctgtaannnnnnnnnnnnnnnnnnnntgaagaaacgcacgaagcgagtaaagaaaggcagagagtaaagactgaataaaaggggaaggagaagaagaggagaggaaggggggaggaggatggtaggagattaagattgagagaggggggggggtgggggggggaataaaaaaaaaaagggccccgggggggggggagtaaggaggaggggtgtgagggaacgggaggggggtgtagggaaggatggagcaaaggaggcaggcatagtggcggggcggcggaaagaagaaaaactcattaggttgagtcaggagaattgtttgaacccctcggctcactgcagtctccacctcctggattcgagtgattctcctgcctcagcctcctgagtagctgggattacaggcgcctgccaccacagctggctaattttttgtatttttagtagagacaggtttcaccatattgggcaagttggtctcaaactcctgacctcaggtgatccacctgcctcagcctcccaaagtgctgggattatgggtgtgagccaccctgcctggcctgggttgtcttttaagttttaaaaaatcatttgtacatatagtcctttctgaatataacattggtttgaagctaactcaatagaaagaaattccatctctttagtctctctagtttgactatagtagctaacagagctgggctgcaatgtcacacttcacctttaggtgccaccatctgatttgatttgctccagcctaagcatttcttaaattgggggctttagattctgcgataggtatctctattatgggtattttgcctgagacgtacgagccactcttctggaggaggggaacagaagccaacatttatcaagtggccttccctcttccagacacagtgctgctgtgggcgggtttcatacactgtttcatttccctctcacaagcactctctgctgcccatttcaccaaggaggaaactgaaaggctgaattactcacccaaagttacacagccaggtaataagagggagagccagggtttgaattccagttttcctagtgtcagaatctacaccccttctcccaaacacagaggggacatctgcaggcagggactaacaatctcagtcacatccattctatccattctctgttgacatccatgtgtatgtttccaggagtctccaataggcctggcactgccccctacattgttggccacaatctaataaaggctcatgctgaggcctggcatctgtacaacgatgtgtaccgcgccagtcaaggtggcgtgatttccatcaccatcagcagtgactgggctgaacccagagatccctctaaccaggaggatgtggaggcagccaggagatatgttcaggtctgtttttcctctgggcacttgttcttactcttgtccatctttccttccagcctaatggaaacagattgtgaatcaaagatttagggtgtggtggctcatgtctataatcccagcactttggaagtctgaggcaggaggatttcttgaggctaggagtttgagactagcctgggcaacatagaaagaccttgtctgtgaagaaaaaaaaattattagggcatggtgacacacacctatagtcccagctgctcaggaggctaaggtgggagcttgagtccaggaggtcaaggttgcagtgagccatgatttcggcaccattaaactccaggtgacagagggagaccacccccaacccccaaaaagaagaattattaggatctaagcctagttttgctattgcctgattttgtgagcttgggaaaatcatctaactttttcgtaccttagtttcctcaacttcaaactggagatgtcctgcccacctcaaaagtttgctgtgatgaaagtgataaagtctgtggggttaagttgtctttaagtttttaaaaatcatttgtacaggtaattctttctgtaacattggtttgaagttaactcctagagagaaatttccatttcttcagtctctctggtttgactatagtagctaacagagctgggctgcagtgtcacacgtcacctttaggtgtcaccatctaatttgatttgctccagcctaggcatttcttaaattgggggctttagattctgtgaaactcattagtgcccctaatttgccaactcaatgagtttaagaacagcatctttcagtcatggaatttcacccaaggaagtagagacattactaggaagccaactgggcaaggtggctcacgcctgtaatcccagcactttgggaggctaaggcaggctgataacctgaggtcaggagttctagaccagcctggccaacatggtgagaccccatctctactaaaaatataaaaattaccgaggtgtggtggcacatgcctgtagttccaactactctggaggctaaggcaggagaacccagaagctgagatcaccattgcactacagcctgagcaatggagagagactccatctccaaaaaaaaaaaaaaaggaagcaggtgccagcatggcctacctttatttccacctgaacccctgactgacaagaggagagaaggaaaagaatgatcctcgttcacggcacagctcctctggctcctcctagaaagggatagaaggtgctctctcctacattttgcatcaggaaggaaaggcaagggtttctctctggattggttcccactttgggctccgtggaagagtctgccaactgtggcactataactctctcgggggaaacaccatgggccttggtttgccaaactcttcacaagagaacttgacaaagatagtcaaattaataaatgcaacgaagggcttaattttctggtctgctagccagctggggaaacagttttgaaacaaaattaatgtatccctcatttcagactcacagaactggtgatttagaacaacatttccttttttcctgaaatcaaaacttcaaacgtcaggaaacgttaggctgtcatatcattagattgagccacttactggtgaactgtgatactgcagccatggactatgacagatgcatctcttattagaatcagcttccacgaaaatatctagtgtgttaccttggagtgggtgcatttaagcctctttaccagggcatgtgtgttccatgcctcatctctgaccatgagtggaagctgccctcaccccacattcccagcagcagccagtgggtgaggagaggatttggagagactacagaaggctctcaaacccccagcatcatagtgtttgggtgccacgtatccccgcacatgataaggatggcctaggcctcattagagaaaataggtcaaacggttccccactctggggctgtgaaagcccattaagagttatgctttgcccggaaagtcaggaaagccttgcatttcagccctccccagaaagttctgtttgctccttgggcactttgatgaggaagtgcagccgctcagtggtgagaaagagaacccggagcctggaggcttgtgggttctcccttctcctctgcaggacccatccaagggcagccaggaagcatttgttgagcaccagggccagtgcccaggtcagttactgtcacctcaagctacaactatgaagaggtggccctgtcctcagtgcaacagcaactgagcaagcacagacccagctgggagacctgtggacactgaagctgcaacaggcaggagccacagggaagagagcttaacctgggggtccaggaaaaggagggaggttgtgaggccaggcacttctgagcggggacgatgctgtctcttgctgtgcccacctgtaacgcctgggctgtctcccccaccctacccgcagttcatgggaggctggtttgcacatcctattttcaagaatggagattacaatgaggtgatgaagacgcggatccgtgacaggagcttggctgcaggcctcaacaagtctcggtaagggcctggtgcccgcagtggtgagggcatgggcgtcggggtcacagaggcatgtctcgggcaagttaccatgactgagcttctttgcttgctgggaagttacatgtgatcatatatgtaaagcttagcccagcacctggcactgctatatgcttgacagaggggtttgctattatggttattatattgtggaacagccaggaaatctgttccaaggctatccacctctgagcaaccccactatgccactccacagacaaatcccagctcatcctatcctatttcatcaccgcacgtgtgaatgtgggtggcagtggctgacagtcaggcgtgtgctttgcatcacttggccagcaggtggcgatggtctgcaccaaagcgtccttccttacccgcccgccccttcttgtcaaggaaggagtagcaacattagcagccaacgtttacccatcttctgttggtatctttatttctatttaaatacgagtaaagtgaggcgcaaagattagggcaagatcacccagctattaagagatagagctgagatttgcagccaagctgtcggcccccagggcgcatgctgggggcttgagaatcatgcaggtggggtgagaggtgtggtgtgaggaagcgcaggaagcggcagtcactgcccacgggaacatgcccaccgctccaaggctggcgggaatcaagtgtgaattctcaacatagtctttgagtcctgcccctagacgcccccatatagtccagctgaggattaaaaatccagctcccaggccgggtgcggtggctgacgcctgtaatcccagcactttgggaggccaaggtgggcggatcacttgaagtcatgagttcaagaccaggctggccaacatggcgaaaccctgtctctactaaaaatacaaaaattagctgggtgcggtggcgggggcctgtaatcccagctacttgggaggctgaggccagagaattgcttgagctcgggaggcagaggttgcagtgagccgagatcatgccactgcactccagcctggacgatggagcaagactctttgtctcaaaaaaaaaaaaaaaaaaaaaatccagctcccacctcacaatgcacaccctggcctagttagggtaagttccccagagcaggctgtgcctaaaggtctgatctgcgaactgtgatctccagcaaaaccgatgagcgcccggcccatctgcacaactttgccgagcacctaccatttgcccgagccagggccagggggaggggtccatggaaggagaggattccattcggctcctcaagctgctgacagatcagctggaaagacagttctccatcccattccccaggctcttcagtacaaagaaaactcagaagatgagatcagggtaggctgggtagacccaggagatttcatggacaaggcaggacatcagctgagctgggccttgacaggggatagaatgtgggggattgcaggtcattctttccacggggcagagttgtgaagacaggcctagaggtaagaatgagtgggggtgccagagctgagagtggggagaccagcccagcagcagtgaaggggctgaggccacatggtggagggcctggaagccaagcacagggccttggctttggtgccacaggccattgctggcttctgagcagaagcgtcagggacaggaggaggctgtgctttggttttctcccatcatctcagaaaccccagggaaggaaggttcttgatccctcaggttaatggtagcagaaaggtcaagatgaaagtgtcagaggcctcagcagggcatctctgggccacacctaaaccagaagccccaggtctccctgtgggcatgcgcatgcattcaggatcacctgtacatgctgcacacaagtgtattagtcaggttctacaggagaggcttttcactcagagtgcctggaaaatgctccatctataggttaagaagccaaagttcccaggctcacaagtaatctcagcactttgggaggctgaggcaggaggattgcttgagaccaggagttcaagaccagcctgggcaatataatgagactttgtctttacaaaaaatttaaaaattatctaggcatggtgacgcacacctatattcccaactacttgggaggctgaggtgagaggattgcttgagcccaggagactgaggttgcagtgagctatgattgcaccactgcactccagcctcagggggcgtgcagtgtcctcaggaggacagggcgagaccctgtctgggaaaaaaaaaaggaagaaagaaaacaaagttcagtgaaatcgtgagaactgagaaattcaaactcaaatactcaatttgcaaattatttcccctgctactttgaagatcttgaagctattattattattattattataattataattattagagttggagaaaagaggcatgcctaaacaaaccccaagaggagcagagaaacttggaaagggcagaaaacggaaatacaaattacacaagatacagggccgggtgtggtggctcatgcctgtaatcccaacactttaggaggctgaggtggggggatcacttgaggtcaggagttcaagaccagcctggccaacatggtgaaaccccatctctaccaaaaatataaaaaatcagccaggagttgtggcaggcgcttgtagtcccagctacttgggaggctgaggcaggagaatcacttgaacccaggaggcggaggttgcagtgagctgagatcgcgccactgcactccagcctaggtgacagagccagactcagccacaaaaaaaaaaattatacaagatctaactttacaaacataggggaagagtctcagatatgtacctcaggcatgctcttgattttgaaatctgtcatagatgctaaatatcagaatttgcatatgttgtttgaaggaaattaaaaactgtttatgcatgtgtgtgtgtgtgtgtgtgtgtgcgcgcgcgcgcgcgtgggtgcgtgtgtgtgtggtccttcaggtttcagaggctcttgtagagacctagggaagccaggtttatggtctggcgggaggagccgcaggtgcttcctgcaccgcctgaaggacctcttctccttccctgccagtttcccctactcactgccaagtgcctggggttcggagagctcccccgccccagccctatgacgttctcttctcaaagcatggctctccctgaagccctgccctcaatggcttcttccacccaggctgccagaatttacagagagtgagaagaggaggatcaacggcacctatgacttttttgggttcaatcactacaccactgtcctcgcctacaacctcaactatgccactgccatctcttcttttgatgcagacaggtaagtccaccaacagggagcccggagccatctctggaaaaggcagaaaggtgcccttggctgtgctctctgaggcctgcccagcctcaaaacagggcctccaacgccgaatgtgccggggtttgcaagatgctcgccaccccacagatcccaaggaaatctccagcaagcaagagggagagaaggccggggtctccagggcacctcccattagggcacatgtgcttggctttttgtttttttatttcatttttaaaatttatttattttgcgttctttttcacaggctgcttaactctaaaaatgcttggttgttaaaaaggattttcaagaaaaaaattgtttaggttttatcaaaattcgctttaatattaataaatattacaataatacaagagtaaaattttattttctctttttaaacaatgcttttatgaagtagagatagtaaaagattttggttcaccttttaagtaacagtttttatttttattttatttattttttttgagacagagtctcactctgtcaccaggctggagtgcagtggcacaatcttggctcactgcaacctccaccacccgggttccagtgattcccctgcctcagcctccaagtagctgggattacaggcgcgtacctccacgcctggctaattttttttttttttttttgtattttagcagagacggggtttcatcatgttggccagaatggtctcggctaattttgtgtttttagtagagacagggtttctccatgttggtcaggctggtctctatctcctgacctcagatgatccccttgccttggcctcccaaagtgctgggattacaggtgtgagccactgcgcccagccgattgtctttttctttatgatatctatttatctagagactttttcatccatatcctgtattgttttttaaatttctctaagttaattttcacctttctctagtacctccttgagtagtttaataatcaaccttctgaattctttatctggcaattcagagatttcttcttggtttggatccatagctggagagttagtgcgaccttttgggggtcttatagaaccttgttttgtcatattaccagaattaacatttctggttccttctcattcaggtagactgtttcagtggaaagatctagaactcaagggctgcccctcagatccttttgtcccacagggtgatcccttgatgtggtgctcaccccctttccctaaggatggggcttcctgagagccagactgcagtgattgccattgcccttctgggtctatccacccagcagaattactgggatctgaactggtgctgaggaatgtctgcaaagagtcctgtgatgtgatctgtcttcaggtctcccagccatggataccagcacctgctccagtggaggtggcaggggacttaagtggattctgtgagggtccttggttgtagttttctttcgtgcactggttttctcaaacgctggttatgcgagcagtgaagttgtcatgtggacagactcaggacctctggttagccaggatgttgcaggcagtggaattagttgttgttttctctttctttggagcagggttcttctgttatgagttgctataatggcgtgagttggttggtctccagccaggaggtggcactttcaagagaggaggtggcacttttgaggtgctttccccttccactgccaccagctgcggtagtagaagggggattacaaggttgccctacgttggccagggtatttgggtttctcaggttatgggcggggccatagagctcccaagagtttatgtcttttgtcttcagctaccagcaaaggtagagaaagaccatcaggttggggcagcattaggcatatctgagctcagactctcctcgggtgaggcttgctgtggccactgtgggggaatagggggctggttctcaggccagtggagttctgttcccaggggtattatggcttcctctgctgtgtcatacaggttgctagggaagttgggaaagctggcagtcacaagcctcacctagctcccatgcagccagcaaggccagtctcactcctgctgtgccctgccaacagtgcgcagggcagagatctcaccccaggccacaagccttctctctgagaaagcaaacagggctttcaggccttgcccctccccacctgcccacactgttggctgtggcttctgtgcttttatctgcacttcttgtttgcccccaagattctgctcaggaaaattcatgcttctagttgaaattaataagttgagctagaagcttccttaatcctgcccctccctaattccactggcttccttctacaaggacccctgtaggataaagtcaggaatggcttccctgggctcaagctggggacagggagtggctacagggctcttcccactgcttcttctacttttacatttcacttggctccctaaatccacttgcgctctaggtaaggttaaatccttctcctatgatctggatgttcaggtccccagagaggatgtgtgttcagaggcagactttccccttctcacactttgggaactcacagttttgcagctgtctcatggagtttgcagtagcattctgcttctttcaaaggtctgtgaattcttttggtttttctggtatgttccagcagtagttcttggagcaacagttaacaatgtgagtctccacacactgttctgtccatccaagtgggagctgtacctaagtcctgtctcttatctgccattttcagaaaatctcattttgttccttttccatcaagcatctttccacaccagtagctctgactgtgtccaggttctttctttgaaaaccagcccctccactcccactgtatcctgaaacccccagagtcaggctcaccaagggggctgaggagactccagaacacccctctactccttctgattctccctccctcttatgagccctggggctgtccctgggaagacctccactagtgcttatgaaatggcccacattcaattcagctgagtcagataaatccaggtgctgataaaaccaacattttttttttccctgaaagatctgagtgtaggaagtgtctaaattcttggttcttatttgacatatgtgactacaggtgatcaggcttctgtggcctcccccagcaggcacccctgtggcaggagctgtccacctcctcgtccatcactgaagagagaggccaggctcttggacacttgaaggaggtgccagcctgtctgctgcctgtcttcacacaaagcagggcccctacaaatattcgtgcctgtggcctcacccgtggtctgcaagtggcattgactagacatgggtgacttgggggagcccattctctgaagacacagcactggcgtccattggaagcctggagctggggacccatagcctttcatagctggtgtaaggagccatctattcagagtagtggagggctgggctccatgagcaagaccattctctgcacaggcagagaaattgaaggacggagagctgagtggcttgtccaatgctatacaagcacagagtgcaggcagctagaaccagcgaaaggaggagaatttgaggcaatttgattcttctgggtttagtatgattcttaaggctagacaaaacctaaggcttttcctggtctaagtcctgttttgtgtttcgtgtaaagggcctcttgagatttacaaaacaagacctcatctttagtttttgaacttgtagaggagttgcttccatcgcagatcgctcgtggccagactctggctccttctggctgaagatgacgccttttggcttcaggaggatcctgaactggttaaaggaggaatacaatgaccctccaatttatgtcacagagaatggagtgtcccagcgggaagaaacagacctcaatgacactgcaaggatctactaccttcggacttacatcaatgaggccctcaaaggtacgacgggcccgcccttccccagcgtgcacctttccctgttggaaacatctgctatctgcaggagtgtgatacagcgtccttgggccacagtaagaagagaacgataaggcttcttgctcctgtgggggttaagctttgctttagggccgcactctgagtttttttccttcctatgtctaagctcagcaagcaagcccagtggcctgatgccaccaaaccctagttcctggcctgagtcacttgctccccttgatcctccctgatgtcggaacagcagtgccctcctgagaatggtctgggtagggcccaggaggagtaggctgtgtggttgcctgtagggtctcttagtctccgagcaaaagtttgaggctcttggctcagccctaacaacttgagatgggaccatgaggataagagaatggaacaaatgctgagtaaaagagcaagcaatgcaccagcaaaggaaatgattagaaaaatcctacccagctgaaatatattctatctaagggctattttctacagggagaagcattaacattctaaggcactgaccaagatcatggatagaagtgtaggtgacccagggaaattagtccacccatgttcccgactcccattcagggctgagcctttctaaagatgctggtggctctacatctccatccacagaggacccgctaacagtcactgcatgcaaagaaaggggcagctttctcacagagctaaagccaaagcttaccgccatctgtgaaggcggtggggagagcagtaggcagacctggcttccgaaggcctggcaggaagctgccttatgagataggaaacttatgcctagtcctctgtgtttgagcagctgtgcaggacaaggtggaccttcgaggatacacagtttggagtgcgatggacaattttgagtgggccacaggcttttcagagagatttggtctgcattttgtgaactacagtgacccttctctgccaaggatccccaaagcatcagcgaagttctacgcctctgtggtccgatgcaatggcttccctgaccccgctacagggcctcacgcttgtctccaccagccaggtgagatgtggctctgggagggaataaagcctaagggtgaagggcaggtggaagggcctctctcagtctgttttcttctagtttattaccctcctctctgctgccccatctccttcattcattcaacaaatgtttattttctttgaatgctccagacatttcctggggtggaacaaaggacacttagggtcaatgttacacctagaaaccagagccctgacctgggaataagcaggtctagactcttcttccagccctaccactaacttgctgtgcactcatagataagaaaccaggcacatgcttcagggcagttataaggatcaaataaagggaccatgaaagtacaatgcctgcaccatgtgggtgccccgtatttgttaaatgtaagagtataaatcactacacaaatgtaaatgacaattatccagtttcaattatacaggctgagaatccttcatctgaaaattcaaaatccaaaatactccaaaatctgaaactttttgagcatgactggcatgacaacacaaatggaaaattcaacacctgaccccatgtgacaggtcgcagtcaaaacacagttaaagctttgtttcatgcacacaattatttaacatattgtatagaattaccttcacaccacgtggataagttgcatataaaacatatatgaatttcatatttagacctgggtcccatccccaaaatatctcattatgtatatgcaaatattccaaaatcttaaaaaatcccaaatctgaaacacttctgatcccaagcaagcatgtcagataagggatattcaaccgtattctaattgctgatagagatgtttaaaaaatacaactgcttaacttcactcagaggctcctgacacacagtgaaaggggatgggtacctccacctcggcatcccgtcaatggctgtgcggatttggggtaccgtgcagcctctgctggggtctcagagatctgagaactcaaatcagcgccagagcaccaaccaccctgtgtcacactctcctagatgccggacccaccatcagccccgtgagacaggaggaggtgcagttcctggggctaatgctcggcaccacagaagcacagacagctttgtacgttctcttttctcttgtgcttcttggagtctgtggcttggcatttctgtcatacaagtactgcaagcgctctaagcaagggaaaacacaacgaagccaacaggaattgagcccggtgtcttcattctgatgagttaccacctcaagttctatgaagcaggcctagtttcttcatctatctttaccggccaccaaacaccttagggtcttagactctgctgatactggacttctccataaagtcctgctgcaccgttagagatgactttaatcttgaatgatttcgacttgctgagtaaaatggaaatatctccatcttgctccagtatcagagttcatttgggcatttgagaagcaagtagctcttgcggaaacgtgtagatactggtctagtgggtctgtgaaccacttaattgaacttaacagggctgttttaagtttcagagttgttaagggttgttaagggagcaaaaaccgtaaaaatccttcctataagaagaaatcaactccattgcatagactgcaatatcatctcctgcccttctgcaagctctccctagcttcacatcttgtgttttccagaaaataaaaacagcagactgtcctttctcctatggttgcccctccttgagaaagtaggttcaagagaagttatgaagtcacacaagccatctggagctccgattaagctttctcaccagaccaagtctttctgttgacattatattccttggggcaaataccacaacatgcagaaagtggccttttcccacccctcgaacacccccactgccactttttatgccatccccagctctcccatctgaccttggttcatttagtctgtttccttcctcctttcccaatttgtggtagttctaaacggcacataggacaactatccatattcctttgtgtcttcccaaatgctactccttccacctaggatgccctttcttctgaaaatgcctttaagtctcagctgaaataatgtacttcctcctctgaatggcttccctgaaatccccaggcagattctccttcgtctgctttgcttgtaaatatcccctattacaacttgaccatccagtttctatactggaattgcgtatttctctatcatcagcttcttaaggccaaggaccatgtctcattgtctctggcaagcacaacttggagagagcaatgaaaagcacaaatgctcctttcgtgtgttcacccattcacatagcatttccagggcagtggtgggagcagagatatgttctttacaatcccctcaaatgtgctgagagacaatctcagtgtgaaacacctaaacacttgattggcccatatattacatctagatagctgggaaaatgttttgtaaaaacagagtaattttgggctggtcttaaaaggatgatcacacttgaaatttgcttcttgtaagcattcctttccctatcaaaacattccaacgccatgagtcccaacctggcagtcaggagcttgtggtgcacaagcatttttctccatcaatcgactggaaaagtttgtcagatgggggtgggggtggttctaaaattgatattaaagacatttgttggccgggcacggtggcgcacacctgtaatcccagcactttgggaggctgaggtgggcagatcacgaggtcaggagatcgagaccatcctggctaacatggtgaaaccccatctctactaaaaatacaaaaaattagccaggcgtggtggcgggtgcctgtagtcccagctactcaggaggctgaggcaggagaatggtgtgaacctgggaggcggagcttgcagtgagctgagatcacaccactgcactccagcctgggcgactgagtgagactgtctcaaaaaaaaaaaaaaaaaagacattctttggggagaaactcagtatcataaggtgccaattatacctaaataatctcaaaactcaacatcacttttttgggacaacactaacaaaataatataaagaagtttcatatatgaaataaacttgtaagaagagccaggataaatctgggggaagaagattaaaacacattataaagctagcttagtttggtatagcagagagcaaacagatcaataaaggaagagaaagcctagacacagaagcatctgcacatggaacagatgcccacctcgcaggcagtgcgcctactcggggcagagggcccatgaaggcagtgagggaacaggctcctggggatgttagccacgggcatgggaaggagccaggtcctttccttggataccagatttaaacatacaaaaaggaaaccataagaatcctaggatataaaaaaattaatttttgaagtgggaaaggtatttataagcaagactcaagacctggaggtcataaaggaaaacacagataatactgtggaaaaaattaccaaatatactcaacaaaagggagggagaagccaggcgcggtggctcacgcctgtaatcccaacactttgggaggccgaggcaggcggatcacgaggtcaggagatcaagaccatcctggctaacacggtgaaaccctgtctctgctaaacaaaatacaaaaattagccagctgtggtggtgggcacct

SEQ ID NO: 13707 - DNA, 12298 bp, Human
cctccccctggagaggaaatgaaatagaaaatgaaattgtgccagtaaaccgcttagccgggtgcctgggacatggcaaaccagtcctgaaataaataactgttttattaatagcaatcttagctaattaaaatagatagcgtttattgagcgttgggtatcaggcacggtcctaattcttttagatgtctttagttcgtttcactctcccccaaacaatagggtggtattgatcacctccgagcaggtgaaattgaggcacagagaaatcctagtagctggtagaagaacacgcagtgtggtcaagctagcaaggtgtttggtccactgctatatctacaaaacccctaacaatgcctggtgtatagatgctcagtatgcatttgtgggatcagtgattccgatgcctgcttcttataaagtttttatttagaaataattacaggtaaggagttgcaaaaacagtatagtggtcgcgagtgtcctttttccctcggcttctcccaggggtatcgtcttacgtaacaatgtccaaacagggaaattgacttgggtataatccacagactctattcaccttgtaaattggttttaatagaagtactggacaacttgtaagctaatatcgttgctatggttctcgttctcagctaaaacggcgctctttactttgtgcacctgaacactgcacaccgagggcgaccaccgcccccgagatgcccagcttctattctagagcgccgcgccggcgccgaatgggttaacgggcggggggacacgcctccgtgcgcttgcgcggcgtcccttcgccccgccttcgcagcgcagtcacatgacccgcccaaccggcgtccgcctataaaaagctgagtgttgacgtcagcgttctcttccgccgtcgtcgccgccatcctcggcgcgactcgcttctttcggttctacctgggagaatccaccgccatccgccaccatggtgagtaaccctgcctcgctggtgccccggagcggcggcggggcctccgcggggcctacgctgcctagcctgggacgctggggccccccgtgccaggaggagacgtagcggcggcggggccggaggacccggggctggggaagcggccgccgccatgtctgtgcgccgcgctgttcaccgagccctttctccgtttccgagggcgccataaccttgcccagacctggttggagctgggttgttagcggggatgggggtggggaatgatgatgtggcaggcgtagtaatggcgggcaccgcggtggaagcggggagacagggaggcgccttatgtaacccgcgggccgcgagtttgagatcgattttctgccgggggactaggggcggcagggaaatggcagaacgagcaaagcgacacctgaaaggctccccttttccttccaaataccttctcctgatgctgttaatcgtcgaccttaggcacttgtccttcctatgactcccagatgtacaaagactcttattgagacacgaggtgtaggcttgtggcagttagggccgttccggctccccgttatttcctggggtgggtggccttgtctgatcccgtttgccaaggggtgaccttgcattttatgatgaagcttcttgctcggggaagtttgggtggcccggtgacaacgtggagggggctttaggagaggattcatcccttacgtgtttggccccaaatgagactttagtatttgtacctggtatcaaggaaatctgttgacactcagttttattcctgagcacttttatttctgggttgtcaatcatgaatgacacctattaacggtggttccttggagattgcggggtggctcttaaggggtgttaggctggcaagattcggtgggcttggggcaccccagcaccaaccccctcctggccttgggcatgctggttcgtttggactgaacgctccgtgccatgctgtgttcctggaaatcacgagctggtctgagcctccttgtcttgcccaggtgaacttcacggtagaccagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaacgtgagctccctgtgccctctgtacccaggcagggaggtgctggcctggcagctggaggccactgggccagggtgcgcggggagagacttggcaacgtctctttcccctggtttcttaattcatgggagaatgagtgaggttcagtccagcgagacaggatggagaggcacagggattcggggtactgcgagctggaaggttttcttgaggagggggcttaactccgtggttctccctccctgggggacttgcccccactcctacaatatctggagaggtttggctgtcacacctgggaggggagggtgttctagtgcttgggacgctgggaagctcctgtgttgcactggatgatgttcattccatgtcagtttctggccccgatatgagtagggggagcgcagagtacggtgaccccaactgctttttgtcctgggttggtacattggtgagggactctggctaaggctcttcatttcccctggagcaggggcagaagtgaggaggggagggtcggagtctctggaggcttttgccgtcctgctgggtcttttagttgctactttgagtcaggtgtgatgaatcttgggaccaagtcggtggggcaggatgtctggtcaggagggctctgaggatctggctatggggctggtaccaggagttccctgtcatgggggtggcatgtctcggacagaggcaaaggacaagggtgggttggctcttgtgggagcctctccagggatgagtcatggagggaggagcagcctggcttctgacagcatcccagactccctgggccaggtgtgtggctcctgtccccctgacgagtccctccctccatcagtgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggtaagcagtgggtccccctgaggcacggcctggaaccgggggccatccttgcttgaggatgacagcgccgccctgtcccccgtgtccccaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatggtacggccctccctagctgggtggtgggcttgccgcagcgggatctgcaggagccggtggggagtggagttgagctgagggggactggaagtgtgtttttgccaggaatgttgggtgacagagaagggggctggaatgttttcatccgacttgacccagcccttgatctttgggcagctggaagagacgagctcagggaacgctgccctgggtggtggaggggctggcccccctattcgtgatgactgatcatttcttcactttgaccagatgtctactgaagaaagcctgcgtctgaggcccatgcccaaggcgcccagcccgtagcttcaggctctgcgcaggggccctcacggctgcttctcgtttctcacacttccagatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtgagccccgcgggatatggtgggggattcctgacacctgggggtagtggcagcgacgtaggggcgtggtgtgctattcacagcgtggctcaagcccaccaggtcttgcccaagcatgtccccttggcgaccaccctccccaagtcatcccctggagaccctaacttgatttggcttggcctctccttgccaggtactttgacccagccaacggcaagttcagcaagtcagccaccagccccgaagggaagaagctgccacgcaccttctgccagctgatcctggaccccatcttcaaggtgagtgagggctgcgccaggcaccccgccgatgcgactattggccctcggccctgtgggctccggccggtagcctgtcggctgactgggcccgtctccttgtggggcagatgcgagatgggaggaggcacagctcctaactgaggtggagtcagggctcctctcttaagatctggactgcatagccagagccttgggacctctcctgcattgagggggttgaataacttgtggctttggcggttcagtgcttgtaagtcagaacttgggtccttgtctgagtcagagtgggctttttcctctgctccaccacgaggtttcctccagctcccgatccgctcagctggctgggcccgtggtaggcaggccaggcctgctcctgctcccgtgctgcgtccccctgcgctgacctgagtcttccaagcaggaagcagtgccaggcttcctcctgctgttcccaaatgggctttcttgtttcttggtggggaatgtaggtgtttgatgcgatcatgaatttcaagaaagaggagacagcaaaactgatagagaaactggacatcaaactggacagcgaggacaaggacaaagaaggcaaacccctgctgaaggtgcggcctgggcccagccctcggggtggagggaacacaggctgctgtttccggatgctctgacagcccaggcctgggggctgaagtcctcagctgggcagggacagctgctgcccctttcgctttagactctgggtgctgctggagacacatcccagcagccagccccatccgggacaggtgtgggtgagggccttggcaggagtgtgcatggcctttgccgccttccagaagggactgtgctttggagaacgttagtcctgactttggcttccttggcttcaagagaggaagcgtgtacggggtggggccatcctgggctccccaggtgtctcatgcaccgctctctgcccccgcaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggtacgtggtcccggcggccgggccctgagatgcagccggatgacttcctgttgcccaaggttgtgggttgcagggttccagaaggctgagctgcactggaataaagcttgcgggttttctctgtccctcaggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagaggtgagcagctgggtgatgtgcaggccccttggcactgttgcgggccctgccctgctccaagtcttgggctcctcagtcgggagctagaagtaaggagcatagaaggaatatagggtgatacttgtgccagccacaacttttgttcttagcccagtgagggcatttctggagaagctccaagccccagggcacagcacacccctgctcatctgtgtccctgggcacaggtgggtggcggccgtcgacccatacccagggaggagggcagtgattctgaagaggatgtttcctgacagccccgacgcagcagtcagggccttgtggaagccaccagtctgccctgggacctggcaggagggccaccaactccgggagggacctgccctggccctccagggtccagcacaaccatccctgcggcctgctgccgccttctgcttcttccagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcaggtgggcacggagtgcacctgctgggagcagacaccctgaggggggacggcttgtgtcctgagttgtggctgtgtgggttgctgtggttggtggattggggtgactggtcatgaaaggaggggttcttggctgtggctgtaaatggagactcctgcccaggcagccaccaccctctcctaggctgctctgcgcgtgttcactgtagcttgtgggacttaacatttcttcaggagtttgtgctggtcccagtttcccagcaccttccctgaaatcttgttctggcggggtccctagctaaagggaagctgggagcctggtcccgcctgttccgagccgcctacccctttggtgctgacccgcatccctttcagtgcatcatcgaggagtcgggagagcacatcatcgcgggcgccggcgagctgcacctggagatctgcctgaaggacctggaggaggaccacgcctgcatccccatcaaggtgaggcgccagtgaccagccttccccacgccccaccccggacacctgccctctgctttaaagctgagctgagctaggctctgcagacgcctagacttgatctcggtcttggtctcagcttcttaagttcctcaagtttcttctttgcagtcttccacaggcatgtggggctgtttttgttgttgttgttgttttttttgagatagtctcgctgtgtcatccaggctggagtgcagtggcgtgatcttggctcgctagaacctccacctcccgggttcaagcgattctcttgcctcactcagcttcctgagtaactgggactacaggcgcgtgctaccacgcccggctaatttttttttgtatttttagtagaggcggggtttcactgtgttagtaagtcaagatggtctcgatctcctgacctcgtgatccccctgcctcggcctcccaaagtgctgggattacaggtgtgagccaccatgcctggcccagggctatttttttttttttttttttttttttttttgagacaagagtcttgctctgttgcttaggctggagtgcaatggcgtgatcttggctcactgcaagctctgcttcccaggttcacgccattctcctgcctcagcctcctgtagctgggacttcaggcgcctgccatcatgcccggctaattttttgcatttttagtagagacggggtttcaccgtgttagccaggatggtctggatctcctgacctcgtgatccacccgcctcggcctcccaaagtgctgggattacaggcgtgagccaccacgcccggcctccggggcagtttttgagttacatcctgctgtcttctgtccacaaacaacacaaatgctctggaggggttgggacaggcctgctccagacctcgtttcttccctgttaatgcttaaaattccacaagcccgtggtttctgcgccggagagctcagtggagcccctgctccttgtccttgtctggagtgagatgcgcttggcactgcaacactgactccgcttcgttctgattgacgtggctctaccaggctgtatgaggtccgccttgctaggaaaagcttttaaggatgcgtctgtgtgtaaggtcacctctttctccaggcaagagtgggacttaacctctttttgcagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggaggtgaggcacggctcagcatgtgcagaccacacccgtttccaggctctagagggacctcatggtcctgcctcccgagacagagaccctaatggggccaaggcgggcaaggccccaggtccccctggtggagacctgcaggacttggcaggtggagggcaagcagccgaggtgtgtccggcccttgacggtggctctccccctcccccagggcgcactgtgtgaggagaacatgcggggtgtgcgcttcgacgtccacgacgtcaccctgcacgccgacgccatccaccgcggagggggccagatcatccccacagcacggcgctgcctctacgccagtgtgctgaccgcccagccacgcctcatggagcccatctaccttgtggagatccaggtgaggtctacccgcccaccgctgaccctgccaccgtcctgcccagcggccactgacaggttttctttcccttctggcagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggtgagtgcctgcccggtgtggcctgcagagcctggcaggctggtttgggggacagaagcccagttaagcttagcaaggtgttaaaggaggcgtcctgatgggagcaggtgatggatggagcaggtggtccagtttctgacagcttgtggaccccctaaatcactgaattcccaggggaggggctctcctatccccagtgtgagaagggctctgggcctggagctctgaaggcctacgccctgggccggtagagcagccgagctgtagcacagggttgtcccaaacgagcagcggcatgaggcccatgagtggcctgctaggcccttcgtgaagtgctgggcaccaggccgagtgtctggtctgcagggtgactcaggctgaggaactagcctgagctcctgacaggactttccttctgccctgccaccttctcgatggcccagtgagcctctcgcttccctctgcaggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgactctgttctgcatttttcacggtgtcttcgcaggggagcggggctgcccagtactgggctccctggagcctagaaggggacccgggccctagttaggtgcagcctggggctgcctcagtgttaggtggaacgttctggaatggtgggaatgccctacccctgtgtcattcagagaagcagctgccagctgcgcgggtctgctgagcatttgaagtaggatcagtgcggcaaggaattacgagatgtcactttgaacgcatttggatggccctgtggagcgaggggctctggattgaacttcgcaggtttcagcaactttccgaattgctgacgagctcacaagttctatctgccatcaggattttctgtggtcaccccagtcctgactagtttattagaaacccatttttttttttttttttttgagatggagtctcaccgtttgctaggctggagtggaatggcaccatctctgctcactgcaacctccacctcccgggttcaagcaattctgcctcgggctcctgggtagctgggattacatgcgtgtgctaccacggccagctaatttttatatttttagtagagatgaggtttcaccatgttggcctggatgatcttgatcactcgaccttgtgatccacccgccttggcctcccaaagcgttgggattgtaccactgtgcccggccttgtaaacacttttttagaggcagagtcttgctgtctcccagatgagtatagtggtgcagtcagctcactgcatcctccacctcctggactctcctgcctcagcctgccaggtagctgggactccaggcatgtgccaccatgcccagctaatttttatttattttgagacagaattttgcttggcctggttggtctcgaactcctgacctcaagtgatctgcccgcctcggcctcccaaagtgctgggaattataggcgtgagccactgtgctgacctaatttttactttttttgtagtaatggggtctcactatgttgctcaggctggtctccttcccgggctcaagcgatccttctgcctcagcctcccaaagtgctgggatttcaggtgtgagtgccaatagcttagaaaactatttgtttttctaaatagtgcctaagatgtgaggaggcctaatcttgtcagtgctgataaggttaacatgatcattttccgccttttactctgtcctcaggaaggcaggtggggactgtgaagtagggctgtggggttctcggcaaaggcgggggcagctctggccctgcattgtcaaggccaagcctcagctgaggttttgcccacatgtaggtatgcctgaggtttggtttggctgtcgcatttgaattggggctgtaactgacgctgtttccagcagtcagggtaacggattactgtgtttcgagaatctcactctatcgcccaggatggagtgcagtgttgtgatcttggctcactatagcctctgcctccggattcaagtgctcaagcaattcttgtgcttcagcctcccgagtagctggaattacaggcgcctatcaccaggtctgtgtaatttttgtatatttaggtgagatggggtttcaccatgttggccaggctggtctcaagctcttgaccgtaagagatcagcccgcctcagcctcccaaagtgctggggttacaggtgtgagccaccataccgggtcctattcttttttagtagtgcaaacgttaagatggtatgtggaagctgaatttttttttttttttgagacagtctttgctctgtcacccaggctggagtgcagtggctcaatcttggctcactgcaagctccgcctcccgggttcacgccattctcctgcctcagcctcccgagtagccgggactacaggcacccgccaccatgcccggctaattttttgtatttattagtagagacagggtttcaccgtgttagccaggatggtcttgatgtcctgacttcgtgatctgcccaccgtggcctcc

SEQ ID NO: 13708 - DNA, 16621 bp, Human
  misc_feature (1)...(16621): n = A,T,C or G
tttttgtatttattagtagagacagggtttcaccgtgttagccaggatggtcttgatgtcctgacttcgtgatctgcccaccgtggcctcccaaaatgctggaattacaggcgttagccaccatgccctgccacttttttttctttgagatggagtctccctccgtcacccaggctgtagtatagtggcatgatctcggctcgctgcaacctccacctcctgggttcaagcaattctcctgcgctagcctcccgagtagctgggattacaggcatgtgccaccaggcctggctaacttttgtatttttagtagagacagggtttcaccatgttgagcaggctggtcttgaactcctacttcaagtgacctgcccgccttggctgcccaagctgttgggattacgggcgtgagccaccacacctggccaacccattgtacgttgaaaatgtaaataaaaaatataaaggccggcttgtggctcacgtctgtaatcgcagcactttgagaggccgaggccggcggatcacagatattgagaccatcctggccaacatggtgaaaccctgcgtctactaaaaatacaaaaatcagctgggagtggtggcgtgcacctgtagtcccagctactcgggaggctgaggcaggagaatcgcttgaacccaggaggcagagattgcagtgagcccagatctcaccactgcgttccagcctggacgatagaaggagactgtctcaaaaaaaaaaaaaaaaaaaaaaaaaggctgggcaaggtggctcatgcctgtaattcctgcactttgggaggccgaggcgggcggatcaggaggtcaggagatcgagaccatcctggctaacacggtgaaaccctgtctctactaataaatacaaaaaattagctgggcgtggtgacgggcgcctgtagtcccagctattcgggaggctgaggcaggagaatggcgtgaacctgggaggtggagcttgcagtgagccgagattgtgccagtgtactccagcctgggtgacagagcgagactccgtctcaaaataataataaaaaatgaatttaggccgggcgcaatggctcacgcctgtaatctcagcactttggaaagctgaggtgccggatcacctgagcttaggagttcgagaccagcctgggcaacatggtgaaaccccgtctctactaaaaatacaaaaattagccgggcgtggtgatgggcacctgtaatcccagctacttgggaggctgaggcacgagaatcgtttgaacccgggaggtggaggttgcagtgagctggataccgccgctgcactcctgcctgggtgacagtgagaccctgtctcaaaaaataaaattaaaaaaaaaacaaacctgatacctcccagtgttgtcagttggcacatactatgtctcaataaaatgcttgctgttaccctctattttgagacgaagagggaccctgtgtatgacaaccccagattgacctcatttgcattttaagtatttagaatgtgggtaacagttttcagtggaggaaactgccacatagggactaaagcagtcccagggtccactccaggagctgccaggcgcgctcggccacaggtgagccatccattcgcccaaccggtgctccaggaaggcaggaagcgggatgcagggcttcagcctcacttctcgcagcttcagcacctgggtcagaggagaggcgggcggggcgatgaagggaccggaagtcggccttttttccgtccgcttgaccagcgtcgactgcagccaatgaaatcagggatggcgagtgttcagccagtggtgaggctgcatccgggtgtgggtgccgaaaaggcagctgggggcgggacgtcgaggtgcggcacgagcggcgggcgcaccggccaataggcggcggggttcgtttcccgggggtgggcactggcgggtgcggtgacgtcggcgcaggcgcgtcgcggcggcaggggcgcggggcttctggaggcggcggcggtggccagcgcggcggcgccggccgtattctccgggctgcggagggtaaagagcgggctcgggccgaggctggagggctgggtggggccagagcggcgcttcgggggcccgcggaggacgagggagggagagaatctgaggagctggtaggtttggggacccatctgggtgaccgggccggggaaagggctcggccgggcgtgcgaggggcgtagcggccccagggatgctggagcggagccttagggatgggcaaggccttgggggcggggggaggttctgcaaagggagccactggggtctgcctaggggcttgtgcggagattgcgggcgagaaggggcagaggacggtggaggagactcagatggggccctttttggaggcccgttttggggggtaggggagacggcggttgggggactttgatacatggagcgtggaggaagaggttaatcttgcgaggacagtggaggtcagcgggggagggaggcaaagtgggctttcaggagcgtggaaggcgtcgtccggttcttggaaaattcagaattggagggagtcagagatggttgggggtgggcgggggtgttccatcgatgagggtcttaagagacctgccgagggcaaggaccaggaggggttaaggtagtaacttgggaattttgatcggaatggcagcactttgggaggcctgggacgatcgcttgagccttggagttccaggctgcagtgagccatgattgcaccactgcactccagccagggcgacagagcgagactccttctcaaaaaacaacaacaccaacaacaaaagaagtagacttgagaacttcgttaagacattggccagggagtaaggtagccctgggatttgaggttgaggagaacgtgcaggaatggtgggggattttggctgagcaggttgagagaagtctaggagtgagaggcaaaaaaagacgcaggcagcgtcggggaaatcagaattatgtgtctggagagagttttgcggggtgaaggtggcccagtggggctgttaccaaacttttgagtggttatggggctctaagaggtgacatgacaggacccagcccagtaaacacagcacctctttttgtcgagtttggagcttcagagtggagaggtgggaggcttgtgtttgctggacaggtctgtccattaatctaggagaaaagggtggtgtctcagttcctcacttctgtctttccctgtcttctccagggttgccattaggggactcctgaggtcctatctccaggctgcggtgactgcactttccctggagtggaagctgctggaaggcggaccggccgccatgtccacgttcaggcaggaggacgtggaggaccattatgagatgggggaggagctgggcaggtgagctgtctgcccgcacggctgggctccagggataggagagaggcgctgtggggttttctgaacagcagctctcctttcctgttctttatcctgtatgctgagaaggaatgagtcagtatcatgcggtgggggaacgaatttgggccgtggagtcagacagccccggctgtgaattcctgcttgggaatcctctgtgtgtttcctgtggggagaaaagtaattgagccgttacagcagccaagaccgtgcctggcatggggcaccagagcaacagatgccagctgcttttgttattaaaagatgtgtcttctgcctgggcaacatagcaagactccatccctacaaaaaataaaaatgaaaaaaaattaaccaggtgtggtagctcatgcctgtagtcccagctactagggaagctgagacgggaggatggcttgagcccaggagttggaggaggctgcagtgagctatgatcgtgccactgcactgtagcctgggcaacagagtgaaaccccatttatttaaaaaaaaaaaaatctccctgtgttaatcctcttttgtgggaggcactttagtttttttgcccagctcttggatgtttaaagtggggggagggaggggcgtgtctcccagctgggcccaaacctcggtcaattgtttaacatgcttgtgggaaaaagcagaggtttcctcttccagggaggcagctgatttcctgcctgtctgggccttggagggtccccctggggccccaccccctccagactagccaggcaccactaggccctgcctccttttgtagagcctccagccttatttggtgagtttgctactggccagcctccctggagcctccccatgatgtcaccagaagggaatgtaaataagtgagctctgtgtcaggctagggagagtgctgcaggctcttttgggatcctgaggtccctccttcaggaatttcctcgttagtggcagagaaagcatgctccctcctcccccttctcatgcttcagtgttgacccctcctgctaggggtcgtttggcaaaagtcagcaaaattcagccacatttcttttaactcgccgatttcacctctaggaattaattcattggaaaactgtacatacatggatggaatgacttaagactggggtagttgctagaacgtttaccagaataacagccttttttttttttccttgacactatctcattctgtcgcccaggctggagtgcagtgatgcgatctcgactcattgcagcctcggcctccagcctagcctcccgagtagctgggattacaggagcccgccaccacccctggctaatttttgtatttttagtagagacaggatttcaccatgttggccaggctggtctcgaactactgacctcaggtgattcacctgcctcggcctcccaaagtgctgggatcacaggcgtgagccaccgcaccccgctgggaacagcagcctcttaaatggccttccccaaaccactgcatcagggctggaataggatgcagcttgtaaaaagaaccaggcagggccaggtgcggcggcttccgcctgtaattctagcgctttgggaggccaaggcgggaggatcgcttgagcccaggacttcaagactagcctgggcaacataagttgacccccatctctcaaacaaacagaaattcataattttaaaaaaagtatttagccttctgtttttgccgtgaagccttggaggtctggtgtgtatttcatgtcgcagtttttctcgggactggccacacctcacgggtttgacagctctgggtggccagtgtctgctgttctgacggcactgcttcaggtagtggtctggaacattctcagagatacatgaagtgcaagatgaaggcccagaatgtagcaatttttgtttgtttgtttgagacggtgtctggctctgttgccgagactggagtgcagtggtgccatcttggctcactgcaatcttcgcctcccgggttcaagtgattctcctgcttcagccttccaagtagctggaattacaggcgcccaccaacgtgctcagctaatttttgtatttttagtagagacggggttttgccatgttggccaggctggtcttgaactcctgacctcaaatgatctgcccgcctctgcctcccaaagtgctgggattacaggtgtgagccactgtgcctggccccagcccacactttttttttgagacggagtcttgcagtgtcgcccgggctggagtgcaatgccgcaatctcagctcactgcaacctccgtctcccaggttcaagcgattctccttgcctcagcctcccgagtagctgggattatagatgcctgccagcacgcccggctaatgtttttgtatttttagtagagacgtggctttcactatgttggtcaggctagtcttgaactcctgacatcgtgatctgcacgcttttgcctcccaaagtgctgggattacaggcgtgagccactgtgcccggcttcccagcccgcatttttaaacatcatgaactctatcagtagaaattgtcggtgtgtaggccacgcttgggtcgtgtctgggttgtggcaggcacttaggaagtgggttgggagtgacacctgagaccatcactgaggagggcttgctgtgcccccacctgcactgggggctggggaagttacagagaagcgaagagggtgggctcagctcttggggagtttctttcccggctggggagatgaggcacgtttcacattccgtagaggaactgagagcctgccagtggccttgcctctaaggagcaagtctgtggccagtgagaccgggggctgtctggaggtgggcggctgtggtctgctgttgctgtaggaggactcagtggcagaacctgaaatctggttggcaatagcaaaacagggaaaggcgtggtttacagaaccaggttgtccaggtgtgcagcggccgcaggtgtgactgggtgctggtgcatatggtgccctgtgtccccggggccgaagtccactccagcatggaggaggcgccctggcagagtgaatgacggggcttatgtgccacccgcagtgcctggtggctcccctctcctggcctggtctgttcttaggcaggcttcttaggtagccttctatgtggtggcccctgccgcgagcctggatccaagcccagcagagggagagagagatcctctcttcccagcaggcgttcagagccctgtggactggaccggtctctttgggctggaaggcgtggttttctgcttgcccaggtccagtcgtgtccccttccacccctttcctgggccactgagtcccacagactgagagtgagcggcaaaggctgccctgggacagctgggtctgttagcaggagacagcgtggagccgggaggtaggcacgcaggaacccggtacccagcagcagctgtctgcttcctgttagagcacctgggctctggagcctgcagcacctggtttgaaggtttgaatcctcccgccactgactgactgcatgaccttgggctagttgctttccttttctcagccttggtttctttaaaatgcggatactggccagatgtagcggctccacctgtactgccaacacttggggtgggggagtgggaggatctcttgaggccaggagttccaaagcagcctgggcaatacggcaagaccctgtctctacaaaaaataaataaatcaggtgtggtagtgtgttcctgtagtcccacctacttgggagggatcacttgagcccaggagttcgagaccagcgtgggcaacatagtgagacctcatccttacaaaaagaaaaaaaaattaattgggtgtggtggtatgtgcctgtagtcccagctgcttgagaggctgaggcaggaggattgcccgagcccaggaggtcaaggctgcagtgagccatgactgaaccactgcattccagcctgagcaacagggccagaccctgtctcaagacaaaacaaaacaaaaacaaaaaaagcggatctggcacttgccttgcactttttatttttttgaggcaggatcttgctacgttgcccaggctggagtacagtggcacaatctcagttcactgcaacctctgcctcccaggttcaagcgattctcctgcctcagcctcccaagtagctgggattacaggcacccgccaccacacccagctaattttttgtatttttggtagagacagggtttcaccatgttggccaggctgctcttgaactcctcagctcaagttatctgccctcctcgaactcccaaagtgctgggattacaggcgtgagccaccgcgcctggccccctcagttccctcttgatatgcattgaactgttcattctttcacttttcaaaaatacgccggtgccatggtgttaacgtgtggctctgcactcccctccacacacctgctgggcatagccctgggaggggtgggaacgccgcgtctgatggtgtggggcgctaaggaattgctctctgagaaggcgcagagtctgcacccccgcagtggccagctcatgtccttcaagtgcctggtgcagggccgcgcccaagaggagcaagtggaggtgacggggagccagccacccccacttactccctccgcctcctccacccccactcactccctccccctcctccagcggccagtttgcgatcgtgcggaagtgccggcagaagggcacgggcaaggagtacgcagccaagttcatcaagaagcgccgcctgtcatccagccggcgtggggtgagccgggaggagatcgagcgggaggtgaacatcctgcgggagatccggcaccccaacatcatcaccctgcacgacatcttcgagaacaagacggacgtggtcctcatcctggagctggtctctggcggggagctctttgacttcctggcggagaaggagtcgctgacggaggacgaggccacccagttcctcaagcagatcctggacggcgttcactacctgcactctaagcgcatcgcacactttgacctgaaggtgagccctgtagggccctgtggggccggcctggccagtgtgggggtggggatggggcggggaagagcctggaaggcacctcctgcgcgtgggggtgaggtgtggggagcgtgggggtgaggtttggggagcgtgggggtgaggttgggggagcgtgggggtgaggttgcggggagcgtgagggtgaggtttggggagcgtgggggtgagggtgggggaggcccgtgctttccctgctgagcctcctcccaccccagccggaaaacatcatgctgctggacaagaacgtgcccaacccacgaatcaagctcatcgacttcggcatcgcgcacaagatcgaggcggggaacgagttcaagaacatcttcggcaccccggagtttgtgggtgaggccctgcccagtgggcagccccggcctggggagggtggtctggggctgcctgctgtgcgtggggtgggtcatgcccggtgctgggtgccgcgtcctcggccctgaagccacccctcttgggcccggctttgcgggaggtctgggcctccatttggtgcagccccgctgtcctacccgtcaggccctgagggccagctctgccgcattcatgcccccaagggctgcgacatgtgagaaccttgaccccatgcctgtgtcttgagcctcttccttggccagcatgtccccagtgcctgacccacatctccctgttctgcagccccagagattgtgaactatgagccgctgggcctggaggcggacatgtggtgagtgtaccacctgctcccaccgggcctccctgcattcctggagcgcaggccagtgctgcagctggggatgaagcggggccttgctgctgttggggtatggggggaccgttgccctagaacaggggcgctggacgccacggtcctgggagggtgggcggccccacgctgcgctgacccttgcctcttgtctgtccccaggagcatcggtgtcatcacctatatcctgtgagtacctggcgggggccccctcggctgtgcaacacagctggcatgggtccccggctccgtgtgtctcatgtggacgccaggggtccccagcctggctgtgacccatcgcgggtactcaggggataccgggtgaacggatgagtgattctctgtggctgctgtcacagaggcttctggagagttctgaaggcaggacactcacagagcggctgagcaggctccgggttgggggtcgtgtgtgctcctgtccctctggctgctagggagcccagcctcctctcgaagtgcaaggaaggggtccgaccccacgctgggttttggctcctgtccctgggccacacgtgggcctgctgttgtttattatttttatttgttgagacggggtcttactctcttgcccaggctggagtgctgtcctagctcactgcagcctccacctcccagacttaagcaatcctcccacctcagcctcctgagtacctgggactacatgtgcacacaaccatgctcccatgctcggacttttttttttttttgatggagttttgctcttgttgtccaggttggagtgcagtggtgcgatctcagctgctcactgcaacccccacctcccaggttcaagcgattctcctgcctcagtctcctgagtagctgggattacaggcgcccaccaccatgcccagctaatttttgtatttttagaagagacggggtttcaccatgttgatcaaggctggttttgaactcctgacctcaggtgatctgcctgcctcggcttcccaaagtgctgggattacaggcgtgggccgctgcacccagctggctaatttttttttttttttttttttttttgagacagagtttcgctcttgttgcccaggctggatggagtgccaaggccccgtctcagctcaggcttactgcaacctctgcctcccgggttcaagtgattcccatgcctcagcctcccaagtagctgggattacaggtgcctgccaccatgcctggctaattatttgtatttttagtagagacgatgtttcaccatttcggtcaggctggtcttgaactccagacctcaagtgatccggccgccttggcctcccagaatgctgggatgacaggtgtgagccaccgtgcccagctggctaatttttaaaagtttttgtagaggtggagtttcactgtgttgcccagccatattgaatgggcatagctcattcagtaagcaaggaaataaacaatggcgtgggcccagcccgctgtagcgcgtgagcggacccaaaggcttcaggagatgggctagaccgtttgtattctttttaaatgttcagataattcagacttacaaaggagcaacagaaacagcacagacgccccctgcagcttcctcctccttcagtttacatttttcatgaacacgaacgttatgaacaccaagacgttagccttggtgctacgctaatcacaaaagtgctagatgggccgggtgcgatggctcacgcctgtaatctcagcactttgggaggctgaggagggcagatcacgaggtcagggcattgagaccatcctggctaacacgatgaaaccatgtctctactaaaaatacaaaaattagctgggtgtggcagcgggtgcctgtagtcccagctactcaggaggctgaggcaggagaatggcatgaacccaggagatggagtttgcagtgagccgagatcgcgctactgcactccagcctgggtgacagagcgagactccgtctctaaaaaatttaaaaaatttaaagtgccagaggtggttagacacccccgttttccactcctgtcctctctgaggtccccacacggcatttagccattcagctccttcgccgcctccagtctgaggctgttcctctgtctggctttcatgaccttgaccctgacttgtgctcacgggtcaggtgttttgcagaaggcgtctgagtccacgtttagtctcgtgcgctgtcacgatcagacgatcagacggggcttcagtgtctctgctcaaaaccccagggatgatgctgtgtcaccctcccagcgtcaggctgggaggcagacgctgttggggcctctcactgccgggctgttgaccttgatcctttggctaaggtgttggctcgggctccccactgcagttaccctcccctcggcgttactgagcactgggggctttcgggctctgcgtctgcacagatacttcgagtctccaaggagacttctgcctgttcatttctgctgctgtcagtggcggggtgggggggtggattttgaatgcctcttgggtggtgtctgggatcgttgcaggaaggttctaagggctcaggagtgtgagtggcccaggcacctgccgtcagcctgtcttctgtgctccgcctgtcgtgggcagccggagaggcggcgcggccgtggtgggagcccaggaccccactgagcccccacgcctgtctcgcagcctgagcggtgcatccccgttcctgggcgagaccaagcaggagacgctcaccaacatctcagccgtgaactacgacttcgacgaggagtacttcagcaacaccagcgagctggccaaggacttcattcgccggctgctcgtcaaagatcccaagtacgaggggccggcagggggcacggggtgggacatgggacacaggcccactccacccacggaggctccagaggactctcctcccagcgccacctccctgcggctggggatcagacattgcttaccccttgggctggagagagtaaactgataaactggtggcccaagctggccattgccatggttttttttttttttttttttttgagacggagtctttttttttgagacggagtcttgctctgtctcccaggctggagtgcagtgcagtggcgtgatctcggctcactgcagcctctgcctcccgggttcaggctattctcctgcgttagcctcccaagtagctgggattatagacgcccgccaccacgcctggctaatttttgtatttttagtagagacagggcttcaccatgttgcccaggcttgtcttgaactcctgacctccttggtttgtgatttgcctgccttggtctcccaaagtgctgggattgcgggcgtgagacaccgtgtctggctgcttgctgtgtttttagcaaacttttaattagttgccggtgtgtaaagtaaggatccatgtaaaattccaggtcacttgttttcctgtaaacacttagaattctggcagtgctgagccctcactcgtaggcctccccgggcctccatggccgcccagtccctctctcgggcgcctgggtttgcgactccagcctgaggtctcagctctctccaccaccccccagaaaaccccacgctccctgcagtacccttgttcagcttctgtggttggctgagcagaggctggggggcgactttagggcttttgggggtcccgggagtcagttgttcacgggaggacgggacagatggtgcaggtgtacctaaccagagcgggggtcttccaggcggagaatgaccattgcccagagcctggaacattcctggattaaggtaagtggggaggtgggggagctccctgggcttcccaccttggccttctcgctggggtcccggggggccttcagcatttaaggcttgtggatgtgacaacccccagtggctggggagggtccccagaggagtgagcctgtgtggcgggggttgggtcctgggcgtgggatgtccagcacccgacagacctggtggcatccttggctggtgtgtgtccaacggggctgactcctggggccagggccgcagcgtttttctcgagagagcactctcggctttgcgtcgggctgggcagtctccgtcacgaggcgttgactctgctgccggatgagcccctgaacctcagttcacactggcaggtgggggctggcggggctgggtggcatcgcggggaccccgctcaggcttccctccttcctaggcgatccggcggcggaacgtgcgtggtgaggacagcggccgcaagcccgagcggcggcgcctgaagaccacgcgtctgaaggagtacaccatcaagtcgcactccagcttgccgcccaacaacagctacgccgacttcgagcgcttctccaaggtgctggaggaggcggcggccgccgaggagggcctgcgcgagctgcagcgcagccggcggctctgccacgaggacgtggaggcgctggccgccatctacgaggagaaggaggcctggtaccgcgaggagagcgacagcctgggccaggacctgcggaggctacggcaggagctgctcaagaccgaggcgctcaagcggcaggcgcaggaggaggccaagggcgcgctgctggggaccagcggcctcaagcgccgcttcagccgcctggagaaccgctacgaggcgctggccaagcaagtagcctccgagatgcgcttcgtgcaggacctcgtgcgcgccctggagcaggagaagctgcagggcgtggagtgcgggctgcgctaggcgcagtggggtgggccaggccccaggacagccggagctcggcctgcggtgggggcgcttcctgtggacgctgcgcctcccatcgcccgggtgcctgtccttgcccagcgccaccaggctggaggcggagtgggaggagctggagccaggcccgtaagttcgcaggcaggggtgggtgtgggacggggctgcttctctacacagcctccacgctggccttcaccttcacccctgcatcgtcggtgaccctgggaccctccaggcagcgtggcctgtggcaccgtgagggttgggacccaccgaggcgcagaggcggcccgaatgcagccctggttcaggcccggaggagggtttgcgggtagttgcacggacaattcggcggggtgctgcctgttgctgccattagcccaggaggaggtcgtgggacggggagggtgggatggacggcggacaggcagtccccacgctgctgggtggcgccgggcttggtggggtcttccactgtgtgcccttctcgccgaggccggtcccccgggtgtggggtgccctgctgcggactcctccgcgagccccatcgtcgcgcctgtggacgcctaggcaagagcggccctctgcagccaagagaaataaaatactggcttccagatacgcgggtgttgtgtgcctcaggccttggcaggggacagccagcccttggccaccggggatatgccctccgcggcgttcatgtttctctctgtgttccatgcctgccgctgtgctcaggaaggagggcacaaaccgggggtcctcgcagaccttcacggtgtcctgggagctgccggatcttggtctcagctgccccgagtgttttgattgcaatgaggtggaagctctgggcagctgaggtggatcagaagcgtttcctgtccctttgcgccttacgggatgctgctgtgtcccacgtgggagcccctgccccgtctggagccacatgcaggtggccctggagggggagcggctcagctcagctgctagggctcacaggtggtttcagagaggggccccgaccctgtccatcctccctggaggaagtttttttgctttttttttttttttttttttttgagagcgagtctggccctgttgcccaggctggagtgcagtggtgcgatcttggctcactgtaacctcggtctcctggactcaagcgggtctcctgtctcagcctcccaggtgtctgggattacaggcatacaccaccacacgtggctaatttttttttttttttttgaggtggagttttgctcttgttgcccaggctggagtgcagtggtgtggtcttggctcaccgcaacctccgtctcccatgttcaagcgattcttctgccccaacctcgcgagtagctgggtttacaggcatgtaccaccacaccgggctaattttgtatttttagtagaggcagggtttcaccatgttggtcaggctagtcatgaactcccgacctcaggtgatccgcccgcctcagcctcccaaagtgctgggattacaggcgtgagccaccatgcctggccgtaatttttgtatttttaacagagatggggtttcaccatgttggctaggctggtctcgaacttctgacctcaattgatctgcccttcttgtgctcccaaagtgctgggattacaggcgtgagtcaccgcatctggccatttttttttttaacttttttttttctttcattgagctatgattcacacaccctaaaatctttcttttaaagtgtgcaattcagtggttttatacattcacagaggcaggaaaaggtacatccacacaaaaattgtatgtgagccaggtgtagtggggttgcctgtggtcccagctactcaggaggctgagacgggaggatcacttgagctctggaggtggaggctgcagtgagctgtgatcccgccactgcactccagccttggtgacagagcaacaccttgtctcataaatgcacggtacaccgggcacggtggctcacgcctgtaatctcagcactttgggaggctgaggtgggcggatcacgaggtcaggagatcgagaccatcctggctaacacggtgaaaccccatccctactaaaaatacgaaaaaaaaaattagctgggtgtggtggcacctgtagtcccagctactcgggaggctgaggcaggagaatggcgtgaacctgggaggtggaacttgcagtgagccgagatcgcaccactgtactccagcctgggcgacagagcgagactccgtctcaaaaaaaaaaaaaaaaaaaaggaaaaagggtgaaagtggtgcattgtatgttatgtgtattttatttatttannnnnnnnnnnnnnnnnnnntttttgagatggagtctgcctctgtcacccaggctggagtgtagtggcgcgatctaaactcactacaacctctgcctcccaggttcaagcgattctcctccctcagcctcccgagtagctggaattacaggcacctgccaccacacccagctaattttttgtatttttagtagagacggggtttcgccacgttggccaggctggtctcgaactcctgacctcaggtgatccacccgtctcggccaccgaaagtgttgggattacaggcgtgacacgcgcacc

SEQ ID NO: 13709 - DNA, 12309 bp, Human
tcctgacctcaggtgatctgcccgccttggcctcccaaagtgctgggattacaggcgtgagccactgggcccagcctacagatgggattaagttgatgctattgagatgagagagcatcctggatgccccaggtatataatataatataatataatataatataatataatataatataatataaatattaataatataatatatataatagtatggtttaaccaggcaccatggtgtgcacgtgtagtcccagctactcaggaggctgaggcaggaggttcgcttgagcccaggcatttgaggccagcctgggcaacacagagagacccccagctctaataatgataataataataatatagtttcctagtctgctgcataatgttccttaatatagctgttctgtaattctcttgtaactgggcctctgctccccgcaaaatcatgtgatgcccccaagtccagacacacagccttttggggtaacagaagattaaatatgggcgcaggccacctgggcatctcggttcattgccctcctaagatgaacttcatctttgtttcagaggactcatcccttagaaaggatgataaggtgcaaggcgtggtggctcacgcctgtaatcccagcactttgggaggccgaaatgggaggatcacttgatcccaggagtccaagaccagcctgggcaacaaagtgagacttcatctcaaaaaaataaaaataaaaatacaaaagttagcagggcgtggtggcacgcacctgtaatcccagctactcaggagggtgaggaaggagaattgcttgaacccgggaggtggaggttgcagtgagccaagatagcgccactgcactccagcccgggtaacagagcaagactccatctcaaaaaaaaaaaaaggcaaagtggccaattcttggattcctcccaggacagggaactcaccccctcctgaggctaccccttctatggctctatgaaaatttgggaaaaaaaaaattaccctgtggtcccagctacacgggaggctgaggcgggaggctggcttgagcccaggtggtcaaggctgtagtgagctatgatcacgccactgcactccagcccaggggatagagtgagaccctgtctcaaaaaataaatgaataaaaataaagataaaggcctgcattgggtgaaagcagattgggcgttttggtcaccccaaccacaaagccatcgctgggggccagggccctgtccaccaagaccaagtgagatcaaactgttctgtgaggtgaaagcgggtggggcccccaccctccatatgggggaggaaatcccggctggaaaaggggtacctcctacctacgggcagagccaggtccctccaactcccaggccccccttttaccctccaaggagggcagctctaagaagtttgcatccggatgattacagttcccgatgattctgttactccaattttcccttaatgttgatgattatgataatgatattgatagcggctgacattttgaaagctttttttttgtcaaccaccaatagccctctgagacggtgggtgctcaaatgggcgacactgagggagttggaattgcagagtacgaagtgtcctctgggagtccgggcttggcgccttgcttatctccccggacgggcagctcactctccctcacccccggtccccgccacgcgcactggcggcgcccgttccacgctccaagaaccccgcttcccagggtgggtggggggtgcacgcccgacagggccaggtcagggccaggcgtggagcccgcgtgcgccccgggaccccgcccggggcgcgcgggaggcgccgggggccgcggaggcggggcggggaggggccggcggcggcggcggcgcgcggaggagaccgcagtgcggccggcgctaggacccgcgggggcctcccaggccgcggcgcctcccgctttcccccactccccgacccttcttcgcccccaaaatgaggaaacggagcaactcgctccaagttgtgcagccgggaccgcctcggggtgtgcagccggctcgcggaggccctcctgggggcgggcgcggggcgcggctcgggggcgccccctgagcaggtgagcacgtcggcggggagacgtggagagaccccgaggccggggtggggggaaaccccgagggctctaggcgggggtgggcccgggacgtgcgcaggaagggccggtgtgtgcgcgagtgtgcgcgtcccgggcgcgcagcgggtgcgcggctggggcggagggtgctcagaggcgatcggaccccgcgtggtggtggctggggtttcctgggtgcgggtgtgcgcggctacgagccccgggcgtgtgtacccgcgcgtccacgtggagggctgtgcgcgtgtggccgaaaagcgtgtgcgcggccctgcgtagcgccctgcgtgcccgagtggcccggcgctggcgcccaggtgttccagtgtggggcggctgtgtgtgtgccgggggcgggggacaggtgcgcacgttcccaggtgtggagcgcttgtgcgcgcggatgcgcggggacgtgtgcgcacacctgtttccacgtggacgtggtcctttgcttgtctgcgcgcagctgtgtccgagccctgtgtgtttctgtgcgtgtgcatgcatccgtatgcgtgtgagtacacgtgggactggaggatttcatgggaggcgcatcttggaggggccgagactcaccccccagcaccgcccacttcccagccactagcggtcggggagatgggggaggcagggaggctcccccacccctgcagcaatgagtgactttgtgtgtctgtcctgggtttggggggggatcagagaggctcagcgggtggccggaggagcccagcagggctacaggacccgcccctgcccccagctccaccccacggtcagagattcttgggaatgaccttgactcatccctatttccccaccctgcccctgcctaccaaccagaaaacaggaagaaccaggctcggtccagtggcacccagctccctacctcctgtgccagccgcctggcctgtggcaggccattcccagcgtccccgactgtgaccacttgctcagtgtgcctctcacctgcctcagtttccctctgggggcgatggcggggcgaggctctctggtttcctggcgggcatttcacggctgtgattctgctgaggaacttccccgggtaaagatcacttccccacaggggcttggggagccagttctgggtcccatccaggatgcctctggggaggctctctctgcctgcccagccatcgcccccacctgacctgggctggaagtggtaggaactggaccgtgggtcccagcccagctcccacctggactctgtcccctccccaggtgagcccccgcttcctccgagcctggcacccccctcccgtctcagccaggatgccaacggtgagtgtgtctagcctgcttcctctgctccccgggtccttcttcaactccgtccacaccctgagcccccttcctgaagggctgtactctctgccccctacccccttctgctggcctcggcctggcctttctcagtcatcttggcttcctgaccttctgtcccaggccgcctctctttgtgactctacgatttctctctgagcaccccactccccctttctttcccccgatgtctgcgtctgttttctctgcctctccgctcttttccaatctctatacctttctccctcctgtcctctttcccctcccgtgcctctgctccccacatctccgtgatgtcctccctttgcccctctcccggccccctctgcagaggcgctgggccccgggcacccagtgtatcaccaaatgcgagcacacccgccccaagccaggggagctggccttccgcaagggcgacgtggtcaccatcctggaggcctgcgaggtgagaggtggccggcgggtgtgggtgcttggggctgggggctccaccaggaccacccccacaccccccacactaaccccgtgcttcctccctggcagaacaagagctggtaccgcgtcaagcaccacaccagtggacaggaggggctgctggcagctggggcgctgcgggagcgggaggccctctccgcagaccccaagctcagcctcatgccgtgagtgggcaggacaggggcctggggtaggggacagcaagtgaccccccctccacagcccagtctgacccaccccttccgtggccgcaggtggttccacgggaagatctcgggccaggaggctgtccagcagctgcagcctcccgaggatgggctgttcctggtgcgggagtccgcgcgccaccccggcgactacgtcctgtgcgtgagctttggccgcgacgtcatccactaccgcgtgctgcaccgcgacggccacctcacaatcgatgaggccgtgttcttctgcaacctcatggacatggtggaggtgctgccacccagaggccccaccccgtccctgcagtggggcagcccagggactccggagactcccctacgtagagatagaggggcgggtcacctgacctccatcccttccccagcagctgggcagacaccatccctacctcctgtgctgatcacccgggaccccctgagctctgtgcttccccaatgtggagatgaagggggtattccccagggccccccaggcacccccaggcccccatcccatctcagatgggcagacaggaggacccccacagtaggattccccttaatgcagaaataggggggctgatccctatggactgcccaatctacaggtggcctgagtcagcctggttctacctccagggactagagtgactcctctggggaccccccaggaccccccaagttgataccaatccagaggactccccctccttttggcttgcctcctttcccgttcctatggaaaccagcctttctcctcctccccggtcccacccaccccacccagaggccacccgggaacggaacaggatgctggggttcccctccctggggctgggctcatggctgtcccaccatcctgcagcattacagcaaggacaagggcgctatctgcaccaagctggtgagaccaaagcggaaacacgggaccaagtcggccgaggaggagctggccaggggtaggggacgcccaggagggcagacccccttccctacccacgttagcccagtccgggaggaagggccctggggccccgcacctctgaggccagatcacccaagcctgtctccatgcccagctatgggatagaagacctgggctgcctcgggggtgcccacagacacagatcagtcctttattcaataggtccccagcttcgccactcatctgtcaccatcatccaccatctgagccagaaacctggccccgaacctccacccaccccatcctccagcattccctccttggccaggttcccaagacctggtgaatcttctcccctcccctccccacagcccagcctcaggccctcccatcagaccgcctccttcccagagggcgagtcccccttccagcccaggccttgagtgcagcctcaaggttatctttctatcatgaaaccatgcctccagggagagaggcccagcagctccaccaccttccagaacctgcctgcatggcctgagccacctttccagcctcatctgcaaagcccttcctccacacatccaccccctcccaggtcaactgtgatcatcgttttcttcatgcctctgagccattgtatattctgttcccttcacctgaaatgcttttccagcccctaagtagtgaaatcctcaatatttaaggtcaaaagcaaatgcctcctctgaccccatgtctgtctccttgaaagtatctctctgctggggaagtctgtacccatcagggatggcatccaggtggagactagcatcaccctggccaatgatctcttaagaccgtggcatttggagggggcactttctggagggagaagagaacgtctgcagaaccgaccagagggcagtggaggggacaacacaggagtgcttgggagaagggtcagggaggctagagccctggaatattctggaacctttatgggtctccatgttgtgtttttttgctctgtgtgtgtttctggggtggtcagaggtaaagaactgtgtagggaagagcccagagggtatttggagggacaagagagccaaagagaaaagggcagctcttatctctgagaactgaagtgtttcctggcactaccccttgggcctgactgggagttcctggagggcaagtgtggggtctgagggtctcagccaggcaggcccccagctttgactattcacaccactatccctcctgtaagcccctttttgttcaggtcaacctgagatagttctgttgcttgcaacaacaataattggtaccaggagtggggtgtctctgatatgtcctaggggcattgccaggcccagcagccactcaaatgtgtatccacagctgcagcactgtgagagacatcacctagtctctcaccaagtagaacccccaatgggaggatttagggggcccattacccctctgactgggtcttcactccacagcgggctggttactgaacctgcagcatttgacattgggagcacagatcggagagggagagtttggaggtgagtggcggactgggttgggggtgctgaaggaagatgggaggtgcatattgaggctttggagtcacagagctgaattcaaacccatacttaaccacctactagttgtgcagctgaagacgtgcaaatcctctgagcctcagtttccccctctggaacagggggtaatggcagctgtcatgaggagtaagtgaactcaagcaggcgctcagtcaacgttagtgacttcttcacactgccagggtcttgtatggtcagtcccactgtttggaatgtttgaaacaccattccctgaaattattattctggaaggctctggggtttagatcaggggtcggcagactctctgtaaaaggccagattgtaaatatttcctgctttgtgggccaggtagctgctgtcaccactactgaatcctgcccttgtggagtgaaagcgaccacagacaatatgtaaacatatgggcgtggccatgaaaactatgacccagaaatttgaattttgtgtaatgctcacatgtcctgaaacagcactcatcttttgatttgtttttacaaccatttaaacatgcaaaaaccagccaggcacggtggctcatgcctggaatcccagcactttggtaggtcggggcaggaggatcccttgagctcaggagttcaggtgcagcctggacaacgtagcgagacccccatctgtacaaaaaaaaagccaggcacagtggagcatgcctgtagtcccagctactcaggaggccgggatgggaggatcccttgaacccaggaatttgaacctgcagtgagctgtgatcacgccactgcactctacctgggtgagagagtgagaccctgtatcaatattttaaaaataaaaatgttggccgggcacagtggctcatgcctgtaatcccagcactttgggaggctgaggcgggcggatcacgaggtcatgagatcgagaccatcctggctaacatggtgaaaccccatctctactaaaaaaaaaaaaaaaaaaaattagccgggcgtggtggtgggcgcctgtagtcccagctacttgggaggctgaggcaggagaatggcgtgacctgggaggcagagcttgcagtgagcagagatggcgccactgcactccagcctgggcgacagagcaagactccgtctcaaataaataattaattaattaaaaataaaaatgcaaaaaacattttgagctgaagggtcttgcaaaaagaggtgataggtagatttggccccgagggggtgggggttcacagacccctggcttagatggttctctctttgtttttgttttttgtggggttttttttgagatggagtttcgctctgtcacccaggctggagtgcaatggcacaatcttggctcactgcaacctctgcctcccgggttcaagtgattctcctgcctcagcctcccgagtagctgggattacaggcatgtgccaccacacctggctagttttgtattttcattagagacagggtttctccatgttagtcgggctggtcttgaactcctgacctcaggtgatccgcctgcctcagcctcccaaagtgctgggattacaggcgtgagccaccgcgccagagccagatggttctctgatcttgggtctggagcttgcaagggcggcaggggtgaggagcatgggggctgtgtttcaaggtctggggacccgcagctgtgtgaatgttacatgggcaccggtgtgagcgggcctgtccgtctgtctctctgtccctgtttgttgggggtcctgatctcaccccgttccccacccccaccccccagctgtcctgcagggtgagtacctggggcaaaaggtggccgtgaagaatatcaagtgtgatgtgacagcccaggccttcctggacgagacggccgtcatgacgtgagtcccagggtggggctggggaccgtgggacggggggggtcccagccctgccctcacgcccaccccaccgcccccaggaagatgcaacacgagaacctggtgcgtctcctgggcgtgatcctgcaccaggggctgtacattgtcatggagcacgtgagcaaggtggggcggggcccaggcggggagggggcccacgcagcggagcagccccaacatcccgcggccatctcccacccccaacagggcaacctggtgaactttctgcggacccggggtcgagccctcgtgaacaccgctcagctcctgcagttttctctgtaagtgggactctcagggtgctgcggcactggggtcgtcggggcgcagattccaagatccatcaaggggaaactgaggcacggggcagggaggctttgtgagcttgtggccccaggcaccccgagctttctgagccctgaatgtgggcatcctggcacctgagcccccactgccccctactacccccaggcacgtggccgagggcatggagtacctggagagcaagaagcttgtgcaccgcgacctggccgcccgcaacatcctggtctcagaggacctggtggccaaggtcagcgactttggcctggccaaagccgagcggaaggggctagactcaagccggctgcccgtcaagtggacggcgcccgaggctctcaaacacggggtgagccctgccttcacatacccctggggctttggggtccccccagctctgctgtatgaccctgggtatgtcccttggcctctctgaaactccaagggcaatggctatgcctccccaggaagctcttggcccataattgttcctcgtagcccccctctgggcctcagtttctccagctctgaaaaaggcgtgggctcaggactgaagggaagaataaccaggcttccttcatgcactaaggctgagctagactcaactgcgggcggcgttgggggaggactcaattaggagaagaccagagagtgagggtcaacccaggagggcttcctggaggaagcaggggctggagcagaaaacctgaggggtccctcctcacccccgtctcgggccccacagaagttcaccagcaagtcggatgtctggagttttggggtgctgctctgggaggtcttctcatatggacgggctccgtaccctaaaatggtgagcgggggtcccagggaggcactgggttccgggcaggtccagaggctgtggccctgacccctgcccacgcctgctgtccgcagtcactgaaagaggtgtcggaggccgtggagaaggggtaccgcatggaaccccccgagggctgtccaggccccgtgcacgtcctcatgagcagctgctgggaggcagagcccgcccgccggccacccttccgcaaactggccgagaagctggcccgggagctacgcagtgcaggtgccccagcctccgtctcagggcaggacgccgacggctccacctcgccccgaagccaggagccctgaccccacccggtggggcccttggccccagaggaccgagagagtggagagtgcggcgtgggggcactgaccaggcccaaggagggtccaggcgggcaagtcatcctcctggtgcccacagcaggggctggcccacgtagggggctctgggcggcccgtggacaccccagacctgcgaaggatgatcgcccgataaagacggattctaaggactctaggcgcctgtgtgtctctgtgtccccgtgccctcttccccgggggccacctttggtgatctgctctcggacacccccaggcgccaggcatcctgggtcctcccttagaggtccaccccccctagatgccctgtgtgccccagccccagtggtcaccttcctactctgtggaacccactgcagcccacatgatgggatcaattaattgggaccccactgatccttggccgagtcttgggcacccaccggccccaagcccctgcctcctgtggccacatgcctgcacacgggggcctccccatcttggcccatggaggatctgcccagctggcacctgcctgctggccactgtggggacaccgttccctgggggattctgggcaggggacccacttgccattacccacgggttccccactgcagtcccccagggcatgtggtattcagtggtgggcaccctttcccaacccatggggtcccaggcttaaaggatcttgggaggctgccaacagccctcaaggtccaagtctcccctcccaccacagccctttctcaggccccagccatccatatccctatgggagcccccatgatgggagccccaggagggtctgcatgtgtggcagcagccccatttagggatggcctggggaggccaccctcctcctcctcctgcctcccccattcatggccaggccccatgttgagtgctttcaggtcagacccccaaaatgccactggaggtgagtgccaggattacacccatttcacagacgtggacgctgaagcccagagagggcaggttgctcacactgggttgccccaagaaaatatggtagagcctggatttgaatctgggcctgtctgggtccacagcccaggcttcgttcccctctcttcctgctcctgcctctcccacttctgcatgtctctcacttctgcttctttcatgatggcctgaaccaatcatgaaaatctcacccatcatccacccatccatccacacccacccaatcaccatccacccatccatccatccacccacccaatcaccatccacccatctatccacccacccaatcaccatccacccatctatccacccacccaatcaccatccacccatccattcacccacccaatcaccatccactcatccatccacccatccatccatccatccacccacccactatccactcatccatccacccactcactatccactcatccatccatctacccactatccactcatccatccacccacccacctatccatccacccaccatccactcatccacctacccaccatccactcatccatccatccacccaatcatccatccatccatccatccgtccacccatgcatccatccacctgtccacccatccatccatccacctaccatccactcacacatctgtccacccatttatctacccatcatccatccacatacccatccatcctttcatccatccatccatccatccttccatccatccacccacccacccatccccctgtccccacccatccatgcatgcatccatccaccaacccatccacttatctatccatctccccacccatccatcccccacccattcccatgtccatccatgtacccatccattcattcacccacccatccactctattcatccatccctccatccactgttccattgatctacccacccattcatccatccctccatccacctacccacccaccatccattcacacatccatccacctctcctcttcacttaacaaagccaggctgaaggaggtgtcagaggctgtggagaaggggtaccacatggagcccccaagggctgtccaggccccatgcatgtcctcatgagcagctgctgggaggtagagcccgcccgctgggcacccttctgcaagttggctgagaagctggcccgggagttgtgcagcatgggcgtcccggcctctgtctcaggctgactgtgtgct

SEQ ID NO: 13710 - DNA, 12488 bp, Human
taaatttaggaagctgcttgctggaagaggtgatggtaaataagaagggcctgatggccgggtgggatgttgagcacctgccttggaggaagctaggcagggcacaggccggcaagtgggaagtgcgtgggtgaacgagtgcatgtgtgtgtcagggtacctgggtagctccgcagcctggctaggactcagcacggcttctttctcccacatacaagggctcaggggcctggggccataaggggatcctccgtcctgggcctctcccacctccttcctcccctacctcctgcagctccagtgccccgagctcccggccacagtgcccactgccggctccggttacccactcccagctgggccacgagcagctccagccgctccactctgacacctgatcggctctgagcaggcggccgccccagggggccggggatgagccgagggaggagacaggctggcagcggactgcctgttggccaactggctctggcgggaagacacccacgatcttccctatcatcactggactgatttcagtttctggaaggagccatgctcttcctctttctcagcctttgcacttgctgttccccccaccaggaacattctttctgtacttcatgtcaccccaaccggctctacctgactcatgcactctttatttatttatttatttatttttgagacggagtttcatgcttgttgcccaggctggagtgcaatggcgcgatctccggctcaccgcaatctccgcctcctgggttcaagcaattctcctgcctcagcctcccgagcagctgcgattacaggccaccacacccagctaattttgtatttttagtagagacggggtttctccatgttggtcagggtggtctcgaactcccaatctcaggtgatccacctgccttggcctcccaaagtgctgggattacaggtgtgagccactgcgcccggctcactcactttttagatctttgctgcaacatcccctcctccaggaagccctcccggatgcccccagcctgggtcaggtgcctcctgtgagccccctcactgccctgtgccctctgcatcacccattgcaccccaaccacaccatgtcaccattacctggtcacatgtttgtgtccacccgcagccaccagggcatagatggtaccacctttgctctccagtgtgcccagtacaaagtaggtactcaacacatgattcttaaatgagtcctccaggccaccagccccattgaccttgagcaggacctgtcctgcagaatgcagaacctccagttggatgatactcagataacttggccggacgcagtggctcacgcctgtaatcccagcactttgggaggccgaggcggtcagatcacctgaggtcaggagttcgggaccagcctgaccaacatggagaaaccccgtctctactaaaaaatacaaaaatttgctgggtgtggtggcgggcgcctgtaatcccagctactagggaggctgaggcaggagaatcgcttgaacccaagaggcggaggttgcagtgaaccgagattgcgccactgcactccagcctgggcaacagagcgaggctccgtcacacacacacacacacacacacacacacacacacacacaaatgagatattcaggtaactctgcgtggcattcaaaacccttaggctggggtccctgctgtccggctctgtccttacggaatttactaatccgtaaaaggggttgtggggacatggatagcctgtgtcccgcattttagaggtgactggagaactctcacgtaggcggccgccccaatttcccgcccgggtcatcggggagccccttcccaagccccgcaaacacctgcatgcaaagaggcaggcttccttctgacagcagataacatgtcgcctgcggcgtcagcaagaggcgcatgcgccttgccgtgggaggccgggtgcgcaggactggaacgcggttcctccttcttccccgccccgccccgcttccggcggaagcggcctcaacaagggaaactttattgttcccgtggggcagtcgaggatgtcggtgaattacgcggcggggctgtcgccgtacgcggacaagggcaagtgcggcctcccggaggtgagcgcgtctgagggtcccgagcatcgcgccccagggccgcgggctgggagcggccggatggcaggggggcattgtgggaatatcagggggcactgaggctagacaatgggagggacttcccagtgaggaaggggcgggaagtgacgcccctgcgcgccgggggacgccaacacgcccaactctgtggtcaccctgtcggggctgatcggggagagaggggatgtagttccaggaagaggggacgacaggcgcaaagggaggtgggaataaacacacctggagaacgattaggcctgggaggtttccagagccgggccaggacggggctcaaatgccaggctggggagttggcactttatcctgagggtgatggggaagggttttgccctggcgaggggactggacagaatgtgccagaaagatccctccagccactcagaggggaagtggagggatcggctgccccctccacgcactgtgggactttggggaagtcacttcccttttgggtctccatctccaaactttctgcaaacgaggtgaagatggccccattccataaggctggcccatgcattctgactcatgcatttaatgagcgctgatggtgtgcgcccgtccagaagccccactcttcactgctgctgttagtcactttattattattattattatatttttgagatggagtttctctgtcgcccaggctggagtgcagtggcgcgatctcggctcactgcaacctccgcctcctaggttcaagcgattctcctgcctcagcctcctgagtagagtagatgagactacaggcacctgccaccacgcctggctaatttttgtatttttagtagaggcggggtttcaccatgttggccagtctgctcttgaactcttgatctcaagtgatccacccaccttggcttcccaaagtgctgggattataggcgtgagccaccatacccggcctgttagtcactttattccaccaacatttatagagcacttactgtagctcaggcactttctaggtactaaggccacagccaggagcaacacagattaaaaacccctccttctagtaagggagactgactaggggttgcatggaaaccagttggccaagggaggcatcactgtcactgaagtgacatctaagccacaagttacaggaggtgagggagggagccatgtgggtatctgggggaagagcattaaagggtgtggccctgaggcgggactgtgcctggtgtgatagaggaacaaggaggagacctgtgtggctggagcagagtgaggcagggagagggaggagaagagggcagggagggggcaagggaggtagtgcagggcctggtgggccgtgggaagggctagggctttgacaaggcaggtgggaggcatggaaggttgtaggaagaggaggggcatgaggacaagctgccttttccaatccattttcctccctcaggcaagacagggacagctcagtctgtggctcgtgcgtggccttgccacttgggggaactgttttgacccctccgtctgctctctccccccacagatcttcgaccccccggaggagctggagcggaaggtgtgggaactggcgaggctggtctggcagtcttccaatgtggtgttccacacgggtgccggcatcagcactgcctctggcatccccgacttcaggtctgtgattgtgcaggggaagtcgaggcaaggcctaccaggctgccagaggcttccctgcgagccacacacatctgggaatgagaacccatccatctgctttcctcctggatgtgtcctgggtactccctttaagatgtgtcccttggctgggcatggtggatcacaaggtcaagaattccagaccagcctggccaatatggtgaatccctgtctctactaaaaatacaaaaattagccagttgtggtggcacacatctgtagtcccagctactcgggaggctgaggcaggagaattgcttgaacctgggaggtggaggcagtgagccgagattgcaccactgcactccagcctgggcgacagagtgaggctccgtctaaaaacaaaacaaaaagatgtgtcccttgtcacaaccagcattccactcacctcattggccagaacacggtcacctgatcacacctggctgcaagggttgctgggaaatgtagtctttcatatttgcaagcgtagccaggtgtggtggcaggcacctgtaatcgcagctacttggaaggccgaggtgggagaatcgcttgaacccgggaggcagaggttgcagtcagccaggatcatgccattgtactccagcctgggcaacagagccagactccatctcaaaaaaaaaaaaaaaaaaaaaaaaagccaaggcgtgaatttctcctccttctcctcttccataacctgctgtggctccccattgccaggcagtgtagagttctgaataccttgtgctggaagctgaagcccttcctgccccagccctgaatcacctctccaacttcagcccctcctgctcctgctgcagcccccaaaacacttgcattttctcctaaactcatgggctcttcccagcacccaggcctttgtttaccccttctgtctgatcttccctctcacccttcaagaaactgcttagcctcctccaggaagcccttccacgtgccccagggcccccacctccacggggcttccccaggcccaggtacctcctctgatccaggcttgactcttggggccagaggatctgtgtccacctgtctcccccaagatcaagggcttctggagggcagggcttgggcccatgtgagcatcgtcgggctcattgcagcagcagtgttggttgaatagaataagtcatttttgccttcgtgtgaattcatctctctctctctgcctctccctctctctgtctctctccaattctgtctctgacttgctttgtctttaactctttatctctctgtctgtgtcttgttctatccccctctccctgttcttgcaactcaccctctatttctgtttctgattccctctctctgtctccctgtctctctctgtctcctgattttctctctctccaactttctctctatacctctctgattctccctctgtctctttttctgttcccctctccccgtccatctctcccggcctgccaccttcaggggtccccacggagtctggaccatggaggagcgaggtctggcccccaagttcgacaccacctttgagagcgcgcggcccacgcagacccacatggcgctggtgcagctggagcgcgtgggcctcctccgcttcctggtcagccagaacgtggacgggctccatgtgcgctcaggcttccccaggtaacaccctggccccgcccccacaaaagagcttggggccccacaaaccgtgtttgcatttttagggggagagtccccttttcctggttctataagattctagccctgagttcttggcccagtgtgtggagatctctgagtcccatggctcagagctgtcccggctgaggccagaggcagaatttccctcgagatggggctaaggggaggagagctgtcagggtctagaagttgcagtttgttttttgttgttgttgttgtttttgagaccgagtttcgttcttgttgcccaggctggagtgcaatggcgtgatctccgctcagcctcccaggttcaagcgattctcctgcctcagcctccctagtaactgggattacaggcatgcgccatcacacccagctaattttgtatttttagtagagacggggtttctccatgttggccaggctggtcttgaactcctgacctcaggtgatctgcccgcctcagcctcccaaagtgctggggttacaggtgtgagccaccacgcttggcctgttgtgtttttaatatccatctttattaatctgacactaaacgtgtctgacactgaagtgaacctgtgctctggggcaggctgatttcccaataaaagtgtggccctcccctgcccctctttgccaggtctcacccctggggcaaccaatgacagccaggtcagttgttgagacgaggagctcggcagccaggggtgaggggtgaggaagagatttttctctgcttataaaagcaaacgaggggccgggcatggtggctcacatctgtaatcccagcactttgggaggccgaggcaggcggatcacgaggtcaagagttcgagaccagcctggccaacatgttgaaaccccatctctactaagagtacaaaaattagctgggcgtggtggcgcatgcctgtaatcccagctactcgggaggctgagtcaggagaatcgcttgaacccgggaggcagaggttgcagtgagccgagatggcgccactgcactccagcttgggtgacagagcaagactctgtcttgaaaaaaaaaaaagcaaaggagggtcaggtgtggtgacttatgcctggaatctcagcactttgggaggccaaggcgggcggatcatgaggtcaggagatcgagaccatcccggccacatggtaaaaccccgtctctactaaaaacagaaaaattaggctgggtacagtggctcacgcctgtaatcccggcactttgggaggccgaggcgggtggatcacaagctcaggagatcgagaccatcctggctaacacggtgaaaccctgtctctactaaaaatacaaaaaattagcccggcgtggtggcgggcgcctgtagtcccagctactcaggaggctgaggcaggagaatcacttgaaccccggaggcagaggttgtggtgagctgagattgtgccattgaggttgtggtgagctgagattgcaccattgcactccaacctgggcaacaagagcaaaactctgtctcaaaataaataaataaataaaataaagctgggattggatctcatgcttcagggccattcaatgtctcggtttcttccattataaactgggaatttgaattcctgtgcttctgacctggtgacatcaagaggttcccatatgctctcggagggggacgggcattttgtgagtggaaagggcttcccgttatctaaggtgggttcagccttgggggttaatgattccttgggctcagagaggttgggccacttgcccagagatgcacagcagatgaatggtggagccaggagctagaagagccagaaagaaggagttgatcaatgttgtgggagaggagtccgggaagccttcctggaggagaggggcttagcaccagctccaaagcctgggcatccagggatcctttcccaccatcaagcctcttcctgctcttcccacagggacaaactggcagagctccacgggaacatgtttgtggaagaatgtgccaagtgtaagacgtgagtgccacctgggtgcaggggcgggggctctgccagagggggttgggggtcgaatccgatgtcccagagacccagagggtatggggggactggggtgtggccctcctggggggatctgggggcgtgtctccctcttggggggatataaggagtatgtctccctcctggagggatttggggggcatgtcttcctcctggagggatttgggggggccgtgcctccctcctgtggggggtacatccgtgtcctggcactgctgtagcaacctgccacagatgagcagcgtagaacaatagaaatttgtgatctcacagttctggggaccagaagtccaaaatccaggtgtctgcagggccatgcccctctgcaacctgtaggggaggatttttcctgccttttcctggctgctggtggcagccagccacccttggtggtcctggacctacagccacaggggccttcttatctctgtgtttctccttttttttgagacagtcccgctctgtcatccaggctggagtacagtggggcaatctcggctcactgcaacctccgcctcccgggttcaggcaattattctgcctcagccatccaagtagctgcaactgcaggcgcccgccaccacacctggctaatatttgtatttttagtagagacggggtttcaccatattggccaggctggtgtcgaactcctgaccttgtgatctgcccgcctcagcctcccaaagtgctgggatgacaggcgtgagccaccacgcccggcccagtataacgattaaagtcaggaaaagtaaagtggacatcgccttctctaatcccgaatccagactcggcctgtcgcccccatgctccaattgttcctgtttctcctggtccgggatcccatgctgggtcttgtctctcgagccccttcgtctgtctgggacagtttcctgctttgttttctgtgctccgggcaccgagcagcatcccagcccgttattcgtggaaggctactcgttccgtgtcgctgggtgctagttctggtcacctgtccaccccccacctccctgggagaacgtcaccctagaaacagtgcgagagtcacccatgggagctcacctggtcccatcctcccccttcctccctgacacaggcagtacgtccgagacacagtcgtgggcaccatgggcctgaaggccacgggccggctctgcaccgtggctaaggcaagggggctgcgagcctgcaggtgagccacccccacccatgccctgggctccaggggaggctgcgaggcccctgaggactctcctcagcttcctcattgcaggggagagctgagggacaccatcctagactgggaggactccctgcccgaccgggacctggcactcgccgatgaggccagcaggtctgaccccccacccccagggagcccatggtggggcggggcgggacgacagcagaaacacagccagctccagcatgggacagtggctgaggctcacaggcagtgaggggaggcttcctggagcaggtgggccaggccaggggctgcacacacgcactcacacacactcgtcacctcatggctctgggtgggtgctacacaaggaaaccaaggcttccgccaggtgtctcctctatccagtgctgcccagccgggaggtgaccgagccagggtcccaccctaggtgtccaagctcttaccacactgtgatactccccggaagtgtctaagggcccgcccagatcaatgaccccgccaacggaccgcagaggagggcagggcgggatcccaaaggctgactcgggagtggggctggccttgaccgccccggtgagcacagatggcctaggtgtgaaccggcccccagggctggctcgggatgttggcaggagcagggcatcaggctcagcccacgctccccggccccaggaacgccgacctgtccatcacgctgggtacatcgctgcagatccggcccagcgggaacctgccgctggctaccaagcgccggggaggccgcctggtcatcgtcaacctgcagcccaccaagcacgtaggtgtctgagcctacccctgcccagggccaccatgcaccctctgtcccccacgcctgacccgtcccgccccccggcaggaccgccatgctgacctccgcatccatggctacgttgacgaggtcatgacccggctcatgaagcacctggggctggagatccccgcctgggacggcccccgtgtgctggagagggcgctgccacccctgccccgcccgcccacccccaagctggagcccaaggaggaatctcccacccggatcaacggctctatccccgccggccccaagcaggagccctgcgcccagcacaacggctcagagcccgccagccccaaacgggagcggcccaccagccctgccccccacagaccccccaaaagggtgaaggccaaggcggtccccagctgaccagggtgcttggggagggtggggctttttgtagaaactgtggattctttttctctcgtggtctcactttgttacttgtttctgtccccgggagcctcagggctctgagagctgtgctccaggccaggggttacacctgccctccgtggtccctccctgggctccaggggcctctggtgcggttccgggaagaagccacaccccagaggtgacagctgagcccctgccacaccccagcctctgacttgctgtgttgtccagaggtgaggctgggccctccctggtctccagcttaaacaggagtgaactccctctgtccccagggcctcccttctgggccccctacagcccaccctacccctcctccatgggccctgcaggaggggagacccaccttgaagtgggggatcagtagaggcttgcactgcctttggggctggagggagacgtgggtccaccaggcttctggaaaagtcctcaatgcaataaaaacaatttctttcttgcatctcagtgtgtttactttattttattgagccagagtctcactctgtcaccaaggctggaatgcagtggcgtgatctcagctcactgcagcctctgcctcctaggttcaagcaattctcctgcctcagcctccagagtagctgggattataggtgtgtgccaccacacccagctaattgtttgcattttttgtagagatgggggtctcactatgtgactcaggctggtctcaaactcctgggctcaagcagtcaggccaccttggcctcccaaagtgctggacttaacgggcgtgagccactgtgcccagtgagtgtttaaattccctatttgtggcaggtcctcgcccccctgggtcaggagttcgtggtcccctcctccctggaccagctgcttgggctccgttgcaatccctgcccctcaagcctgggggccgaggaacaagggctcacctctccccccaccccccctctggagggatcaggccagttttctgatgatgaagccaataaggcagctggcattttctgagcactcagtttgtagttatacacttatgcacatgctttttgttgttgtttaacatttacccccaggctatgagtccccacctgtgctttgggcgcgattttgcgatggcgcccgggcaggcgcgcacagcccgcagtgggggcgaccccacagacgagcgcaggagcagccgggttccactctccccagctgtgaccttaggcagtccctccacttccgacgcctcggtgtcctcgcccgcaaaatgagcagggtgggccgcccagatccccgggaaggcagctgccttccccgcaactccggaggggacaccttggaagcgccacgcctgcctccccgcactccgcccgccgccgctctccaaggtgctgaagtcgtgcccggcgcctctccctccgctgctccagcgcgggcatctggcgggggtgtggagcccacacctcactcacccatcccaggctggcccagcccctccttctggggagtcgaggagccccagactccgcctccacaccaaaacaaggttctgtcaaaatactttatttcggatcaggcagtcttagaaaaggggggtgattgtgggccgtggctgctccaaagaccagggcgcacccggggctccggggccaggctccctgcagtctcggcggcttcctcctcccagtgtgcgagggaggccgggaggggtccctgggcggggagttgctgcgcatctgttgtgtgtgtgcgtctgtctgtctgttcaggtctgtttcagactacgtctgcctgtctgtccaggtctgttttaggctgtgtctgcctgtctctctgtctgggtctctttcaggctgcgtcggtctgtctgtctgggtctgtttcaggctgtgtctgtctgtctgtctgggtctgtttcaggctgtgtctgtctgtctgtccgggtctgtttcaggctgtgtctgggtctgtttcaggctgtgtctgtctgtttgtctgggtctgtttcaatctgtgtctgtctgtctaggtctgtttcaggctgtgtctgtctgtctgtccgggtctgtttcaggctgtgtctgtctgtctgtccgggtctgtttcaggctgtgtctgtctgtctgtccgggtctgtttcaggctgtgtctgtctgtctgtctgggtctgtttcaggctgtttctgtctgtctgtccggatctgtttcaggctgtgtctgggtctgtttcaggctgtctgtctgtctgtctgggtctgtttcaggctgtgtctgtctgtctgtttgtctgggtctgtttcaggctgtgtctgtctgtccgggtctgtttcaggctgtgtctgtctgtccaggtctgtttcaggctgtatgtgtgtctgctctttgcttctgctcctggctctgtgtgtatttcccgggtcctgtggccctctttgccttgtgtctgagtgtcggttcctgcgtgggcctcagtcaggccctgggtgtgtggcta

SEQ ID NO: 13711 - DNA, 46257 bp, Human
ggaacactgtgccctttccttcccaaaccctcacccctgggcctgaccctggagtcaagaactgcacttggcagagttcagagagaagtcgcctgctctcaagcctgggtcggcctggagaaggggagaagccccatgttgcatagagattaagcttgaattcgttcccaggatgggacctaagcctgggaggatccccaccttcaggaggtgatggtgccattcactgggatagggaaactggcaggaggagccggttgttgagggttgggggtgcagacagtctgttggtcccattggtcttgaggtgtgtgggggacaactagagagaactattgtcccctgcttccacgaggtgacatctccctcctgccttcagctctattttagggatcaaggagtccttggagctgctcctaggcattctcataagggccagaagagctctgcatgtctgtccagcggctctgcagagttaaggctgtgggtcataccagccacaccctcagcgtggtccatgtcacagaaacatgtggaaaccaggtgatttcccagcctcctggtcaggaggtggggttttccatccccagggagtcacttcccagtttctcactcagcactcagcacctagaagcaccatccttgcaggctccactgtggggctggtggccgggagcaagggtctctgtacctcttcaggcagcctgcagtgaggaaacagggaacagaatagcctcctgccacccagcccaccccaacccttagaaatgccctatgtgctgggggctaggacccccgtaatccagggctggaggaatgtgctctggccccgcagggctggccctgtattagggctggcactcaaagtggggatggggggacagattgcagctggaatgggtgctcggtcatgatgtaaatcctggggaagccagctctcctgggcctggtctcagcagcccctcagggccctgcagcttccctggtgacattctctcccagcctctgttcatctgccccctgcctgggcaggagacttgagcagggaagtgcagagtcttctccctgtgagaaggctggatgcgtgtttaaggataaatgaacacgcgaagagtagtaacaacagccaagatttataaatgcctattgttatatatgtagatacttacttaagtatatataaagtacagactgcattatgtatattacatatctttaaatttttagaatagtcctatgaggtcagttcagagatccagacccaggtggtctggctctagagtctaaacaggccgagtgcagtggctcacacctataatcccagcaccttgggaggccagaggcgggaagatcacttgagggtgggaagaacacgtgagctcaggagttcgagaccagcctggacaacatggcgaaaccccatctctataaagaaatcagcctagcatggtggcccgagcctgtagtcccagctactcgggaggctgaggtgggaggatcgcttgagcgcaggagttggaggctgcagtgagctatgggtgaaagagtgagaccttgtctcaaaaaaaattaaaaaataagaattaaatatatttaaaatagagtctaaataagtgaatgatctagaattctcttggttcccctaaagcagctgtcagctttgggggatgtttttccaaattagtgcctcaccctcacgggacagggaagcctgtgggagctgggagggcaggtggaggccgggcaggtggaggccgggcaggtggagatggtgattcgaagaggaggggacgataggaggaggttgaggggtcacccgagtgctgggagtgacgctggaggtatcggcccagcgatgctggagtggtcgggtcggaggcccagcagcagcgtctggggaggggcgtgggggaggcgtgtccaaggccggctggccccgccccgccccgccgcctggcctctggcccgctggggcgcgggctttcgctttcagtcgagggctagcgagcgcagcggagcctggagagaaggcgctgggctgcgagggcgcgagggcgcgagggcagggggcaaccggaccccgcccgcacccatggcgcccgtcgccgtctgggccgcgctggccgtcggactggagctctgggctgcggcgcacgccttgcccgcccaggtgggtgactcgcgcggcccacgggggacagccgccccgcatgtccacccggctggtgcgcagccttcgggtgcccgggccgcgctctcccggggcgctgtcacgggctgggaggctgggagtcccagtcgccgccccccatccgcatcagacacgcgcgcctctggggacccgctggggactccgggcccggcacacgtgcgctcggggcacaactctggcccccgaagcccctcttacccgcgtcgtgacaggggcgcaccctggttcctccgcgagcgcaggccggggcatttggggctgagcagcgggtcctgggcagacccccgctagacccgggacccctcttccctcaccccggcgactgccgcgacagcccttccctcccacgcggtggagaaggggctgtgccggggcgctgccccactgcccacgccgggcaccctcttcaaaagacttccttttcctctgggcgacggttttccgatttcttagaaataccagggtcctgtgtctgaagagcaggaccaggtgtgtgtcaggtccactgagggcacagctggagggcgagctgcctgtctgcttcctccgatgcgtccgggggctactgcagagtctgttttctgcggcctctggggacagggcaagcgagggaggtctgggctggtaatcgagcaaggcaaatgaagtctccgggggccgcaggaaaatggagacagcagaaaccctagggctcctattcaatatgaacgtcactcccacagtagcaacgggcgtacaagggactgtgcaccctttgcctgtttttgactgtctcctggtctggtaacataggataaccccatttttgttttactgtctccatggtttggtaagataagataaaccattttttagagaaggaaaactgaggctcagagaacttgtatttcatggaagggtctggggggaactcttcctccaaagggggcctctcctgccttcggcccctgtgccctgaggctgcggggaaggtgggcgttcatccttcctcagagccgcccctgatggacacatggcccatctgcccccatctgacatcttgaccgaggaggaaggtgggaggtggcactggcttctgtggtgacataaggtgacttgttgatctgaggccagagagtccagttcttgtgggtggaagatgggggctgtcagactagaattgactcaccgacagtgggtgtcaggagtgggtcctggagaactgccccagagtaagtcctgggtggcctttgggtcaggagagtccccactctagggccgagtgtgaatggggacgaccgtggtccccagcttgactttggggtcatgccatatactctggcctcagagggggtcttcctgccgctgagcttgggcctgcctgggtgaactctggggtcatgtgagcccctggatgggagaggggtgtcaggcacagggctcagcaggacaccaggctgcagtcctggagtagctggaggaggttccctcccacttccttcccttcctgaccagctcctgcggcagctcatattccctcctccctcatccctgctccccacgaccccacccggactattgccgcagccttgtagctggtctcccggccctgccccctctcccgctgatccttggcagagagacccttctcaagcatgaggcacctctctgtttgcctggggagcctcctgtggctcccaatggttgaggcagaaactcccctggagatcccaggccagagtaaggtacctgaactcttcctcgcgcctccctgcacatgtgctcccccgcctctgtagaactgatgatggtcatcgtgtgtgtcattgtgcaaaaagcattgtccgtgccatcccctctccaagggacacttcttacccctatccttcaaggccttctgcaaatgccattctctccaggaaagcctttccgcattctcagttggatttgatcttctcttcgaactcccaggcccttttgttccctttgaggacagattgcattctgctttttaatctagctgtgttttatccccctcagtggatggaaggtgtcttcagggccagaactgtgggttcctcttccttctcatcagtagcatcgccatagctcctgatttctgaacacccactaaacaccaggcactgggctaggtactttgtcacaaaatttcactgaaacctcccttacagcaactcccaagaggtgggtggtgccgtttgtctttagagatgtggaaactgaggcgtttcccaggatcacagagctgggggccggggagctgggggtgggatttgaatgcaggtctgcctgattcccaagctcctttcactgcaccctccccgtgcccgtatctgcactcatgctcccagccaggccctcacacacagtgggttctcaggatggaagtcaactgagctgcagaagaagcccccaggagacctgagctagccatggacgcagccgactcactgccagcagggcttttgccccgtttaaaagtcttatttgccagctggtatggaaaacatcattcattcatttagccatttattcatttgacaaagaaatgccagtaaacctggcagtaggtgagtgcttggtgccctctgatggggatgagcagggtctgggctgtctggggaggaggatgaggggtctctgcctgatgggcctggcccacctacccctggaagtcttggtgctgaggtgccactatttgcctcctcatcacccagggcctggggccagtttgggttaggggagaggttgggggctcccaggctggatgtcaaagaggagttgggtgatctggggtacctgctggccctgggggctcttccctccttccaccacgtctctgtctctttgccctctgtctgaaatcccagtggggaccctgtgtgttgactgagggtgtggtctgttggtcaggcacgtcttcagagggcaatgggtaggtggccaggcaccctgaggcagggccattcattcattcattcattccccaaagttcatggacacacctagtccaagcccagcccagtgcctggctctggggacctcaagatgactccagctccaatcctctaggagctacactaccaataggtcacagacctcacagacctgggctctgtcccaactgcccttatgagcttagctgagctagtaagcctatgttctcatctgtggttgtggaaagtattccctgcctggcctttgtcacagagccatgggtgtgaaaggctgagaacctgccgggcattcttacgtcagaggtgaccctgccatcctggcacctggcacagtggctccccgtagcactgtccctccccacggctgggtgacgctttatggtccttactatgcaatgttttctggaggagtagcagggacggttgtgcgtgggaaggggaagagttttgccggagccatggcatgtatgttacacccgactctacaccaactcacttcttactttttttctgagatggagtcttgctctgttgctcaggctggagtgcagtggcgacatctctgctcactgcagtctccatctgcctcttgggttcaaacgattctcctgcctcagcctccagagtagctgggactacaggcatgcaccaccatgcccaactaattttttttttttttgtatttttagtagagtcggggtttcaccatattgcccaggatggtcttggacccctgacctcaagtgatcctcccgcctcagcctcccaaagtgctgggattacaagcatgtgccactgtgcctggcccgttctcacttcttcttctttttttctatttaatttttttttattgagatagagtcttactctgtcacccaggctggagtgcagtggcccaatctctgctcactgcaacctccacctcctgggttcaagcaattttcccacctcagcctcccaagtagctgggattacaggtgtgtgccaccatgcccggctaatttttcctttttttttttttttttagtagagaccgggttttgccatgttggccaggctggtctcgaactcctgaactcaagtgatccacctgcctcggcctcccgaagtgctgggattataggcgtgagccaccccacccagccccattctcacttttaagccatgcttttctgtcctcagatgtgctgcacacacacctgctccagggcctttgcacttgctttccccatcacctccaatactcctcctgctgacgtctcttggtctccttccctcgcttccttctgctgaagtagacaatcctgcctgtaggtgctccctgccaggcactctcactccctgacctgctttgtattcctgtataatgctcttgacctattctatttatttcacttttattatgtcttcccacaagattgtaagtaccgtgaggacagggactcattcaccactgtagactctagcctagaagagggtttttcagtcagtgcctctgactttaattctttgttgtggggctgtcccgtgagctgtaggatgtttagcgacatccctggcctctacttattggatggcagtagcgccaccctccctcgtgacaaaaatatctccagatattgctaagtgtcctttggggttgggggattgcccctgattgagaaccactggcctaggacagtgcctggcacatagtaagtgttcaaaaaatattcatctgaccttgaccttgataatggccctgttttacagatgagacgggggtttgaaaagtcagtggtggcagggtggggttctgtttgcctccatctcttggggtatttttctgggctcctcttcccattgagtggtgtctgctgaggttaggggtcctctccccaaattgctcaccccctcgacatccctcgtgtagtgagggatggggccactcactgacggtgactcagggccccagaatgcatgtgatttacccagaagcgggcaaggagggaagctggggtttggggtgccggggatgaacaggaacaaaggagaggcgctgtggctccccgttctggaccctcgtctggccacagggaagcagcactgatgactctggggaaaggccccggcctctgaatcagataaacctcaagtcgctgctctgctgttttactggctgtgtgacctgggcaagtctttctatccctcggagcctctgtgttcttatctgtaaaatgggagtaatcctagcctcacgggctggctgtcaggattaaaagtgctttctaatcctggcattggcagctatttgagccattggtggctttgcaggtctgacccgactctctgggccatggggtggtgctcgggcctaggtggggacccctgtggagtcagactgtctgctctgagccccagggccctgaagcttgggtggcagccctgcagttgcccagagttcctgtctaagtggctttgttgcccatcatctcagaaagcaacttctttcctccctgccttttcctgtctgtgcttctgccccagtgccccctggctgggctctcaaacccactgcttgacagcctggtcttaggacactgtattgtggcaaaggctgtggggtcaggatatcccctcccctccctttgccaccccttttagtgagtaacaggtgctgtgtgttttggggatgagtgaagggtacatttggtgaagcacagagagagtgcacaaggcttcagtttgcaagatgggcacgggaagattccaggccatctccaaaacctcttccatctccaacctctgtgctgctgaaggttctgtttacttgtgaccctgagaaggggatgccctgtgggggctcttctgagatcatgctgtccattttcctgcctccaagtgacttctaagacagcatggctctgaggaaggagcactgacttgggtgttgggagatcacagttcccatctgagcaccgtcactggcttgctgtgctaccttgcttgggttacttaacctctctgggcctaagcatccctatctatgaaacctaacaaccctggttccaatgctttcctagaatattggggaagtgtcggctttgagtatacttgacaaaggccacagattgggggtggggtatataaaagtctacaggaaggagagcccaggactccccactgtcaatatcttggttccccagcttctcttcttcttgctgacctcaatctcacttgctttgggtggattgatttcctgactcaggctccagggccatcaagaattcacggctgcctttcagccttcatgaaggacatggtggagctccttaggcagaactggggtttgtggatgtcctgcctctctgccccttggtacctaggtggcaccttttcaagttcgggagctagatcctttccccttccccacactgtaggaaagtccttactgtaggcaggcgctgcagagcctgctgtctgggaacccacaggttcaaggaagccttgagcaggaagggcgttttcctggaagaagccctttgtcgctggtaatgggtgcaggctgctctgacccggttctgagtcctgcccccttccaggcctagggctttgggccttgatcacctctgctgagtagctgactgcggggctggggctctgatgctcaggacccacctctctgggacccacagtctttttccactgtggcgtgtagtgatgtcacaggtggcagtgatgtcactgtggtttgaggtacttggctgtgagccccggaggaggaagtgtctgttcgctgatggggggttggaagagatcattgacttctgccccaagcgtgagccccaagtgtgcaggggggagtgcggggggagggctgttggcggcgcatcccagggctctggctctgcccttgcatctagcctgtctttcctgtgggctgtgacaagccactctgcatctctgagactccatttcttcttcttcttcttcttcttcttctccttctccttctccttctccttctccttctccttctccttctccttctccttctccttctccttctccttctccttctccttctccttctccttctccttctccttctccttctccttctccttctccttctccttcttcttctgatggagtctgactccgttgcccaggctggagtgcagtggcgtgatcttggctcactgcaacctctgcctcccaggttcaagctattctccagcctcaaccttccaagtaactgggattacaggcatgcaccaccacacccggctagtttttgtatttttagtagagatggggtttcaccatgttggccaggctggtctcgaactcctgacctcaagtgatctgcccgccttggcctcccaaagtgctggaattacaggcgtgagccactgcgcccagcttccatttcttctttgaaaagtaggaggggttggaattgtcaccctggaggttcatggttgctagattattgattctgttgctggattcaggagacctgttagctggctagttcacagcaagtattgggtgtttggaggggggctgcagagccccttctcaggccccaggagggccagctgccctccctaccccctcttttggacactagtgggcatgttctgctgggaaaacagacagtgtaacctgacttcgagggctgcaggctgaatctctttcagatgtactggctccttgagaggcctagcagatctctactctgtgggtccctttcggagctggggctcaggtttgacccagccactctgaccggagacagcgcagaaatcaccaggagcatttgtttgttttcctttgctgtccagacagtggcccaccgtctgcttcagtctgagcgtggccctgcactagtgagactgatgtggccacaggttcagagaatcagtgcgcctgagtgggagagcagagcgggaggggatttggaggcaggcgggctgtggacagggaggggggaggacatcttccgagctgtcagcgggaggccttcttgaaggtctttcaggagcaaggccagaggccgtgggagtgggcggggcctggggctgggagtcaggggtctgaggcctcatcttggcccggcctctgcttccgggagaacttggccaattcccttctcctttctgaaccttggtggccccagctgtcacttgagattagcaaggacctccctggtcccagcaggagtgagtggctttgggcagggggtggagtgcagattgcactgccacgtcacccagctcagaaggcccaggtgtggtccagctgtggacttgattgtgaactcctggggaagggctctggtcctttgcctcagttagcgggacccccaccagtgccctgggtgcccctgctggcccctcctctcgctgaccccagccccagtttctggctgcaactcacagaggccccaggctcctgtggccccatcaccagcagctcctgctgtcatttcctgagcctcgcaagcccctaatcctgctccttcctgtcctggcccccagctccctcaagccccactcctgcatcccattctccctggacatcacccctcccaccccttggctcaatttccttcctgtcgtggcttggtcctttggtcattgccctggtcttttcttgtccccttcctgattctgcccttctccaggcccacacggggaacctcctaaccgctgagccctgaaaggtaggcgggtttaggatgagtggctacagggaggagaatggtgtggggagagagatatggaggaaagaatattaggggacaggccgggcacggtggctcacgcctgtaatcccagcactttgggaggccaaggcgggcggatcacttgaggtcaggagttggagaccaccctggccaacatggtgaaaccctgtctctactgaaaaaaaaaaaaaaaattagccaggcgtggtggtgtgcacctgtagtcccagctacttgggaggctgaggtatgagaatcacttgaaccccagaggcggaggttgccgtgagctgagatcgcaccattgcactccagtctgggtgacagaacgagaccctgtctcaaaaaagcaaaacaaaacaaaacaaaaaccgaatattagaggacaatgttaggactgtcccagctgtcctagctggagccaaaggtttgttggggacagtgacagcagcacacgaggctgtaagtttagggccagtttatggaggagtagtaccaattacattgagaaaactgtagcaactataatttgggaggaattttctaaatactttacatgtgttatttaatcttcccatcagccccaggaggtatgtgcatttatcagtcccattctacagatgaaaagactgaggtctatgaactcctttatttaaaaacaaaacaaaaccccctcaaggctgcctgctaagaggggaggagtgtggattcaagccagcatccttattccagtgtccatgctctcagccaccacacacacactcctatcaggagttggggcagtggggagccattatagtttttgagcaagagagtgacagggcaaagatcactgtggcctcagtgtgaagcacagatgagatggagagactggaggcagggaggcccatgaggaggctgtcaacatggttcaggtgacagctctgggttggtgaagaagcagagaacaggaaggaaggggcgagaggcttgagggaggaggaggaagcctttggactgggccgtggatatagggtgggaacataggaggtgaggagcatgctctctccacctgctttttgcaacatgcggcctctctggccttagctctgcctgtcctgagccctgagccctgagcccaatggaccgattctgttttttttttgagatggagtcttgctcttgttgcctaggctggagtgcagtggtgtgatcttggctcactgcaacctctgccttctgagttcaagcgattctcccacctcagcctcccaagtagctgggactacaggcgtgccccaccacgcctggctaattttttgtattttttttagtagagatggtgtttcgccatgttggcccggctggtcttgaactcctgacctcaggtgatccacctgccttggcctcccagagtgctgggattacaggcgggagccaccgtgcccggccccagtggactgattctggtcagtgtcaaccccatttgtccctggagcttttgcagtcggtcacagggccagcccggtcctggtcaccgctggctggttaccccggctgggttgggcaggagtctgggcagggctggttgctcatctcaggtatgaaattggctgcacccccactagtgtgggggagcaggattccagggcctgcctggcgctgctacccctgtgcctccagacccctcgagctcctcccagacctttggcttcgttgactgtgaggtgaaaacaaaagggctgctctctgtcacttcccctaggggcgggcagatgctggcagggcacagagagccgagggctaagagctgacatttagcctggctactcaggagactgaggcaggagaatcgcttgaacctgggaggcggagtttgcagtgaaccgagatcgcgccattgcactccagcctgggtgacagggtgagattctgtctccaaaaaaaaaaaaaaaagaagagctgacatttagcgggtgcttcttgggtgcaatgcgcaagagaccgatgcattaactacacagagtgcccttccttgtcacagctacctgggggcaggggaacatcatccccattttacagaagaggcctttgaagcacagagattaactgacgtacttagggttttgcagctcactagaggcagagccaagactccaccccaggtggccaggctcctgagcgctatgcctacctcaccctccaatgaggtggtggtggaggagaccgtgagccgctgtcacctgaacactggtgcactcagtctgctgctctgaggacgccgccccctctctttgtaagtccatttcctgcccatttctcatgctagctccagctcatttcaactaattgaaaattaaaactttgcttctgttgagcaattcggcatcgatgagacgccagctgtgggctgtgtgctggctgtgtgtagggtgatgagtagcagaagcacgggtgacactgagctctttccactgccgggcacggtgccaagcacgccacgtatactgacttcatgaatcataaagccctgtgaagggggcactgtttctgtcgccattttatagatgataaagtggaggtgggggaatggcagaactgggatcaaagcccacgtgtctgtgtctggctcagcgcccatacaagggtgtcaaggttgcggggaggcacgagggaaccaataattaaccaaaactggtcgggtgtgggcagtatagagatgcacccgggttgtcacaggagcccctaggagggacctctgacctccctgaaatgatggcagagggaactcttgaaagaagctgagaagtcagcactgccaggtcgggggtggcgggtcaggacgtttgggcagaggcagcagcagtacgggcatggagaagggggcggaggagccaggtgctgctttgtgttgtgacagcaacaggtgagtgatgaatacaggtgggagatgctggcaggggctaaggaggttgcgcaggtggtggcagccgctggaagcttttaaggagagtcaggcttgattgtaggaagggggcttaggtccatctgaaagggacagaaggctgggaaccaagaccaaggagcctgcagctggcaggagatgctgagggcagcgaggaggaggggtcgtgggagatggagcaggcgacatcagcaggccccttggagggtgacggtgggagaggctggggcgtctctcattagactcagggttccttgcaggcagggaccatgcccggcgtctttgtaccctggcatttagcacaaagcctggctccaagaaccggataccagcccagtcttcctgtctgcccccagctcatttctaaagcaacatcacaggcagcgagtcgggagtgggatgtgtcacccccgggttgcctgcctgtgatgtggtcagtccttcctaacgcagatgccattcctctccgtgacggcagacgggcctccgctgtcactggccctggcgttgctgtgacgacctggcctgatgtagctgcaccctgcagtccatggggctcctgtgaacccccaaggttgagacccaaatgcctctgctgcctcccaccacgccctaggggccccgcgacccgccatgcaaatgacgtggtttccgcattgcttgaagagggtttcctctgtgtgggggtccctgggtccttgggcagatacctctgcccctccccacagctttggcccctgccctaagaccctggagacccttttgcctgggagagtcactgaaccacctgcccctgctcacagtgtgttcacagaagagtcactcccctctgtgggctccttgtctgtaaaatgagggagcaggacaagatcacagggtacaaaactgtcagagggcacagaggctgatgttgctgccatcagctcctggagtgccgctcactggctgcatgaccttggacaatttgcacgaaatctcccaagcctcaatgtctgcatctgtaaaatggatcatcctgacctcattgcgttagtgctaggataaaataaagagaaggtatatgaacgtgcccagcactgtgcctgcacacagtaggtacttttcctggatctgaacagtctctgttcttccagctctgtgtaaaggcttgatctcgacccctaaagcctgaagcttctccctgtggccacctccccaccgcatcatcttccgttctcagcgggtagatccctgcccaggggggaccccctggggaaggctgggagcatgacctcttcccaagggtacggcatctaaaagggatctccggaacattgaaaagccatgaaggccgggcacagcggctcacgcctgtaatcccagcactttgggaggctgagggaggaggatcgcttaaggccaggagttcaagaccagtctggacaacatagcaagacccggtctctttctataaatgaaaaaataataataaagccatgaagatccccaaagaaggctgtgctaatggcggccggaagagcagagggcaccacagatgccgtgctttcagctttttccttctcctccaggcctcccttctttccttcctctctcgctatttataaataagagaaggcattgagggcccccacctcgggtacttgcagggccttggcctgggaacaggacaagcagcaagtcagttgacccggggttgctcaattccccaagagctgacgcaaactccagaatcagacctgccctggccacctggccctgccccttaccagctaagggctccagcagagtcctagtcttgagcgaatcttatacctgcagccctgtccaccagctgtgcttcctgagtcctccagggtgagggggcgtggggtcagaagagaggggacggtgtgcagggagggtggaacctgactgaccgggtcagccttactcttccagcggggtcttttcttcctggagctcggccctcggcagctctcagaagctcaccttcttgcaggctctcacagccgcatcgtcctctggctgggctgctcacagaccccggcccctgggttttgtccactcacccagactctgttttggggtcacattacccttccagtgttcctctgagcaaagtccctgtgagttagcccaaggtccctgtcaaggaggaccacatctggcctgttgcactcttctcctttgccccaccgaagcctctgtcacactgtcacagcagcgggcctgccatggtctccccatgtaaggcttcctgaggaacgggcctggtgccagcctgggggtgaactgccagccccaggagtcacaggtcagcttccccacacttaccctggaggcaggatggaggccccctcctttgcaaggcccacacgggccatctaacaccccactaaagccgggcagttcgctgccctggggtgtgttctcgccttgccagttcttggctaaaaccaaggcaggaagagcccagttcccatgttctgtaacatgggtctatgaccagggcctttgcaggccccttgcagcgcccccatggagcccccaggagtctgggagaagatgatgaacccaagtgaggacctccccaggggcctttgctcctcacaagaacccctggaggagacagggcaaggagtaccactcccattttacaggtgacaatgccgaggctcagagaaagtccatgacacccccaaatcccccggacccactaccctgacctcctggcggtgcacagagcatgccacgcacctctccatatgcacatagaccctctaacctaagtcagcgccccttctacaaggccggtgtccagcacacctgggaaaggggacatttctggccctttcctctcagaagtcgcctgctcgagctgccctccctggggggaaggggatgggggcagaagctgagcatggaagcccctgctaatccaccctctgctctctccagaggcccaggaccagcccaactctgccccacatcccagcccccacctcccagctcgtgctgtttctccacctctcatgtggatgggccacacaccacccagcacccctgaggtctggtgagggactgagccttcgacacccatccttaagaacccagggctggtccttttgcttagagcatcaaccaggcccacactctcattttacaggcagagaaactgaggcacagagaacctggttactgcccacagcagaggagacacttgagtgaggacacagaggatctttggggtaggggcgggccttggggttgagacccagtcttcctggccagggaggaaacacaggactggaggtgaggaggcctctttgaggctagtttcttcatctgtaacttgggaataacaataggactggcctcagggggaccaggggaggattcagagaggctatgatgctgggacagctcttcgtgatgactggcatgaagcaggcttctagtagatgctctactgctgctttcgttctcaccctcacccacccgctctgggcccactgccctgacctcctgaccaagcactgagtgtgccaagggcatctccctgtctccccggccccgcaccttgtgtcacccttttccttagctcttaccaccaccttgaattctctattgaacgtgcatgtgtctccccagctaagatgacaacttcccgggggcagggatttgatttgttcaatgctactgtttacccagcacctacaacactgggtgctcagcacgtctgttgaatgaatgaatgaatgaatcactgctttcacctttgcccctgactttctccatggaccacggacaagtgacttgatctccctgagctgtgaaatggggccattcacaccagctttttagggtggaactaggattttatacagtgcctgccatctggcctggcacatagtagttgcttagcaaatatcccattgttttccttcctccccagagggccaaagccaagacctggaggagcaacagggtgggggtctaacccctgggtgacagagacagctcccatctgggatggaggctgcatggtgggaggagctgctgaggttgggccattcagctttggggcccttggagtcctgggtctgtgtggagggggaagggaagctctctgggccccaagagaagggaggcaggattgggggtggcaaggattgcagctcttctgggatagccttgggcacactgctttgtctccctgagcacctgcgaatgtcagtgagaagaccagacagtgggtctaacacgcacagttgcccctgggaggtagcaggtgctcggtaccgatgagctaccgctaactgcaggtgctacctgtcttagaggagggagcccaatctggaggaggggaaatgggagctgtggacccagatgggaggcggctcagagactgtgggtgggccctgatgagcttcttatccatagtcctctatccgcttgccgccatcctggccctggcatggcccaaagtctctgggagacgaggggaggtggctttgcctttttccatctctgttatctcatctgtgaaatgggcacaatcagacctgcctcaccaattggaatatagatttaggtgcagttttcttttttctttccttttatctattctctctctctctctctctctctctctatgtatatatgtatagctatctattgatattttctatcatccatctatttatcttgtatctactttctattatctctatcatctatttatctaatctatcatctatctagctatctttctattttatctatctatctatctgtttgtctgtctgttttatctatctagctattttatctattttatctatctatctatctatctatctatctatctatctatctatctatctatctattctatctacctatctatctatctatctatctatctatctagctagctagctagctagctatctattctatctacctacctatctatctatctagctatctatctattctatctacctatctatctatctatctatctatctacctacctacctacctacatatctatccatcctctccgattccctcaccactgggtctcagattccctgcctgttaaataaatggtcagttaaccctcaacagtgattttcaatttttcacttgaggcccccatattttggaagattgtagtttgctgaacacgctgactgaatcaagtactatccaacttatttcctcattttaacatgtcaaagatcccctgtggggtgagtggggtgtgaattggagcctccccaatccaaggcacaggaactggaagcttctgtagccctgcatttcctagagaatgcttgccatgttttggggacctcctggggggcccctgtactgaccagaggccggctcccagggctgtggtttgggcccagccccctgctcctggggactgctgctgtggagggagtgaccttttgttctgctttgccaaggggctttctgttcctcattgtttagccatgacaaggctgtggatttttttttttttttctgtccaagagaataaacaggcctgagattgctcaagggagccgaccccctctgccagctactgggggctggaggctcacagagccagggaggaagtcctaccccctctgccggctaccgggggggctggagccacacagagccagggaggaagtccagggacggtcactcacagcaaagcctcagacaagagaggaacctggaggggaggaggtgggaggccaccactcagccggcctgggggccatgggagtccagctgcctgccgttagtggccaggagccctcgtccattgcggctcttgagagcccaaacttggccacggcagggctctttcccatcaggccctttgagccctgatgggaaacccttccccagccagggtgggatttcttgctgccgcctggagccgccctggccctgtggttctcaggccctggaggagtgaggggctcccctggttaccccaagggcactcgtggggatgaagcccgcgggatgcaggattcccacgagacctgtgctggccactgtgcggggtggggggctgccagggaagaggtgcagcccctgcctgcctcagggatgcgatctgagggaagaggcagctgtgtctgggaggccgttcggtcggagggggataggcacagcccctgcccttggggaagcgcccagcagcagccttcagggaaggcagtttgggggtttgccgagggccaggaagaccctctgccgcagttagtattcgatggaatggcttgtgcagagggagctgcagaagctgccatttctctgggttaggggctcccacagcctttggatgccgggtctcggccatgagccccctccgccacccctcccccaggtcaccttgctcaatccaggaggccggatgatcagagtgtgttctgcaaaggagcgtgagaatcactggggagatttcctttttctttttctttctctttttttaatggtacagcttcctgggcccacccctgagattctgcacttgtttggggagtgggtgttggcttcatgacaggcacccctgggtgctttggacacaggcagtgagctccccccacactgtgtgaacccctgagaaggcttctccttttgtctagggtgcctgggagtctgctccagcagcaaaccggggaggggaggggtactgggaccgagtgtgtgtggcagcaccgtgtccaggcaaactgaggctccagacgggggttacttcttcagaccctgttatgcagcatggttcccactgcccgtgcccagaattcaccatagctgatgggcctggggtgggcctccggggcaggccagggtggaaagtgcatctgtgtttgagctttgcggccctggcgctggagttagatccctacaggaaaggacattgtaacccagcccgtggttgagactagcagctgctgagcacctacgccctgctaggctgtggggcaacagcaaagggtaacccccagcctgcagcctcaggggggcttcccatctagcgaggggcccagggaggccatgaggagagccatgagggaggaaggtggggactctgggcctgagtgactccttcagggtggggtgcgggcagggagccttcaggagggagggtactgcctgagcagggctcttaagggacacgtggaatttgttacaggaagcaccaggccattccaggcatagaaatcagctggggtgcaaaggcctgggggtcagaagagtggcagattgctccatggcaggaagccccagctcctctgggtcgttcccgctgagggattccagctgttggcaccgaggggtgcagccagggcagggtggtgctgcctgccaggctgaggtgggagacagctgggtttctagccctgcttgtcactcgctataggtgcagccaaacgctcagcaggcccaaactctgggcagtcctgactcccaggcagtgctgtgaggaaggggaggaggaggcacactgaacccacctgctacgttggctggtggaaatttggccaggtctgcactggcccagcggtgctgggtgtcgtgactggtgtctgctctgactggcttgctgacagctgaagtccaggataggtccatggccacgttgtgctggtttgttaaatatttttagtatctcccctgctcctatatgttaggtactggagtccagagaggttaaggcacttgcctaaggccacacagccgctaagtggtggagtgaggatttgaaaccagttctttctgactccctgtatccttatctatggagaggccccatgactcgttcactaaaggttatggatctcgatcttgtactggccacatgactgcagctggcagtacagtggggagtgcgccagccctggctctgacctcctagaactgccctttgttcatttccaggtgacgcatctgtgggggcccctgaaggacttggggtgtgtgtgtacaccctctttgcttgtacagatgtgttcacacccatgtttgcctacatgtgaatgtctccattctgagcttgctctcagcctggtagaggtggctaattaatgcttgtccctgaaagcccggactgccaaccccagtctttcaggagagagggcaggactcaggggcttgctcccgggggtcctgggaaggcacaatggtgacagtgctgcagctctgcactcctggagggtcactcagagacccgagagaggagggctctgcgtctgctcctctgtccagggctgtagcttctctgggtgcctttgcttttctcttttctcccctctttttttttttttttcgagatggagttttgctctgtcaattaggctggaagtgcagtggcatgatctcagctcactgcaacctcctcctcccaggttcaggggattctcctgcctcagcctccagagtagctgggattacaggcacacgccactatgccgggataattttgtatttttagtagagacagggttttgccttgttggccaggctggtctcgaactcttgacctcaagtgatccacctgcttcggcctcccaaagtgctgggattacaggtgtgagccaccacacctggccctctctctcttttcattcatcacattgttcatctcttcccggaggcatccagcacagtctttgagactgtgagctgtgaagtcagacaggacccaggtccaaacccttctctgtcacttaccaggtctgggaccttgggcaggtgacctgccctctcaggcctcggtttcctgttctataaaatggctgcagtagggaaaccgtctccatcttcattgggtggttgggaagtcttgctgagaccacacacctgtctcaggtagggtcttccagaagcagagcctgaggcagggatctttgtgaaagtgatttgctagggagggctcccaggagaagcaggcagggcaggtcaggggagggggcttagcagggacgttgttcaccagcttcagcccaacaccacgggggtggctctggaccatgaattgtaccagggtgggtcccaccttgaggctgtggagcattcattatcagccaacacccacagcagctgggggagcggtgccctgctggcagcaggggtctgagtggggtgcaacagcacccaccaattcgagcagcagaaacgcttagaacagtgcctggtacctaggcagtgcttcaaaaatggcaacgattgtcatggtcataaccaacattcagctgatgagtgccggctctacggtgggtcccatgtgagagattgagggtctagagatgacaaggctgccacctctgctgtctgcatcacatgagtgtgtgtgtacacatgtgtgtgcatacatacccacagggggtggaaggacaagcaagtaaccattccagaacaatgagatgactgttagaggggtcataacccacgtttagagagagccgagaggaggaggaggaggagcttgaattagccttgggtagtcagggagggcttcccagaggtggcagcactcatcttgaaagacaaagggatgtttcaggtgcaggagggaaggagaggtatcttccttcctcagcagagggcagctttgtgctgagaacccccgttctctgtgaccaaggccactgtcttctggatatctgtcccatgcagtgttaggggtcacccagcactggagaaggccagcagagtcagtgcttctgcctgcagacatgactagggtacactgaggtggggaggcaggggaggtaaaagaaggcacgagctctccttcctgtaccctgctccagggggagaaacctccccagccatcatcagtgcagactggcagggggagggccaaacatttgcagggcggggacctgggcatcaggcatggcagaacccaggggcggccctgttgatggcagtcttcccttcttccttccaggtggcatttacaccctacgccccggagcccgggagcacatgccggctcagagaatactatgaccagacagctcagatgtgctgcagcaaatgctcgccgggtgagggcagccacgggggcactcggggcccatgccctggaggagcgtgtgtgtacaggggctggggcgcaagagcatagcccttgattcttactgaactcctagttctatgcactggcccatgctccctgctgcttctgggcctgtgaacatgctgttccctcttcctggcacacttcccaactccctttccctgattaactccaacttgccctttagacctcagctgaagatgtcccctcttccaggaaggctgcctgccccatactgcccagccggtggaggagggggaggaggagcctaaattagctcctgggggagtcagggagggctgcctggaggaggcagcactcagcttgaaagacaagtgctgcctcctttgagctctcactggcctctgatgttcccatggaagctctttccttgctgtgggattatagcccggtcctgcttcctgttgcctccactgtgtgctcctctagggcagagattgtggcttgttttctgctgaatccccagcacgtggcgcaatgccatgtaggtgctcagtgcatatttgactgactctgtgaatgcttacccatttcacagatggtagacctgaggcccagccacagttggtggagctaggtagcctgactcctggtgccctccatctattcatttgtgtctgtattcattcatgtcatgattataaggtatctgctgtgtgttctaagtgctgggaatacacagagagcagggcagacaaaacccttgccctcgtggagtctgcattttaacggtggatgcagacagatacattaggagatgtgtggtcctgtctatctgtaagtgctgtagaaagacaaggtcaggtaaggcgggggagacagaacgggacatactgttttacacagggtggtctgggaaggtctctctgaggaggtgacatttgggcagagccctgcaggaggtgagggagcaggtcatgcatgtatacagggaacagtgtgccaggaggaagcaacagcatgtgcgaaggccttgaagtcggagcctgtttggtgagttggaggaacagcagggccagcatgtgtggcccaggatgagcgaaggcgagtacggtaggggaggaggaggaaggagtgagcagggaccatggtaaggagtttagattttattctgtctgggagccaatggagggctttgagccgttaccttgagatgtaggtgggcatatgagtacctgtcaccgtccctagccattttaagacatcctagggaaagtgactctcttctttcttttattaactggaagggtctctttaagaagttactagagaggctgaggtgggcggaccaccggaggccaggagtttgagaccagcctggccaacatggtggaacccgtctctactaagaatacaaaaaaatagctgggcataatggcaggcacctgtaatcccagctacttgggaggctgaggcaggagaattgcttgagcctgagaggcagaggttgcagtgagccgagattgtgccactgcactctagcctgggccacagagtgagattctgtctcaaaaaaaaaaaaaaaaaaaaaagcagctactgagtcaacttttttttaaggtttccgttggtgttctctgtccctggaatgcctgctttccaggcccatgcccttgtccttgataggataccagggactacattcttactacctgttccccctatcattcatgcccctagctggagaatattagccatctatcaagaaggaagaaactggcaagctagttcttactaaagtgtgattgactgataatagggctccagtggtggaggttcaagcatctggaaagagcagagaggaatctatttttgagcagaaggggttcagaaatgacgtgatagctggtacaatactagatgggagatgattctgaggaattggaactccacagaatagccttcccagctgggctttagaactctggactttgtggggacagtggatgagcccagggtcctggcagaaggctcgcccagctgagacctctggcccttgtttcctcaggccaacatgcaaaagtcttctgtaccaagacctcggacaccgtgtgtgactcctgtgaggacagcacatacacccagctctggaactgggttcccgagtgcttgagctgtggctcccgctgtagctctggtgagtaggttcagagaaaaagggggcccttacacccctgcctccaacttcccccggcaactccagcctctttggcttccagctgtctggagttaccccaggctggttgttggaagtggcacaggtgcagctgtttacccctaccactggcattttcctcctctgtctcaccaaagcctcttcacagccccacggggcaggcggtgggagaactgtgcccacgtgagggttgaggaggtggtgcgtgggagagtggtgcgcatgctcgtgctgcgaggagcaggactgcggggaggagcgaaactgctgggaagagcgggactgcggggaagagcgggacttcggggaggagcggcactgcggggaggagcaggactgcagggaggagcgggactgtggggaggagcgggacttcggggaggagcgggactgcgggggacgagcgcgactgcgggggacgagcaggactgcggagagtagcgggactgcggagagtagcgggactgcggagagtagcaggactgccggtcctgcccctggactctggccggtgttgtgtgtgccccatgctgaggcggtccgccagcctcctggagatccgctgtctgagagtgctgggctgtctgggagggcagcgtgggtgtggcggaggcaggcgtgaccgtttgccgccctctcgctgctctagaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggtacggggtggggctcaggtccttggggacgcccatgggcctctcctttgtagacatccttgcagtgtcacgggcatcaacccattaattagtccagcagggagcactgttagtggtggccaggtgcctgctacccatccgtctgtccacctgtccaccgttcattcttcctgccagcactcccgattaggcacctcttatgtactggaaccaggagacccagagatggatcagaccaagccctaagctaggaaagttatgtgatgctgcaagatgaactcacataactctacagcccaatcccgtgcatgtgtgtacaggaatctgtgtgtgtgcatgtgtgtacaggcatctgtgtgtgtgtgtgtgtgtgtgtgtgtgtgtaaggggtggaggtgcagacagagctccttgggcccctcagacctctcctagggctctagtgccaaggcccagctgtcccgcagagtgtctgagtggttgacaagttcggattgttccctgaaggaactgaaacatcagacgtggtgtgcaagccctgtgccccggggacgttctccaacacgacttcatccacggatatttgcaggccccaccagatgtgagtagctgagtcctttggttctggaggagcagggaggggctgtccctgggtgactgtgggtccaggacacagagcagctcaccaaccaccattgtccagactgctttatctgagggtggctcccaggataaatggcatggtgggcaggaccttgccctggaaggcaggactgggtgggtgcatggggaggtgggggagggctaggagggggtggtcctcagagagggcacacatcgtcactctcctatcctgcctgctggggcccgtgaatgagcccagccaccccagccactctgtcccctgctgcctcctgaccaagcctcctcctcctccagctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggtaagtcgcaagaagtctcattcattcactccttctgtctgcctgtctttctgtctctctttcttcctctcccatggttttactgagagcccacggggggctggaccctgtgccctgtcctgggatacaggtggcagtgagactgctttctccccacacctggtgctatcattcaaaatccctaagtgcgtgggctggatgcagtggctcaagcctgtaatcccagtgctttgggaggccaaggaggctggaggattgcttgaggctaagagtttgaggtcagtctgggtaacacagcgagactccatctctataaaaaaattaaaaaattatttgggtgggatggtgcctattgtcccagctactcaggaggctgaggtgggaggatcacatgagcccaggaatttgaggctgcattgagctctgatcgtgccactgcactccagcctgggcaatgagtgaggtcctatctcaaaaacaaaacaaaaccaaacaaaacccctggataggggagaggtggggtcagcaattcacctgaatatgcagatggtctccttgctgctgtttctgatgagcccattaggctaagaagacagcgggctgggccaggtcacctccaggggcttccattctggggtagaactgcatcaggccagaggtctcaaactagtggcccttaggctgaatgaggcacacagacatgattgctttgtaattggatttgagaatctccggcctagactcgcccctcatttgcaatgacccgaagcaccttgggtccctggcttgcctggctggcccctggtacatttgagtttgttttctgtagctgtctgagcttctcttttctttctaggactgattgtgggtgtgacagccttgggtctactaataataggagtggtgaactgtgtcatcatgacccaggtgaaaagtaagagtccatccttccttccttcatccacttgttcaggaagcttttgtggggtgcctcctgtgagtccagcactgggcacagccttaggggtcagacagagctggatatgggggtccttgttctgtaggagcttaaggcctggggtgaaggtacctctgctaacttaattactaaaaggcaagaggtgatcagggttttctaaagggtaggaggagttcaggattcctatccaggaagcctgggggattcgggcttcctgcagcaggtggtctctgagctgggtaagatcttgatgggtggagtctgtgcagggaaggacacgcatcctcagtggaggcgcggatggtatagatgggggactggagaatggttgggatggtggcaggtggagttgggtgggggcttctgtggaccttgtctggtaggcgattggtccccacagggctgggcctctctgctggttctatggggccccatactgccctcctacttaggacagatgtgcctgaggaagtcaatctcttacttgtcccctctcctctttatagagaagcccttgtgcctgcagagagaagccaaggtggtgagtgtctccactgccctctccccctcttcccctggtctccttcccggcgtgctgggctgtcacagaggaagcagtgaattctgtcattggtctgtccagtgtcaggaggtgtgcagagccctgggaggtggaggaaaggccggggagtcaggcagccctccatgggctaagagaggctgtgagtgtgaaatgctccggcagagagcagatgccttcgtggcgttcgtggcaggcacgtggtcgtggacccacagcgcaaccttgggcagatgtgaaattgctctatggctacttccttaccatgagatgggggttgtgtctgctcgatccagcctgcagggtggtgccattcggtcagctgacaatgatgtttctccttgcctccattgtgtttacagagcactttctcagagagcagtggttttcaaactgaattctgggatagcccagtgtcccacagagggcccttgggcgtgggggaagtggtcatctctcaggtttgaggtagaggctgtggggctgggccctgggtcctcccaaagcaactcacctttgatctgttttataaagtagggcctgcgaaggctttttgttagagacagaccaacagtgtgtcatatcatagtatttcattcattctccatcaggaaggcatttggctgcaagtaaccccaaacctacaggtgactttagaaaaaatggctttatttttcttgcattgtaagaagtcaaggggttggtgtctgctggaatggcctccactatccccttgcatggtgccagcaggaccccaggctctgtcatctttagtgtgttgacttttgttctcttgtttgtggcctcatgtcataagatggtaatcatcacttcatatgtcacctctaagtttgaggtgggaagaaggggcaggtggccaggtcagccatggtgcccttatcagtaaatcggatgccttcccagaagccctgggtagacttctttcatctcactgaccagacagtgtcacatgaccacccctagctgcgagggaagctgggaaagagggtgttttgcttttccagcctctatggaggaggaggacaagggaggggggttggaagtgggtatggggtgagccagaacatacgtctgtcacagccttgcacctggtaggcagggcaggttttttacccaatttgacagatgagaaaacagagtctgatgagttttctcgacctcaggggcaggtagagaaagaacttctcaacctcatggatatttgagacaacatcttacttaagggaggccaaggtgggaggattgcttgagtctaggagttcaagaccagcctgggaaacacagtgagaccctatccctaaacaaaattaaataaaataaatatttttaaaaaggatcttggctgggcacggtggctcactcctgtaatcccagcactttggaaggccgaggtagatggatcacttgaggtcaggagttcaagactagtctggccatcatggtaaaaccccatctctactaaaaacagaaaaattagccaggcgtggtggcacgtgcctgtagtctcagctactcgggaggctgaggcaggagagtcgcttgaacccgggcagtggaggttgcaatgagctgagatcacaccactgctctccagcctgggcaatagagcaagactccatctcaaaagaaaaaataaaataaaataaataaataaaatatcttacttagttgtgggggctgtcccgtgctattcagcagcatctttggtctttatttacttacatgccagcctcattcccactccagtggtgacaatcaaaaattctccagacatcaccaagtgtcccctggagggcaaaatcacccctagtggagaaccactgctcgagggaacagctcagccctgggcagcccaatacccgaagcttacaccaggtgtttggaatcagatagattgatttcatcccctgattttggtgacaagaaaagagatgcagggaggaaaactgagttgctcaaggtcgcaccgcagtgtgtctctggactcccatctcagtgctctttgccctgccctacagtatttcagtggggaggaaattttctcattccccggcgagcgagtttcactgctccctttctccagcttcaattcagtgacactgacggttgccgcctggtggcgtgcgtagagcaggtgtctcccccaagctcttccgcagcagcccagctgtcaccttccctttccccaccaagcgtttcccaatcctctgtgcactgaagatgtcctgggtgtggcctagcagcctctgcttcccttttccattttttttttctttctttctttttttttttttgagacagctatgtcgcccaggctgcagtgcagtggcgccctcttggctcactgcagcctccgcctcccgggttcgagtggtcatcccacctcagcctcccaagtagatgggactatgggcatgcgccaccatgcctggctaatttttatatttttagtagagacggggttttgccatgttggccaggctggtctcaaacccctgacctcaagtgatctgcccacctcggtctcccaaagtactgggatgagaggcataagccaccacgcctggcccctttcctttcactgttgctctcagtgttcactgaatgtgagtgactcaagtatctgttgagtgccccagtggtgtgtctagtgcagaaaaaaacccccaaaccctgatttgtggtgtttgctaatttctgtggtataaacactcacactgtagccagtttccaactcccaagaccttcctgaatatggagttgggaggaaatctgcacaggcctgagcttatcccagcacagccctggctgagccctgccaggctctttgtgactgagtccccacgcatccctgtggggcagggagcatcatcacccccattttacagaggaggaaactgagactctgggaggttccatttttcctgtaggattagatcattaggtgagtggcatagcccaggtttgaatcaggtttatgcctgtgtcccacgctactcctcaaccagcagctactcctgataagaggccagtggagagtcctcttgagctgggctgctgggcttagagtgtggactcagcacccacctgctcctcctgccacagaaagaacgtccagggcatgggagacagtggcgttcctttgtttagaaaacaccaacatgtggccgggcgccatggctcacgcctgtaatcccagcactttgggaggccgaggggggcggatcacgaggtcaggagatcgagaccatcctggctaacacagtgaaaccccatctctactaaaaataaaaaaaattagccgggcgtggtggcgggcgcccgtagtcccagctactccggaggctgaggcagaatagcgtgaacccgggaggtggagcttgcagtgtactgagatcgcaccactgcactccagcctgggcgatagagcgagactccatctcaaaaaaaaaaaaaaaaaaaccaatatgtgagcttacccacaatcacccccatggacacggacacactcatgcacggacccacgtctgataacaggtgcgaacatttatcgggtgttgaacggatgccaggcactgtgcccagcgttctttattctcacagccatgctgccacacgcaggcagtatgattcttgtcccccattatatggcccaagaatcatgggcccagagaagttagtaactttcccagtgtggcacagctaatgatcacggcctgggacacgaacctaggagtgtctctcctcgccaccccagcgcacacactcactacgtcactcacagatatgcacacatgcccccaacatagacacacgtgtgcacgcttcacaccctcacgcctgtagacacaggtgtgtgagccttgtgaacacacaaacagacggacacagcaggaacctggaggacctggcccgtggctctgctgggtctctgcttctgcccagcagggctgggccaggaggggccgggagctgagggtgctggctggctggctggctggctggaattctgtttttttttttttttttttttttttttgagaaagagtcttgctttgtcgcccaggctggagtgcagtggcacaatcttggctcactgcaagctccgcctcccgggttcacaccattctcctgcctcagcctcccaagtagctgggactacaggcacccaccagctcgcccagctaattttttgtatttttagtagagacggggtttcaccttgttagccaggatggtctcaatctcctgacctcgtgattcggtgaccacctcggcctcccaaagtgctgggattacaggtgtgagccactgcgcccggccctgggatcctgtgttttgaatgaggctcctcagtactcggctctactggggtcccagcccaaggaataggactcagcctgcttctgtgccacctggggctgcttgaactttgcgacttgtggcttgggaggagggaggtggccgtgacctttgggggtttttgttctgcctggctgtagccaccagcagagggggtggggcacaggccagaaaaaccccttttgtggggttgtgaggagtgacaattggctgcttctcctccccttccaggctcagagcagggctggggggcagttgtgggcagtgaccagggtcagaccacctgggcggaggttcagcatgaacttgcaatgccctccatctctccaaaactgggggacccagcccagggagggtgtgggggttcctggggaagctggtctaggcttctgctcctgccacggaccagctgtgtgatgctgggcacaggatgcactttctctgggcctccgtggcctcttggggatggcttgcacgagatccctccagtcctgagtgagaggctgtggccttggggaattaagggtgcaggtggcgctcaggtgtccgagaagccatgggagccgggggctgcagggattggacagagaggaccctggtactcgcatctgttctcagaccacatctggaattgtagctccctctggagggaggcaggaggtctcagcctttcttggggggcggtggcacctgcgctgctcgctccacccctgctctcacctcccgctgcagtgctggcgagccccatcagcccttcactcatctctaccctccttctttctgcctgggacacttgttttcatcctgggcaggccaggggccagggcagctgttgggaatgtggcctgtgccatctccttttttgctgggatcagaaaacaatcgcttagaattccaaggcaagggtgtgagcgcctggccagccagtgggaacagacaacagcctgggagaggaatttccagcctctcttcagtgtgcgtgtctggaaatggggaccttgccttgagcctccagagttgaaaccccagacacccaggaaaggccctttgggatttagcccagccacagtatgtcctaaccgtgaccttgggcaagtaactcaatctctccgtgcctcagtttccacaaagcaaggataacactgggttgttggaagaatcaatatagatattgtctggagggatgtaggtacagtgcatggcattgggtggcactcaaatgtcagctaataatattattattattctacgggaagaagacatcaggggaagttgcagagcagcctgtgggcggactctggaacaagaggctgaggcagtgcagcagagggtctcagacgtgagcgctctctgccccggaatgattgactgagcgcaaaggtctgcacgctttctctgtaaagggccagatggtaggaatttcaggctttgtggactgtatggtctcagtgacagctactcaaacctgcctctgtagcaagaaagcagctacatgcatagacagcacacacccaactgagagtggtgtgttcctatctaattgtgctactggacacccaaacttgagcttcccaccattccatgtgccgcaaattattctttttttttgagatggagtttcactcttgttgcccagcctggagtgcagtggctcgatctcgcctcaccacaacctctgcctcccaggttcaagcgattctcctgcctcagcctcctgagtagctgggattacaggcatgagccaccacgccagctaattttgtatttttagtagagacggggttttgccatgttggtcaggctggtccccaactcccttcctcaggtgatccgcctgcctcagcctcccaaagtgttgggattacaggcatgagccaccaagcctggccacaaattattcttaaacatttttttttcaaccatttaaaacatgaaaaccagtggggtgtggtggtgcacgcctggtatcccagcactttgggaggccagggtaggaggatggcttgagcccaggagtacaagaccagcctgggtaacatagcacaaccctgtctctacaaacaatcgacaacaaaaaaattagccaggagcagtgacacgtgcctgtggtctcagctactcaggaggttgaggcaggaggatcacttgagcctggaaaatcgagggctatagtcagctatgattgtgccactccactcctgcctgagcaacagggtgagaccctgtctcaaaaaaaaaaaaaaaaaaaaaaagtgaaaaccattcttagtggcaggctgtactgggcctctgggcaatcatttgcctagttctgatttaacaaactcttgtatggagtttactatgtaataggcattgttttaagcactttacaaatattcagccatctaatcttcacaacaaccctatgaggtaggctattattctccctttatagagtaaaaaaaaaaaaaaaggcacagagaggttaagtaacttgtccaaggtcacacagcaagtgagtggtagagtcatgatttgcacttgtgtggcctgggtttagagtccacactcttggttgctaggctgggccatgtctccctgtgcagatggggtgaaggaaagctgctttccttctactcccttatgcaaaataaggatgaaaatcctgccccacctctaagactatttggtgaacagggccaggtattctctgccctcataggacactctagtagagcagctgggtgctaataacagaaacacagaaaccacggagaatcacacctcccaaaaagtgccgtgtgtggaaagaacgtgcaagggtgggcagaaacgtcacgtaaactgagaagtgctgatggcaggaggtgtggatggcagtgggaaggaagaggggaagaaagagctggctggtgggctgactgctctcccctaccaccccctgcccatccagcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcaggtaagaggtgggagcacacctggcttcttcccaagcctccttggtctttctcacctggtttctgtcttagccatctcctcctgagcctccccgcagggtgggacgaggcctgagccacagggaacttccttcggttcgctgaacctaagttccctcccgcctttgcccatgctgggcctatcacctcaaaatcctcccttctgtgggacaaccccagcttgtccaagtccctggtatctgggggaggagttttcctgaaaccttctccctgctaccacccccagctggcctggctgctcctccgggctcaccatgccctggcctccctttcacaggactgtcagactgcatgtacagacattgtcttctcctgtctcccacgccaggctgtgggacacctggtgagcctggatcatctcattcatccctgtatctgcaggcccaacacggcccagctactgataattaatcataacaatcgcttctacttatggaaggctacggaacagcaggcactgtactgggcactttacatgcataaaactgacctgcatgtcaatgctaagagatagttcctgttgttatcccattttacagatgaggaaactgagccccagagaggttaaacagcttcttcaagggcacatggctagtaaacagaagagccagactcacccctaggctgtcgggctccagagccctgggattggaagatgaatgaagaaatggtggctccagggctccactcactgcagtttgttgctgggtctctttaggtctgaggcactgggactgtggggattgtgtcccatttatgcaggctgcattgtgccctggacctggtctatgacagatgtcactcctggttggcatctctagggcccacactggaggggcccctgtacagggtctgctggcctgtgcctctctccctcttacctggcagtgccagccagtgagaattcagggaatgaccatgaacttgggtcagtctgagatccttgcctggccactctggtgccataagaatttgggtgggatgcttaaccctgccaagccttggttttttcacctagaggtgagctatagcgcctccttgccagggctggtgagagatgggtgacattgtgcccagctgggcaccagaccagggccaggctccctctgggccgcctccaggtggggactgatggctgcagcccccaccacgcagccctcctccagctcactcacccccagctgctccccagctcactgcgcccctgcctcttgcctgcactcatgccacccctgcctgccacacctgttcctacctgcccccaactgcccacaggagctgacgtggccatttctgtctgccccatcatagcccccagcctcctcggtgggaggtctcatcagtgcccctcactccatcctgagaactccctatgggagggcctgggccagtgcctggaagagatcaggggccctacacactgttgaatgaatgaatgaatgagtgcgctccaattataaactcttagtctttgcccagttcttggattcgtctgattttttttttttaaatggggtctcgctcgtcgcctaggctggagtgcagtggcgcagtcttggctgacttatctgctcaccgcagcctccgcctcccaggttcaagtgatcctcccacctcagcttcccgagtaggcgggattacaggcatgtgccatcacgcctggctaacttttgtacttttagtagagatggagtttcaccatgttggccagactggtctcgaaatcctgacctcaggtgatccatctgcctcggcctcccgaagggctgggattacaggcgtgagccaacatgcgcagcccatctttctgatttcttagctacacctggtgtggctccctccttgggccagggtggagccctgaccatgtctgccctcccctctcccctctgccccttctgctctgtgctccttctcccgagtcccccagcccgtgtccctggcctctgtcttctctttctctccctcccacccctaacacctccctccactgtgggaacctgtaaaccccagggttgtgccccttcatggtcccccatccacccccgcaatgtctcatgctcgatatgcaaaggccatggtgactttgggtgacatttgggtgctgtggaggctcagggtggaaatttccttccggccttgtgatttcaaccctcctcccccaccacatgcttggggctgttttgagcacagcaggttgccagctccatccacctcccggctaccctatccgagtagttggagttagggagaaccaggctggggtgagggcactcagcaggcccctgcagcaacagcagcagcaactctcattttctgagggggctacttactgtatgccagtcccttcatattcatctcagcaaacccaccgtccagtgcctccccaaccagttagaaaactcagttgcccacaggggctgggcaggaaggtgaggcaaaccttgggctgtccttggccggatctcctgcatctggctcccaagggaagccataaatccagatttttaaatgtaaacgcctgaattttaaatgttggtaatcaattcacttaaaaacatcaccaccaccaccaccaccaccaccaacaaaaaaacccgtagacttgtccctgttacaggcactaggaacacagcagggaacaatcaaaaagtccctggtctggccaggcaaggtggctcatgcctgtaatctcagtacttcaggaggccaaggcaggaggatcacttgagcccaggagttcgagactagcctgggcaacatagcaagacccccgtctctactaaaaaaataaaaaaaaaagtccctaccctcctgggttcagagtctggttggggaccccaggagctgggggctctggagatcaggagatcacagaaatggggagggacccagagagtggtggataggatgggaagtaaatgtctctagagagggaggccagggggtggagggcgcttcgtggaggaggtggcctttgagctaaggcctgagcactagagaagagctctctaggctgagggagcggcctgtgcaaaggcccaggggacctgaagggctcaaggggctgtagcagggggtggggaatgtggctggaaggaaccccatcaaggtcttggagcggcaggagagggggtgggagaaggcaggctccagatcagacagggcctggtaggctgtagcaaggactgtgggtttttgagcccccaaggaagtgatctgccaggttcaagggccagctctggctgctgatgggaaacagatttcagaggggtggggttgaagccaggacagatggaggctgttcacacccatccagatgggagtgaggggaggcttccatagcccaccatgcagcagcagggcagggtgacccttgcagaagtcatcttttgtttttgtttgtttttgagatggagtttggctctttcgcccaggctggagtgaagtgacgtgatttcggctcactgcaacctccgtagcctgggttcaagctattctcctgcctcagcctcccgagtagctgggattataggcacctgccaccatacccggctaatttttttttttgtattttgagtagagacagagtttcaccatgttggccaggctggtctcaaactcctgacctcaggcgatccacctgccttggcctcccaaagtgctgggattacaggcgtgagccaccctgcctggtccagaagtcatcttttgaagggagacaaggcaggaatgatggatgggtgtgtgatatgagagaaagatgggtccgaggctctgggcccaagcagctgggtggatggcagcaatgggaactgtgatgagcaggagaggttttggatgcgagatgggagtagaatcaagagttaagttggaggctgagcacggtggctcacacctgtaatctcagcgctttgcgaggctgaggtaggcagattctttgaggtcaggtgttcgagaccaacccaggcaacctggcgaaaccctgtctctacaaaaaattagcagggtgcggtggcctgtagtcccagctattcaggaggctgatgtgggaggatcacttgaggccgggaggcagaggtcacagtgagttgagggagtgacacagcactcttttgagaccctgtctcaaaaaaaaaaaaaaaaaagacagaagagacagggtctcactatgttgcccagtctggtcttgaactcctgggctcaagcgatcctacaaacttggcctcccaagtagacatctgttttatataattggctcctcccatctctggggtgattggggctgggtaggtagtgatgctattcttattcggcagaggggaaaatgaggcacatgcaggttaagtgacttgctcaaggtcacacagcagagctgggctagaatcttggtctcggctcctggcccagtgctctttcccatgtgtctgaatctgcatcttgggcaggggtccctgggccccactcctggacccccggactgacccccaccccatcttgtgcttagcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaagagcagaggcagcgagttgtggaaagcctctgctgccatggcgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgccccagctctggcttccagaaaaccccagcatccttttctgcagaggggctttctggagaggagggatgctgcctgagtcacccatgaagacaggacagtgcttcagcctgaggctgagactgcgggatggtcctggggctctgtgcagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaagcaccgcctccaaatgccaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgtctagcagagcaggggcagggtgataaattgttgataaattccactggacttgagcttggcagctgaactattggagggtgggagagcccagccattaccatggagacaagaagggttttccaccctggaatcaagatgtcagactggctggctgcagtgacgtgcacctgtactcaggaggctgaggggaggatcactggagcccaggagtttgaggctgcagcgagctatgatcgcgccactacactccagcctgagcaacagagtgagaccctgtctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttttacacgtcgacccctggctctgcctggggtctgggcttgggtttgtccatgctcctacttgtctgccacccctgtgtaaggggagatggcgtcacggtccctggagtctggctggcccctgttgtgactggaccacagagggacccctgttacagccgccccctcaagcctgtgaaccataagagaacttcctgctcgggaccacacagctggctgggttccaagtgtgccctggtctcatgccttcatcctccaggtctcctgggcctgctctcaggaccgggatggggtctctgcagatccctagcagcctaggcagccaggctctgccctcctggggaccccactcggggagagtggttgcccctgggatactcagaccagtacagggttttgggggcccagaggacatccctgggcccaggtaggaggttagaacagggttctggagatgacctctgacctcctcctgagggatgagcagcagttttccagaacaaaggattgcagggaactgtcaggcaaaaggagttctgagtttaaaggccttagcctggccagcatggtgaaaccccatctctaccaaaaatacaaaaaattagctgggcatgacggtatgcacctataatcccagctagtcaggaggccgaggcacgagaattgcttgaatcgaggcaacagaggttgcagtgagctgagatcgggccactgcactccagcctgggtgacagagtaagagtctgtctccaaataaaataaataaataaaatcaattaattagaagaaagccttggaggggagagagaccttggcctgtgtattggttccactgaccccctgggtcaccatcgtcactccagctcctgtgactccctcagtgggaccattttcattcttggtgattataggatctgtgattgatggaacgccccgcctcctggcttctcgccctcctctcctccatggtcctgtcctccagcctgtctcagtcactcaacccttgaccaaggctccccacacttattccataaagagccagggagcaaatttattttaattttttgagacaaggtctcactctgttacccaagctgaaatgtgatcgtggctcactgcagccctgacctccagtcgcagcctcttgagcagctaggactacaggcatggaccactatgccgagctaaattttaaatttttttatttttattttttgggtttccctgtgttgcccaggctggtctcgaactcctgggctcaagtgatccaccggcctgggcctcctgaactgctgggattacaggtgtgagccattgcgcctgaccagaatcaatattttacacttggcaggccttacagtttctgcaacaaccactcacctgtgctgttgaagtgtgaaaacagctgtgcacaggacatgaaagaatgggcaggaggcggatgtggccttcggggtgtgcccatgccagtgccttagagcctggcattactgataactgcacgctaatctcaatttcaagcatcccacttccccccacccctacttcctcctgtctttctccctcagtggcacctgcagctgttggttacgttttctcccttgtacgcacccacggcactttctcctggtttgttgttctctctctggttgaacccagctctctgcctgtgccacacctgcacgtctgcacctggctggggcaggatgatggccttccaccatgctggctggtcgcgttttcatttcatgatcattagacttggctgggcacagtggcttatgcctgtaatcccagcactttgggaggctgaggtgggcagactgcttgagctcaggagttcaagaccagcctggggcaacatggtgaaacctcatctccacagaaaaatacagaaactagctgggtgcggtggcacgtacctggaatcccagctacccatgaggttgaagtgggaggattgcttgagcccaggaggcggaggttgttgtgagctgagatcttg

SEQ ID NO: 13712 - DNA, 7926 bp, Human; identical to SEQ ID NO: 11793

SEQ ID NO: 13713 - DNA, 177669 bp, Human
  misc_feature (1)...(177669): n = A,T,C or G
aaagaattcattcttattctcataatttatctaataaactactttggagcgagaacagactctagagtatagttcagtttgaatttcataagactcttagatcgtaacgaaaaagataatagtttgaattcaaaaggcccacaccgcaggcatagtcaagttcatctggaggtcagtcacaaaatgctttcttgtggcgtaatttataccttcacatttggcaattttgaaagtcctgtgtaaatgtacatatgttggtaagaggtagtaaatattttgctgacaagttctttgaatgatggctcagtagcagcatttaaaggcagacaatcagagggttttttgtgtattttttttttaaatccaggtgctgccaagtctacaaagctggaagggaagaagccaaaagtgcccactagttatagttataccattaattatataatattcatgtgcctcagagtttctgcacctggcatctgttgatatacacaggtgggggaggacaggggcacaggatacagttgggagagagcagggaggaagacagggtgcttgctgtcaggtaacggccctggaatatggagcagtccctggtgccaggtgtggccaccagcacctgcttccctcctgggtgtccgtgttgtaatactgcctggatttgatggggtgagaaggggaggaactgtggccacatgaaaccctccctactcaggcccttggcctcctcttttcgatcaatcctttctctctcatttttgggaggcctttgaattaatgatcctataccttttcaacaaaggaatattgatatgttagtgtgccagacagcagggagtactggattagatcattttcacattgacgttatgccagtttgacatttgtttggaaagcttatccttttatgaccataggttatatacataatttaaggggaataaatctttcagagattttttttggttctgtgatcttcagtgctacagaaaaagaaatgaaatactcccccacagttttcatgtgatcaggaattcagcataggctataagacggagtgctccatgtcaatagagaatatttccacaggtgtgctaggcacttgtggtagatgttgcagggaagtcaggactggggacagcttggtccctacttcaaggttacagtctaggagctgagagtggcaaagtgacctgattctacagggtaaaagccccagagataaatgacataggtccaggtcagccagcattgctgtctcagtagaatgagtatgtgtgataccaaaataatcttcctccttccctccttgatcctgccaccatcttgcatcttgatgatctcatattgggatagtgacactaacagagtttccgagttatgatgccacttgccatggtgaagtggacattttaaaaaactttattttcttataaattacttgttctgctttggagatttgatgatcatttagcaaagtgcccctggtagatagtaggcactcagtaaatggttttcgtatgaatcactgcaaacttgcaactccgagtgagtaccattcttccatataaatttcctctcgtctgtgaagattatccagcttctgcccaccattgcatttctgtgtgggtgcttaatatgatacttagataataaagccacttggatctcaaaattccatattctccagtaggagttatccaagcaaagctggtgactgaaccaaaatcaccactaaagaacttaaccgtgtaacccaaaaccatgtgtatccccaaaaagactgaaataataaaatgaaatgaaaaaagctggtgactgaagaacttgcactagagctagcaagagcattatgtttgtggttaccacatccttatactgtttttggttttctcttctaggtttattttcttgaaaaggctccaggcttcggcttggaaaatcccaccgccaaaattgagcccagcagctggagcggcagtgagagccctgccgaaaacatggaaaggatgagtgactctgcagataagccaattgacaatgatgcagaaggggtctggagccccgacatcgagcaaagctttcaggaggccctggctatctatccaccatgtgggaggaggaaaatcatcttatcagacgaaggcaaaatgtatggtaagtggcctggaacactcctttgaaatactacaacctgcagttgtggtaggggatagattgtagctggtcttccagcaagagctgttcattgtatggggttgagtgatatttgtagaattttagtgggtcatccaaaggactcaccctaaactaaaaaggagagtcaataaaggacctttgggaaaaagaaaaggacccctgggcttttcttcttctacatgtgtagtggcattacatcagaagctccaggggtccaggcaggaacataaatagttgcagtggcatgtacagacaccagatggtggggaggaggtcttctgaacacagaccagatcacaaggaaatactgccacttacctctaggtaactgatgtcactaggaatgggggcctggtgctcccgaatcccttgattgcccccagcccccttgaggaagagccagcattctagatgcttatatgaaatctactctttttaaaaagccagcacttttttttttttaaaacaactctgtacaggccagagaaaacatgtatgtgcatgggcttgatcagcctctgaaccaccaatttgctactttgctgccagtttgcagttgaatggtcagacaaggcattagcaccctgggtcactgtcaccatctccccttctttgggggttgccttgaaaggcattctgaaggaaacaccaagagtgccaaggagagagagacctgttaactatttggctctggatgcctagggcagcagcaaggatccacctgccggtctggggcttgcttgctgggtttgggcaccccctaacttccttccataaatgcttccagctgcagacctgtactttttggctgcttaccttttgggaagcagatggcaggtgtagttgcttgaacattctgcttgtctaattgagcacgttgagttgacagagttcgcactgtagctgagtctaaaaagatgcaaacacaaataacctaacctcaaagagaactggctcagtattttacctgaggttgttaacttctcatgggagtgattatttctgaacaattggaagtcttttttgtaataaggtgttgtacctttaatactgcacttcctctgtcaggagccgtaggagactgtggcttcaactagcacacactgctaaggagaaagcagatggtggtgcagctgccaccagctgtgcccccaccccgccctcctcctctccaacttggatgatgtaatggaaacaaggaaaattttgctttctgcagcattggagtctctcagcctgtcacacacaggggagaaggagacccaggccttcagcatttgttttatgctcccataatatcctttgtagccagggaagcctcttcgtatctggtgaaatggactggggatgaaatatctcagctactatgggaagagtgtttcagggccctagattttctctatgtctggatctttcctggtctcttcatctcagcctggctatttgctttgtgggtcttattttcatacctgaaaatgcagctccctttcttaaaggcagagaaaagcattttaatctttgaagcttctttgaagatgattttattatgggtagtgaagggtagccttgggacactaccttgtacaactctcatttgcttacccaaaaatggtttcaatttaaaacaaaggcatagtattagaaatcccaatggggcataaccactgcacttcatttcccacaggaaatactgggaaaggtcctgtcctttcaggaataaggttttggggctgagaacataattcaaagcacaagttaacttttgtcaactccaattttgtattgttctccattgagattttagtttatagacagcagccctggtggatttaaccaatttgcctataattcaattatataaatatttttatgtgaaaataattgtataagagctcttgttggtaattgggtctcagaggcagcaggctaagaagaacaaagagaagctttggatgtgagtagctgtatcaacaatgaacttgaagattttacccttggtcttggtctcagttttcttctgtgtaaaataagatagtaaagtagttgatgatgtccatgggtcctttggactcttccattttgtgatgctatggttttgtttcttgtcactgagcaagagggtcagttttgacaaatgtggtgctgcttgggagcctagcctgtcttgggtacccagtgtaacttaaattctgagtgcttcctgagtgtgcatggttttgatgtatggattcttttctccttaactcagcagcacatttagtgaccgtgttggtggctaacctgatttaaaatgggacagtccttttgagcaagcagcattaggaattttaactcatttggaagaacaatcttactggttgtgggtttttcagcaagtggagtatacagcctgggagagtgtgtatcctaattggggctcagaagatgcgttggatgcactgtcctgcagccacccccacctccaggcagctgccttggggaggaaacatcccccctgaactccctgtctctggtcgacatgaggagctttgcttctactgctaccttggaagggaaccatggtggttaatgggactattggtggtggagactggaccccttaagaggaactgccctggttgactgggagctgcctctgacctgcctgtgacttggaggatgagagacagttgacttgggagcctccctgttgaggccccagccactcgagaactgaatcatatgagcagtgtggggccagagctactgtcctgggcttttggcctgttccccatcttaccatacatgaattgggacacaaaccagaccaggagtcagggtttcttaaggccttaaagagcatactttttttctaagggttctgaaaatgaaaacatttaaagcatttttgaattccatgcagtaaaataaaaacggtttagtcttttagtgaaataccgagtgttttttacttgaaagggttatggttattccaatatttcagagcatttgtagagtgctttgtgatgtcactaatcctgagccattggagaaacaaggtcaagtgatttattttggtaatgaaattttgttcgtggttggcagtagggcaaatgcagtcttataaaggagaaaaaaggacaactctatgatgaggtttttggccaccggaggaggtggcttcattcgctttctgctaacttggtctttggggagctgagactttatgtgtttgggctgtgtgtggataggtggcttctgctgtgggcacccttatgtgtaggcagtcgtttttatggattactagaaggggtacgagatgtcctttgacctggttcctaagggcatgtgtgctcagtccctggggctctctctttctctgtgcttgtctttttcattttttgtttttacacagctacgtgtgactcttttcctggtagatcatgggagaggagatagatagcaggaggacaagatgagagggaagttcttgatcaacaaacttatccagaattggatttcagaggagcaggctgtagtttaaaacaaaacaaaataaatagcaaaccacgggaacacctgaatttgttacttttgcaactgaaaatcccagtcagatagaccccataatcaaatagggcagggacaggaactaaccttcactggttgcttgctgtagaggcagagaagtatataacacttaacagtctggactctataaataatatgaatcctggccctgcacttctagatatcagatttttatcgagttaccttacttctctgtctcaatttcctcaactgaaaaggaggattagatagatcttactgtgtaggattattagaagaattaaatgaactaattgttatctggaacaccaccaccccctgcaatgtttgaactgtatctagcatatagtgagaggtatgtaagtgcttatgaactgaaaacaaagaagtgctctctgccaagcactatgctaaaggctccacatacaattctgtctaatgctcttaacaatgctttgaagctggtattatcatcctcactgtatagacaggaagctgagtctgagaggggtaaaatggcttgcacatggccaatataaatggtatagctagcaggtttcaaattcagggctgtctgactctacatcttggacttttctactgagcttttgttccttccttggtagagaccgttatacataaatccagtgaatcagtattgagccccagcgcagctgtattccagccctgtgctaggggttgtcagggatactgtagtgaaccagacagacatggtccctgccctcatggagctatctcaagttcatttgcaggaaactgacctgaggtcaggactgtgtgccaaagctttctgagaagtttgagagccctttgaagatggtcaccttccacttagccttttgaagcctattcttggctaccaaggtcgagggcacctggcctgttgctggcaggaagaaatcatctcaaataacatagcggagaggatcccagatcacaagcctggcctcggtagtggccaggaggatgtctggaagattctagtgccctaggatcctataagcagtctgggcagagctgttgcttccagacatcttcctggccactattgactttctccttttgcaagcagatgtcttcaggatccttgcttaggtcagctccaaggaaggaccctttcttactgggataccaggactactggtcagccccagagacctgaattgtgaggaccagcgaagatgagggggagggtgtctctagtcagtcctcccccgctgctgacctgtgccctgcccaccaggacagcataggacttaggattgcatctttctttacttcataggagcagaagtcagaagaggaaagagggctttttaaatgaggtagtggcagaactgacaagggggtatcagaatgagagtgcacacaagtaagtgggagtatgtattgattagtcagtacagcaaagagactgaaacctgtggtcgctacactcctctggatgcagaggactggtcaaaaaattgcagaatcatccttttataagatagtatgttctcataacagctctttgaggatcagggaggtaggctttgtcagtggaggccccagagccctggtgtggaaatggccatagactcccagccctggagggtctccaggccttggcaaagtgttcttctcggagctccatatgaacatcatgtggcatctttgatttcctctttcggacctctgattcagggtgttatttcaagttaattggttagaagcgtgaaacaaacagctatgtggtagaacaggctagaagctcccaaagccgggaccccaccgatcacaggatgtatttcaaggcctggaatatagaaggtgtcagtaatgtttgctgaataaatgcttatgggagatgaattatggttcaaacagagaacgtaggtgattaagcctgtaagccctgagggcctctcctgtgggaggaagtggctagaaaaaaagaaggaaaaaaagaggaagatgtttatttaatgatcttagattgagaaagaagaagccctattttttatgttggcaaatgttagttgaagagatagaaaagatttctgcacaaaatatggacaatagcagagcaagggttaattctggaatgctcagaacagatgagtaatggggaatttttgaaatagtttggttcctgtgagaatagcagggccagcgtcatcagcattttgattgggaagcttaatgtgtggggggtatgcaaaagtgtatgcacaaggtgtgagctcatgtgcaatccgggtacaaagtagctaattaaagatggctcaagaattggtcataagggaggtagaaggaaaagaacatgaaagtattaccaagttatgctttccaacagcttttctgtggcagtggatgagccctgggattcaggaagatgtggattcataaatcatttattgagggcctgcactgtgctttgaatgtgatggggacaacagacataaaataacttaaaaagctgacctgtgtgagcagttaacataccaggcactttcccattgctataggatgtgcgatcttgattattcctcaaaaacaacccaataatataggtactgtaattatgcccattttgctgctgaggaaagtgaggtccagcaaggtcaagttatttgcttgaggtcacatagtaaataagctgtggagctgacatttacaaccaagccagtcaatacaaatgactccaatattgatatggaaggaagtatattctgtactagagatatacctggtttagtagtggagcagcacaaagtgtgatcatttatgattggggaattgacttgtatatgtttgagaatgaaagagagcatgagacagacagacttagctaactttgaactttgggaaaaagatcatgtagcggtttttaaacttattttggattatagattattttggatttccaccccttggagaatctgtggaaagctatggaccctttcccccagaaaaatcacatatttgtatgtagttttaggactgttgcatgtaacttcaggcaagttctggagcacaggttcagacttgccccattggggaaaaggagaagggaagggcattctggctgaaggaacatgtgataaaggcatggaggcctggaagggcacagccctgatgtgcttagaaatgaaaatatctcctgggggaggggtacaggagccagcattgtgtcgttgcgggtccgagtgccatgccaaggtgcctggcactcatcctgggggcagacggaagccattacatttttttcaggagagatgacatgtctcagcctgtgtttgacaaaactagatctgaaggcgtgaagacaagttagatggctgttacagtagtccggtaggagagcctgaggcctgcactaggatgcaggcggtgctggtaggaggagggagtttcagagataaaaccaacagaattggctgatgggatgagatttgtgaaaaagaaggagtttgatttcaggttccacttctggctcattgggaggatggtggtactgttaagcgagatggggagtggaggcaggagaagcaggtttgtagagaagagaggaatgaggagttaagttttgtcatatgcttgatgtactggatgaccatccagatggagatgacctgtaaggagttggaaattcctgcctagagctcagtcagattgaagttgcaggggtagtttggagcctcatcatcagagaagtgatctgataatggcctgtgatgcccaggctcacaatttatcaagggcaaaactggcatggatattaaatggaatgtctgtagcactgggagagtaaagtgattgcctttttcagaaaagggaagacagattagtggttcccaaggctcactatcaacagaaacactcaaagagcttaaaagacaaaacaactactgactaagaatatctgggagtatggcctgggaaactgtatttctaaatgctccctgagtcatttgggtgatcagccaggtttgagagctgctgggctagctgcagtctgggtccaagaagacaggaccacatttttagagtgataaacaagtgagcagagaatgaggctaacatttgaagcagtctttatgaggttttggtgcaggaaatgaatgacgctagtttcattcttcagtttatgttcactttctacctagagggaacattaccatgaccaggtcttcagagagtttgaccatgcatggaaggagacacggtatcctgaagggcagaacaaattaagagaagactttttctaggacaggggagacacttggccatttggttagttggggaaaagaatttatgagttgaggatgtatttgatggagcaaaacccagaagagactttaaagggaaaggagcctcttttcctctgatgcagaatggaggaggatggggggagggccgagagggggcctcattgcttctctcaaatgaaggttattgtgggcttttgaaaagtagagcaagcttagtacagatgtacagtatagatgttatcattgacagacagggatgattaaaagaactactcagcagtgagtattagcagagagtattactttcttttttatttgaaatttttgttgagatactgtagattcacatgcaatggtaagaaataatacccaaagggatcctttatgcatgttgcccatttccccccaatatggttacattttgcaaaactggagtgtaatattgcaacaagcgggatattggcatccacacaacccagtgatacgactcagattttcccagttttacttgaactcgtttgtgtgtgcgtactaagttgtgtacactacttgttgtgtgttagtcttgtgcaggttcatgtctccaccgccacaatcagaatacagaacagctccaacaccacaggacccgggttgcccttctccctaactgctggcaaccaccgatctgtcctctgtttataaaattttgtcatttcaaacatgttatataaatggaatcagactacatgaaccttttgggattggctttttttcaactcagcttaattcccgggagattcatccaggttgtgtgtatcaagtttgttcctttttatcattgagtagtattctgtggtgtgtatgtaccacagtttgtttaaccattctgctgttcaagggcatctgggctgattccagtgttcaggcatttcaaatccactgtgaacatacacgtataggtctttgtatgaaactaagtattcacttacatgggataaatgcccacgagtgtcatttgctggctcatatggtatttgtacattcagtatttttttcttttaaactgcccaagtgttttccagagtagttgtaccactttacattctcacctgcaatctagtttctctgcatcctcaccagcatttggtgtcatcaccattgtttattttcattgtgataggtgtgtaattgatacctcatgtggttttaatttgcatttccttaaagactaacgatgttgaacatcttttcatgtgcttatttgccatctgtatatcctcttcagtgaaatgtctgttcatgtcttttgttcgttttctaattggagggtttatgttgttactgttgtgtttttggaattcttttttctagatacaactcccttttttggatatgtggtttgcaaagattttctccttatctgtagcttatcttttcatcttttctcatgggcaaagcaaaagaacttttagcagagcaaaacttttaacagcgaaagttttaattttgatgaggtcttatttattagtttttccttttgtgagtcatgcttttggtgttgagtctgagaactcattgcctagccctaggtcctgaaaattttctcctgtgtcttgttctaagagtttatagttgtatgttttaaatgtaggtctgtgatgcatattacttgtgagggaacccattgtcatgattctgtgattttctttacaagaaggttattgggtttattcatattttgacagttgttatggcttggtcgtaggagtctaagttgggaaagtgacagggtgaagctggaggggctggtaggccatgaggcatgctgttcagaggctctggtgcatgtaggagaggaggcaggacaggaggctctggtcatgcatgggagaggcagcactgagattagagatggaaagatttcaggggatgagtttcgaggtgtggccacaaatacggtcaactgatgtgaatgtgggcgatggacatgggagatgaggaagcaaggcactgtgaagctcatccacagtgacttgattaatcacttagatgctgaacttcacagtggtaaagtgtgcatttttaaagaaggtaccgaagtaaaccaggtgctgagggatttctttgaggagtacatggccccatggatatgcatggaaagatgttgatagagtgtaagtggtgtctaaaagcagagagcagaacagtggggcaggaggtatatcaaggtcagaagaaaatgccaacatttctaccttcctcttcccaaattcttcagttggtccaaaactatacctgtttgtgatgtatagttatagttacatgggccagccatacaagctctttgagccttgttgccatcaccagtagaatggggctggtaagtcagcatgtttctttctacctctcagcaatgttgagagaaaatgtaattatgtatgaagaagttctttgaattcttaaaattaatggtttaattaatttaaacagaaaaccaaatatcgcatgttctcacttgtaagagagagctaaataaggagaacacatggacaccgacacatagatgagagcaatagacacggggcctgatggagggtaggaggagggagaggattgggaaaaataacgaatgggtaccaggcttaatacctgggcaacaaaataatctgtacaacaaactcccatcacacgactttacccatataacaaacctgcacatgtacccctgaacttaaaagtcaaaaaaaaggaagttatatcatattttaaaaaagtaatgcttttagaagttaagcctgttcaggacttgttggaaaagtaggaaagaacactatggaaccatcaaacagagttaagcatccctagttcagttagagggctgtgtggttaagggagaaattgagctgagccctcctttcttagggtttctgtcaaagaacagggggacggggagctccagggcagacttttagagatcagagccacaaatgatggaagggactgttgctgggcagaggttcatcaggcctccctcacagtggccctccgcagcatcagagggaagtagagagtgggtggacatttgtgttcttagcagcacaggcctggattcaacgatgtttctctgttctcatccccaccggacccccacctctagagcttcagttcctcactcatctgctgctgtggccttccattttacgtgaaagcgtgtctctgatttattattgttgttatgtattttatcccgttccagtgatagtatgtgtttaaagtggtctttttaaaataaatgatcattattgatggtagtgttctgttggtctctcactaaaggtgctattttagagactgttcaacttgataaatctaaatatagaagtgtgttcgttgggaggatcctagaaaaaaatctggaggaatttacagtctactaatagtggttgccacagggagatgggattataggagactcggtttctattatgtttctgtattaatgggattttttcaatcgcaaacatatgttacttttggaatcagaagaaaaaagataattgtgtcaagtttattttttcctctggttctgagtaaaggatattcattaaagaaaaatgtggaaaatagcaagagttagaaagcaaaccatattgcctgggtccactgtggtgtggtgtttactggcggcggggggttcacccggggaagttacggcagggtcacagtgggcagggaggggtgcaggggtgtttggagagcatctctcccttccacttgtgggtggctgaggtatcaagctcaggggacaggtggtcagagagtggcagtgctagggcgggggaggagaacagggcattcttattataggttttaggacattggtccgggacttcaacaggtgccctggccacttgagtgtgtcagtcagctggcccagctcagagacgcataattccaacattcatgtattatggtaagatggtgatgggagagagaaaggaagacgtccacatccattccttgaatgtgcataggctcacaccgcaaatagaatgaacgggatccacatctctgctgagtatttttcgttcagcttgtacatgagagtagacgtggtttattcctagagggttgggggcttctctctgccagtaatgtttttgatggccatgttatcctttgtaatagattcctggcaagtaatcttgtatttgtactgcctttggacagaggtgggtagattttagagaacaaaaacactgggtactttacagtgtgctacagattctcatttaattataatttttaattataataaaataaacttgcaatccgaatgtgtttgatcggcttgatagtgacctgctatgcataccctgcagataattctgtctgcctaccttccctttcctcatgtttcagttctagctaaataataaaatcaaatttgttcttcaaagcccatttggatatttattattattattattattattgttattattattattatcattattattatttttgagatggagttttgcttttgttgcccaggctggagtgcaatggcaccatctcactgcaacctccacctcccgggttcaagtgattctcctgcctcagcctccgcagtggctgggattacaggcatgcaccaccatgctcggctaattttgtattttagtagagatggggtttcactgtgttggccaggctggtctctaactcccgacctcaggtgatcctcctgccttggactcccaaagtgctaggattacaggcgtgaaccaccgcacccagccttatttttttttaaagtttgttcttgtgtcaatgtactctcctctccctcttagccttttagaacacagtcttaaaggtgtgatagcgaaacctgctgcccaggatgtttaatttgtttaaaaaattttttctttattgcattgtagtccccccgcctttgggggaaatatttgtcaccccaaagttttacagcttctggggtaatatttaacatatgttaataagctgagtttttttggccatttacaaaggtcccaattgctcactgtatgcctaccctcttccctgggtctgcctctgtgctctgtgacttgcccgatattttgttgagacgggctttggcaactgtctcttagatgaatggttctattacaaacacagtagcttccatgaccgcttagaagagattgttgtttatgacagcttttattgagagaggtttggtgcatgataatgtcctgataaggacatttgtacctataaagtagccacagccttaaacatatttgattgtcagtaaaatattggggatgatgacatgccagatgtgaggtatcggattgcatgtttattcaactgttactgcaatctctgtactaagatgtgcccttgtattttctgtctcacagcaacacacaaaatgcaatggtgatatgatcctgattatgaaagatgctatttaggttacttggattgtaaaccatgtgtattaggaagcattctctcagtccccatatgtccttagacagcaaccacaaacagttgttaggtgaagggaattgtcaagtgggttgaacatacgcattgtgatagggaccttttgaaatgtatgaatcttagtaaggcctggactgaccagggcaggtgatgtgacagtcaaaataataataatgaatatttgttcttgcaatgaatttttgcaataatgaatatttatgcttgcaatgtgccaggtactgttctgaacacttagcattaacccatttaaaccttctaacaagtcttatgaatagctactattatcttacattacagatgaggaaaccatggcctagagaggtttagtaagttgccctgggtcagattctcatttgattgtaatcgttgattatatttaatcatgaaagtagtggttaagagctcaggctctggggttcctatcctggctccagtcctggatgttcttactgctgcctggctagggtggaagagagttttggttccaggtaaacaatagaaaagaaagaatgggctttcctggtgtctgggataccgttcatcctgttttttgctttgtaaactcctactggtcgttaaaaaacactccatcctctctgaagccttccttaatctccacaggcagagctaatttttccctctcttatgtttccaaagcacatgacttttaactgtccattaaaggcctcatcagactctttttttttttttttttttttaaactgtagtaagcactgtcaggctctgtttctgtgggtctgtacccactgagaactcttcaagggccagtgctgctcagcctccagtatggtccctggcacacattaggcccccaaaaaatgtttgaattagtgaaagttgttggtaataaaattccatcttgtgcctctcaagagttttctttcctacattcttggcatttttatgacatttacaacattttaatgaaacaacaagggcaagaattttgatttcataaataagaaactgaagcacagagaccaggatgttttctgttagattgttttatcttgagaaaccacctggtgaaacaaaacttaggagaattaagtcatttgcaagaccccactcccctgtttacacttttccatcataaccatattgatcttacacctgagatgttgtgaactagagtaatttgttcacagtagtaaagcataatcctagaaaagttagtctttgaccatttcttttccctggtgtatactggacataatatgtttgtaagcttatttgagatgtttctaagtggtaggggtgtgtgtgtgtgtaaatgttacttttttcagatcgactgtgggtttagttttagttgtctgaaaatcacttccaccactgattattctaagatgacattgttgatcttgaatgatacagttaccgggagcaatgaactaagtaaactctcactgtagagttcagaagggtgttgagttagggtgagtttccaggatacaaaatctggttagctcattggctgatttataaggggcttattagcctatgggagtaagttcttcattggtggtggtaaagggcacagggttgggaataagggttgttggggtttaaatcctggctttgccacttcactggctgtgtaaccatgactaatattgctaaacctccatatcctcatctggtcaatgggaccaatattggcaccccatctcacaacttcagtgtgaagattaaattagataatacattaaaatacttagaatacccagttcattctttgagagcactattaccctgacagctaaatcagacaaagatatcatgagaaaataactaatatcccttatgaatatagatataaaactcctccacaaaatatgaacccattcagcaacatataaaaaggttaatatacagtgaccaagtgggatttatcccaggaatgcaaggtcagtttaacatctgaaaatcaattaacgtaacacaccatatcaatagagtgaagaaaaaaccacatttttatctcaacagatacagaaaaaggatttcacaaaatccttcatgatgtaaataatcagcaaactaggattagaagagagcctctcacctgctaaagggcatctgtgaaaaatctaagcaaatgtatgtaatagtaaaagactgaatgctttccttctaagatcaggagcgagacaaggatgtctgcttttactccttcccttcaatattatactggagtaagagcaattgtacaaggaaatgaaataaaaattactcagattgggaagggagaagtcaaactatactgtctctatttgatcttgtatgtagctaaaaaagtaaaacaacactattaaagttcataaacaattgtagcaaggtttctggatacaagataaatacataaaaatataaaactcaattgtaaattttttttttttttttttgagatggagtttcgctcttgtcacctaggctggactgcagtggtgcgatcttggctcactacaacctccgcctcccaggttcaagcgattctcctggctcagcctcccgagtaactgggattacaggtgcctgccaccatacccagctaagttttgtatttttagtagagacatggtttcaccacattggccaggctggtctcgaactcctgacctcaggtgatgcgcctgcctcggtctcccaaagtgccaggattacaggtgtgagccactgtgcctgccactcgattgtatttctgtacttaacagcaaacaacctgaaaatgaaataaagcaattttattcatcatagtgtgaaaaagaacaacatacacaggaataaatgtgacaaaagagcaaaaaacatttacctccaaaactacaaaatattgtttaaataaattaaataaccgaataaattggaagacattctgtgttcatgggttggaagacttaacattgctaagacagcagtacctacaaattgatctacagattcagtgaaatccttatcagaatcccaggatcccatgacttctttgacaagttgattctaaaatttatatggaaattcaagacccagaatagccaaaacaatcttgaaaaagaagaacaaagttggaggactcacactttgtgatttcaaaacttactacagagctacagtctgaatcaagacagtgtggtactgggataaattagacatatcatcaatggagtagaatcacaagtccagaaataaacccttatatttattgtcaattgattttcaacagatataccaagacaattcaataggaaataatagacttttcaacaaatgatgctgagacatgcgaagagtgaagtcggatcccttcctcacatatcatatatcataattaactagaaaatgatcatagatgtaaaagctatgattatgaaactccagaaggaaatacaggaatgagtctttctgactttggattaggcaaagccttagatgtgacaacaaaagtataagtggtaaagtaaaaatagagaaaattcatgaaaattaaaaaactttcctgcttcaaaggatatcatcaagaaaatgaaaaggcaatccagagaacaggagaagatattttcaaatcataaatctagtaagcaacttgtatctagaatatataaaggacttttgccattaataaaaagataactatccagttaaagaatggacagaggatctgactggacctttccttaaaaaagacatacgttgaaaaacacaccaaagatgctcaaaaccattagctagcagggaaatgcaaattaaaactacactgcgatatcactttatatctcttaggatggctatcattaaaaaaaaaaaacagacaataacaagtgttagggaggatgtagagaaatgggaaccctcacaggtcactggtgggtttataaagatggcataaccactctggaaacagtctggaagttctttaaaagactcaccatagagttattataggacccaaaagaaatgaaaacagatgtccatacaaacacttgtacattaggggtaggtgtgttggctcccagcactttgagaggcctaggtgggcagatcgtgtgagtctaggagttagaatccagcctgggcaacatggtgaaacctcgtctgtacaaaaaaaaaaaaaaaaaaaagaaagaaaaaaagaaaaagaaaaaaaaaattagccaagcgtggtagtgcacacctgtagcccctgctactcagctggctgaggtgggaggatcacctgagcctgggaggtggaggttgcagtgagcagagatctccccacggcactccagcctgtctcaaaaaacaaaacaaacttgtacatggatatttatagcagcattatttctaataatcagaaagtggaaacaacccaaatgtttatcagctgatgactgcgtaaataaaatgtggtaatagctatacaatggaatattatttggcaataaaaaggaatgaagtcttaatatgtaccacaatatggatgacacttgaaaactgtgctaaatgaaaagaagattcatgaaagaccacatattgtacgattccatttatacatggaatcatatgaatcatacgaaatgcccggaataggtcagtctacagaagcaggaagcagattagtggttacctgagactggaggatttgagagaaaatagggagtaactgcaaatgggtatggagttctttctggggtgattaagatgttctaaaactagttacggtaatgcttacacaactctgtgaatgtagtaaaaacttgaattgtacacttaaaatgggtgagctgtatgaaatatgaattatatcacaataaaggtagtatcagtgtatatgctcagcatcatgcttggccttgataaattggtaaatgttagctaccaatgtaatagtaactctctgacttcatgtgcagagcacgtttatagtagcaaagatggaaagaaaggaaaatgctgagagagtagatgaacatacaagttaactcagataccaggtgagggagaaggtgactgaatctgtggcagccgtatggtaggagctgagtgctgcttttggagaaggtgaatgaagttatgtggtgcaagagcctgataccctaaaagtgtctagtaaacctgaatgtagttacccttaaaatgtggttgaacttgggtctggggatccagatgtcactaaacagtatcttcttcacaaaagagtaatcaccgtcagtgtgataaaagccagagtttttgtgtctagaagtcactaaaccaggtaagggtttgtgtgtgtgtgtgtgtgtgtgtgtgtgtgtgtgtgcgcgcactttctttttaaatcactgtatgacaaaggccagagttttagtttttgtgcctttttttttttttttttttaaggcagtgtctgggggaacttatcttcccacagtcagcccatggctgaccagctttgatttttgcagggtgtctttgggcctgaatgtttgagcctccctacaggagatggctagagcctagccctcatgctctggaagttagttctggtaaaagctttgcagttggcgctgtggatgccctgtgctacttaacagtggttcctcctttagaacttggaagacacgtgccaatagggaggaaggttctctgctaagatgcatttatttgtgaacacctctcacagtgtttttttcaaggatatacctgtggagggaatttcccatttcagttttgggggaaacctggtgagttgcttctcagatgtttaggtcacacactgacactcaaggtcgaatggctactgcgtggtggagctgtgattccaagaaaccttccatgtctgattgctaagacagctcacagtcttaaccactaggctgaattttccctcagggatggacaaagtggaagagagagaaagctgaaggcagagagatgtgaaaatacagtgttttcaggagtagtaaggaggctggtaagcatgtgggatgtctagaagggtggatggagtgtggggtggcttgtaagctgagaggttacgggagtgaagtgccaggcaaggatgttcgaacagtaagattagaggttctcaacttttctgtgtatgcagcatatacacaggaaggggggatgggagcccttgtttttaggatattcaacaagtgtttgaggagaattattctggaggctctatctcccataaggaggctgacactacaacacttctggtaggagatgaggagggcttgaactaggtcagaggttatgggagtgacaaggaggggatggatgggaaggacattttacatcagtatattagagattaggcatttagattaggtgtattagagatgagagggctctgtagggttttctgatgagggagaagatgaagatttttcatctgcatggatggcagtgccatttatagacacagttgtacagcaggggagacaagttgtaagggccagagttggggtaatgagttttgagttgtatggagtttgcagtgctttggggcacttcatggggagggcgccagcaggcactgggcaattcagcattctggatttgagaacagtttggaaaacatcatcacagggtttggagttgagaccctggaagtggataagcttgtctaggagacagagggaaaggacagaaaggaagaaaggctaggatagaatccattggaagcattaagagtcattgtcttgagtaagcatcttccatgtcatatgaaaccttacagatgcaggagcaggggagtctgaattcatgtatgcttactaagtgtgctgaagtatttgtctcctggtggtgtgttgatggaagcagatgattttcttgcaagttccaggggtgctgatgtcttggcatgttcctttctgtggccccctagggtgagttaatgggtcagcccaggatcctagttcctccttccctttccttaagtcaaagctggcctatgctccatgtgtgatctccttcttcccagcctccctgggagtgttgctgagctccgtttggagtttcagttgcaaggctttagccacccatgttaactgtagctcctatcgcttgagaagtgcagggtgaggggatcctggagaatcagctcccttttgaaatctgctccagcttgctctcttggggtcagcatgagtgtggagaagactggagaaaacccagagatggtaggcatgacctgccagatgcagcaagccctgccctctctctgtgtcagatcaaagactgactcttcagtcatttgacaccctaatgtgaggatgtttctgagccagggcccgggctcctggtggcctgtgcctgggagccgtggggaacgtgtgggcctgcatgtgctctgggtaagtgggggtaggagagtaggacaagtaacttcccagctgctctcttagacacagagctggagggatctggagagatcagcccagcctcctcagttttcagattggaagctgctgcccagagatgcccttttcccggttccagttctgagggcgagttggcccagcttggttgcagctgctcctgcatggctctttcctcctgtcccacaggtcctgggttccagggcacagaggttgttcccagtttggctggtgcctagaatgaccatatcatttaatgttcagactaagacacttcagagaataaatgggggcaatgttaacaatgacaccaggaaaacagaaataaaccttaggcaaaccaggatatataatcttccttcctgtgccttcacttttggctcaattcttattcctatgccaggtgatattccctcatcccctaccgtcctggtcctatggcccacatgactttaggttccgggaacttacagatcttggtctttggaggtttggtctgtggatcttggtatctagaggttagaaacctcagggatctcccatgttggagggtccaggagatggaaaacctgggaataacatcgtgagcatatctctgacaatccatgactattcagaacctagatccaggaactttgattttcagtagctagggtgggtatgtcataatttactaacttagtttttttttccaacatacatttgtctcttgcacgtagcgtaagatggcatgctggtaacatacaaatcacgagagcagcatcctactctgcaaacctgtagccccagatagagctcagcaactcagccatgcaatcttctgccttggaggtggaggggagccaaggccctgggctcctgacaggtgtgtgacggagcagggcatagttacttgtctcccaggtgtccacagtcacagcacagggtgggaggggacatgagcagctgggctttgctgagaccaagccaaatggggatttaggcagagaaggtgttctttatttgagagtagagcaggtggagatgaatgctctgcctggtagctttctcggactgcactggcttgtttttctatctaaagctggcagaacccagaccaccatggatcctcaatgacaaaggccagaggagaggaaatggttcttcactgggtcttctggctgtgtccttggacctctgcctctcccagctgaccagagtggtctggatttgcccattctctcactggagttaggagtaggattgccggacctggcaaatagaagtacgggaggcccagttaaattggaattgcagataaacaaaaagttattttttagtatgagtatatcccatgccgtggttatattttatatagcaactctacttagtaaggactggcctgattttgcttacctctggggcatggtttcacagtgcctctttcattcagtagatgcttattgagtgccaaggatatgtcagatgccactctaggcactggggatattgcagtgagcaacaacagacaagagttggtgaactcatggagcttacattctagtgggggcgatagacaataaggaagatatgtaagtatgttaggtggtggaagtgataaagaggaaaataaagcagggaaggaagatagggaggattcaaacctgaagaagatgagggattgaggggataagccagacagacatttgcagaagagtcttctaggcagagagcaccacagacatcaaagctcgggcatgcctcatgtgtttgaggactggtgggcctccgtggcttgagtggagtcagcagggaagaggatccagcatggaggtcagagctcagatcttgcaaagcctcatagccctctgtaaggatatgggctttcactctgagcgggagtgtgatctgattaggttttgaaaggatcaccggctgctgggtagtgaaagactgaaagcaagcctgggcccaggtctctcaccgtatcctcaggggtgggccatgggatttgagacctgcatgccatttggaataaaagggcatgccacctggacacagcatcaccttgcaggatctttgatttctttttgcctttttcttcctcatttaagggatacattcctactcaaaaaagggaaggatatgttgcagttatctacctcttttttgctaaccattgtatgatgcgcctggtttaagggacagttccctaatggttcctattaagctttggagaaagagtagtggtgtggtgggtgtcacatacctggagctttagagccttctgagaagataattcggtaaaaatacatcattttttgattggtgttgaaggaagttgtttttcgttgcacagattaaatttaaattgttcatgagagctaaagagcttgaaagcatttctttgttttctaatctttaaaagtagagaagagtgagctggctatataatatagaactttctcggctttactttaccaaagcagtctgatttaaaaacttaaagccaacatatttcacatttatagtttaagattataaaaactaaatatgcatttaatttcataaatttatgtacttaatttcataaaattatgttttttggagaaaaatactgaggctataaaatcttggcttgtaagtaaataaaattattttaaatgtcagccagttttgatgatgagagctataattctaatgagtggcaaatattttctagatatctttgaaatgatactctggtttctcttcagactgtataaatctttcactttttttttttttttttgagatggagttttgctcttgtcgctcaggctggagtgcaatgactcagtctcagctcactgcaacctccgcctccagagttcgggtgattttcctgcttcagcttcctgagtagctgggaccaccacaggcactcgccaccatgcccagctaattttgtcttttttttttttttttggacggagtctcgttctgttactcaggctggagtgcagtggcgcgaccttggctcactgcaacctccgcctcctgggttcaagcaattcccctgtctcaccctctctagtagctgggactacagagctaccgtgcccagcctaattttgtatttttagtagtgacggggtttcaccatgttggccaggctggtcttgaactcctgacctcaggtgatccgcccgcctcggcctcccaaagtgctaggattacaggcatgagccaccgtgcctggccaaatcttccaccttttactaaatatctttgacaagccttttgacttagtatactggtaaattagctttggtaatattattaacagatttgtaaatttttggtatatccacaaaattcatttgaaaagaagcaaaaatgaaacctttaaaaaagtataatgtacacattccaaatatgaaaatgtactacttcaccagagttgtgaagcatgtaagacgtggtccatatttaagaacaaagcagactttttaaagggactgtcttgtacaacatcacgcccttgggcactgagaatatggaattacaggggtgatccctgtaaaaaatactgagtaaaatgcaatgtgtgctaaaatgcatctatatgtgtataatttaaaaggcaggcatttcagtttaaagttatttttagactagagattttagctgttttcttaagcagggattaaaaaccaatttaactgggggtttgggtttgttttgttttaagagatggggtttagagatggggcctggctgtgttgcccacgctggtctcaagcccctggcctcaagtgatcttcctgccttggcctcccaaagtgctgggattatagacctgagccactgcacctggcccaaaactgtcttaatgtaattgagactcttacacacataataaattgagatttttgtcatctcagtttggaattaacattgtaaaagtacatgcacttgagggttagatgtaacattactacctctagctgtatgactttgattttagtaagtctcctctgtaaaatggggacaatgaaacctaccccgaggactggttgtgccagttagatgaggtaacttgaattggttcctgagacagtacctgacacataagctctcagcacatagtgaccagtgtcattcttattggcattgcttttattatttatttttattatttttgctatattcataaaatgtatttgaaaagcaaaaatgaaatactttttaagaaagtacagtgacttgagtgagaccatacagtttatgttagctaatgatttccaaggccatccaagttcaagttttgagtgtgcaagccagcatcttttgaataccttgagagagggagcagacaagaaagagtttggctcagagaaggtaggcggtgggaacccagagtcctggtgagtgtgcctttacacccgacatctccctccagatggcttttcagccaggttgataattagcatcaacagatgcaagccgagagtctcctgggctgcatgtctccagcatggatatgtatggagagaagcatgcagcatgtggaagcccgagctcagttgggttgtacggctgggctcggctgggctcagctgggcctgtggaggcattgctccgagttgggcctgcctgagtctcagctggtacacagacactgccctacagcccaggacctgcccagggggctcagcgtaacagacccaccttggtggggggctgctgcttccagctgctttgcagcttctgtcaggccagggctgcttgagtccttgctctgctatttaaatctatcactcgttggtgacagctttctgcttaagcagtggcagcatgtatgctacaggtttcagctcattacctctgtagggctgttcctggactgctggctgggggaaaggccagccatacagactgaggcaccagccccaaactctgtattggatgttgctgagcctgggtggagagtggggccgtgctacctacagtgcctgctacctgtccttcagaggacctgtctgcagcagggccagagcctaaggttttgttttctcccagcctgatgggactgtgatacttggacatggacatcaaggagatgtgggctttgccactctgcttaagtgggcctgggcaagtcattttacctcttggggttcattttctctgttaataggtggtgaacttttcaagggtgattaacatgtcatctttatctccatatcccttggacacagtaggtactcagtaaatgatagcttaaatttgtaaaatgggaatgataggacccttatccctaatttgtactgggcagagacaatgaatataattctattaaactttgacaaatgggaataaagtgaaggaacccttgtatttccccaggttcatctcccatatccccagtattaaagaatctcagatgaatggggacttaaaaagttcatttgtgtatctttatttactgattcaaacttttactacctttgccagttgatctaaatagacatctctgtttaagcatcttctgtataaagaaggtgtataaatagtcaagaagcacatgaaaagatacttaacattagccattagggaaatgcaaattaaaaccccagtgagttaccacttcataccctcaggtgactatggtcagaaagacaataacaagtgttggtgaagggggtgaaaaatgggaagccttatgcattgctgatggtaatgtaaaatggtgcagcctctttggaaagcagcctggcagttcctcaaaatgttaaacgtagagcaattctatttctaggtatttacccaagagaaatgaaaacatatgtccacgcaaagacttgtatgcacatattcacattagcattatttttatatgtgcatctgaatgccctcatctccgttatggattggatgttaggacaccctatagaggagatttccagggatagctactcttgtgtttgtcttcttatatggggttcatgcataggaaatgccaagcttttggcctctctcatttataacttccagataacagcctaagtttggtctatgtttaaggaaattcaggagtcttttgcagggcttctgtagaaacctttatcaagtaaaagtatctggtgtttcccaggctttgctctcctgcattccttgtagtcagcagggaaggaccccttgttatgatgtgagttactctcaacatttcaggcttttgaagattaattcctgatctgagggaagattctggcagaactgggatatctctagaatgcactgataagggccttgtcagtttctggggtgggcaggtccttcttatagacggttttgtgactaagatacctgatcagtaggctttttttcctggctgtaactagtgatgggttgcaggtgggtgcgtgtggggatggaacatcttagagttgtctacaaagttaggcatcagagagcatgggtatcatggagagaactttttgattgagatttggggccaatttaagtcagttctctaatattttcttgcatttgagttataagctgttcctataagtaagtgataagggagtagtgggaaaatgcatccttaattaataggcagaataaagctaggtggccataggaaggccataaaaagcccaaggaagcagccctatttatttgtagaacataggtgaaatgtttattatatgcaaaacaagttaaaccaaaacatctaaatgcaccatagtatatgattacagaaacctgaaagatccaggagtaacaataacaaaggaacaaatgaactacacatgaacactaatcttccctggaactaaggataggtgggcacttagaagtgcttctgggatgggaggtcaggctgcagggtgatggacattgggcatgtgcttgggacactccttgaggcacatggagactatttgagatcacctctctgatcagaaagttgtttggtgagtaccaaaataagacaaaaatgagtaagtgtttttaagggagatttccctcaagctgtgtttggtagataactaataactctctgttctgggatattttctctctaggccactgtcattgacctctcaaatgcttgggggtgagaagggtaaagataatataaaaatatcaagaaaaggaaagtaaagggaaaatagtaaaaaaaaaaaaaaaaaaagtcctatatagtcctatgaagaaagttttgacctagatataaaaatataggcaagtctgaaatcttgttgcttttctctttagtttgccttcgttgatataagtctgtttattcatgtctgtatgctaaccgctgacacttaaatgtgaaattgttctcaggactctgctgcattgtcctactagtagaagtcctggttttagaacataaggtctggatatgtacagcctagcttttggatgagcaactctgtgcaagttccccaacctctgttcaacttcaaaataagggcagttatactgaacgcctgtatgggtgctatgaggattacatgagatatatagtaaagctagccaaaaaacattggttatgggccaggtcccaaaatgttacaaaatgagctgggcatggtgactcatacctgtaatcccagtggtttgggcagctgagacaagaggattgtttgatgccaagagtttgagaccagcctgggcaacatagcaagaccccatctctacaaaaaattaaaaaattagccgggaatgatggctcatgactgtagtcagctactcagaggctgaggcaggaggattgcttgagccaggagtttggggctgtagtatgccatgctcacacctgtatagccacctcattccagcttgggctgttagcgagaccttgtctctttaaaaaaacaaaacaaaacaaaaaagatttttgcatatcattgaaaatctatgaagtggttttttttttttaatttataaatatacgttattcaaccggttgcctatttttgagcaattaaagtgggttttccctactacaagtaactacagtgaatgtccttgagtgagatacataattatttctttaggaccaattccaagaagtggaatggcacagttaaaggatagatattttttttaagaactatgataatatttccaaataccaatgtctgctctactaaaaaagtagtgagaatggtcatttcctcagtctgtgatcagtgctggatatttaggtttttaaatatctttgctattttagaggtagaaaatatcttatagtttttttgatttttatttctggtaacagctgagcttaaataatggtatattttattatgtactgtgtttctttcatacaatattgtttaattttgttcagtttttcctttagagtattgtctgtcttattagtttgtaggacattgactgttttcacttttgttgcagatacctcaagtttggcattccattcattcaaaaaacccaccgtttttagataacccactgacatggtgaagtaaggacattgttaggaaaaaggcatgtaggatgtggaacatgaatcaaaagagaactatcctggatgatctctttgttgttaagcccagtgattgtctgagggagtgggattggtggggatctcactgagtgctgactgtccagaactcactttctcattgtgatctgactccagttgttcaaaagccgttccttactgggagaagtcagagcatgggatatcccttgagagtatatgtgaaatgcattactttgaagaattggttttggaacactaaagtggataatggaagcagctatttcattcttacagctctggagtaaaatggcgatgatctttggtctaccccaaaactgtcttaaatttcgcttgctttggctaactctgataggaaatagctatgggagagtaggaagggaatggggcttagagcccataattcaaaccctactaccacttctaggtatgagctgtgtaaccctgcacaggttacttatctccgttttctagattttatgcggtccatttggcatgtcctaagcacccagtacatgttcattaattattttttctcttctcaccaggtctggtctatatcatgttcatctctatcctcattagcgtgatagtctctttgagattatttgatgaccaaattaatggggctggagtgtaacagcttaagagcaggtacattctgaagagtgagaataaactttgtctgtgtattatttactgtttaagaaaaaagaaaaaaacagccctcatggtgttgatggattttgggtaatcaagggagatttggaatatccctctcttttcgacatgtgacagcctgtctaggtgagggccagggtcacaatgatggttctgattgttcctctccaggagggcccctgaactttgacatcatctcctaacgcagttctgccggaggccttcctgtcagagcctcctgggccagaatgggcctctgtggcgagccgggcctgtaactgttcccactcataatgagcagagctgctcctgcaacccggcaggagcacccgagtgggtgtgcatgcacataatgggcccagctgctgtggctgcagcctgtgaatgccttccaagaggccagatgcctggacacatctctcagcagctacttttcctttaagggggatgctaactccctggcgcttatccctagtacctctgacaaggaaaggaaatccatcctgccctgaacagcagggtgagcaccttcaccggattcagtctcatgcatctcagcaagggagatgctagtatctaattgtcttagtttcctagggctgccataacacaatagtgtaaactaggtgacctaaaacaacaggcatttattttctcacagttctggaggtgagaagctggaggttgaggggttggcagggccatgttttctcaagtctttaggggaggatgtgttctgtgcctttctcttaaaggctactgtgttgccatcaatgcttggctttccttatctcacagctgttaatttcagtctctaactttgttgtctcatggtattctctcctagggttgtcgttgcattatcttcttgtaaggacaattgtcatattgaactaagggatcgccctactccagtatgaccttgactgatcatatcttcaatgacaccatctctgaataaggtcaaatttgaggtgtactgagggttaacacttcaacaaatctttttggggcatgcaattcaacccataactctcatgttgcatacatgggtgcaggtttaaagaggatcagtaatttgggtatggtcacaattaggcagtgttgggaccaggattggaactcaggccagcctgtccaaagccacttctctttctactaaactttggtgtgtcagaatcacttggagggctgataagaaagactggggcccaggctttatacccttgctcctccacctgtggtccatggaccaactggcaacatcagcatcacctgagagctttttttggaaatgcagagtctcaggtcccaccacatacatatttttaacaagatccccaggtgatttgggtgtgcagtcagtttgatgaagcacctgaatcgggtatacgctgcttctcagtcctgattgcatattagattgcttgagaacagtaaaagacaaaacacaaataacagtgatggcagccttaccccacgccattgaatcagatctctgatgaggcaccgacgtttatattttttaaaagctgcccagattattctgattcacagtataagttgaggaccactgtggggctggaggtcctcatttctggaatatccagacttcaatattgaggttgagaattctttttgcacaggttcttctttttatttccacagtagtgcagaaactgggccaggaggggggctagtgtacggaatttatttcagagaaggcagaatattatatagcaaaggagaccacagtgcattttttttctgactttacctcttacagatactaagtgttgggtagcaacctatttgtccaccccaggagcttgggagaacatgaaaagtggtgtggagatagcatatagtgggcagtcagtgcttgttgaattaaattgaataacaaaaaccataggaaatcagcgttgttggtctcactgaaacatatcatttatagagatgctattgtgttacttttggggtacaaggaagagttgcagaagactgcacagatgcttacgatgtttagcaattcttaggctacgtgggatggcttatgcttgtaatcccagcactttgggaggctgaggcgggcggatcacttgagtttaggagtttgagaccagcctgggcaatgtggtgaaaccagtctccacaaaaaatacaaaaattagctgggtgtgatgtcacacacctgtagtctcagctacttgggaggctgagatgggaggatcacctgagcccaaggaggttgaggcttcagtgagccatgatcgcaccactgcactgcagcctgggcaacagagctagatcctgactcaaaaaaaaaaaaaatttagcaattcttgttatatcaataaacatggaagagttattggaagttttgagaataaagtgggagcaccccttaatatctacagatgtggccgggtgcggtagctcatgcttgtaatcccagcactttgggaggccgaggtgggcggatcacgaggtcaggagatcgagaacatcctggctaacacggtgaaaccccatctctactaaaaaatacaaaaaaattagctgggtgtggtggcgggcacctgtaatcccagctactgaggaggctgaggcaggagaatggcgtgaacccgggaggcggagcttgcagtgagccaagattgcgccactgctctccagcctgggaaacagcaagactccatctcaaaacacaaaaaacctacagatgtattttccgttgtaggttttgtggtgaggggaagcactagtatcccagatggtgacctcttaacttttaattcttcaacatagacttgaagaaggatggtgattgtgttcagaccatcttgccctactgttccctcaaactctgtcccatcagtccttctcctcttagctgatcttttggacaatcacagaatgtggggaaggggctcatttcagtctggggtcttgatgtagcatgcatttggtcctcagactagggctttcacagacggttggcaccctatccaatgacaattctagtgtccttttctcattcctggacttcttgacgtttgtgcttttgtaccccctggtgtgccacccaccccatcccatctgaaaatccttggtacagcccttaagtcttggatgtgcatgctgtccctctctttttttttttttaaactaacctttcttcctcttcctgactccactaagtagtggttatctttaaggttttatttatcccctcttttttgtaggggtttcctccactctgccaattttactgtcctatctgtgcagaggatcaccatttctcttccaaatggttgtcccttcatcaccaaaacatcccatacattgaaaatggaattctccaacttctcttgttttctggcttgcttttttatgtcagtgtatcctatctactatttttcaaagccccttgtctttgaaacctcctatttgatttaccctgtagggactgatcagtcccttactcttccattctcctttgggacatcttttgtatgttcatttttcctttggataattctcattatccaaactcttaattgcctgatacctggatgagtctctagctatgctttccatccctgcaatggaaattaaactttttattaaagccgtttgtgtaacatatcaactctacctgtatttccacttttatgttgcagtactgccctggtggcctcagctccagctacactattgtttttacctttcccatagttgcctcctgcacacatgctctgtggttggcccccgttgctgactgctgattggagatgacgtgtacccatcctctagacagtctgtgcttttcctgtctttggagcttccagttccacccccatcagtttttttctgaccactccatcttgccttatttctctctctttccttttgactggaagagtactcatcttttctaacatcttttcataaactgttttgatttcacttatattgatttttaacgtataatgtgctggtgttctatttcctcagttagatcagaaggcccctaaagacagggctccattggtgttaaactgccatcttcaaggtctgggacttgatttctctttttttacctccacaacaaggcactcctctgcacccagtcggaattcagtgcctgtggtcaagtaaatgcatgaaggaagttggaacccgtggtgggtatgtttatttaaatgtgtaaaccaagaatgccttatggtgtgtatgccagaagtgaagttctcatctgtaattaccaatgaagaaaacaccttgtatttacggttgagtttggcaccaaatcagcactggtctttccttccatggtacaaatgttgtaaaactctgaatgctgcgtttccataaaaggagcatgcatttctgtggaggtggtgattgatgttggatgcctttaggcggtgccatcctactcatgagggaagcagtgctgttctaggctcagtccacgaattggtttgccttttctcctttcccaactctgccacctggaaaacaaaacaaaagcaacaacaaaaccccccccaggcattctgcctgctggcaccctgttagaataaaaagattagaacacttggtatctgttcactcactcaggtgaagtttgagatgtcctactgggcttttctatctgtagacccatgaaaatctcattgaagaggtgttgtggaaacatgagaaatacatgtttatcatcatttgtttgtttatttacctacctgtctaccaaattagaaaagttccaggcgtttatctcagtgttttacaaatattaacttgtttaatttaaatttcataaccaccctgagaattgagtggtatgttttcattatcccacttcacagataaggaatctgggcacagagcactgaaggcgcttgttaatagtcacatgcaatctttttcctatttcttggcttccagtaatttttcaggtaactaaatgcctgtgattcccaattaggtgtcgagttctatggcttttatttctataaatcattctggtttctttttatggtcatggctgtacttgtgtttccctctgaaattggcagaagatgagtgtgtgtgtgtcagcgtttttaacacccactaaaaataaatctcctacagtgctttacagtttataattgctttttcagatattatcttccttagtccagcaatgctggtaagaagagttattatttatttccatttaacaaatgaagtaagtggcttagagaggttaagagactgaacatatccttaatgtgattagtaccttggaatttgaacccaagtcctcttaatcctttgctcttccaagctgttacgctgcttgtaaattgggaaaccctatagtctgtttttcttgaagttctttgtttttctaacctccgtcaaaataatgtagtgttttgcttttttttaaacttatatcccaagcctgtatggtagaagatgtgaaagtaggggggttgagaatgcagtttttttgaaagagaggagtttatcagatgccacaagaaatacttttttctgtttttctttgatagcaaaagagtaaaaattttgcaaggcttttcttgatatttttggagtccaggggaataagtgcataatggtaataattaaatacagtttccagtaagggagttttctcaggtttagctgcacaggcttagaaagttgggtgagagaaggctttgaggagagattagaagttggagagcccatctgtcgtgccagtatacaaaaatgtccgtggatgatgactgcttgcacctccagagctagtctcctctaggaaaaatcaacagtcaccagtgcaggagaatgaatgagtcagagctctgggtcctgagccggttttacctcttagctttgtgatcttgcataaattatccaaaggatctggactgcagtttagttcagtgtagcaagctttgatcaaacagctatgtgccaggtactgtggtaggtgctctggagagaaatacaaattagataaggcttctgctcttggatagttctcataccagctggggagactgacaggaaacacagcgatggttcctgctgtgttagagatacgttcagagggctgataagggagggggacgcaaagcatatcaatcagggaattctactaaggtgctgattcaaggtcagcttccctcctcctgaccgctgtacttagcacagcacgtagaggggactgtagggaatgcaatgaaagtgaatggtgacaaaaaaatgaaaaagagcctcaaggcaggagccatggttttctcctctggggtgggaattttcttcaatctgggaatactgtggtggggcctctcatcttcctttcctcccatctctgcccccaagcaccatgtctttttcctagcacaaggctagtctcatagatttctaagagtcctatatagctgtctttatcttaggcactagcctaagtaccccttgtgaatggggttggttgcatctttgtgttctcagtgtcagcaccatgcctggcacagaattggtggtttaaaaattctgttgaatgcatggatggatggggattgctggaagcacagcctggaaggagcagaggaaggagagattgaaacaagaagagtgagatgtccctgggcaatggctgatgaaatttaacccaggcagggaggggcttgggctgaaagccttattaaaaagctgccatctgcaaagcaagaatttaactccttggtttcacaagaaaagagtaagtgtagcctagaaattggggctggatttgaaaattagccccaattctgcaattttcaccgcaataaaagcttctccagttatacatggtgattggtcttgatgggctattgtggacagaggagggtgctaggttggggtggacggggccacagctcagactaaaaatccccttttctctcttcatgagcttggctgcagatgtagaaactagagctaacagcagttttacctcatcttaaagaaaagtagtaaattaatggaggctttaattaattgctgtggtctgttgagtacttactataggctaagggctgtagggaacactttaattcactgaataatgtcagtaactctgtgaaatagatattagtgacctattttgcagatgcacaaactgaagctcaaaggggttttcacagatagtgcaatactaagttggagccttggtttgaacctgagcgtgtctgcttccaaagcccatgctcttaggtggattttcagtgatgccagaagatggttggactttcctgaagatgtttatgtgcattgtcgccacagagtcaaaccaagaattgtatggttgtatttcattcagaatcataacatgcttaatccagatgatgcctcagatgatgaaggtgggttgcccacaggctgtattgattggtgattcttaagagtgtaaaaaaaggaaatcacttgattttgttgtggggaggcagaatgtatcacacaatagcttggttgagtttggcttaatgtagatatgtttaatataattagactgagggctgaaatgggcaccttcaggtcactgtggaatgagacagagccctcactagatttttgagtcacttgaggtggttatgccaagccctgttcacatttcacacttgagtttaagtatttgtgaagggaatatagatctttggtttgaactagatatagctcaaaggttacccattcagaacagagcatttcagcctcagggcacctacttagcctctaagatgagaccacatctgaaccagccaagtcagcctgggatgaggttggaggagaaaaattcatgtgataagtcagattacaattaacttttttgttattactttttgagtgaccacaatgtgtgtgggacttcgaaatatggaataatgatgggttttattatttctttttgagaaaaatccagtcactttttttttaacccgaggaagttgaatcctgaagaaggggagatttatctctgccctttgaacttaaagcccataaagtaaaatatatagtttaaaacaattacatgttccccccatctcaccgccgcccgacccttcacagatagtgtttgacaaaacactatttaggaaagtgcctgactggtggtggaggggccttgcttcctgtgaatctgcattccctgtgccacttgcttccttccctgagaggttctggtggccaggtgttatgaatccaggtcaagatgaagaaaacacacttttgtcatttcttcaggcatgtggccgacccgaccgggtctcaggtattccagatatgagcgatgtgccgattgcgcaaggctggaagcattgctcactcggagataccgaggcctgcttgccccgagccctttgttctcctggttgaaagcagttaattagcaactgtctccatagcaacaccctcatagtccaaaaacattgtctagtttttcagtttagcttatcacactgtttacctgaagggcttttcactgctctgagtctcatttgagttggcggcatgcctgttggggaagtgaattgtcaagatagaaaaaaacaccatggtagcaagaagccgaggagacttctctctacccagcccaacccgggccctggattctgggaaaacagaagttgcgcctgcctaacattttcacctgtattttttttttttgttttgccataaaactgctgttctctccaccaagccctgaattgtgaggatttttcccccctttccccgagaggctttctaagctctttaatattccctgtttatagtacatttccatgattagtcatcttgaaaccccgagtgttctcagcccctgtacattcgaggaaattttgcttccctgagggtcttggcatttgcaaaggcccttggatgaaggattatgagtctgaatgtgaattagtcagagcagctttgtttttaggcataatgaggaaaggcttctctttcttggtttaagttcattgtttgtgggaagaaggcaacttcaggtggcttgttggtaaaataggaaaggaaactgtagcttttttataagccatgcaatgaagataattttcatagctttcatggactgagtgcagtctgtgtggccctccatgccagctgtgtggccctctgtgcctgctgtgtggctcatggcgccagctgtgtggctctccgtgctgggacgcttaggagctttttatctcacatctgcaatgggaagacaggaggcagatgggaaagaagactgcatttcctgaatgcctaccacatttcagttgctgagccagactttcacaaaatgaggtctcctgtatccttcacagcaaacctgctaacgaggccctattaagtattttaaagatgggaaactggggttccaaggagtcgttgcctgcccaaggttgtggaattctaatctagacctgttggtttataggacgccaacacttgtcctgaagcagcgttgtggatttggtggtggagttaggcggtacgtatcacagattgcagggctctgggagacttttgctaaggaggttagttagaatttggtggtgtacatgtgtaattagatgcctaagtatgtctcaggaaatcatgaagcttaggtccagtgataaaatagtagaatttaattttgaggcacgtgtgccagagcttatttacccaaacaaatgtaattctctttgaagtattaacttggaaagactgtgctttgtgatatttccattcttcagacctttttaaggaaactttatgggagcaagtgctttcccagcttgcaaaatacggctttgaatgcattcagcagaccattcttgagcattgaactccccttaatatgggcagagaagtatggcttttccctagcggtggtccctgggacctagcatgggttcaccaagaacgagccaccccaggctagcttcgcttctttctctgaaaaccttattaagcagaaaactatagtttatacaatgcataaatgagacctttgatctgctttttaattttatctactgtgttgaaaacagagacatagtctgagctgaatgcaagaactatggtctgaactgccccttagttaatacctaagagtgacaaacatgtgttgtaatgggagatcagtactatgtgatttttgttgactgtgcgatcacagtaagtttgtgatgtggcttctgcagaagcgagtgttacctcggagtgtgcagatagaggaggatgcataccatgttagaacacacttggagccaggggttctgttttccttccttcgctccctgcctctctccactatactgtatgccaggtacctttctatgtgttgggatgcaaaggtggacaaaagaaagcccctttagagagaacgtaaaaactagggtttcttcagagggcagcaccccagatgataaagagaagaaaccacatgtcacacaaaatcattcaaaggatggggtggatgtgggagtggtagtatttgccctgacttagaaaagactctgcagagacatgggtgaagaagcagcacatttgtccagtagactctagttataatcttaaaaggcagtcacattttggctcaattataaaaaagatattcttcacagtcctgcaaaggtggactgggcttctgctttaggatatagcgagaagtattgaagcagggatcaaaagaccatttggtggcttactgtgaaggtcaacaatataatgaatctcctttaaaatttccagtcatgaaaattgtataagtgagcaggcatgtcatctgcctgcaagacacatgctagtaatgaaggaagatgtatatcacaatgaacatgcctgctttatattgtttatttatttctttgggggcagctgaatatgatcaatttagagatgttagaacatttgtaactatagtttgtgagatgggcaattttaactgcaggaagtcttcagaatcacagcacaggttcaattcactgtggttgttatgtcataattatatattgtggatgtctaattccttttcaaacctagaagtaaagatcatgtaacatatcctagccaatattaaagcaatattattataaaaatgatctctgatgtagaaccactagaattagggccttaggtctacccatattgagtttgccctttttatttgcaaaatgcttgatcccagattgctatgagagatagacataatagtgatctttctgcttttgatagttaggtatcatagttttaagacagcccatggagttttagaaattgtgtctgtgtctacagaatcatgtgtgtgattagataaagattagtaggtacagaaactagctgaagcattgattgatacaccttgtaccttccaaagaattgatctgtttaaatcaagttagttttacagctccgtttgttgcttctctagattgattaggtggttttatgatgtttcttttatttttttcactaggaattttgctgagtatttttaatacctgaattgacagactggtttatcggtgttgggggtctgtgtgagcttctcattagtccatttacaatggcagcactttcatgtttaaatgtagacaaacctgtccctaatatttatggagcctgaggcaaagagtgtcagtggaagctcatgtactctatgttgaaatatttaaaggaaaattcgagttaatacactgttaaataacattttctcacctcctactttgacaaatttactttaataataacttggaacccaggttcaaatttagaggcctgcccccttctcttcccactccagctgtatgttgtaacatgttcatatggatgctgcagattgcacaagcaaaccttcttctccttcctcctgctaacagctgttcccaggccactccttgcagtgaagcatactcacacctgtgacacaatctgcccttttgagaacagattcagggaagtggcctacacagaccttggaagtggaaaagggttattggcttgagagttccaaagtcttgggtccttggtcgatggtctaaaaggtgagggtgttaggtgaagtgtcctcttgatcctcaaaggctcctcaccctgggaggaggaggaagatggctagaagaagaccagagcaagaccctctaaagtctagggcccaagttgggccctctggccgaggtctaaggactgtacagaatatggataaaagcatgactaacttccaactgcctttcatacttcagagcttgaaaccgagtagtttcaaccaagtagttgggttggcctaagtagctttgccatttaacctcgtaaatgatctaaacatcaacatagtctgagagttgaataaaaaataagtgaagtagttgttcattgtcaggtcaggtttgaattctctcatacttgaaatccctgcaactgtgaaattgcctgtaggaattgcaggttgtgctaaacaatcaaacgaattggtaggttggctcccataggcaaaatcttgaggctgtttggggcaaaaaaaattacaaaatataactagtaataagtgggatgcaataagaatcaaatgtgatccaattttctggggaagcaaattgcattgcactttgttttattttaaaaaatgatgtgaaaatacagagcatcacagcacagacaaatatcttacaccagttttcacaataaaatccccaaatgtgaaagctctccctttttgcaaaggcactttggaagcaataatgtttgtgtgcatagttgagtttatcagagtatactgattttttatcccatgaggttttcaaggaaagtgcagctggtcaacctttagtgttttctttgccacagggtatagttctgtttctgtccgctcaaatacagtctttcaggaaacgaattctctgtaggataccttaaaatgtctttgtgttgtaacacagggtagggggcagtatgtttaataggttagtgtggatacgtgggtcctgaaatcacagtcctgctttttgctcctggctctgccacttctagttacttgtgtaaccttgagcaagttacttaaccttctctaagtttcagttttctcatcagtaaagtgggttgaataatagtgcctttgttaaaaggtaggtatgaggattgaaaagtataggtaaaggggttagcacatagttaacattcaataaatgcaaactattaatcactattagctcacttgtgtaaggaaggcctatgggtttatagaaaggtaacattttgtggtaagagaacctctccaggggaacctctgtaaactccagagggctgcacggaaaattccactgtggatgatgggccttctcccggagtttacctgttaaggtgaagtaggtcgtgctttgaagtgcttggcagtggccagacctggacaggtactgagagttgcactgggtgctgtggttgctgtgtccccgccttccatcctaggtagcagatggtagtccttactcatctctgaagagtcctaagtagcccgagtcctagatgtaatttgttgcttatccgcaaagtggttttgaaggatatggtttttcttctttgggtatgaaacataagaggatgaaggaaaaatgagaagttttgtttctaaatgaatatagtacacagcctcagaaaatatggggaaaagatgagaaggaaaattatttttatttctaaatgcactattcatttcattttccaagtaacttgtggctatcattatttttagtgatttatgcttaaatagtcttccttgggaataatcaaatactggcttcaaatatagacagggaaattataggttcatagtaggctcataaaataacgcttagaatgaacttgggatgggacgtggaacagggcagcagactttccaccaggcgccattcctgtgttctcagctctacccttgagccttctctagtggggccccaaatgcaccaccatgatgtaagggtctgaccaactacttagtttctagcagcccagagtgaaggcacctctctgtgccttcctcttcgctaagcctcagtttttttgtttttgtttttttcccttgcaaaaattgagacagtagtgtccaatttgcagagggtctctgagaatgaaatcagaggcacgtagcaactgcctggacagtgccagcactccacctgccacccctccccactgccctctatttgtggagaggtggatgattttgctagtcacaaagcctgtcttctttgagacagtagggaaaaagcaaccactgtgattcacagaatttcctgaataggcacagctgcaatttctctgcctttactcatcaccataaacatactttaaagttgtcagttatgttttctttctcatttttggtgttgaaaaaaattaacctttgagtttcagtttccttttctgtaaaatggggagaagaatagctcccattccgtaaggtggctgtgagaatgtgagaatacaggtgacaggctgcataattctcgcaaaatgctgttggagtccctagaaggggaggaggggagctgtgaaatccggtttggaattgggaattttcatcctgagcttgtgttaaggaaaggaatgaggcccatcccaaagtagaaaccaaaaacgttcttactgaatatggcacaagcactggttttctttcctaatgagtgtggtcattattagagttaagcctttccctgcatggcaagtgtgaacatgtctgcagaccctgaggacaccagagcggcaggctttgaagggagagcagtggacactcagtgacggggccactcacagtctagctctgaccccaccagatcctgtaggttcctggttcttgttcctggtgaattcctgactatcacctttacacagtgatagagcctttatttccactctgcatggaggcatattgcatttgaaagattgaaacccattgctgtccccattgacagggagcatgttaagggtaagatgctgcatttcactcattgctgggcccccatttctgaatctggacttgtgtcttgtaggcattcaagaagtagcagttggaagaatgtcactgatggaattgatgtctctgtgtacacacccccagatcaaagaccatgcttcttggtctagccataggaactctccacccttgagactcagccaggacgtggggcccagcctttctttacctccctggtagtgccctttttagagataggcataaaatgacagtgctgcccctcaagtctaaaggagggggcaaaacgtagcgtcctgtgcttcaccactgggggctggctgggccactgttaaggtctgtggagacttctgtttgcaggagaggttgatgaaaacccttggctttagctgtggccagaggatccaggctttaccttgtatgctccgagccctgtgcctggcaagtctgccacatggttatggaaatgttcctgaggcatgaaggaggcctttctggaccagccgatggggagtgggtgaggaggtgtggaggaggaaagaaagaaaactctttccccattcttttttttttttttttttttttttgagatggagcctccctctgtcgtccaggctgtagtgcagttgtgcaatcttagctcactgcaagctccacctcctgggttcaagcagttctcctgactcagccttccgagtagttgggactataggcgcacaccaccacgcctggctaatttttgtatatttagtagagacagggtttcaccatgttggtcaggctagtcttgaactcttgacctcgtgatctgcccacctcaacctcccaaagtgctgggattaaaggcttgagccactgcgcccttcctctttccccattcttaagtacctagtaacaggtctgagctgtttagaggtgtaagggagcttgcgaagttgggaagtgtccggatgtatggacgctggagcattttccccatgagggtctaagcctgggaaaatggccagattctactcagagacattctcccattttcttaaactaggggtgtgctgggagaactctgggctccttgcccacaggacagccgagaagcttttgtcttcccctctcttgctgagacacatcctccctctgaacttcccaccttagtcttcggagtcgttttagactcgagattgctagtgacttgaaggttctggtctttctgctatgattgggatctgtgctgcacccctgggtctggcagtgtccccagcagtgggatgctgcccagcagtaggtctttcatgctgacgagcacagtggctgatgtcattgtgggggagttccttctgtggccatagaggtcttggtctttaacgctatatctcctcctccctggccctgaaataaattcctttgggctgctaactctccttcctttagtggctgctgttagttaatagtccttttcctagactggtgagatggttgctttcatctcagcctgtgaggctgggagtcatttggatggaggtggccagaagctacttgaatgctccacggctatagaggacattcagcatccattctgtttttcttaccaaatgcatagaggccagccctctcactggctcattgtatgattcaggtgggatgacgtcccttgcaactctggaagtagaccgtgattgatataagcctaaaacagctatgtccacggcgattgattgagggatggtgcctgaccagtcacatccagtgagatagaggagatatctttctggggctgctgggaaagtaaagctttctttcgctgaagctttcagaagagaatcacacatcctgtggatggtgtagggtgaggacatgagttctatatgggagcagttttctttcataagaatcccacacatgtgcaggactggttactggttggaaccactaagtaacctattgggaggcagattggtaatgatgccatctaagctgttggaacaagacttcttagttaaataagccactaagccccctccattgcttaaaagccagtttgatcattgtttcttagaacatagtgacctgatatgcagaccttcctcttgtgaatttgttgaggacttttcctacaaggtcttctccaaggtccgtgtgagggttcggcattagcatctgggaagccagggatcctcatgctaaggcagaacaaaaacaggagtcagggctggagaggggcgtctgtggtctctggggcaaggcagcttgaggtgggacccagaagtccagggaatcagagaggaacagtgggttggagtagatctgtgggttggaataggtctgtgagaggtcttaggggagtggtcttgcccacagtggagtggccccgaatccactgaggatcccgggatgggggtgcaggccttcggttatcatagactgtatatgtgtatctgggtgggggtgggggtagggtggtgtgtctaagttctttcatgtctggggtggtgttgtagatcgaacttctcccaaacaggctcagccacaccggtaggacgtagtctcttcctgttttgctttatgatgttcctgtctcttaagctgaaaagagcccctgaaagccactatttagttgcctatactgacacacacctgcgattggatggatcgtctcacacagagagttatgcaccattcatagctaacctcagggccggggtggtgctcagaaacactgtctttatgatatacatgggcttttgagctcgtggcttgtggttgtggactgagaaaattgcttcctgggtttatagagatggtaggggaaatgaccctcttgccaccacttattcagtgatggcttcctggtgtgatgcttggggatggatgtgactgaaaggatttcaggagttaattggaagagtacatcatagcatgcatgattgatccctatgtggtattatcattattagaatcccaaaaaggtgatggttaaaagagtacttaactatttgctggtcactggagagatggaaacactgaacatgtttgtccttatcctgcaagagctcagagcctaatatggacagcagatctgtaataaatattgtaggggatggtagagggacagattcacattgacacaaatttttaaaaagtaaatatttaaaagtaaactttttccctccagaatattactggtattcatcttcttccagatagaatatctaatataaaacctatgaaatttatcaagagaaggcttaatacaggagatgctggaagcgcatagattttcctcaaatccctcttggtacatgtgaatccactacatccagaatcaggccatgcatcttcaccaaatcattccctttggggaagtcgtggctcagtgctcttctggttcaggaacactgagccagagtaaatcacccctaatggtcctctctgcagccagtgagatttctaatacagcaagaattcaatagaacaatacctttctaaggtactagctagactgttaagaggggctaatgtggtagcagcctcctggcacaaaggcaagggtctgtggttagtgactgtcgtgtctgtctgagcagggagaatgtccgtgagcagaatagctggtgtccagatgctcctagtgaacttttatcagtgagcagacgtggcctgggagggcaagccagactgtccagccggcttggagctggaagggaggagttcagtcttaggtcaagatactgtgctgagggaggtggagctgtagaggcagtgggcaaactgggggctccctgggagccctggaagcagcttccaccactttggatatttggcaattggaggtggaaggatgccagggaaggtgtttgggtttcttttctctgtgaagttatggcagtgccatcttctaatcagccatcaagagagccacctttaagagtgcctcaagtgagccaaattaggggatcgccgggacagaaaagctgctgaggtgggatgagcactgtggatcatcttctgcccttctggaagtctttgtgggctggacatcccaaatgtgggcctgggaaaataacatttcccatacttcatgtgtgtatgtttcattttttacagtggtgcttttgataagcagtgtaacatcaaagccaagaactgtgctttccatttctggaaatatgaggagcccagaggcttctctttgagataagagctgtgtgactgtgtgagctacttaatttctccaaacttcagtgtgcaccttctttgcagggctgtataaggattcattgagatgctaaccatgacacacttggctcacagtgggtacttagtccttgtcagctttcctgcccgtctgcaggggtggcagtggtgccagggggtggcgtgctgaactgcaagttcatctgggatctcctggttgtgtttggatttagctggggtgtgtcctctcctcctacaccttgagtcaccagccaaggtggaggagagaggatggggtgtagcctgtgtccagctctctcttggacatggttgggaggtgctgaccacaagtccgaggccctgaaaagaagtgctgcaaggaggatgtttctttccccattggcacagcatcaaggttctcaacagctggacacaaacaagctgttctgggagccgtgtctcattccccttcacctcctgcttgctgcctgctacgctcactggtcaccagggctgacgtatggggaggaatggagagtggtctcactgacagtggatgtcattgtttgctctctctggaaggaggatgtctgaccgaggccagagaccacgctcaggggacctggacgcccggggagttcaagcgagcctctgtcctcagtgatggagtcctgggccactggggcagtgtttgggtgctgcttccactctggctcttgacaacagagtttgttccctttgaaacaagtttgtaggaaccagagtgtgtgaggggcctttggcagcgctgaaggaaaggcagctggaatctttgaccccctcaggcccccgctggcctggctagagagctctgcctggaaggggacctctgttgctgggcaagggaaggcacctttggctttaggaagcctgagggtcttgtccctgtcctggttgccagggctctgcctagtgccatggaagggaagaccagattggaagtgattcagaagccgaataaatgaagagcgtgacagcacttgagagtctttgcgcatgtcatctcatttaatcccctaatagcagcaagggcgagaggcttagacatgttaggaagcttgtcacaccgtaagcaagacagccaggaattctgatctcaagtccagccacccctgaccatcgcagagcttgtgtgtgtgtgtgtgtgtgtgtgtgtgtgtgtgtgtgtgtgtgtgtgtccccgtccgtcccgagctgtgtgtgtgtgtctgtgtgtgtgtgcacgcgtcccggagcgcacgcacccatcagtgaatgctgcctccacgtgggcaaggcatatgcgtttttctttcattattctcagaaacaggcatccagtgcagaacgggcctgtaatggttgctgactaagtgcttaatggagatgtttctgctgataagcctcagttgaaaagggaaagacgcaggcaagctggccaacatcaaagccgggctttgtttatagataagggtaggtttcattctgtgggttccagagcccctgtccccaaatctcagagggggtgagttttaaacagaaactgtgtttatctcccgcagtgggctggaagacaggcctgctgggactcagaagcttccctccctcccatcctcccttccttcctttttccctttcttcttccctccctcccttcccagatagctagccactgccctcatttataacataacataaataatgctctctctgccccagctgtttccgtttggtttttgttcttcacatattttattcgtacttgattgtgggttatttaaagtaatttggaaaatatgaatattaagtagaggaatctggagaagaggtcacagaactgtaatggacccaagctgcaaaaatgcaaaacacagtgtgtaaccatatgtgtgtggaccttccctcttagttaaaactggccatgacatgatggtatgcccctcttaacaggtgtttcaactagatgtaaccaagtaataagtagcttcaatgattgggtgatgacgattggactaaattgtaatctgggcagaagtatagaaattcaacagttttaagggcatttgtgatatatgtgtatgtgttacttatgtgttcttcaggacacagatggggccaaaggacaaattttctgtgttttcagcactggggtgcatgagggagcaggtgtcggccacaccaacacatataagttgttgcctgcgggtacagatcaatgaattctttcctgttacttcatggctcagaggaaagaaggaagagccagcaagttaagatcatgtatatgacgtagagctaatccttttaaattacatgttacagcacttcaggttttgatatgcccaggactgaggtccttttaggttttcagaagactgagaattcttaggaacctagacagggcctctgttaaggctgagcaagctgcggtctgccttcctgtctcttctgttgggcagtcacgggggtgctgatgccaggtggcttgtgagccttcccactttgcactgtgcctgcactcgggtggctttttatcaatccgatactgttgcactcacgtcccactttgaggctggatgaagtcaagctgcccgccttgctgccaccctctctcattccagtgtctctgaccacactctcactaggccctctggaaatcccctgtaggattttggaggagcattctgagaacggttctcttgtatacgctcttgttgtcaggacacttgagccaaagttgttggtcatttgccccaggagccccttttcttctgcacgctctttttccaggggatttcagggtaggttcaacactttaagttaccccgccccctttttggtatttgtagtggcttacacgccccaggtaactgaaaacttttgttggcttattaggggcatttccacattggagctgtaatccgtggagatcaggaagacgttttctttgggtgacttttttctcctggtgatgcagtgggccagtgcaaggaggagggtgagtttagttgctatacacaagccaggtacaagacttccagagtgagagggataatttacaccctgtggctatttatttagcacatcttttgtgtgactctccagtgctagggacagggatctcaagatgagtaagacctggttcctgctcttaagatgctcatggtttagtggaggggacaaagtgggacacaggtgatgatggcattacaatgagaatgtagagaacctacaactgctgcacccctccctgttcttcaagatgccttctctggccatcagggcagcatgtgcagaggcccgctggtttggaatagtgtttctttccatgtgtgatgcagcgttccctcaaagccgaggcgaggtttatgcacactgcccaattgaaatgtgtctcatgttcactcgctgctggatcagcagaacctcgcgcagggcactccttgggctcacgctagctactttgcctttgtttcttcaggccttgcgctgcttggattgaattggattctgccacgctgatattattatctcacgcctttaaagccagaatttgtaataaactactaatgttcttggaataaaggcacttcagagcatgcgtagcttgaaataattcttctaacacctagaaattagccaattttacttttgaaggagatgagaataaacatttagtggtcagccagacggagaataaatggccagcatttgagattttcctgctcctgtttatggagagagactggcatgtacctaattcccaacttgttgatctgttgtaccctattttaattattttgccagatgtaaacattttcccttttttgtgaacggagtgtttacaccatctatcacatttaatgtattcggtgcctgtgagtgccgacctcttcaaaatttgtcgacttcatcatccgtgtgctgtccagaaatgagatcttgatgccccccaaatgaattatgaaaagcttttcatagtaatataattgatccactgttggccacacttataaaaaaatcaatgttaacgtgttaatatttcatgagtacccacgttgccagctccttgcaatgggaccaaactataaagaatgagaattgtttcacagtagcccagcacatggacagagtgccaagaaagggagttcagggttgacttgaaagtttgaagcgcaacagggccattgaaacacagtcctctgactcatgtcagattgttataattatttaatgcccacaatgcagctttgtccccacggatttatactggagaggtttcttacccacacattgtggttattagctgcaaagaaagcggcgtttgtttataatgacatggggtatatctggatggcaaagaaaacactgcagattctgtcttcttaggaaggaggcaggaatttggcagataacctataggaaattgggagacatgctgtcattacttttcatatatgtgggtggttgcagccaataaccattagacaccttttagttttcacctttgtcccaaactcttgagagaatggaattgcatgcttacttttcatctatatgacgttatacagctggtatgcccagagtgtatctcaacttaatctttttaaatgtgtctcccaaaatccctttctcaaggttctacatcctgcctccatgaaatttggtgtcaccaacattgtcttacagaaccactgttactatttttataaagagtttataaatatgttttgaaaagttctcatgtggctagatctcatcaagggattttttttcagacttgaaaaataaagttaaagaagtaaggctttggggcctccctggggacatgtctggtttggagatcagtggtggtgctaatggccccgagtccggcatccggctccttgggagaagaaaggtcattaagtcagagaggaccagtcaagtccagctcctccaaactgcttttctgtgtgtcttccttggatgtcctcccttcttcccctacatggaactctcagttgcctttgctgtcagaggaggttcaatatcaatgggtttctcaagcttagagggcaacagggagacattgaaccacagtagtgtgaaattgtccgcaggtacttacaagctggggtgtgcagatgcaatttataattgcaccggaaatacttgtaacctttatcatgcttagtggtggaaataagaaaatctatgtgagtcagcttagtactaacttgggaccaatatgaagcaactgaatcctcttaggttttgcaagagagctacaaatagaaagcagacacaaaacataggctagagtaacagtaaatgtatctggagcctcaaattaggactcatatattcaattccttattttttgttttctggttcaacaggaagtctgggagatctataggaatttgaattacctttaatggtttatggggaccagagaacctaaactttagaattgggattgtcctggaaaatctggaacacatattgacccagatccagacagtgggttatggaatatgatgcagatgatgagccaattaagagaaaggtttgcatttaagcatcttcctcttgtactggtgactgagtgactccaaggtggcaccattatcaccggtgcttgtgcagaggtgatttttttttttttttacactttgctgtctgaaatgctttaaatgattcttttaattaaaaaaattagttacctatataaatattcacttggtaaccccttcatttaaacagtccatttatgccttatgcacttgtatgtgtgtgtgtgttgtgtttcacggtaacaaagttttttgttttttgttttgagatggagtctcgctctgtcacccaggctggagtgtagtggcgcgatctcggctcactgcaagctccgtctccaggttcacgccattctcctgcctcagcctcccaagtagctgggactacaggcgcccgccaccaagcccggctaatttttttttgtatttttagtagagacggggtttcaccatgttagccaggatggtcttgatctcctgaccttttgatccgcccgcctcggtctcccaaagtgctgggattacaggcgtgaaccaccaagcccggccggtaacaaagtcttaaaagcggtcttattctgtaatacgttggccagttttaaaccatttgcagtaatgcatttaaaagatgttatttcatagataacaaaatagcttcttgattttcatgataaacatagacttggagcctttttctttttccccgattgtgagtcagctcttggagggcatggacagtttctcacacctcctgggattagaggtggagaaacagaatgggctgggtgggcagagactgggtggttggagctcagggcctggggcagggagttgtggggagggagggtgggaaggtgaaggggaggtggtggcaggtcatgggggtccactgtgtgccatactgtggaatataaacctctccatcagtgcagagccacacagcaaaggttttaagtggataagtatgtatggggagtgggacgtgatctggtttgaataatgtatactcaggactcttgccatacagtaatttttttcaacccgctagacactgttgctgtggggaagtggagagtggtttcatccatatggcagcatcatggctgtgtagccctaaagccataggcacctcccaccccacccacccacagtggcatccacagttttagtctctaatagcactttgtctcctgagaagaaaagcaaagttgtttttcctttcttcttctctcatccccaaagcattctccttctcacccaaaccatgatctcagatcttaggagttacaggtcagacatgtcacggagcctgtttgagatcagttgtctacgttggtgatgaaattataacaccctaaaagaagactttggagtaggaacttgccagggtcatcagacatggttgggttgagagaggaaatgcgattatacaaaaaacgtagaatacaaagtagtgcttattctgtgatcatggctactgtttcaggggacaggactagaagggaacccggacaaagaaaaacccttggcctgtgcaggctgtggggttgtgagtgctgtttccccaaattaaaatatctttattattgtcatgattttgttgtgccattgaggtacattaacttaaataaatcaaagcgaacaattttaagatgacgagtaagtctggagaaaaacctaggaccccagaaagaaggcatattgtacatcccagtctgctgtaacttccggagctgctgctgatgacaaagggctttaaggcaagggaagtgtttgcagcactttgggggctctatgcctgtctgcatgcttgtttagtttttgccatggcctgttcaccagcctgtctgccctgaaactgggaaaggtggatccagctgctgtccaggccttcaagaagcagagccccattcaattgtccacttctctgttgctgcccagagccagatcctgtgtgggatacttggcttttcaagggcctgtgtatggtgtgttgttgagtagaaatgtctgagatgctcctttagtagcacctgattcttttggatcagtgatttgccatttcttatatgaaaacgagaagttcagagttttgaattctggccccagttccatcactttcttgccctgtgaccctgttctcctcccaaaacctttctgagtcttcatcattaataatgtttaattggatcacatgaaatgatacaggtgaaagcatttagaaatggaaagcactgtgggagaatatttttgttcataattgtatcataatgtggacatggagagttaacctttgtcagcgcttagtttctcagcctttttatctattaaatgggagtacaaatgataccttcattgggggttccctgagcatgcagtcggaaactatgacctcttctggaggaccatgacttttattttttgactctatagtgtaggaacatcttaattaaagattatggaaaaaaatgaaaaatgggtttataaaaaaatgcccagatccaatttcatgtatttgtaaactattgatcaacaacctgtgtggaacctatggccggatatgaattatccagtattagcattgatatgaatgcttttatcaatagagcattgataaggcatttcatggaacacacatgtcagctcgttctctcactttacctacctcctccgctgtctgcctcccctctgccttagatcttctccctccccttttctctttcctcttttcctatactctctctcctttttctcttttccttttttttttttttttttttgagacagagtctctctctgtcacccaggctggagtgcagtggcgcgatctccgctcactgcaagctccgcctcccaggttcacaccattctcctgcctcagcctcctgagtagctgggactacaggcacccaccaccatgcccggctaattttttgtatttttagtagagacagggtttcaccatgttggccaggatggtctcgatctcctgacccattatccgcccgcctcggcctcccgaagtgttgggattacaggcgtgagccaccggcagttgtgctgcaactgtagagaaactagaggtctaatttctcaaatactggtcctctgtgaattgaaatatagatcctccctcacagatatagattcggtgactgaaataattattttgaaggaaccattgcatacgtgacatacttactgtcagataaagtctttggagggagatgggatagtgtgtggtgtccaccctgtcacttctgccagggcgagggctcacataatttattctaagcttcccatcctcagcttctgcgcaggagtacaatggaagatggggggtggaggccttgcctgtggagccttgactgggagaaggacaaagaaggcatgtagctggagaggtccagtgctttttccagggctggaggctgggaggtgtcctcatgcactcctataagctaagcagaagccagagagctttccctagtcatgcagctcacaggatagtgtgcagtagagctctgctaaaggaccttcagttttaagagcgccttcactccgtagtatcacagataaaattagcatccatattagtaagcccaacccagagaaccatgcaattatctcatgattttatttaatgactgtgctcttttcacagcttatcagggtaatctttggagcatgtcctgattacatgttgtacagaccataaaataagtgaacttaaaaagcaattcaaaagctagctctaatttaatttataatttttacatctcaagacaacatttttagtagataattgtccagtatttggttttgtttttttgttttttacatatgtcaatttttacttgtcttgcagtttccattcccccagcacatctcatctttgctcatagcagcgaagaagagagagcatctgtcctggttctccttcaccttgctaatcaggctatccccctcagctcttcagggaatgtataatgacaaattagaccttgtaggacttgtgcatggagcttcagggtcttttctaaatggcaaaccaaagtggccaacacttgctagctgtgtgatcttgagtaagttacttgacttctgagctctgatttcttgcctttaaaatgttcccacttcataggtagtggttgattcacaaggttgccatgaatcaacaacgtacctcagtgaggtacctacctgtgagaagtgcctagtccctgaaggcgtttggaagtcatttcccagggcaggtcagatactgaggcttcccaggctgctgtacaggtgggcatgctggggaccttctcagacaccctggcctctttttctttccatctggcacaagagatgctttttctagttgggacatgcaggaggaaagagagagcaggtgcttccttgatgtgaataatttatttttccttcagatcattctgataatgcaccaacctttggatgggaaaaggtgcaaagctgggatatgcactagtgttacatcactggagttatgttggggatatgtccagtgtcagatttttttgtccaaaatcccattagcagaggaaaggaagaagatacatttccttggcaactattatgtcccaggcacagagattacagaggcaggagtgacagttgttgagggatacagtgggtatgagagggagggatgtaaactgaagagttcccatcataaaatgtggtagaatgttcacaaaggctcacctaccctaccccagggagacatttattctaattttgggggagactaagtgattggggctattcacttctccgagacaccagaaaatgagaacgtctgtaaaattaagaatatgaactctagttctgtctgcatttccaacttcttcattgtttcctttctcacaagattttaaatcccttgaggaagtcatttttcaaacagtattttctgtgaaatccccaattgtaatgtctactttatttactcctccactcatccttccttatcaggtttattgcatagtataatggaatatatgaaattaaaaataactacactggacactgggctctgcatacagtaaatattcagccgttgtctgcagacttgcctaagtgtgtacgcagtagttattctaggcaggtgctgtgctccaggctggaagttgtgtataggatagagagagagggtgcctcagagctggcagtttcctccagcagtcaaattctgaacacccagctatgcctcttgctggggaatctaaactttcacctttcagagaaaacaaggtctttggaaccagtgtgttctttcaaacaatgttggatactgcccgattgtttccatccgggaaccaagttttcaaaaagaagtccggctgctttgttaagataagagactgttgtgtgaaaattgctgagtgagagctcccactggaggctccttgtcttccaggccattaccagtttactcctagctgggtgatgggggtgagggttggggccagattgctagagccccattcctgccagttcctcccagtcctgaactctggggtgagtagaaggtagagagggttgatggggccgggctcctggcctggcagaaccgtgctgacctggagcctgttcggaagctggcagtgattgcagtctctcccggactgttgctgcccttgtttgccctcccttctgtttccttctctctacttcgagcattcattacatgagatggtgctgttttttcatatatttgttatgagtaattttatctttcatctattagatgacatttttgattctgttcttaatttaaaacacacactcattttttaaagtttctaagtacgttttttatttgtatgtgatcatggttcatcagtataagaaaatatttagccagttctgtttcgtaaagtcttcaagaaagataatagcttgggtggactgcttcttcatgcactttattaatgtggcttcctgttaagatctgaagccaggcagagatgtccacttttgctacttatatttaaaattgtactgcaggttcagaaatcaaaggcatccggattgggaagaaagaaagaaaactctctttattttcagatgaattgagcctgtactagaaaacctaaaggaacacatgcccaatcccgattcccccaaagtacgaaccgactaatgagttcagcaaccttacaggataaaagattagtatacaaaaatcaattgtatttttacatactagcaccaagcaatctgaaacccacattatgaacacaattctgaggaataaatttaataaaatcagtgcaagactagtttattgctaaatgagagttatcccatgttcatggattggaagactcaatattgttaaatcttcctaaaatgatttgtagattcagtgcaatccttatacaattttagtatgcatctttttaaaaaaaattgtcaagctgtttctaacagtatagaaatgtagatgacctagaataaacaaaacaattcggaaagggaagaaaaaaagattaggggtcttatatttcttagtttcaaaacttactacaaagctatactattcaaatcagtgtgttactggtgtaaggatagacagtggtgtaagcatagataatggtacagaattgagagtctagaaataaaccattacattattgtcaattgatttctctacagaggtaccaaagcaattcaaaagcaattcaattcaatagtcttttcaatgaatagtgctaggacaattggatatccacatgcaaaaaaggtaaatttaaattcttaccgcacacggtacatagaatttaactcaaaatggatcctaggctaaagtgtagaaggttaagctaaatcttttagcacaacataataaaaagtcttcatgaccttgagttaggcaaagagttcttagatattaaactggaagcacagcatgtcaaattacttttcgagaaggtttgctagctcattcagtgggtgaaaatgggtgaaaagtgagcacattatttaactatattctcttgttcctagttaggttgaacatatttttacttaccactcaaaaatattaccactttctgggctcttgtaggtctctgtcacatcttcgaactcaccaaacctttcaggagaaaatagttccttggagaagtacataaagttgtgggactttgtaccttggattacactttccctgtcaactctgggtcctccatagtggggaatccatagtggtttttgtcctgcaaataaaacagtgtgactaagtaattttccagaaatgaacagcagagtgggaaatagacataagtgagagtaatataacaatcacggtgtgataaattagcatgggatttgaaatcaacctgtttgggttcaaatcatggttcacctcttaccggttttgcaaaccttgggtcagttacttaactccatcaaatccttcacttcatctgcaaaatagagataagaaaattccttttctcttagtgttgctttgagcatcaaatgaaaaaatgtgtgtaaatgtttagtgctttgtacctagcatataggaacccattattaagtaatattacagtttggatttcagacctgtgagcttagggctcagactctagaggttcctgaactaggttttcctaggcattgcatgtagagtcttatcttaaaaaagttttaattgaaagattggcagcaaattcttcttgtcacttcagacatgatttcctttggggctcttgtactcccatggtttgaattcatagagtaactcaagggcaatagggaattcctctcaactctctgtctccaagaatacctctgggtgctggagagatgccacttatcaattctgttgttattgtttttagggctgtaagccttctggatagaactcagtggattttcctgagtagtgaagaattaagtgagatgagggaaaagcattgagagtaattatcagcagtggactatgcctgagtttttgttagccctgaacttacatatcctgactttactagtccatgagttcttcatagtcaggaactgtaccttttaattctctgcatctcctaggggctttctcagtgctaagcaaatagtaaatattcatgagatactgggattgtgcccagcattttctgagttttcaaatagatgaagttatagaatcatattcatatcaaaggaagttcctgtgtataatctcatttcattctgtcaacaaccctaggcttggggtgggtgtgttggtgtggatgagaacacttagtatccctattttacaagtaggaaaagtaagacccagataagttaatgacttgctaaaaatgatacagctcttgagagacagcagacatttgaatcccatctactgattctaggtcctatggtcattcctttgctttatgttgcctgttttgcacactgtcaaacgcatcagacacttccagtggtttttcagtgggtttttgtcctagtgacagtccacacatcctgctctcctattatcacatttgcaggaggaagtgagacatcttttgacactggtgatatgggagaaggagaaaaatcctagaatcaaagatacttactccttgcttccctctactcatactctctggaaagaaacgtttagggacttcttgtgttgtgcctgttgtgccaggacagctcaaatggatgcttttgtcacagcccctccacctttagcagaagttgttgtattcctagccaatgcaaaaataaacaagtgagggaaaatgacatttcctggtaatggaaagtagcagttggtgagactttagacaagaagcgggtgttccagccaatgagcagtgaccacagtggagctagttgtcggtttacttggctgaagaatatgtttgcctgcatcctgattgtcaataaagacgtttaaaaaccccagcttgactctggcgggctgagggtgctgccgtgccactgctgcaggatggagctctcttcctggtggagacttgattcacaaggacgctaattattcattcttcctccgtgcagcccgctgaaacaattgctgtgcttgttcggtgcacagtgtggcgtcggacagtcaggcctttttatgtaactgatggcgctgtatgttcatattgttctttatgtacttattttatagcttatgcagcagacattcgagtcaattagcttcttgtcttgcaaactgggcactgctgttctagaaccaagttagaagggtgtgttgagggcgacccgggcagacctctctcctttctttttgtgctgtgtgggttggtttcaagttacagcatttttattggctcttgtttgctgaaccttggtttcaaaagctgatgtttgagttgaatttcttaaagatacagcttttgttttcacaaaactgaagtcaggcaatatgcatagcccttgggagtgtgggttttttttttttttaactgagtgatttttttttttttttaaatggtacctattaaccaaaaaatctaagcgaatggtttcctaactcacttttccttaactggcgtcagcatggagtccttgtttcttattgatttgcatttttttttttttctgtatagccttactcctgactcttttgtcctgaattttttttttttttaccccgtatttcttgaaacctgcctgttttggggacaagttggagtttaaataaattagttaaattctgttgtgtatatttctgcagatgataatgtttatgaagcatagattcactgttttgtgaggatttttaaatatcggaaagaaaatttcctgcttcctctttccatctccttttctgtggttttagccccctcgcccttaagagccatcggtttgttattgctgattgaggtagtggtggtggaagcagaggctctgatccagagaaactccccaagacggaagtgcagcaggcaggatttttatccagcggattttgacccagtagaccctaaagaagctgcatgacagagactcatatttaccataccattgaattctcagagctttccgtggtggctggcccaaggcaattgttcaaaacatacgcgagagaatgaatgaacaaatgaccttgcctaccaaacgtctccctccctctgtgtaagcatcccttaaactctcccaacccaggtggccttgacatatcccatgctcacccaggaccctgaagtatgcctcggagcaactggtttctcctgaccagttagtgtcaactgagactaatgcagaaaacattgcttaccctaatgtttgcctttagaagtaaaatccaaactgaaggaaaggaccttgaatttgttttttattcttgctgacttggaacattgataatgctcatactgatcctctggctaaacatttttcttcctttatccatgtatttattgagctctccactgttagcatgaaaggtggagaagcaggaatacatggtgtgtgcttctgctagccttttactgtccagttgtagagagtaggcccagtgaactcagtcaggtgtttataagattgagcaattgagcagttgctgtatcctgaagactgtatctggtgctttactcttgtataattcttgagacaggaatacctgggtgttggcatcaaggggctgttgaggccatctttatttctccataacacccagcacaagacatttacatgtatgggttgggtagggtaggagttcatagctgtccatagagcagggcagggacatttctgagaaggtcagagaggtttgatgaggtgattttcctgagctgggccttgggagtggagagatagagggagaacaggtgcatggacacagaggccagaagggcatcagacaaaggacccctggggctgtgggaaagcccccgagccattgggaaatagaggagcttagccttgctaagaggagagaattcagagagccatgaggtgattgaggtttcaaagaccaaataaacaaaggaagacagcatcttggggagtgggcaagaccatgcctcacctggcaggtgaggtcagaggatacctgacctacgaagatccacaaaggctggcagtggggggcatcccagtggacagtgttgtgatgagcaaggggcccagaagtaggaagacttaaggagtcctaggccttaaggaagactcaacccaaacctggctacctctttaggcagcttgagtcttggcctctcctaccagctcctgaagggtagcttcatgttacatctggctgcagagaccctcctttttagaagcaggcagggagtggtgcccaggctctcaggacctcctcttgtctgggagactgcagcctccccacacgacacagcccagcccctttgttcttgagtgcctgctgctcacgtggtcttaataaacaaaatctagaacgtgctcatcctttaaaaaaatctgttagcctggttaacgtgtatataatatgtataaatatatgtatatacactaattatatataaattatattttgtgtcagttatatttgcaatcacacacacacacatgcacgcacacgcacatgcacatgcacatgcacattcacattgtaattcctatttaaagggaaaaacgagccagttttttaaagggaaaaaacaagcaaaaggtgtagggagagggagacacccatctctgcccccatccgctgattctcttcccttttctatcctccctctggctgggtttacggacaggcccttcttcctcctgcccttcatctgccgcaggacctcagtgctggtgatggtgagcccatgaccctccttctctcttgttctctgctcttgtggaggctagttccagccgttcagttccactgaagcaactgctttggcagacgaagctctctctgcctgaaatttcttactttcttccttctttggttcccatttcaccactccatggttcctcctccaggaagccttccttgtctggttttcttccttctaactctccccagccctgtctaaatcttacccttcttcagagcccatctcaaattttgtttcttccatgaattctttcctatagagcttgtccttctcctgccccctctgccagctgagggctttcttctttccctgaattcccccagtgccctgagctgatcttagatctgccttgtttgccattaattgaggagtacatattccccccaaactccttgagggcagatgctctgccttattgtctttgtgtcttaaaaatcttgctcttgtatagtcaagaaattattgtttgaaatggtttttaaaaatagggttctagaggtgtttttgttgttgttgttgtgttttttgtttgtttgttttaccaaaggaaaatattccacctggctgatatagtgagaccttatctctacaaacaattttaaaaattagccaagtgtggtgacgtgtgcctgtagtcccagctactcaggaggctgaggtgggaggattacttgagcctgggtggcagaggttgcaacaagccgagatcatcatgctgctgtactctagcctggtgacagagtgagacgctgtctcaaaaaaaaaaaaaaaatgtagagtctcagtttgcctataatatttatattgcacaataatacatttacttattttttacttattgaaatatgccacttgtttttaaatagcatgtaagatgcagatatttgcacttttaattgatatgccaggcaggagatttactgctctcaacaggtattaagaggtaggaaagctgccccccggcaagtttcttagcactgtggaactgatcctagtgccatggtgagtaagtggcagacctcagattcacaccacgtctctgactcccaataaaccacactgtccccccacccccaaccctcatggtgattaaaatgattactatgtacacacaaaatatattaggttacaggttttttgtttacaattctaagcttctaagctctgttcatttgtatcttcataatttgggggcctatgaaggattgtttatccctaaattgaaagcaagcaaactaacaaaaaatgagatcaaacattgtcagagacggttgttcagttaatccaagcattcaacaagggttataaatacggcatagaagactagggggaaaaatccaagtttttgataaattgtcctcaaagctaaactgtttcttagcaaagtgagaaaaggcataatgttcccaagaccaaatttaatctatacattcttggtaagaccttatttttctcctctttccattaagtttaaggtttccttctgcttcttgcactaatcattaataactatactgttgtcacagctcaaaactttcctattgacacttcagtcatttttaaagatcttgaatgttcaacctctatgaagctaaccttttgcactctattaaaatttaagaaccatttgattctcagtgaatgccccagctactggatcatgaaagcattaccttgtgccaagggcatgatgcagaacactcattcctttttaacaaataagaagaagtttgacttttcatttacacatcctgccaattgctaacaagtttccatctcgttcaaacaccagattgatcctaagaaattgaaaatattgatttaaccctctgtctgatttgtactgcaggcacctgctagtgcagtcttagcacattacaattgcttggctgtaattcctcaggggaccactaataactaccacatctgtcttttcatcttccgaaattatgctagcagttgtccaagtcaattgtgattcatttgatactgctctccttcaagacatattgcaaccaaatagacttgctcaccagtaatatatctgatgacatagttagttcttgttaattgacagaatgattcaggcttttatggatggcattaattggtcccttgtgtccatgcaataattgaccagacagagaaggcagcattttctttcaccaagtcaggagagttttgaggtgagataaatgtagtaaggatgacaaaatgtctatatttttaatcaagactttatcaatgagttgaaaaaagaagatttggggggaattcagatcatcttaattatgaacattgcattgcagcctgcagagatgtgctgaaatgcaggtctgccttctctttggcctccttgtgctgaatattttaatgcagggtacaacatgaatctaatatatgcaaagcagaagagtgctgtacctgaactaagataatgaaaaaggagaactataagtagctttgtttttcttttgacattcatcattagtgacccaatagactgggcatgtaaaatctgaaaatgtggaatttgcattacctcctgcttgctgagagagccagaacgttagttacatttactcctgttgccatgctactaaaaaaaaaagcgttggttccttttttcctacaggataaagttttcatatataacaattttcacaaactgcctccaccatttattcttccttcccatttggtcacacagaattaatatttccaagttatggtaccattttgtcccttttttgtacttagtatgctctttctttaattagtcattttatagattcccactcattcttcaagaatcccataggtgcctcccgaatttctcaaaccaaattagctgccccctccttgtgtttactcatttggttgcttatttccccaactagaccttgagcttgccttgggcgtgggctgtgtctgtttgcttgacacaggcagttatgtaaggacttaataaatgtttatggaattgagttgcaattgttgcattttgaggaatgagaatttaagatttgaatccgagagagatgacttggatcaaactagatgtcaagcaacctgtacttccaatgtgaataagtggctgacgaccagccctggggaataattataatttggtgtaaaacaaaccatttgaggtgtggaagatgaattagtcagttgacgtttgtagaggggagggtgagatatgagttatgtggaatagattttctggtgtttgatttacttagactattctttttaaatcatttgtcacataggatagacagtggctgtaacagatatccatggaaactttggacttgtgaacatctgacatgacctccttttaagggcagtgcaatctgacagacctgggctgaaatcccagtgctaccatttattagatttgtgttttgagtgagctccttaattggtctgaggctgtttcctcatctgtaaaatgaaaataatgacagcctctgttgacttttatgatagtggagagagatgtatgggaagtgtgttgcacaacgcctggtggtatacagtagacacttgataaatggtacctgttaccaattaaagatattttttgtttgtttgtttgtgtgttgttttcttgtagggatggggtctcacagtgttgcccaggctggtcttgaactcctgggctccagcgatcatcctgcctcagcctcccaaagtattgggattacgggtgtgaacctctgtgcccactctttttttttttttttcttaattttaagtttgtttgtagaggtgggatcttgctgtgttgcccaggctggtctcaaattcttggcctcaagctatcctcctgccttggcctcccaaagtgctgagattacagagcaattatagataagttttgactctgtttcttcctgagagttctgaaaggcagagggtaaatacaattgtgtatatagagaaaatgctttagagttttgtgatttttttatattgcctctagttgcacaaggctgaccatgtctctgtgacaatatatatcactttcatggggttcagagcttcttgttatagctcaggaagttacagagggagattgggagctaatgcaccaaaaccggcagtgagtatgtgtaatggggtcaaaccttgttggttttttttagctacaaagcagcagatcggccactgtgatagaatttgatttttactggtttgggatagattcctggtgatgctgatagtttattacccaatgtaggtctagaatttatacttgcagagcattttcatatttgtgggagaataaatttatttggctctgaggttggttggttggttggtttgagaaggagtgttgctccgtcacccaggctggagtgcagtggcgcagtctcggtcactgcagcttcagcctcccaagtaggtggaattataggctcgtgccagcacacccggctaattttttttttttttttgtatttttagtagagtaggggtttcgcaatgttgaccaggctggtctcaactcctggcctcatgtgatccgcccgccttggcctcccaaagtgttgggattataggcgtgagccaccgtacccggtggctctgaggtttttaaatggtaacacttaagtaaacaaactctagtttctttctaacatatggctggcctagaagaatgtgttattttttcataatctacaggtagagaaatagaagaagagaacttctattcaaagaggcaaactcagggattctgaatgccttaatgctgctatttggagttttatttgaaagcattaatattttctttttgggggtggatggagaaaggagaggtcttagtcaacgggtacaaagtttcagttaggaggaataagttctagtgatctcttgcacagcatagtgactatagttaataataatgtggcgtatatttcaaaattgccaaaagactaggttttaaatgttctcgtcacaaagaaatgataagaatatgaggtggcagatgtgttaattagcctgatttaatgattctgcaatgtatacatatatgataacatcatatgatatcacaaatttatctgtcagttagaagcaaaattaaaaaaagatcttttaggccgggtgtggtggctcacgcctgtaatcccagcgcttcaggaggccgaggtgggtggatcatgaggtcaggagatgaagaccatcccggctaacacggtgaaaccctgtctctactaaaaatacaaaaaattagccgggcgtggtggcgggcgcctgtagtcccagctactcgggaggctgaggcaggagaatggcgtgaaccgggcaggcggagcttgcagtgagtcaagattgcaccactgccgtctagcctgggtgacagagcgagactccgtctcaaaaaaaaaaaaaaaaaattgttgcttttcccgcgatgatgaataaaggggtcacttagtgtagtgtggatgagttcaactagactgcttcctcctaaccccaaactggaatcgttatgttgcgagcatgagactttagcttggaggagagagcgggtttggtaattttggaacctggtaaactttaggggccttagtaaatttcaaatatatgctacaggattgctaattatagtcaacttgctgtatattaaagctccagaatgtatttatttttgtgccacctttcagtttctgatttcagtccctggaaaaccacccattcttgtgctgactattccaccaactagtttatctgccttagaggttattttggtaaactttcactgcatcacggacttagcagggtaaaagtcggagagtaatggtacatttgtcataacaagaaaaagcggatctatttttctttggcaaagatcacctttggaaagtgttgtattatgaaatgcagagttaaatacaactaactcagctttgatgtgtcctttgttaacgttcagcctctaagcgcaagttgattaatgatgcacatcccacagtgactttttctcaagcccagcaaactcatatataccctagtgtataaaagcaaacaacttaattaacttactcttcatccataattatcttgaaattaactacttataatgtccaaaagtttatgctgcaagcatatttaaaaatctgttgagagtaaaagggacggtataattggttaccctcttcctttcttgcccacttagctattaatatgaaaagtagctactcccctcatactctttggctgtgtgcttaaaattattattattttaatttctgcaaacactcaagaaaagggctttctgttattttttcattgagcccctgccctgggccaggcatcgggtcctcagtaacggacagggcagttttggctactgttctcaatgagattagagtctctttggaagctacagataggttatactagtctggtagggctgccataatagaatactgggtggattaaacaacagaaattaattttctcccagttctgcagcctggaagcccaagagatcaaggtattaacaggtttagttactcctggtacctctctccttggcttgtagatggccgtcttctcattgtgtcctcacacggcctttcctttgtgttcacgcatctctggtctctctttctctccttcttcttccttcttccttctttctcctttctcccttctcccttctcccttctcctttctccttctccttcttcttctcctccttcttcttcttcctcctcttcctcttcttcttccttctcttcctcttcttccttcttcttccttctttcttccttcttcttttttttttttttgagactgagttttgcccttgttgcccaggctagagtgcaatggcgcgatctcatctcagtgaaacctctgcctccagagttcaagcgattctcctgcctcagcctcccaagcagctggtgcctgccaccacgcccgctaatttttttgtatttttttagtagagactggttttcaccatgttggccaggctggtctcgaactcctgacctcagatgatctgccctcctgggactcccaaagtgctgggattacaggtgtgagccaccgtgcccagcctaatctatgggattttgaagacaatactgtcacttaatgacttacaacacatcctcatgagacctaataacagaagttctgggttctgtgttaatacgggacttccttttgtgaaacttgtaatacactcaggagaaatgtgtgacaaataggattctactttttaggggcatttggagcactgtattgtccttgggtaataatgcttaatgtggacgatgctacatggcctccaagaatatccctaggcccttgatcctttaagggagaaaatcaacctttacttttcgattgtgtaattgtgatcagaatagcctctgagatataaattccaaatatatctgaattggttttctttaattaagaatacttttggattcaaatcatactggcagcaaattaaagacatgtttcatgtgtttactaaatgttaatgatgggattactttgaagataaattttaacattttaagtaaaacgttcatgtaaaacaaaagtttattatagattggttttaaaatgagcactgcttcagagtcaggatattcttagtaaacccacaagtgttgtggccttgtgcacgtcttttggtttctttttgctttcattttgtcatcagcaaaattgaaattgttagatgaaattgtctctaaagtgttttctagagccaaacatttctgattctctaatattaaagtctctaagagagtttctctaagcccaggcagtacagttaaaaatattttcgttgtttgcttgttggttatagagtgataatattttgcaattaggaagcttggatgagaaaccacacacgtgacataaaatggtttctcaacagaaaatctgtgccgctcaaactggggaaacagacttataaattccttttgacaaaagacacgtcaccacacaagcaagttaggacagaactctgagcattgtttttcatagacttgggacaattcccaaatattcttttttctcaaaacaatatttttcattccaatttacttattaaaaaaaaaaactgggagccgggcatggtggcttacgcctataatcttagcactttgggaggcagaggccagtggatcacctgaggtcaggagtttgagaccagcctggctaacatagtgaaacaccgtctctactaaaaatacaaaaattagccgggtgtggtaatgcacgcctgtagtcccagctgctcgggaggctgagacaggagaattgcttgaacctgggaagtggaggctgcagtgagtcaagagcgtgacactgtactccagcctcggtgacagagtgagattctgtctcaaaacaaaacaaacaaacaaaaaacaaagctctttttgaagatcacgagcttcagaaagaaatactgcatccactctgtccacatgtttctggcctgtccattcagttaacagttattatgtcccaggtgctaggctgtgtcctggggactgaggtaacagaaattacaggataaagctcctgccgtgtagtagtactttagggagtagtagagatgttggttgggaaagaagtgatgccagaatgtggcgggggttatcagagcaggttcagaacgtaaggagcacgaccagggaatcactaacttcgtgtaatggaagggtttgtttcagttggatattaaaagatgaatagaaatttgcaggcagcaacaagagttggcattctaggtgtagtaggggactatatgatagaaagcccacattgaaggtaatgtggtaagactcattaatctaagaaagatccttctggttgtagccttaaggaagggtgagagtgggaacagatggaaagtaaggaaaacagttcggaggcagctttaagagaccagaaacgggcctggcgcggtggttcacgcctgtaatccaagcactttgggaggccgaggcgggtgaatcatgaggtcaggagatcaagaccatcctggctaacatggtgaaatcccgtctctactaaaaatacaaaaaattagccaggtgtggtggcgggcgcctgtagtcccagctacttgggaggctgaggcagaagaatggcgtgaacccgggaggcggagcttgcagtgagcctggatcgcgccactgcactccagcctgggcgacagagcgagactctgcctcaaaaaaaaaaaaaaaagaaaaaaaaaagaccagaaacgaaatcgggccaaggcaagaagggtggaaggtggatgagtctgagagatggatgttttcactatggaatggttgtgtaaggatggggagtcagaagaagccatgagaagcttgtgagagttaagaggccatattcagtgttgtgctggtaaatataacctcctataattaaattgtaaagaggtcagtccaaattcatgtactggggttgatcgtttctgcgtaatagtctttcacttaacttttactcattttcactttcacgaaataaatggccgtgtcttagcctgggggcctaggtctggggttcggctgtgtgctcttcctgcagtttggaagtgccgtctatgttaatagatattcccaactctgcagatcttctctcgaggctgaaggggccccattcctatcagaagcctctcatttttctctgaggtagaaaaactaaggcatagacttcatagggaagtttatatgcaaatggtggctttctgcacgggcccctgtgagtggagtgggatgagatacccagtggctttcagagttctggtggatatttgattgctctccattggtagtaactttattgcttttatagggagagttgtactggaaatttgccctccctgtccttcagctggtttgttcccaagccagacctgtctgaaaattgaaatggaatactttttctcatctcaagttatcagttgtagctgtcaggaatttgttactgtctgctaaagccttttaacatgaaaatacgctaagggcagtgcatgtgtgagtcatgtgggaagttacattattttatggatgcagagagggacacagacccagatttattcataggtgaaaggggaaaaggaacagaatttaaaagggaaatcctgaaaaatatgtagcctctgtggctctgcctcttttcctacctgcgtctcttatacaccatggatagaatgtaagctcagtgggtacagaagagctgtcttttttccctcctttggtcttcttagctgtccccaccaggccatgcctataatcggtgcttagcaagctactggcttaagagagtctctgtctgctgtgagtgcagctcctgagatggtggggatggatgctggttaggaagtgtgttcgctgccttagcataaagaataagtacagtttttctcgattatttttctccaagggaaactcaatggggaatgtcggtttcatgctgttcttggaggggttggtttagaattctctctggcttttctgagaatccctccacattccccctccaggctgctgtcatggtagctgcccttctttcagctacttgcattttttgggagatatgccatcttccttcagtttgcaccctggtagcttagctccttcagtgtttagagggaaatgggagatggagaatcgaagcacactagtgctttctggtgttctctgcatgtgtttggaaggaatgtaaaagtagctagggcttatcgtggtatcatagcattatagggtatgagacctttggggaaactgaggctcacaaaggctgataactttacctagagtcagtgactgctaatggcagactcctagcgtctgtacttttccacacttacccgttcatatgaaatagtctgggaaggtctcttttaaaatgtatcgtgacctctcctataaacctcaaggttacatatgttaaagaaatgtagtcggctttcctcatgtgccgaattctgaatcaagcttacccaaacccccaaatcatttccacagagcagaggaaaaaaacaaaacaaaacaaaacaaaacaggcaaatgtgaatcatgggaacctattataatgatatatagcttgtcataacacattataatattacagcaaatgtatttaactcactgaacgttctcagggggctcttagctccctttaaaagtgttctccaaatctctgcagcaagatggagctgcctagtccacctcacttttgaccaaaccaccgttacgagaatacctattgaaaacccttacactgttgctgtttccctgggcttaaaagtatgtttggttttgtcagtacctggaaacaggaagttgagatttgaggagaaatctttggcagttgtgcactaagcttgcgggagttaggagtctgttgccacggaaaccacactgctgcctcatttattaatggaggcttggtgaacttccggagatactcttagcctgtcctgtaaattcattctagagaaatgcagggtgacttttaagagatttctctgtcgtttctcaagcattctctcctgggtcttcatgagctccagaaaattgcttgtatgcaggttcagaaccactgatttttatctggcaagcatgtctgaaggccgtttcctttttttcatgcttaaatcgtgtttatgcctgcctgccttgtccaataagtgaatttttttttattatgctgcctttaagaattacatggatttcaaatgaaggaagaaggaatacaaaaatgaactaagtaaatatattgaaaaccttctgacactaactttaagagagttataagcatcaaagccttttctaacttttaaaattctaaacttaaaaaatctaaaatgaatggtttatttcttctaattccagtgagatactttaagaacatttgtctgagacattttcaaattttgttctaatttcactaaactaactctattctgctaggcagagtaacagcattggaagttgcttccaggaaaaaaaaaattttttttctagctaattgtttatctgggaggatgcaaatggtggttttaagtcctttaagtcatccatcatgcctggcagcctctattgtctcattgttggatttgagccaagtcaggccctttcttggtcttgggagggtgcacatagatcttgctctgccaaatctgtgttcacaaggagtccgagcccagctctaagggtaggtaatgttgtcagatctatagatcccctcagattggaaaagatcatgcatcctcgttccttatgtcacactaaagtagaaagtagcactctattcaaagtagaagtgacaggacttgttccctcagttcttccagtgtctacgaattactgttagtttttaaacgcatttttgtggatgtaataaaatactgtttatagtcagctacgaagtaagtaattacaatgcgggaaatgaaattcaatatagctttgttgtggttttttgaattttaattaaaccagtcttagagtaaattataaatgctgctgcttttgttgtgacaagtgacattgacaaaatattaatctaatggattgttattcacaaaagctaaatcttttcaaatctgcagggtttggttgtttattttgttttacttttcagtttgtgttttaaaaagtctagagaaaagaataaagttttaaaaccacatgaaataactccatgtatggaatatttcattgttgatgtcttgccagccataattgcatgcatctcatttatggcgctgaaaacttgttctttttaaaaatcagatgtttctgtggtcacttttttgttattaaaactggagccgggttaaataaccaaccattgaccacgaagcctaatattaaaggaataatcagcccatgttcctattagatcatttccgttttcttttactttataaattaccttgttgcttaaaaatgacattttgttggttgtgaagtcctcttatagctaaattattcaagttattttctttggagattcttttaacttgaatttatataaactgtaaagaatgtacattaaatattcagaaacttttctttatgccagtttcttattttcacccatcatgacttaaagcttttttttgttttagcattttaatgtttaaataaatgtaaataatttagttacaaggtctttatggtagtgccgccattgtttttaagaagacaaattttaatccaaggttaaaaacttcacatttgcttatctcttttttctcttaagaactaagagtccagagattagagtaaaatcaccttttcctcatagttttttctttcaacgtgttagaaattcctgtttgaaaaggaaagccagttcctccccctttttatgtttgaggggatgatggtaaaatcacattattcagtcagtttccacatgtgatttgttgcctatattttttaatccagggattaaattgttgccaccaccagcatcaaatcattggggggcaggggtggggaaggtgcgagacagttggttatagacatccaaatatgacgacagaaaaatctccacaacaatatggcagtggagcatttgctgacttcagagtgccagatcaaccccaatatttttttcagggatgctaaacctcttgtaactgctaaattggatttgttactgaatgaagtatcagctgctgttggacaagaccataaaagccagccggctggccctttgtaggcagggcttacccaacgattgatatgttttagcacttttgggattattgtgattaagaggaaaccattctgaatgagtgagcaaagggggtaaggacacacagcccacagctggtgagcagcatgtgttggctccaaggaagtcaccattatggctttctcctggttcctgccctgattgacgtgtatgaaatctttttttttttttttttttttttttttggagacagggtctcgcctgtcgcccaggctaaagtgcagtggcgcaatcttggctcactgcaacctctgcctcctggattcaagcaattctctgcctcagcctcctgagtagctgggactacaggcacccactaccatgcccggctaatttttgtatttttagtagacacggggtttcaccatcttggccaggctgttgttgaactcctgacctcaagtgatccaccctcggcctctgaaattgctgggattacaggcatgagccactgtgccgggcctagaatttttatatgaggaagtggtgtccttattttctccagttgcagctctctctgcagggaaagagacatttggaatgttgtggacttgagaactctgaatgctttcaaagcactatcgtgtgtgtgtgcgcacacgcacacacagtagctagaagtgttagtctagcacaggagttaattgagttaatgtgtagggaattcagtaataacaacagagcgtcctctttcatttcccagatccaaagctctgtgacatgcattaacaatatacctccatgtagtttgtgtctcagtctgtgtacacgtgtgtgatggctaaatgggaactgcacagccagtggatttgtgaacttgagcacttgcacctggctaagggtttattaagtgtggaaaccgtactgttgttgtaaaacagttttcatctcaagaaccacctgccccttttagcggtggccttttgcacgtgtcttgcactagccaagacaagtctatccaagagggagcttgtggagtaggttggtgtttgaatctttcccagtactcccaaatgcacatagaattggtcgcctctctgggtgtcccagggggctgtgccccgctcatgttcagagtttgctcagcataccacacaggaaagaggccggcttgccaggtcctgcggagcgcctttccaagcctgtgaaaggcacgaatcatccagcagccgagcatgcttacagctggccctttgctagctttgatctgcgaatcaggccacaccatgaatgcacttattgtcatgttatgtgtacacagtgtgtgaattattgaaaatagggaggcctgagcctcatctggtagagattacagtgcaggcatgctgggcgaaggtctgtaattgaaaatccccagatgctgtttatttggcctttgtcacatgacctgctgcaggaagattgtctgaacaaaatgttgcctgcatggagagtggagcccgccctcccccaccccccagagcctccacaggctcagtctgtgcacagcttaaacacctgcccaaaggatttttaaaggcttaaaatagattcactcatagcatttaaatagagggcatcttgcttgttggtttaaactgcttaagcggttgttgacttgtggaaccttctatccacacaagggtttgctggataatttcactctgagatatctttacaaagcaacattcagggcccgagccacataagtagtttgggctctgcctttttttttttagaagtcaaacttctgtgtggtgaatgagcttgcagataaagctgtgttgactgtatgtattccttctgtctgtagaaaatattgtgggtactgagaataaggccctgagttagcatgtctgacttccgtttgtccagttcattcttacctattctgcctataaacaagttgaggtgtttcttagaaaatttgtttttctcaattaaatgctgaatgttatgctctctgtcagtggtggattgaagtaggatactaaatctgaaattgatgaagatcacaagaattaaaaacagggaagattgagctaattttgaagtaagaagggctttaagctttccaggttcattctgttagggaacaaaacagccacatgtcctctttcattgccagtctgtctcagctgtgcttgtggcttcctctttgatttcttggagcttaagaagaggaaagattcatgggtatttctgcattccataagcatccaacacgactgtgagctccttgaaggcaggagccctgttgcattcttctttgcatccccagtgcctgccaacacagtgctttctctgtcttcctgcggcttccccctccctttctgcctgcccattcaaagaagacagtcactgcgtcccatgagccatgatgtcatatattcagatattttttctttcagggagagactcaagtcaacagtagcaatatcattaagtagcacattcttcatgcagggccagaggttgggaggatggagtagatgggagtaggatgtgggtcctgccttcacaaagctcacaatctgccaaggaaaaagcaaaaacaggcagaatgtggtgtagcaagcttgtgctagcagtgtgcacaaagtatggtgagcaggaggggcagacccagcccactgctggggagtgagtggaggaagtgccagctgcagaggcctggcagctcaggaatcattcattgttcagtagatttggtggggtgggggtgggggtggtggccatttcacacaaaggaaatagcacccaacatgacaggaataaggatttttagagacagaagtgtgtgtagagagtggcaggagaaaagacaaaaactgatttgcccatgtaacgttttaattttttacggatagaatgtgttcatgtgttacctagatcattagaaatttattttattttattttagtttttagagacgggtcttgctctgttggccaggttgttcttgaactcctggcctcaagcagtcctcctgtcttggcctcccaaggtgctaggattataggcgtcagccactgtgcccagcctagaaatttaaaaggagaagaaaaaccaagcagctgtcctgaatctaagctcaactgaggaaggtgattttcttggtttgcttggtcatcatctccagtgggaaccctatatcataggccactgctttgtctgtcgtgaccagctggtatggggttacctctggctgcttctagttttgagataggtctgatgtggctagggcagtggggtcagtgagccagagcatggcaaccctaggaggaaacatctctgggcacctgtctcaggcccttcctgagtacatctatccatctaatcgttccgtctttgattaccattgtttggcttctagcctcatttctcttcctagaccataaactccttgagggcagagagtgtgtattattccagcgtgtttctcttctagagcctagcctaattccttttgtacagaaaatattctataaattttattgaatgggagaggaaagtgccttggggccagattatgtaggccttggatgcttagagagttgaggctttattcttctgtattgtggatgagaaattagagaactttaaagtgatgtgtgtacaattcagtccatttcatggctggattctgccgccatctaagattttgttctcattaaacacttaacagttggtctaatgttaaggattaaggaacttggaagacaaagctgggttcaaatcccgactccactgcttaattagtttgggaacttgggcaagtttcttaacttctttgaactgcagtttcagcatgtataaaatgctgagctaggtagaattaggtgaatgtgaaggttaaatttgtggtgtataagcacagtgctttggccaggtgcagtggcttatgcctgtaatcccagtactttgtgaggctgaagcaggaggattgcttgaggccagtagttcaaaaccagcatgggcaacacagtgagaccccatctctacaaaaaattaaaaaaaaaaatagctgcgtatagtggcacacgtctgtagtcctagctactcaggagactgaggtgggaggattgcttgaaaccaggaggtctaggtggcactgagtcatgatcacaccactgtactccagcctgggcaacagagtgagacgctgcctcaccaaaaaaataaaataaaaaaaagcacagtgctttgcatagtgctggtgcatagtagatacacagtgcatgtcattgcccaactttcttgctttttttttctttctttttattttgagatggaatctcgctctgttgcccaggctggagtgcagtggcactgtctgggctcactgcaacctccgcctctcggattcaagcgattctcctgcctcagcctcccgagtagctgggattagaagcacatgccaccgtgtccagctaatttttttgtatttttagtagagatgggattttgccatgttggccaggctggtctcaaactcctgacctcaagtgatccacctggacctcccaaaagtgctgggattacaggcttgagccaccgttccctgcaaaagcccaactttctatagcctcccaccatctctaaactccgcaatagtgtttcatttagcttattccctgaatttcaatttcttcagtttgagttcattttaaaaatgttattccttctcatcatgcttttcatatttttattagattactgagtgcctagacatttagatactccttcagcatgttttctaagcagcaagtcatccctgagcatgccattttgacttaatgcttgcataacttacctttgtgtagctattgttgtagtagcttcagaagttgatagaattcttctggtgatagttgtttttacaacaagaactaaatactggacgtccagtgagggacatgctgtttaatgcaacacctccagcctattcatagacttaattatacagtctgtcacaaattttaagaattttggctatacttaccttctggcaaaaacctcattcctgctatttattcagtggagaatctatttcaaattaaaagatttgtgccctcttaatgttaagatagtgccctcttaatgttaagatatcacaataagtgctctgtttacttggaaacaatttttaggaccatgtcattttgaaaattgaagaagatacaaagattggaaaagatgttcaatttcaacaacattagcaatagaagcatcatgggtttataccagatgccatgtagtacggtgtcctgaacagaaaacctttttcaacccttttaggaccctatatatcagttcaagcaacgaagacatataaacctggtgcagtgacattacattacagttaaagaactgggccaggtgtggtgacacatgcctataatcccagcactttcggaggccgaggcgtgtgtatcacctgaggtcaggagttcgagcccagcatgaccagcgtggggaaactctgtctctactaaataacaaacaattagcctggcgtggtggctcatgcctgtaatcccagctactcaggaggctgaggcaggagaacagcttgaacccgggaggcggaggctgcagtgagccaaggtcgtgccattgctctccagcctgggcaacaggagtgaaactccatctcaaaaagagttgaaggaccattttagagccccagaaggtgccagagccttcccattttctgttactaatgcatacagcagccctctagagtaggaactgttatttccattttacaggtaaggaaatagaggtctagagaagttgagcaagtttcccaagttcacacagctcattagtccagtttcctcagaagaatctaggcagtcatacctttgagtcaaaaaaccagaaatcggcagcattgcatcattaaagattcttcattataaactagcggtgtttagcacttcaaatgtgtggatttcacacttctctaaggccaaataattaataaatagagtgcttttagcaaaccttttcattaataagactttcttgggttaatgttaagattagctttttttggaccaggtctctatggctgtggcttggggaagtggcagggacatgggtatagggcatgaagaagcaatgagcatgcattggtcataagagacgagaacaaaggtctgaaaaattgtgccacttctcactgaaatagttgcaactttaaaaggatttacagatttcaggtgatattggcagtgctgtctaattttcataatctttttctagatcttttcttcggattttctttatacaaaagaggtgagctccttcattcatttattaaaaccatttattgagcgagacacggaaagaaaaaaactatttcatgatctcacttatacgtggaatcttaaaaaaaagtcatacatatacagagtagagaaaaaacaacaacagaggatactaagaaccagaggaggagagaggaaacggatatgtaggtcaaaagatacaaagtagcagatatgcgtctagaggtctaatgtacaacataaggactatagttagaattatgctagacacttttaggaggattttaactattgtcgtcacacacaaaaaattactatgcgatgatagctatgttaatctgtttcactatggtagccattttattatctatatgtatctcaatatcattttgtaaacttcaaatatatgcaataaaatttattttttaaaaaaatggctgggcgcagtggctcacacctgtaatcccagcactttgggaggctgaggtggacagatcacctgaggtcaggagttcgagaccagcctggccaacattgtgaaacccccttgtgtctctactaaaaatacaaaaagttagccagacatggtggcgggcaactgtaatcccagctacttgggaagttgaggcaggagaatcacttgaacccaggaggcagaggtgagctgagatcattccactgcactccagactgggcaacagagcaagactccatctccaaaaaaaggaaaaaaaaaaaactatttattgagcacgtacttaatagctaccagatctggggtcacagagaaccagacaggtgctttaccatggagcagtcactattctaggaggtggatgaatagtctgtagataagtaatggcagtgcagcagtagcaggggtgcatgctcagtacttgaggttacaaagcaggaaatgactaactcagtttggatggctcccacagacattggggaggaagtgttccaggtagggtatacaggaatgaataggactttgcaggtaaaagagaagagaaagaacatgtaaggataggtggttccacaaaggcatggaggtatctttggaaaagaatgacagtggtctggggaactctatgaagagccacattctagaatagaggagccctatacaggagtgggctcttagctttaggtaccagactaaggagtttgtgttttgcttgtagtggatgagaacctgttggtataggaaggcaacataactagatgtggaggtgaaagaaaagacaaatgcctgcaagatgagtggcaggacatggtgggcgcctgagagcctgtgggtagcagtctatttaggtcacagttgggggcagcaagttcaggctccattaaatctcatctttttttcctttttttttttttttcgagacagagtctcactctgttgcccaggctggagtgcagcggcgcgatcttggctcactgcaacctccgcccccttggttcaagcaattcccttgcctcagcctccctagtagctgggattacaggtgtgtgccaccacgtcaggctaatttttgtatttttagtagagacggggtttcaccatgttggccaggctggtctcaaactcctgacctcaagtgacccacccgccttggcctcccaaagtgctgggattacaggcatgagccaccatgcctggcctccattaaatctcatctacactttaagtgtatgggataccaagatgtgaaagacatggactgtaccttgaagaggcttgtagtctgttacacagggaactcagcagagtctgattgtgggcggttccctgacacatgaagtaaagaactatgagaccaggacagaatggtgaagctcatgctgcttgcctagttaagagtcaagccatcattcccctcgtatactaagtgacttgtttttaattcatagtactttttgtttcactttataatattgtggtctttcccagttgctggtctggtgaagtgggctctgggcacctggctgtctggcttacccctcttcatacactccatgtctagcacatgtttcaggcacgtttcaggtgaggtttcttggaggggacatctgagctggacctggaaagattttccttggtggtcttaagggttattgcagctataataccttagcatggcagggtgggttcagggaactggaagcttggtaggtattttgatggtggtaaaatgaattgtggtggtggtcgtggtggtggtgtgtcatgaaaaatagttaggggccagatggtggggacaacactgaacaccatactaaagcagtttattcctttagatgtgggcagtaggagccttggaaggtcttataactgagaactgtgttttaggtagctgtgtagaggatggattagaaagaaaaatgatcagaggcatagttacagtggtaaggctagtcaaactactcattagaggattaagaaagtgattatgtggcgtatctttattgcctcatagagaatgagccactaagaaaacttcattcatatttctttttcatctagaaatagttagaacagaaataacttctatctaacatagcagtgttgtattcactatgcagccttaaacatttttacttgctcatctctttctgacccctgtaacccaaggcaaatgtgtagtttgtaagcggttcctctaagatgcgggagaacacagtgttctatggagttgtcacatgataatgttatcagctgccgttgactgatacaaactcctgagaaggtgggacttgagttatcgccagacactcactcgcagggatatgagatagaagttctgagtaaccaggagttaacacagcctttctctgtatgttctttctctgaaagctgttttttttaataagcccctgggtgaatgcagacacatattatctccagggattgctattgtttacctcctgaaggccgtcagtcctttggtgaacttctagtttgggaacaagtagtaccagcccctgacaaccctgaatgggcggcctggctgtttctggtgattttccacattggtgctgatttctggtcaatgatttatattgaggattaactgagaacttcctcgttggatatgctgtgggactggttcagaggctgtttttcatgagcctgtccttacacctaatcttagcctgtgcccattctccctccctggctctccatccctctcactctgtcatttactccatcagtctgtagccactgaggacctgctgtgttctcagcactggatgcacagtgatgagcaaaacccagtttatgctctgggctcctgtggacttctctgtctggtagtagaggggtaggcacatgttcatcttatagtctcattcagataaatggaacacagtagctgtgctgtgtgctgtgaccgagaggcgtaggttcctgtgagagcacatgttagggtgatctgaccagttctcatgggttggagttcttccaaacaagacataagcacctccaaggcagagatggcgtgttttctttttctttctttttttagacagggtctcactctgttgtccaggctggagtacagtggtgtgatcttggctcactgcatgcttgaactcctgggttcaagcaatcctcctgcttcagcctcctgagtacctgggaccacaggcaggtgctaccaagcctggctgatttttttttttttttttttttaagagatagggtctcactctcagccaggctggtctcaaactcctgggctcaagttatcctcctgcctcagcctcccaaagtgcttggattacaggcgtgagccactgcacccagcttgagatggcatctttttacccccataattttagcatgtttcttgtgtttaatccacacacagtccatgtgtgaccagtggatgactggccagcttccgtaggcctcctttcttttccactattgctgggacaagttgctatggcatccgtgtagaagaaatggttaattagtaactcctcacaggttagttaataaatgttctttactgcttcctctggcagtgtccacagatacatacctcctagatcttcaggaagatggatggggagataaaacacccccattctgtagacctctcccaagacagtgacatgtggtttcctcagtgtccccttcatctatactttttggttgttggcttgcttgctttctttttttttcttttttctttctttcttttttcttttttgttgagacggagtctcgctctgtcatcaggctagagtgctgtggcgtgatctcagctcactgcaacctctgactccctggttcaagcgactgtcctgcctcagccccccgagtagctgggattacaggcatgtgccaccacgcccagcttatttttgtatttttagtagagatggggtttcaccatattggccaggatggtcttgatctcctgactgcgtgatccacctgccttggcctcccaaagtgctgggattacaggcatgagccattgcgcctgaccaggttgttggctttcatatcctaaaattttttttccttttgatgaaccccagctgatgaaaacagacttcatgggctaagcacagtagttcacgcctgtaatcccagcattttgggaggccaaggcaggaggatcacttgaggctaggagttcgagactagcctgggcagcatagtgagacctctgtctctacaaaaaaaaaatttaagaattagccaggtgtggtgtacctgcctgtggtcccagctacttgggaggctgaggtgggaggatcacttgagcccgggagatcaaggctacagtgagccatgatcatgccactgcactccagcctgggcaacagagctagaccttgtcttaaaaaaaaaaaaaaaggagtggtgggggcatatgactagaaggcagtttagcactgtcttgtagaatcttgcctgagaaatttctttgtaaaccactctccccatgctttgtgctgatgccggcatggggtctcctgtggaagacatctttctttgcttctttccactgggttatcttcttcctttttttttttttttttaactttatgttcatgatctggtgccaaattgggactacagggatgtaggagcctcttttctgacctgaagaatgactcggtccataaatgttgagccacctgagaaagggaggcggagaagagatccatgtcattggttcttgttgccaaggactttatgacttggttgcaatcatgacatgtgctgaaatgatatcacataaggcagaaaaaaatacaagttaccagcaaagaagcccaggtcaaaggctgtgaatgtttagggaaaggggaggcctccaccagctggtaggttcatgaaggatgaggccttgggaaggtaggcagattccagacatgcagaaatgggcaaggacagtacaggccatgacagcagttgtgcacccaggtacaaagttcaaggtgttcacaggaaacattcgataatctagtagtactactgggctgagcggggtggggggatatgtagaagacccttgtttgatgtagctttggtctagcagtcaagggaaatgagttttctttctgattttccttgttttaatatggaagaacggggtggagaatcctcacacatccttcccagtgaagggaaagggccagcagatgtttccttagagaagccaagctagagcttcctaggcccagggcagtccagtccttcatgggtgtgagtttgccttaggactggccacggccagggaagagaagcattgcatttgttgcttctttcttggtggctccctgactccattcaattacaaagtggctcttacactgttaaagcttgagtgtctctgggctacaatttctagccacagaccttcatttgctgtgcctcaaacatgaccttgaggccacatcacattatatatacagcccacaacaacgttaaccagtcttctatctggtaaggcaagcgcagtgcaaactccatgcctttcttctgggatctctctctgtattgcccctttagcaggaaattccatggcaatccaagatgcaagagaagccaatgatgggctcatttcgaactgtgttatattatttaggaaaaagaaaataaaatgaaataaaaactagattacagtgcctggtgaggatcacagtgtaaaagtgacaggtcaggttgtgtttgtccttgctgcttatgtgcagccggtgggaaagacaagggcagctacaactacagcatctgaggcttaaagaggtgacatgttgtgcatttctaaaataatttttatgttgtagagaagctttatatctctctctgactcactggacaggcgtggtgtaaggcagaaaggaagacggtccccaggtgactgcaggattgttttaggaaaataataagtaacttaaagttagctttattgaaagtcatttttgtagcatcaggtttactgaatcaagcatctctctctctctgtctctgtgtgtgtgtgtgtgtgtgtgtgtgtgtgtgtgtgtgtgtgttagaagatcatggctgcaacaggactatgctgcatagcttggagacccactttcagttacatcagtgatggtgctgcttatcttctggcccttaggaaatgctgcgtcttagtaacatgatcaaaatccagggctgtggaatctgtgagctcacccctttggagggcagggctgtagaaatatacataggggccagtgcggtggctcatgcctgtaatttcagcattttaggaggccgaggtgggcggattgcttgagcgcaggagtttgagaccagcctgggcaacatgatgaaatcctgtctttacaaaaaaatacaaaagttggtctggtatggtggagcaggcctgtagtcccatgagctaccacagtcccgtgctacttggagagctaaggcagaaggatcacttgaacctgagaggttgaggctgcagtgagccgagatcgtgccactgcactccagccagggtgataaatgtgagaccctgtctaaaagaaataaaggaaatagagataggacttaggatgtcgtatcagggccgctgacaagactctcctcagaacctagttgatacaccatgcatatacaatcccaaacagccaaaaagatcttccaaaattgtttggaatggcatacttctgtaaatgggtaagtataattaaattctggaaagatttagaattaaacatataaaattttagtagaattagagccatagtgttaatgtttttgatttaaaggatttatgtatatttgatatttcaagtaattaaaagaaataatttggcctaggtaacagatcagcctgtatttccaaattaaaatgtacaatgaagtagctcatttagacatttgatttgggggaaggttgaaattgtactagttttataagcaacattttagtgcatttaagataatttattaggtttctaagacttgtttaagggaagattttataatttaaaaagcaggtagttctaatatttaaaagaaataattacttattcatggcttgaaacatagatgaaagaaagaacatgggtttttgaaaagtgagcttgctcatctgaaaagcaaggacatgagagtgaagatgagctttcaatgaaataatgactacagcgtaatgcccaggccacagtactcagtaaggacctgttgaagtcataatttttagaagtcactgaacaacaggatacgttctgagaaatacatcatcaggtgattttagtcattgttagaaaatcgtcaagtgtacttacacaaacctagatggaatagccaactacacacctaggctgcaaacctgtctggtgttaactgtactgaatactgtaggccattgtaacacaatggtaagacttgggtatctaaacataatctaaacatagaaaagacagtaaaaacatgccattataattttatgggaccaccatcatgtatgcagctcattgttgaccaaaatgtcatcatgtggtgcatgattgtacttcagtcaaagtgtgagttgacactgtttaactccaaggggtgccatttgtataggctgtggtacacagtcaaatagggctgtcttggatattgattttattcattcaactccaagtgctgcaagaaattaaaagttagtcaggttatgtgtcacatctatcaaggtattctgtctgttttcccagaaaataaacaagtttgagggtaggagacatttttgtcatctggacaaggttcggacaaaattgtatgtaatacagagccctggatctatttcgccttggccgctcaaatagccctgaacaggatgcacagtgaggccccaggttggaggatgcttggcttgtctgcagacattgtcatttagctctggcttctcgtaattaggtactcctagctgggctctgttgtcagcgagccttcaagacaaattgcaaaatctgtacaaccatctgagagatggagaagtagatccaatgatactacaggggatattggtagttctcaaaagtttgaaagagaatgcttagaaaagcaatcctcaaaactgaatttagaggttcttgtcctgtggtaaaagggttcacaggatctgagaagatcttgcaggcaggaatgatagactgaatctaaggggatgaaatggagtagaaaaaatgtaaggttctgttttgaggtctgaaaatctcagctatgcattaaaaagactggaaacaggggtagggacatatcagaagacgagcccgtatgaaaaagacctaggagtttaagttggcatatattgataatttattgtgctccttaaaaatttaatgcagtgtttggctgcattaacagaggtagagtatttaggatgagagaggtaataaactgactctgatgctatagcaggagcactgccacagttctggactccaagctttgaaaggaagacagacaaaggatggtcacaggatggtgtgtgggagtgttccaaagcttgtcagataacaaagtaacacaggaggtttagcttgtgtacaactccaagaggaccccagagctgctgttaatatctgaaaggcagttaaataaataagggactggacttcttgttaagaggaacaggaaggatctggggatgaaagttaaagcagacccccaaaaggagggtcttcttattcttaaatatgttctaagatagaatgggctacttcctcaattttagaagtgctgactaaggcttatgaggactttcaggaatgcgaatggatgacctaggggtactttctagcccccagatttcatgattcctttgccttccagtgatgaccatgtcctgcacagtcccagcactggcaggtggtggacagagccatgactctaggacattctaggcagtgatgagagagtcttcgcaattctcagacaagatttccctaaggacattttgatgttcgtcttcatcagtgtttccagttctttactctgctagggaagatctgggggatatggtcacttcctttcagcagaggctgtgttatttcctcattcattcttttctctgtgcccagcagtgtgctaggtgctagggggacattgaggaagaagacaaagttcttcccctcttcaagtatgcagtatatctgggaggaagtaagacaacaaacacaaattttacaactaactataaagttataaatacagttacagtttgggtacatcctaggaagaagtacagtttgtgccaccatgggggtgtagaacaaggcaaccaaacctagttgggcaattagagaagacttccccaagggagtgacatccaagtgaggccttgaaggagaaatagaatctagcacaatggtctcaggctggtgaagcacatgagtgaatgccacagcagcaagcttcagacttgttcttgaccaaaggaatttttcacaaggatagagctgagctgatacaaagccagccaacagtagtgctatgaaatggtggttttccatttactgtagaaagtatgtagaaataatttcagttcctggtattagagcaagttgaagtcgtaaataggacctgcttagaagaacccatgtcttgtatgagtggtttttatttcacgtggtattttggtaatacattctctgcttagcttctggggatattttttcctatcatggttttctgaagtcaggttgtctgagacttctcagtttcctggtgggatagggctagaaggtttttgtttatacttttgggcattgttctttccccagaaggttatataacttggaggagattgagtcatttttttcactgactacctttagggggtgtctgccttcgtactgttagcttcttgtcattgtccggcttccgtggccacagcagctcattcgttctcttgtggctgtgattttagctggagtaaactatgagtagaaacttgaataagaaggaaagtgaatatgaatgtgaatatgaaaaaccaaagactagaagagaactgggtttgtttagtcccagactaatccttgtctgtatttgttgcttatatgagtgacccaccacccacagcatacaaacagacaaaaaggcacatcttaaaaagataaatttcagctgggtgcggtggctcatgcctgtaatcccagcacttaaggaggccaaggcgggtggatcacctgaggtcgggggttcgagaccagcctgaccaacatggagaaaccctgtctctactaaaaatacaaaattagctgggcgtgatggcgcacgcctgtaatcccagctacttgggatgctgaggcaggagaatcacttgaacctgggaggcagaggttgccatgagccaagatcgtgccattgcactccagcctgggcaacaagagtgaaactctgtcttttttttttttttttttttttaaaaaaaaggataaatttctattcttagatgctggtctaagttcaaatttaaatgcctttcatcttaatttttcctagtaaacatttttgcagacaattgtgctgttttatttttctagtattagtaaacacatagttgtaattttaaaattcttgattctgaattttgttttttgctttcaagggctttgttggtttggtgttttggtaacccacctcatggtaaattcttctttctttcaggtaggaatgaattgatagccagatacatcaaactcaggacaggcaagacgaggaccagaaaacaggtaaaataacccacctggaaattgtgcatgtcagcgaatggcccaaaaaggcattttggctgcagtggctggctatgctttggctcctaggagcccccaatttgagttccctgtaaggacgtcagtgttggaggtattttaaattggctcagttttcactgttcatcatttcagtgaccctttattatgtggtcttacaagttccttttatactcacatgggaaaatgtcactgctaaggacggtgtatgaaccgctcctgtactgtatttcaaagctgacatttctttcccaaaatgtgcacctgtgaacactgcaaaaactgcaagtgcaaatgcacttgcaggtcatgaaattttgaggttttgtgcattgtaaaatcctggagcgattatatattagtcataatttcaatgaaaaagtaacgccagcagccttgagtattggcctgaatgtaatgctaaatgatgtgcgtccagggaactgttgctttttaagcgatggctttttgtcagtagctgctgtgactgaaatgaagttacaacttcaatacctctgtgcagagcagtatcaggaattctctgccctttggcagagctctgcctttcctcgttctttcagatgtaaaacagcccaaatctctgacatgagccagtttagaactggaacgaatgagaaattagtgtttaactaaaaacaaaaaaaagaaaggaggaaaaaaaaaaccctaaaaacctcatgggtgagttgttcacagaaaagaattattttttaatgtcgatttatgctgaatgatacagcatgaaccttaaaaactgtaatcagaccaaaaggctaactaaaccgtggtctcattaagattgagcagcagatttcagttctcttcccagtgaggaattgttttcatgagtgtttataacggggagaggcttttcccaggaatgctacttgtgccacagcctgggagcctggctgctgagtcagcacaaagagaggtggcctcctgccagcacgcagaggcagcgcattgtctgtttgggggatgctagtggccctcgtcaagtcagagaatcacagaagaacaaaattcgggtgaaaacaagtaacagcaggagccagatggagggctgaagaggatgggggagtttctgcttctctgtacttaagaaaagtaccaaagcaaattggaaaaaaaaataattgaataattgaagctcaaagacaaagttaaagataaaaggaccgtttattataaatcctgttttagagccgctggagagttggaaatggggtaatcaccacacagtctgagtcgctgaacttttaaatggaaagttctacatttcggaaaccagtggatctaatcatctacattctgacagtgcgggacctgggctgtctgctggtctgtgagctctggtcatttgcccggtgaccccttcactgagggactcttctaaatttaaccaagtcccactgaaagagatgcagatttcagtggaatcattgtgtttcagaagctgggctcggctacatttccacgccccggcatcctggggatgtttttaggcagcagttggtgatacctctccaatgtgaatttgttgttcagcaaatccatgtggttttcaacccagatttttaacaggatggctggctggctgtattcacacatttcgctttgtaataatatgcaaatccacttggcgcccagtcaatacccaaaagagtggaaggattaaagatttttataagggcaaaaaaaaaaaaaatagctctgctaactgggtctttccatttctctttgagatctaatttacatgtcagtattattttaacgtttgctacagaatccagagctcttaatgagatcagaatacaaccaacagcttcagctttttgattctgcagaatgtgctaatttatggatagtctcttctaaattgagaaaaagggattttccctcctgatactgagaagctataaatattttcatttacctttactcccacctttttaattttagaatgaaaacagcccctctcatccctcccaaaattagtttttcccagtgcccatgatttctcttgggtgggaagactaagatgagtcttaactttcatcctgaatcaagtcactgcagtgatgacccagtatgaaaagcttagagcagcgctgggggcttgtgtctggctgggactgtgtattcctaactgcagagctttgttgagatgcaaataaccaccccccaaccccaccccaaaaccctcccaaagagtagcgattttatatttgatttccttttttgttttgttttgttttgttttgttttgttttgttttgtttcccctcataaacccgaacaatgtaggtgtctagtcatatacaggtcttagcaagaaagaaagttcgagaaattcaagccgccattaaggtacgtctggcttgcccacttgtagggggcttttcatctccatggttacaggcttttcctttgttttcctcccttcccctaccctgcaggtgtctagtcacattcaggttcttgccagaaggaaatctcgtgattttcattccaagctaaaggtatgcgcttttctgctttttggcttgtggttgctatgcatctcacttcctgttttccatggtgactggtgaatgcctggtgctgggattctcgtaacctagtttccttgcatgtgagagctgtttacatttctttgtgtttaatctctctgtttctgtactagcctcacattaaactcaatgtgtgtgagcgcgtgtgtgtgtttgcgtgtgtgtgtgcgtgtgtatgtgtgtgttcctaataacaatgcaaatgcagcagagagctggtcttgataacttttcagcacagaaacatgattttttttttttaaccttcagatgtccaccaagcagccatgggctaggaaagcttaaaaaaagaaaagtccagagatgcaaaattgagtagaaattatttagaaagaatcatttccaaagtgctcatgaaattacctttttaaaaaatttagaaattattttaactcatgcttttgatgtatttttaagaagacttataaaaaatacgtctttttcatgcatgtctcttccctcagagtattttcagccagatttcttccacattgcttactactgttttttaagtgaatggcgctcttattaaaagagaaatctgagcagtggcctttaaaaaaaaaagatagatcttagagatgggaaaactcttgatcaaacccatttgcagtttcatttgtacttgagtttgcttaaatttttttttacttgtacctcatttttcagtctcaaaatatattttataggaaaaatgggggcattgataatttttcatatacaacttctttctgctttttccctttataaaatttataataaaacatacctgacttttatttttctgtaatgccctattttagaaatgcaaagagattatagtttgcaaggaggagctttcgtttataataaaaattgattttggcacatattgatggctttcccatgtgcctttttcggttctgttctgatatttttctatacagtaattaaatttgtggttttgttctgaactaaaaaacagtgtagtctcacaacacttgagtggtgagcactgggactcttcccaaagtccttcgacttttttttatgcaaacaaggctggctgtggaataggacaagtgattaggaaggagcatttggtgtgccctctgcagtgggcagcatgctggctcgctcgcacgtgtggctgatggtggctggcttttagctgcactggctgagcagttggaagactaagataactttgtagatcctgctttttaaccaaaggtgcaatactctctatatggatgtaactaccccagtttttgctcaagttctgactctgtttctagtttctctgagctaatgaattaatgatgtacaaagaagtttacagataacaatgttgtttccatctgtgatgatatgaattgctctatttctgcactgtctgtgtggttcctgtggactcaccagggcacacagccttagactgaaagccctataagtgaggaataaagctcttctgttcagaagggattcccatgtgatataggaagcactctttttctcacttggtgaattttagagttttcttccatagaaacaatttttctgttgctttatacatgtacatatgtaaaaatacacagcggtatttatgtttgtttctaaaaaaaaattaacaataataaaaaagaaacattcccctgactttcagccctgggccactctcttttggggcaggcacaaggaagagacagaaacagaagcagtaggatagcaactggctcagcatttaagctccaagaaccacctccgtcttcttgtagtttcttccgttctttcctaccatattgttcttggaaaaatggagtcctttgtttttccatctgctaataccaactgagtgttccaggcatggtgcttgctcactgtgatgggcagttaacagccaatatcctgttcagggagctggccatgtaaatgggaatgtaaactagaggagcactttgggtaatagcgggagcagccaaaatgaaatgtggggtgcatcccggggatgagcttcgtggagagtatactgttaagtttggcaattgaaagaggaaaggcagcctaatgcgtgctccctcatttaagctcactatgaagtgacttacagtattctgcttttggggcatgatactgaggaaactggggctgagagagtataattgactagtcacaaagccttcctagtaagtggtgaagccaggatttgaactcagatctttttgcaccctaaacgaatcattgttttagataaaattttatctagtgaaggtgggagaatgttttcaagcagagggcttcacaccagcacactgtacctaaactgtcacccctcacagtctttggggctgggcattcagcctttgctaccagcccttcacttggcatccacattttaactttgagcccttggtcaaaacgtggacttaatttgggttggtgctgtgagggtcatcagtaactgggggaatgacatggtcctggagacagagctgcttggcaccactctgagggcattaggacagtcgcagagagtgaggctgtctgtcacctgcttgcaggagttggtgctgctttctttcactccctccatgagcattttatctcaaaggcagtatacttaaccttcctaaccagccattaccaggatatgggctcaactctgttgatgtcccagctccatccatacccccttgttcagctctggaatctaatagcacatttgtgaggaggcagggacaagcatctttaccgaggtcatcatggggtcaggctgatagccatggtcttcttggcctcccacactagctagtgagataaactcgctacagataattgaggtcatcccaaaagacaacaaggatagcttctgggtgggtggggagcagaggggagtggcaggaagtatccaagcttaaaagagacactgtgctttgcctgggaagatgtaggaaggcctcctggagcaggtggctggtggctgaccatcccagtaactatccttgcagacactgccctagccaggttggttaccacttctccacaaactcagacgtcgaaggggtagacaaaggtctatggtcctcatgtgaagaccgaaaccagacttgcatttgtctgtccctctgtggagttggaaaagtggcttacccgcaatggaggccactgccagatgtgtcttcctggtgagtcttcttgcttataagcttctctttactttccagggaagggtgtggcagagttctttgggctggtgttttccagcctttttaaagtagcaaaactcatgttttgaattgaagcttactccctcaaatccttagtaatggcctcttaggctattccattgaatcaggtttgaaaagccccctgttttaggcagaaggaaaaggaggtgtctacctcttatgctgtcccttccagcctttacagagagctcctgtgtcccatttaaagcccatgtttttaaattctgtagttttgaagttctgccatgttcctaggaagaaaacagactccaggagagagtggtcatttgatgtcacattgatagatgagtcatcctagctacaaaagttactctcctgaaaatccgttagaataaattctaaaggtcagctttatgcttctactaattggcagttgttctcaatgtgcttgtttgtggactagatcacccccaaattgtgtagacttaaattttagtaaagaaaaaaattgttctagtgaaagtctaagatttctacgtagatttgaacttgaaaagcataggaatgattactgaattcagtccagtggttttcattgagaacctaagtgtgttctaggtccttttgtagacgttgggcacatagaattgaatccagagtttctgttcttgaggaacattgaacttttctgttatttttccagtagatatccacagctagggggctctgcagtagaaattaaacaggatagtgcagaggctgcccaagtgaaaagaatgattcattctgggagtgagggaattaaagcttcatggagaagtgtcattagaactaaacatagttgaaggcagagaatttccataaagttgggactatctgggggaccatgaagagcatcatgtaattggggacatgcggtgggaggtaagactggaggagcctaagggaagggccctcgattatcccactgaggagaagggattcatctgtgggcctaggggcatacatggggttcattcaaatttaccctctggaaagacctcgccagccaggttttgcaggatagctaataagagggaggccaagctggagtcagggaggctaattcctgggctgctttaagagtggggaagagagtcacaggctgggaccaggggccaacccacaccccctggggctgctccgtggcacttagcactcatccttggctggctccctgctttggtgctctctgcctgctctgtagtctttcctactcattgtgtttaaagaataaattataagttctgtccttatgaagtctgaaaagtgttgtgtgccagaacttttcagaaagattttcaatagcagcatttaaaaatcaacttattaaaattgggttctcttaaagtaatggtaattgactaggagtgtgcatcaaaattatgaagtttttgttgcaaaatttaaacagtacagaaaatatattaaacactcatgtttatactatctggaattgatcattttcattatataagttttttttaatgaaaaatcaagtggcaaacattattctgtactttttcctctacccaccctccgtcttcaaccaaaattaatcttcctttctttcctaccacccacaatgtattttcttgccacttacttcccttagaaaatcaaatccagtgaaagctctctcttctcattttgctcctagatttttgcccattgtctttttctttttcttttttttttgagacagagtcttgctttgtcgcccgggcgggagtgcagtggcgccatctcggctcattgcaacctccgcctcccgggttcaagcgattctcctgcctcagcctcccaagtagctgggattacaggcgctcatcacgacactcagctaatttttgtatttttaatagagacggggtttcaccatgttggccaggctggtctcgaactcctgacctcaagtgatgcgcctgcctcagcctcccaaagtgctgggattacagacatgagccactgcgcccagccgatttttgcccaattatctaccatgaatttgtgcaatagccattggcaccaacatgagacttttcctctggaatttttagcagcttaagatagactcggccaacaatttggtgaccttggatacagaccctgactgcagaggagagatacgaggttcaggacatataggggatggttgaactagaaagggaataatgcgaggagacagtgaaccaggagcagagaagctgggagagtagagacaaagcgtcagtagactgaagctgagattcaagagctcggtaagatggaaaaaagaaaaaaaaaaaggcatttgtggccagagcacagtgattttggaaattaaatttatacattcagagttgtggggattttctcccccgccccccccggggttggggcattttcaaaatatctaggacaaggctgggcacggtggctcacgcctgtaatcctagcacttcgggaggccgagatgggcagattgcctgagctcaggagttagagaccagcctgggcaacacggtgaaaccccgtctctactaaaatacaaaaaattagccaggtatggcagtgtgcaccggcagttatagctacttgggaggctggggcaggagggttgcttgaacttgggaggtggaggttgcagtgagccgagattgtactgctgtaccccagcctgggcaacagagcgagactctgtctccaaaaaaaagaaaaagaaaaaatgtctaggacagaagctagagtacaaactgcaggcctagaagagagcttagctttgaaggagttgtttcttagtgatgggagtgctatgtgtttgtctcctactcagacaaaacccttttgacccactgctctcaagggggtaggttttatagatgacccacagcctgtagctgggcctgagtctacttctaaagtagaagatgaatccatgcagttgcagtgtgaaagaggcttctaggcctatggaatatccatttaaaaatcctgaggatgctgagttagaggtctcccttggaccttgtgtcaccagctgcagcgacagcagtgtcaccaacaccagctttacctgttgtcttccatctcaccctttcccttagtttagcccctattggcgtctccagtggagtagtgagaagcagcagcatgtctgaggattagctcacagccttagaaattattctctacttcgaattgtttcacttaccattaattcatgaaaaagtcattaactgtttttttaagctccagggatttattatcccagcatgtagaaagaatgcagaagcattctccatgtgttaagcagtctttttcctactcagagtttctttgtagagttccatgcaggagtctctttgcctgtatgttcagttgccctaagaagttgttcagaccctgctcagagtccttctttccccattagcagcaaaaaggcagtcctttcttgctgttttcagaagctcacggtagccacagccaaggtctgggaagcaccaccacactgtgggccgtctccatcttcccatgaagatgggccaagccacctctggttcacttctcgagtgtgtttaggtgagtgtatgactcgggacaaaactaagaggaaaggaagtcttcgccgtgccctccgctcggcaggaatacatcttaggcagtagatgtattcacgtcaggctctggatgtgtattgaagaaaaacctgtacttgctgacattgcatcatcccagtagagcagaaagagacctgagcccctctgattatgtccagtcgccggtgactaatttatgagctacatgtgctcccccggggccattttcttgttctcgccctggtggcctttatgatttgatttctgaacaggccattctttccaaactgctgttccttccaataggcagagagcttaaagttcaaattgttgatttaattcttttgagttcaagaacttcactggggcattgctaaagtccacactgctgaatcatgtttgtatcatcactgattccatccaggaatgggcctgtccacagggaaggtagacgtacttcacttcactctgtgttgccccgtgaagccccctgagccactctgctccttcaggacttggctgttagcagtgcaggaggcaaggaaagcctgagcaacaacctcctttgtctgtgtccacaccaagacacttggccttgtcacgggatttgggaaatgatatagtctttcctggcatttcccaatcttcagggggagttcttttgcatttatgacatatacgctttctcctcaaagatatttttattaccttgtttttaatttaactgaacgaaaactaagattggagacaatttctcaggcttcagttggaaccacttgccaacagtgtggtgatggagaaattaatgatgggagccagggcactgaatatgtagataaagataattctgtgtgaactgagccaggtctggattttctttataagggcaacagaaacagtctcatcattctacatttttatctcttcatagcaaaatcccattgttaattggcctccaacttagataatgccctagaatgacatctatccgaaaggttatctagtgaggacaagggctcctgagtatttcaggtcccgagcagaatccagcttggaaagccagtccattacctgggccccgtagactgcaagctcacccagggccaaggctgcaagcaccatactaagtacttgaagcagtcctgaacaaaagtgtttttatctttgatttataaattaggacacagaggcgtggaatggctaactggcttgcttagagtcacaagtctgaagttaatccagggatatctggtgccacaagccaagctctttgcaggatgttcttctgccttcccaaagagtactggtccaggatgaggttcattttcctgacttggaatgctttgcattgtctccctccactgagccctcttcattgtgtctttatgtttgaaagaaatagaagaaggactcactctggagcttaacttgagcctggagccagtttaggttcctctggccccttgctgtcacctcttagagaaaagggggctgaggtcagaagggtgccttctcccagacacctggatccggcaggaagctgtcctaaatcccaggcttcctgggagagagtcatgaggcacacctatgagtttgctcgtctgtagtcctcatctacaatcctttatgatgtgaagccccacatcagagttaaaggaaacgatgttgacaattataaaataccaaatatagctgagtatatttaaaaatgaacaatggtaaaagccttgaaaatttttccttggatgtgaatggagtctttggcatttggaaatacaataaaatgaattaattgctgcttattaggcagcgagtcaggagaagcatgaatgtgccttctgtcctctgcgttagctgttacctgactgaagtagtctccttttgtatttactcctgccttttctaatgataagcaaattagagatcatagctagaaaaaaaatcaagtgccctccatcctttttccaaaaccataatatagttctgtgatgtttatctgctcaaggggtatggctaataattgcagaggtcatgtggagccacatagtgcaagattagaaagaacatctgcaagattacttcttaggaaagtattttgtgttttgtctttttctgaaaaagtgattgtgcaagcaaattgctgtctttcctcccttgcactatattgctggttaaagcatatttgaagaaaaaccatttaataactatcaagagtttttgaatccatggtcgtttttttgactttactattttttctgacgtatttgatggacttctatatgaataaattacattggaatcctatctttaaattctgaaatcatggcccatgaataaactgtttggaatatattgattatgctgttcattaaaattccatatatggcagctatcatatattgtatatgcaagcatgtaacctttttatgttatctttaaagtttgttcatggtaatacctatagaatatgagataattgattttgcagaataatcaaaagctgagaagcagaaggaagagaagggaacaagactcctctgatatccagactgatccgtgagatgtccttgagttttaagagtacaccactccagccatgtgcatttgtgatattgctgtcctcctgtcatgtatattacatgtagatattttccaaacattgtgtccatttcaaccataaaaaggaggcaatcagcagaacagagagctatagcagcagtagccttgctctccttcatgaaatatgaaagcctgtttttacttagaacaataacaatttgtaaggcttcaggctgaggagtttatgcatgacacagcctgctggaccatgtagcagaggcagcgagaccattgagtgtggtgtgttggaaattggttaatgataaaagtagggtagatgatgagacaggcatcccgagtctcaggtcagttggaccgtttgttcttagaacccatcctctttcccatcaaaagtccatagaccacccatagttcctgctccatgagtgttttctgcattgcaggtcatgggcttgggttggggttcagttggaaaagggagatttcccttttctttccccactccccaaaacatttggctttttatgtcctcattctttgtaatcttagggatagagggacggaaaatcagcaataagtagtcagtgtgaacttgtccaaacatttttctaggatgcaatattcttattcttgctcatatgcacacgcacgcacacatacacactcagaatatttcctgtaacctaagacttcacagagcataattccgtattaacctaacagtttttcaggatcaaacaatgtgctcacctttgtaaatctcatccacatctcagaaatgttggtgtgaagacatcttaaaattagtgtggtgtacaaatgtagcatgtgtttgaatttacctagcttcgcttgtttggatagattagcctcctcccctttagagtgaggatgagtagtgaggatagagtcgaatgctttaaagtctgggatattaaaccagagtgacacagaggagcagttcactcaggtctgacacttagagttattttttcaaagccaggcaggtatctctgggctgcaaatgacaatttagaggtccttccattgaaatctcttagcttggcattctttcaaattcccgtttcaggataagtgggtctgtaggcagacccttggttctgatttcaagatatccctggtggtgcttattatttccagggtcacattagattttaaacaaaaacattttaatccttttaattttcaatatatattgtagataaaggggagatgttataaaaattaaatgagtagtcagagtagctcgaccacaaaaggtaggaaatcactggtatagacattttagtccatttgcagaaaattgcctattctcaaataggtaggtcaagtgcagaaagaacctctacttgagatgaaatttcctttctacacttagctttctattaggacagcagaccaaagctgcccaaattttaacatcctgctgtcttctcactagtagtttccttgactatatgcattgaaaagtatctgtttataatggaatttaccctcatagctacaaatacctttaaacccagaaggacattaggcagtaatgtgcaacttttaattttataaataaagaaacttcgaagtcattaaatgacttgatccacataatgcagctcattaatgtcaggcagggacaggtttgaagccaggtctccggacaccccagtgggtacaccttttatagtcttggagcaagttggtgtcataaaagcaattgatttgctctcctgctcttgaactcctgttttcatttaggtacctggtagaatgctgggtaatgagagagtcaaaccttactttaacagaagaaaaagatcatgttctgaagctgtgtgacataaacagcaaagataggtgcttttctccttttccacactgactgatttccgtttcaaaaaagaatatcaaacttgtttgaagatttcaaatgatttttaataagcctagcaaatttcaagcaactcaataaagcgggatgtggagatgcagggaactcatttggacctggacttagaattcatgagtcaccccacccaagtgtgcacaaacagattctgtatttgggcaagcagaagtgcctctgtctgcagaatttcaaatacgtggaactcttcgggtctgtgagaggatccacgatgttcttctggaatggagccaagccctcaagttcttttgtagctattgctcagatgtgtcagtcaggcaggcaagacgtctgtgctgccattttccaatccccctagcctgggccccagagaagttgtaaggcttgttctgtgctgaggaaggcacctgtggtcatacctgagccattacctcagtttcagaaatctgccttgagagcatttataacccccttggtagaggttgagtggcttgggggctggagtccaaagtgactggtctaagagaaaccaatggattcgtattgatgtcagggtgatgttgatggggaatggagttggtgtgactagggccatggtttctgttcatgggctaccctctgaggggatggacaagcgaggagcaggtaaagccacagaatagccaacagtagattgcctggcactgaggtctgcatgtgtgggcccagtttgtcagtttatcataaaatcccatacacttcaagatttgccctctttctggcatcctcagtatctgacatgtttcaaatcttaaaaaaaaggttagttgaggaagctagctttaggttagaacatttgacagattagcaaatggagccccaagtcgaagaactgccatctgataagaaggagataacagcagcaaaaggatcattctgagtcactctggccgttcttttgaggcccaggaatcctgccagcttctagggcccttggagtgtcactcggccacgggaggtgtcattacagatgttcataatgaccttgagcatccatgaaaagctgttacttgaggctccttagtttttcagtcacagccagagtaatatataagacataaaaattaatgtggctgggcgtggtggcttacgcctgtaatcccagcactttgggaggccaaggcgggtggatcatctgaggtcgggagttcgagaccagcctggccaacatggtgaaaccccatctctactaaaaagacaaatacaaaaattagccgggcatggtggcatatgcctgtaatcccagctactcaggaggctgaggtaggagaatcacttgaacctgggaagcggaggttgcaatgagctgagatcatgccactgcactccagcccgggcaacaagagtgaaactccatctcaaaaaaaaaaaagaagaaattaatggaagtgttaggctccgttttctttttcccccctcccctccctttccttttttcctcccttcctccttccccttttctccctcccaccctccctttcttccttccttttctccttcattctttttttttctgatggagtcttgctctactgcccaggcttgagtgcagtggcttgatgaacacagctcattgcagccttgacctcccaggttcaaacagtcctcccacctcaggctcttgagtagctggaaccacagaagtacaccaccacacctggctaatttttttttgtgtgtgtgtgtgtgtggagacagggtctctctatgtaacccaggctggtcttgaactcctgggcccaagtaatcctcccacctcagcctcacaaagtgctgggattataggtgtgagcagccacacctggtcttcccctttccctttttctttattggctctttttcaaaggttaatgtaagctttttggaaattcacattgtcttcctgacagttatagggcaaagtagtatctacaccctgggaacacctagcacatctttcttagaagcccttagcagttgttcatgagctttgattttttaaaaactcctttggccttgcttttgatgccttgatgtgtttttttcatcacctttggttatatcagtaagcattgaagcaccctctctgctggtacttggtgtcttagcctgaagctccctttgacgttccctggaggtggaaagcactctttttattttgatgtcaccattttgtttttgctttgatggcatttgggcctggaatatagaccctctattggcaccggtagcctttatatgcctacgaggctcaaagccctgcctgtgcccaccgggcctgtctcataccaggaggctatttctctgtctgtcctggggaagccacagaaccagtgcaaaggagttgaggggtagtttttttattattgctgttgttgggtgcccttctcaatcattgcctttctagatagccatctggatcaccttttcttcctaaaatgtgaaaaggcccacacccctatgcattttattgttcccaagtattatatgtttgtgtacatatatacatatgtatatatacacatatatatgttttttttttaaccaaagaagaaaaaaaatccctttttatgcaatccttttaacaaattgtttattattgtatccaggtaacaagcatggtaagtattttcaccaaactgagtattctgtattttagctgtgcttggcagacttttttggctagctttgtgttgttagccttggctttcctagaaaagacccgttcaggaaaaggagaaaccacgtacctgtagcatcccctaggctcctggcttcagtacgaacccacgtagccttagccccacggcggggatacctgagaaagcatgcaccccgccagcatgctgcttggccctgttacccccaacccccgctgcttctgagcctctccagccaggtgtctgcagggcttccaggccttgcatgaccccagcagctcctgggaccatggccctgtgacagtcaggacacacagatagggctcctcgagctctgtggacggtcctaccccagtccacagctacatctcttctctcactcctcctcccatccgtttgcttaaaagcagggcctttatttttttttcttccttaaatgttttaagtaattggagaaatcttctggaagctgacaagctaaataaatacgttgtccactcttctgagaggcttcacattctgttggaaaatggatttaatccctaaaaaaagccttgccccattgggtcttcccagtaaatgttgagaggtacggtaggttgagtgtggtttagccttctggctgtgttatttatccatgcatgtttgctttttttggcctattttgtggctctgtattttagtccatgtgctcgtggctgtgcctgtgtaacctgcctggtagccatgcgttatgtattaagttggtgtgtcactgtcaccttcaaggatcagactgcaaaggataaggccctgcagcacatggcggccatgtcctcagcccagatcgtctcggccactgccattcataacaagctggggctgcctgggattccacgcccgaccttcccaggggcgccgggggtaagtcatgagctcagtccagtaatgacagctgctggggttggggttggcatgtgccagtgttaagcctcccacctccatttcttgtcatgtgggtcaggtatgtgagagggcaaaggctaccttgtcaactgataactgagtctaaagtggtgaaagtaaggagggaagggaggcagagagctagagagaaagggagggggaggagaaggaggaggagaggaagaaaagaaaaaaggaaaaggaagagggagaaaatcagaagaggaaggaattctgagtccctgaagacatggaattaaatgtgcctttctgggttgggctcaggcgtcttctctctttatctttttcctggcccttggtctctgtccctctgtcttcaggggcaactagcccctaaagggacaaggtattctattaacatttacattttgacacctaccaaaggctgagaagcattatgttataatctcaatcctccaggtaatcttaaatgctgcttattgtcattgccattttgcagatgaaaaagctgaggttattcagtagcaaaacaagagtttggatagctgggatcatagtggaatggatagtgatgtcaagaatcagccccagggttgcttgactcctgaggctgctctttccctcctctatgtcatgccccctttccagcccacaccaatcgcagcagggaagctcgctgcagagaagctgcctgcattgccgcttggagctcctggccttgttcaagctttgtcctctgccttgctgggtcttcactgctgttgacgcagaatattatgcagggaatgtttcagaatgaagggagggtacatggataaatcagtcagttaaaatattggtgagccccctgcagcacgcgcagatctttgcttaggtgtaaggaaaacaggagctgctgcctgcgtctgcccttgggggcattttcaggaaggaggcgctaaggggagctctgggttgccagtccaaggatataggttgtggtctcgtgcaagtggtgaccgcatttgcactctgggaaagcgattctgttgggtgatcgaacctgctgtcttttagcaggggttgtgatgcgtaggcatcctaaactgtgctttgaagtaaactcgtaattctgaggcctttgcattttgccttccagttctggccgggaatgattcaaacagggcagccaggatcctcacaagagtaagtctgaggaggggtgggcactgacaactacgggctggtcccagcccacgtggggagagctcttcctggaccatagtgtctcagggcctggaggagaaaggagcattacactgaggtcccagaaggcatcccctttttattgtgtacttaggcccctggcaggaaagagactggcttttcggatctgggagaggtggaagcacctcattcccaccttaagtattagcagtcatccagctggaagcaagaagtggacccctcttccttcatggtattgaaggctgagctgtggtcctccttgcctgagaaagggcggcacaggtgatcctctagcccatttcattctagccagccctgtagtagggtggctagtagacaaatcctactgatgccttgggggcaagagaagaaagatcagtaaactggaaataagggctatttcgggataaaagaaaggaaatcttgcctatatgctgtaaaaaaaaacttgcattgtttggcctagagaaggagagcctgaagcatgtcccacactttgcctagaagtggtgactgcttgacctcagaggttcaaaggcagatgccacagcacaaggaattcaggctgtctttccagcacatcccattgaactggaatgaggcttggtggtttgatccctacctggctgctggtccctctcagtttatggaacaactgcctctgcctggggtgtgctaccacctgcaggcagggaccacagcggtgaaggacctcccactgggaggtcatggtggggcctgggtaatagcccctgctgcagatgcgatctcttaactctgtctgccatctctctgttcccagcgtcaagccttttgtgcagcaggcctaccccatccagccagcggtcacagcccccattccaggtgagtgtccctgaaactcctttttgggagcacagccccacacagctgacagctgggtctggcactttgttcccagagtcaagagatgctcaactttgccacagccgcacattgcccctgacttgcaggatccttgggtagcctgtagctcaggagggccacagggtcccgattcccatcagtcatctcccaagagcttttcagatggtttgtttaagaaacaggaagcctcctcactttcactgaagacgctggattatcctcagaaggcgaagttgctgcagcatcttcctcaatataaactggccaaattaggcagtctaagtctcaaggccagatagggtttcattcaccctttcttagataagtagatttcggtcctgctacctttctttaaaggagagagtacatggaagctcaaagtggaaaacatgaatctgtctagcctacctgtctccttccccacaaggcgcaccccccatccccacctgtgtgtgtagaattactcctttgcactacttgaggtgtacagtataaaagtcactgctctcccttatggattccccaaactgaaaatgctttcacgtattgccctgtgcccgagtgctacggagcattcagagagaatattctatagtgctagtgaccacagtcttaaggaagatgggcaaacacaagaagtgcatggcatgttcgggtctcacaggaagtctttggaagcattcacttctcactgtcctgtcattcttggcttggtccccaagtagaccccttggtgcaggattagatgtcctcataccgcagcccttaaccttagctgaagttggcttaatgaggaacacatgctttgtgcttatttgactgtttaccatcactggggccctctgccagcatctgtcgtctgagttatcctggccagagccggtggagagggggctgttggcatttccttctgggtcatctgtagagccctgttccagtatttgcctgaggcccaaggggaggtgagtgaccagcatcaaaggtgacgattgctctttcagggtttgagcctgcatcggccccagctccctcagtccctgcctggcaaggtcgctccattggcacaaccaagcttcgcctggtggaattttcagcttttctcgagcagcagcgagacccagactcggtgagtgtgcccagagaggtgtgtcttgaatccaggatttctttccctttactgtttacctccttgcttctctttctttcctcctttaccccgccccatgcctgacaaatatcctgtgtgaaaacgggcctaggaaagaatagccttttgattaagtaaaaagggattcctattggcagatttgtagaaaacagcagagcaggaggtgtattactgtcctggaccccaaggtgctgtggggaatacttgagtcagagagagggacgtttacaagctcttatgttttgtaaaatttaacaagaagtaacatttattgagccttgccatatgcctggtcccatgcagagttatttagatatatgatcacaattcatcctcataaaaaccctaggaagctaggtactaactgacaaatgaggaaacagagagcgtaagtaactttcccagagtcacacagttaatctctgatggattagagattcaagctcgggtcctgaaaactctaaagcctaatcatttagctgttattccatactctctttccaactctgttttctcaagatagcaagttgttctcttcttaagaacaacttcttaagaagaagtggccaggcatggtggctcacgcctgtaatcccagcactttgggaggtcgaggcgggcggatcacgaggtcaggagatcaagaccatcttggccaacatggtgaaaccccgtctctactaaaaatacatggccacgcacatgtagtcccagctactcaggaggctgaggcaggataattggttgaacccaggaggcggaggttgcggtgagccaagatcgcgccactgcactccagcctggcgacagagcgagactccatctcaaaaaaaaaaaaaatgaagaagtaacaaaatggcactttagcagtttgccatagagtgcagtgcattataatatcataaataccagtaacattggcatctggactctatttgtcactttcttctttcctacctcccccacccccatcttgtacccatcgtcccattgtttctcagccaggcatttcccatacatatgtgatcctcccttctttcccacccaacaagccccgtaccctttcttcacacccactccttggctgtgagtatgagcgttgcatctgtgtgtgggtgagcccaaggcaaaaactgaaggaatccttagtttgtctctgagatcctcaccaactctcaccacgttctctatctcaccccatccttcccatctcataagtcccatgctgtctgtgtgttgcctgccttaatgtcatttctattatcgggagacagtgtcaagaatgagctaagagcctgtggtagataaccgagatgctgaacaattggaggtgacctctcacgggagtgtttgcacttcagcttgagggaaggcctcccgtggggcagaggggcttgaccagtcatcaccagagtggagaacccacatgtggcccactcatgtctttgtccacaaatcatgaactttgggagctggtggaaaaatagagctgcttccaaattagggggaaaaatgagggaaggaatgtaaattgggcccatcaggacaggtacaagaaaatggggctattcagaccaggaaagagaagaaaaggccaactggatgactccttccaagcagctgagtggctaacaggaagagtgatggtgagggttaaatccgtctaggtggaaggcattaagacaaactgaaagatgccctgcgtgactctgtcctgctggttctttctgggaagcatacatagttctttggttgaaggctgggctttggcccagatgctgcttctgcctcttgtaactggtgtttccatgacactttgttgtttacagagtactttgtggttgagtatttcattctgtccttacagtgccccatcagataggttctgttttccccatgataggttctgttttccccattttacagataaagaaactgaggcccagacatactaaatgacttaagattaaacagaaggaaacaggagcccaaatcttgtatttcattgtatccttttcactatcgtaaaagatcacctcccagttttgagggtctcttgaattgtcttttttttttttttttttgagacagcgtctcgctctgttgcccaggctggagtgcagtggtgtgatctccactcactgcaagctctgcctcccgggttcacgccattctcctgcctcagcctcccgagtagctgggactacaggcgcccgccactacgcctggctaattttttttgtatttttagtagagacggggtttcaccgtgttagccagggtggtctcgatctcctgaccttgtgatctgcccgcctaggcctcccgaagtgctgggattacaggcgtgaggcaccgcacccgggcttgaattgtcttttcagtctgaatatctcctgtgtaagcaaatttctgtttgcatatgactgttttttaggaaacagctccaagacactgggaggcaaaagtccccacatgatttttgcttccctggttaaaatactatggaatcatttataaaaattctctttttttaaaagaaattaaaataatgtggtagctccctcattgttaactgtgctctccagttatggacctcttagggcccagaaggctcgattgcctctttttgttgttagtatttgttgggctaaacattttgaatcattcagaccattctgcaaacattcgtgtgcacctgcatgtgcaagaagctgtacaggagaggggctcatcgctgcccagacggccacagcctccgcccctggggagtataatgcctagcaggggagacagacacgaaacagatgattatctgagagatcattgcaaagtgctgtgacttctaggaaggaagaatactgaacgctgtgagtaacaggaaacagggcaagcttccttgaggaagtagcccttaagccgaaagatggaggattggacagggagagaataagggagcagaatattccagaggtgatgaagctgaagtgtatgtggcagtatattaaatcagtgactatttttggaaagtcaaggcccactaagttgctagagtagaggccagagataagtgtttcaggtacgttcaggatacatatgataatctgaatgggtaaactggatctggcctgctgttgttgaataaaaaagcttgacttacatagactccaccacatgacttaaaaggccctggaatgaaaggaaggcctggtgtaacatccttgggacctttgagaaagatagttatattttaggggatatgaattggggattgggagaaattagaatttatttaacaagtattttttgagcacctactacacgccagccactgtttcaggtgttagaaattcagcagtgaacaaaacaaagttctttttctcatggagcccacacttgggtggagaacacaagaactacccaagcacataaatacccagtatgtcaggggatgctaactgcttatgtggaataatggtcctttgtcacaactgatttttttttttttttgagatggggtcttactgtgttgcccaggctggcctcaaactcctgggctgaagtgatcctcatgtctcaggctcctgagtagctgggactacagttatgcactgccatgccccaaccttcttcacaattgaaagttacttgctttttggatttaaagtatataatttcagaaaataataataccccctaatagatatgttgatgtttctggcttgtattatgatactaagtgatgtgcattagacattaccagccagagctctgtcactgctgtgaaattattttgcctaacctcagtcactattgttggtgtcgcttctgatattcctatgttacaaacactcattcttcagttgaacacaaatgatttaatatatgcaaatgaatgtggaagtttttttgtttttttttttttggtttttttttttttggagacacagagtcttgctctgtcactcaggctggagtgcggtggcgcgatcttggctcactgcaagctccgcctcccaggttcactccattctcctgcctcagcctcccaagtagctgggactacaggcatccaccaccacgcccggctaattttttgtatttttagtgagacagggtttcaccgtgttagccaagatggtctcgatctcctgacctcgtgatctgcccgcctcggcctcccaaagtgctgggattacaggcgtgaaccaccgtgcccggccgcagattgttaataggatctatatttgattttagtggacatgtgagggcctgaaggttggttcttgtgctagagggaaaaagtggtggctgaccagttgaagtgatggagaattaataaaattatttaaagcatttgacagtatcttaagtaccagcctctcaagttatatactgtgtgctttattggacaaacacaacgtgctattacaatcaaggtataatggtacttcagggctaaggttacactgaaaaatttgtatcatgtagatagtttctttggctcttagagtttttgtgacttctcagactttaattttgctatagttttgttccgacaacagaaacattaaggccatctaagataaactcagctgatacattttaacaaatttgggcatacagtacttaaaatataacatccagcattaaccacattaatttgataagcgaacaaagtgaccaataattaaagggccctaagtaagttaaactttgcatttgaattctctagatgtttgttacagacagacatgtacatatgtttccccctacttctttgtaacggcttaggctcattagacccaaggggttataaaatatttttagtagagaagagaacttataggtagtgctggcaaaaaaagaaattatgtagccaggttccatgctatttgtcattagtgacttctttcatctttattgagctctgtgaggtaggttattctattcccttctacagaagaggcttggagagatgctgccttacagtagccagctttgcaccccagcctgcctgtagcatctcttaagacaagataagacatgattgctggctgggtgtgatggctcacgcctgtaatcccagcactttgggaggccaaggcgggtgggtcacttgaggccagaagtttaagaccagcctggccaacatggtgaaaccctatctctactaaaaatacaaaaattagctgggcatggtggagggtacctataatctcagctactcgggagactgaggcaggagaatcgcttgaacccaaaaggcggaggtggcggtgagctgagatcacgccactgcactccagcctgggtgacaagagtgaaactccatctgaaaaaaagacatggttgcatactttggtaccaccaaagccaagagaagaaccttagtttatctcctccttagtctgaagtggccttagaaccagcattttctgaaatttactcgttggctcaccacatatgtcacccttgccaacattgaagacttcctcacaaccccaccactcctagcaatagtgatggccaacatttactaaatattttctgtatgccaacactatgcattatcttatgtaatccttatgaagtagcttgcccagtgttagacagccagctgacatgggaagtaggattcagatccaggtctgttgactccacatcctgagatagtgaccaaaaggctatacggtccatttgtagctgatgagtagtctgtttttgtagcccagggccgtaaggagctaatgggagaataattagggggatgatcgccccctgctggctctgtgtcatgtgtaaaccagacggcagcttccccaagttggtggtggtttatgttggaggagaaccagcgagtcagtccctctgttacctttggctctactggaagctaagagaaaaacagcagagggtgaagaaaggaaggaagagtgtaaaaaacaaagactattttagttggaaatatactttctacatgatttcagtgttgcatatcaaaggatctcaagtgttaagtgtgatatcctccacccagggtgggctatttaaaaggggcctccctgaaatcagggtccagtttctggaggccaagttaggcagatgaaaacccggcctggctgagctgtcagctgaatcctgaaagtacacagggagtggttttcctgataaagcctggagtgatgcctccacctcaattctggggcacggcgggttcctccagccccccacagggcagcagctggcaaacccctgcctgctcagactgcccggtcaccaggctgtgtgtctcatgcctgttgtggtctggatgccatagtgagcaggagccaggaagaaagcacagaaaggatttactcaggcgggagttacacaaccagaggagggaagagttgggggtggagaaagaggcaaagagattgttctctttagattttgaggaagcactcactgccttgcagaagagaagttccatgatacagtagaggaacaaacccgatcagggaaggcacacgtttgctcaacatatgaaactcatttatttttatttttatttttttaattgaggcagggtctcactgcattgcccaggctggaatgtagtggcacaatcacagctgactgcagcctcgacctcccaggctcaagggattgtcccatctcagcctaccaagttgctgggactacaggcatgcaccaccacacccagctgatttctgtatttttagtagagatggggttttactatgttgcccaagctggtcttgaactcctgggctcaagcgatccacccacctcggcctcccaaagtgctgggattacaggtgtgagccaccgtgcccagccaagcaacttatttatatattatgtcaataatgatcatcaccagcacttatgagctctgtattagtatgctgagcattatgtccagtctgtacataaaggaaccgtggctcagaaacgttaaataaagttatcaagctctacctccaaaaacggtgactgtgccaaagtttaccaccactctgtattcttaaccatgtcactgtacttttgaagaaataaagacaaagttcaaaagttaaaaacagctgcctgcaaagtaggagctccccaagcaaggccagacctctgagggccttccacattgggtagatggttactctgggtttcctctgagttcctattccaacccatggaaaattgtcttccacaaaatcagtctctggtgccaaaaaggggaccgctgctttagagcctatctttcatcatgctctagtggcagcaaagaggtgactgatactagaattcttagcagctgtttgagatttggggcagattacctcagctcagcctcagtttccagtctgtcttaagtggatataacaggatcgctgccatgcttactgtgatgattacatttagtaatatccctgaacatactgagcactccacaaatgcttctgaacctgaatgtcttacagtaatgtgaaaggaaattgagccagagctctggacagggatcaagcttgcgagaatgtgctcactaagtgctttggactctactgaaattctaacaggagtcagaatatttttcaattacttttgagatggagttttgcttcgtcgcccaggctggagtacagtggcacaaccttggctcactgcaacctccacctcctgggttcaagcaattcccctgcctcagcctcccacatagctgggattacaggcatgtaccatcatgcctggctaatttttgtatttttagtagagacaaggttttgtcatgttggccaggctggtctcaaactcctgacctcaaatgatttgcctgcctcagcctcccaaagtgctgggattacagatgtgaaccaccatgcacggcctcaattagtttttaaaatcaattaaacttttcataaaggtagtaaattaatgtggtcaaaaaatctccaagcataagagaatggaagggagatgtcccttccttctcattcctatcctacccttaagtaggtagccactgctactattctcttatgaggctttgtagtgattttagtgcatatacaatctaatatgaatatgtattctcccaccccaccctgctttttaaagagaggatgtgatctaatttgtgcttcaggaacacgatggctgcatcaggtgagagcaggggctggaggaaactatactgttggccagctggtggctgatgaggacaaaaccagggcaggggccatggctgaggaaatggcagaggggagagatgttatggagataaaattaaaaagccttgtggattaatgagctgtgagaagaggaggataaatggtaatgactgggtgttggagaccaaggatgctgataagatttgaagagtcctggaacagaggaggaagcaggattgctaagaactgacttgatgataatgcttttgcctttcattctcaaaataagcttgttgaaatacctattagagacaggaaagctcagagagtttaagtaacttcatctgggacctggctaatagatggcagggttgactatttgaactttgtctgaatttcacagtgtatgagaaaatgacacttaccccactatctgggaaaatgggaagggcagggattgttctccattcacagatggacatttgatttgggctccaggacaggagagagttcctgaagggtcacctgggcttggtgatggcagcccctcagccagaaggaagggagttttgctgcctggtgttctggcccttatctttattccaaggggctggacctcctggacgtggatgtgggagttagcagtcttcatagtcagagggagcccaaggtctcccctctgggggactggcaggcctgtggttgagcccgcatggaaggtctgtaaatatatcctgcagataacatgattctttctcgtaaaggcagttggtcaaacgtgggcccaaggatgatttaatttcacatttttatacttctttcaatggcctaaatttacagatcaactaaaattccgttgtcagaacacagatcctttcttggtttggaaaatgtgaccaggacagctctaaggaaatatgacattaatgaggcctgtggaagaaagaagagggggatggctgtgcatgggggattaggttggagacacaagataaaaagcaaggtttcagccgggcgcagtggttcatgcctgtaaacccagcactttgggaggccgagcaaggcgtgtgggtcacctgaggtcaggcattcaagaccagcctggccaacatggtgaatcccccgcttctacaaaaatacaaaaattagctgggcatgatggtgggtgcctgtaatcccagctactcgggaggctgaggcaggagatttgcttgaacctgggaagcagaggttgcagtgagctgagatcgcgccattgcactccagcctgggcaacagaggagactctgtctcaaaaaaataaataaacaaaaataaaaaagaagcagcagcagtaaggttttaattcccgattgccaggagggttcttgcctttatcctgggcaggacagagaagggcaccggtgtctctggagaagcttcctagttttatagtggctgctgaggcagttgctccatcttggggtggagaatggctgtttgaacaaatctggttcctggtccttcagaaaagaggctccttctctcctgtaattcagggcttggaagtgatctcatgccagtaagccaggtcaccagcatctgtgcagctctgtgtggcctgggcggaattttcacattgactgtttcatttgaccttgtagacaggctagggttcatcactgctcagatgaggaagccagggcccagaaaggttaagcaacttgcctcaagccactcagctcaaaaatagcagagcctagatattctaacccaggtgtcattaatgttcccatctcatgcttcggaataagtggtcggaaagtacatttggccttccaggtttggggaggaaggctgcagctgatctaacggttggctctgcttagtccttgaatgtctctcaggtttttctcatgtttttccaagcctggtcttccagcaggacgtaggagatggagtgtctcccggggaaggagatgatggctcagtgtggagcacccccatgcccctcacagtcctgagcccttgccgagccacctgcgagcccctcccggcccagggcacactctcttgtggcagcagacattgtactgtgtttctcagatgctctggccacttcccctgtttcttcattaccctttgggaaggaggccactgaaagcgtctggaaatccgggttctatagacatttcacagaggccccagtcaggccccctctgctttctttggcaggtccgcaccccacgcaccttcctggttgctcactcagtcggtgggcctttcagctgcacttctgtggggaagacacactcctgtctgaggaagcagcagcccctctgtagagatggtgctgggagtgggaggtgggaaggatgcatctcggtgtgagatcccggaaggaggcattcacttgctccttgtttccaatgatgtttctctctgggaagaacgaggggcatgggatgaagtggcatatcagggccaagtggccagaacagggctggtgccctggacagtgagctgaggagagaacccacttcagattcactttctcctgggcaggaaccgtgagcacaggcaagctcctgggctgaatgtgcgggaacctgtcttggcttggctccgcagccattccctgtccccccaggggccaccgcaggctgcccagcctgccctggggggtaggtggacagacattccaggcaggaccgtgacaagaagtaaatgtaggtgatttgtccttgttctgttccagcttgtacattagcataccttgacatgagttatttgtcttgatttctttaaattcctaagtggattataatttttttcttggtattatttgacagcagtcatttttcaaggtttcactacgttcttcaaatacttagaatttttggaacaaatttaggaaaagactgccatcttcaggttggacggtgcagtgcaggacccggtgtgtctgagggcacctcgcagatgctgaggactagcaaatttgtagggctttttcttccttttccacaaagattgaactgccttcatcagttcaatacatctagattcaatacatctagaatgtattgtcagtccttttaaaaaaaagagaaaaaagccccagtgaccactgttggaagttgtactgttgtggtttgtttcatctacagtgatggacaacctcctaggctgtccccactccacttttgggaacagactttgcatgccttagaggaaggtaggaagcaggtatctggagagggtactgtgtgcctgagggaaatgcggacgccagaccccacaaggcttccccacactgccactaccctagcaccgatggtaacatcagaacagaatcgccttaatgagtctgaaactttccctgtcttcatttatgctttaagttttagtatgtccaggtttttgttatcagagggaccgtattgatttcacattatttcgtccaaagtaaagaaacatcatgattcttccggaaagtaataacaacagcaaattacgtgctatgtacagtgttatgtgttttccttgcattatctcatttaatattcttgacactccagtacagtaggtactattattattcctgcattatagttctactaagtatacatatttccactatggctgtggaaactgcagcagagagagagggctataatcacttgccctggatgactcagttaggaagtggtgctactgctcagattcaaacccagatcccatctgacaccacagtccaggtgttcatcactcctcactgcaggctccctaagcagcaaagaacagcagggaccaggaaacaaagtgacccatagagcagctttgaaggaagacgaaagtcctttattaaccccccccgggtatctcagaagccctttgcaagtgaatggttgactttcgagggttgcattcacctttattattatttgcaactgctatgaagaataactggagggattatagcaaaacaaagagaaaatggacatttctccaagtcaaaatagaaatccacatattaagatggcatcaggtactgcgtggcatccttgatccaggtagggttttactggtgcaacatctttttggtgaaccctacctgcagacaagcgtcccagctcctgtccagctgtcctgagcgtttgagctgtaggaaagctttgcagtctgacccgagctcctttaaagcccaaggaacttgtggctaacacagagtaaacatcctgaagtaatgttttttgcttccttttatggttctttcccttcctcagaaaaactccataatctttcaagatagtttttgattggtggtttatttaataaaataattgtataagccagattgaagcacgtggcccataggaaaagcagtattctgctccttcatggctcctcaccttccagttctactttttggggaccattgcttgcagccttttcagccatttctttgtattaatatatttacctccacatttctaaataacatgcttatattgtgtatctcattctattaattttaggcatcatctgttgacttcttaacatagaagactacgatttagttctctaaatttagtatatgcccccctccgtcttcctttcagtccccctatgtgcttttctctaaatttagtatatgcccccctccgtcttcctttcagtccccctatgtgcttatatcacattaaaaaaaattagcattcagttaattttacaaacccatataaattttgcacacagcgtggttaatgttatatattggaaccatttccttaattgtaaaacgtttttttctggggtgtatggttgtcttcttaaaaaattgttcagttttacatagctacaccaattcatcctcaaagtttcgaggagaactcatactcttctccagatggtgagatataaatcaggtccgctctcttggtgacatccttccaggagtcctcagctccacggatccactctggactggttgctgacctggctggtttctttacctttcttctatgttaggccccatctctttttaaaacgtattccatccttttgtaggaacataccctcctatagctccctgggaacaagttgcaaggaaggtcagttttctgataccttaaatatctgaaagagtattctactttcatgtgtaatggataatttgatgttcattatggtttttgccttggacttgtgaaactttattcatgttttctaggtgatttccacatattttctccttgctaatgaacaatatgtttaatgctggagaataaggtcattcttataaaaagagcaggtaaatgctaatttagttcatgtgatatgtagaagtggtgttgactgtctttattatccccatcttctctgtaggaatttatgagaacatatatttatttgggaaagatagaattctaagtatcgaggtaataagcttgctctgtacagtcactctgtaggttctatgaagatgagcactttgttgttagctcatggattcctggtgtctagcacagtgcctggcatgtatgatggatgataggtgtgctggttcattctattaaaatctgtaaaacaggcagagtgagtaccttttccatcgttgaccttgagatgttgataatcagttgtgcctctactgagtgcctaggggactcttttggagaagtcaaaattagcctccgttttggatattgaggaaatcgagtcttgggccttgcatatgtgagtcattgacattcgccctttttctgctcatatcttgatcccaaatgccagttttctttcccaaatgccagttttcttttatgagtatttgttttgtgccccatagaatagaattgccctttttttgttttatgtgccaccttcacttttggggaaactaccactgctggagaagaaacgagatttatttgggaaggagagaagcaaataaataatccaccttggcccacttcccttataaggagaactggcaagactggaaatagagccttcaccaaagggtttttagaattcatttcattaaaacttgaacccaacatacagatttcttcctttcagccttctggatttggggacagagggattcctgacctacccaggttgaatgaaggggagagggtggtctgtttgtttcaatgctgtggtctccagggcaccttctgtagtactttgtattcttagaaacagagtcaccacctcttggcagcagtgaagccactcagatgccaatggtcagagtttggtttcaagtcaccagccttgtagagacagtgcccagtttcctttggcaaagacagcctgccccttctctattcatttcagccttgaacacagaggtaaattcctcaaaatagaaacctttgtggactctatctgatgcatttgtgaatcatgtttgtcactaattctaatttaacttcatagaagttttaaaacgctgtttagtttttttgctgttgttcctttcccaaatcaactttcaaaaaacgttggtttaacggtgttagaaaggcttagacattttcttttgggggacagtgtgattaatgtttgcagcaaacgcaagggctgtggtgttgacagatccaagttttattaactccaggactattcctggatgtgtgacctcaggcaagtcagttcatctctaagcttctatttcctcatctgtaaaatgatttaaattaaatccacctccagcagcgtcatgaggcaaagattacctgagatcacatctataaacaacacattgctcacagcgcccagtggacacaaggtctcttccttccttccttcaggcacaggtgagaggcccacactctgagcagctggttatgagtgggccattatcagggatttgaacagtcacttggcttcactgcttgctcccagctcttggcttgtgtttcttttttctttactaggcaggagggatagcaaaagcaggaaagttattttgcttctacctcaggatctagtgaatgtcacatgataataaactataacaatggtcatcttagctataatttattgaacatgaacacttttttttttttttgagacggagtatctctctgatgctcaggctggagtgcagtggtgtgatcttggctcactgcagcctccgtctcctgggttcaagcaattctcctgcctcagcctcccgagtagctgggattacaggtgtgtgccaccacacccggctaatttttgtatttttagtagagatggggtttctccgtgttggccaggctggtctcgaactcctgacctcaagtgatccaccctcctcagcctcccaagtgctgggattacaggtgtgagccaccaatcctggcccctatcaaacatttcttatatggcaggtcctatgccaagcaccttctgagcattagctcctttaatattcacatatgttgcaaatattacaggtattatatccccattgcacatatgagaagtcttgaggtttcaggtttgtgtctggctccaaggctttcgtgctttacactcagcaccttgcttttcagctgtaccttcatggtccccattggtatgtggtagattttacccccattcaccttcttgacctgtagatgtcagggccgtggttcccatttccagcagtgcagtgcagggacattttgatgttaagcacaaagacttcaagtttcccagcttctcaacttcaccccagctctgacctggcccaggggcagctagcgaggcagaacagctaggagtgaggagcctaaagggagactgggattcagctcagtgagtccctaaggcttgtatctcatgccttccataaactcactccttgcagaaggcgctagaatggacagaagcggtgccttctggaactggggcggtctgagagctagctgtaagcagaggttgttaatcagggttggatggacggatacatagccagttgtctaggtaataaagaaacaatgccttttgccctgtactccccattccattttgtgtttctgattgcctttataccaacgtctgtgcccacacctttgcccatgttattcttttttacttttgcccactgagactagaaagactagaagcttcttagcagctgtgactgtgtctcatacatttccatgggctgttgtttataattggaaaaagtgatgtggcaacatttgaaaaaatgtataaaaagctcaaagatgttccctcctacccttataatctcacctcttcccacccccataatctcacttccctaacacaatggcttttacttttaacctttttaaaaataatttcttccttctgaggcagaccctgttgttttatagtatctcccagcttctgtcttacctgccaggtggctagtccatgcagctgcatccatgtcagagcttgatagggttctctctttcacctcacctgataccttttaggatttttgaagctttggaaaagataccactctgatgttgaacaggagagggacctggccctctccaaaagatactggcctcagttgcactgccccttatatgcaacactggcatcagatggagtgtccagcctcctgtcttttggcatggtggccagagatccaaatgtgggtagcaggttatagatttaaaccagtattccttcaggatatatttcatagggttttgtgaccaactgagtttgagaaactctagattatatgtttaaaaatgtttctttatggaagtgcctttttaagagacaaggtcttactgtgttgcccaggctggagtgcaacagcatgatcatagctccattacaccttcgatcttccaggctcaagtgatcctcctgctttagcctcccaggtagctggaactacaggcatgcaccaccacacctggtgattttttttttttttctggtagagatgtctcactgtgttgtccaggctggtctcaaactcttgggcttgaatgagtttccctccttggccttccaaagtgctgatattaaaggcatgagccaccatggccagtcaatggcactgcttttaatacgctagtatttactgtgaatctctaagagaggtcttattaaaagaataatagctagattttattgactgcttattcttgttagatctaggatccctgatgaagtctgtggagtgtcttatttaaaccctgtaacaatccagtgaagtgaatgccatcactgtccccattttagagacttgagaggcacttgcgcagtatcatagctagtttgccttgggcagtgttttgtgcttgagtaggatgagtctagacccacacaatctttttttttttaaagcaggtcccagtgattaagttccatggactgtacattcttaacccatgtataatactcagctttgcccaagccttctgttagttgggacttcctgtggaatagattagtactcagggacagtagttggagaattgccagttttaacttggaatgtgagcagacttggactgctagataaagaaggcggatggagtttctcagtgaaccctatttggttctgaggcccatggagcctctgcatccccaggtttcttggtctgtgtcacattaagttggtattaatgcctattcagtgggagaggcatgcccgaagagtctggagtataacgtctagaccagtggtctcaaatttggctgtgtattggaattcactgaagaagctttaaaaattatgatgtttggcctctctcagggattccagtttaatccagattatgcccaggcctttgtgatgtttaaatgatccttgggtattctgatgtagcctgggttgagaaccattggtttggacacactcctttgtggtccagttaccatgtcttatcccaaagcaaggggaagaaaagggttcactttgtgagtgaaatgacttaatgtggtttagagttttttgtttgttttttcatgaatgagtgacctgtgttctttttcatcagccatgtatggccttgtagatcttctctgtgatctgtaccccagtcctaactttgcactgacagtgacatattgagcagcccttatgtagaagttttggattggttactaaggggactggtgacaaagaggctcagcactcttattcctgctggaagaaggaagtgggtaccattgctcagaccactgtatctacgctgtcccaggagagttgggacaagaagtgcattctgggttatgacatgagctaactgcacacagatttcttattgggctccaaagagtatcactttcattttcagttgggtcaggtgaaattgggtaatacaattgtttcttggtttggtagctgggtaacttaagctgttgttattaatgtgtccgcaaaaaagccttttttagatatttcggaaaatatatgcccttgtcagtaaaaagcaatgattgtctcaaccctaagctataatcgcttttctaaacatactcatcatttcaaaagcattgatcctggactggaaggcctaattccagaattttggtactactgctctttatccagttcaagatggatgagttccaggttgatcaaagagtttgtaatgggaatgtttctgttggtttcttacagtacaacaaacacctcttcgtgcacattgggcatgccaaccattcttacagtgacccattgcttgaatcagtggacattcgtcagatttatgacaaatttcctgaaaagaaaggtggcttaaaggaactgtttggaaagggccctcaaaatgccttcttcctcgtaaaattctgggtgagtaagacattgctgtgatttccgtggtttttgtctgaatggtcacatctcttacatgagcacagtgcagcacagctggctttggatttacactgagtgcaccttcatgtgcttctgcacaattgccaagggagcacggactcacacctgtgaactgtcctcatgccggccttatgcatccacatggtgcacctgggtgacattctctgtccctgccaaagggcacaagggacaagcagcctctttggacttcacttaaattcccggagctgggatgaaaataaagttacatgcttcaagattttgtaagcatcagagaggaaacagaattgctttgcccagtgtatacttcatttgtgctttaaaatgacgggcaaagtcccctggctgctgcagctttgctgatgttccagagcctctgagaggagctttgccaccctttggcactagtcagccttgggccaggggaatgctaatgggtcagaatgggcataagtataatgtgtgtgtgctaagggattggggcaccagataacctgctagcgctgcgagtttatgattcctcagcctttacacacatttttttttaaaactgttttaagtgtttgtgccccttagcatggcattaaaggccctaagcgacctggttccagggtagcttcctcttgtgtcctgccaaacccctgttgccccacctgtccagtctatgctctgccttctgtttgtctagatggactttctgctcctttctccctgtaccactgggccagctccttctcctccatgagacaatagctccactataatagaaccttccccatttgagcagaccattgatttctcttttaatcccattgcatttggtaatcacttcccatgctgtgtcatgattgtttggaggtgtcccccttcctctgggctctgcctcagggggccttattcatatagtggcttccttttttattgaatgcttgctttgtgctaggagctgtgctgaatgctttacgtgcatttcatttcatcctccacgttttaggtggaatttgcctcagctccacctaggaaaaaaggctcgtagatcaccagagacaggcttgtaggttgggtacctggagcttgacatcagatctgtgtgactttaatgcctctgctctgtttcctcgttgcataatcccttgtggaccctgaccacaggatctgtcaacctaagcctctacgtatctctataccaagcaagaaccttacacaacaaagcccaacagatgtgagaacaaatggatgaattaaagaaaaatttatgttttagattccttggaaggaaatttgcatattaaattagtttgtttcgtttcttttagccttccatgataactagatttcattttttgtgcttccattattgaaatttggttagtagtccaggcacagtggctcacgcctgtaattccagcactttgggaggctgaggcaggggtattacatgagctcaggagtttaagaccagcctgggccaaatagtgaaaccctgtctacgaaaaatacaaaattagtcaggcgtggtggtgcacacctgtagtctgagctactcaggaggctgaggtgggaggatagcttgagcccaggaggtcgaagctgcactgagctatgattgtgcccctgcactccagcctgagtaacagagcaagaccctgttccaaaaaaaaagaaatttggatagtagatgtagccttctacttatattaatggatgttggatctgtaatacacatggacaacctgaaaaagcgatcacagtcacattttccttttctgaattggtggctgccttctagtaatttggatggtggttggagatcagttatatggtaacagggtagctttcaaaatgtggcctgcgaacccctagggagttccttgatatcattttaatgggttgacaaggtcaaaactatttttgttataatacaaagacatgatttgccttttccattctgcttatattcacactgatggtacaagagcagtgggatagaactgctttagtatgaatcagagcagtggctttgctgctaaaattcatgcagttgaaaaaaaaagtccttcatgaattttattacaacctagagtacacattgaaagtgaacacataagtctatcacatcaaggaaaacaaatgacattatttgttgccaaagataaaatttgggctttcaaatgaaaattagaatactgggaaatttgtgcctaccttagtgaacttctcagtacttaaagacttttctgatgagatccacgatgatattgacaaaatgtaatttgatattgtgttagagcaatggattttaatgtaacagagttggaaaaattcattgatatggtttcagactccatattccagcctaccattaagaaactactactgcttgttgacttttgatatagtatcaaaggaaaatgaccactgttatctgaggagtctgtcacataatgtaaagcagcactacctgtctcactaattttttaaaaatacaggcatgtttaatttttttaaaaagatgtatatcaacatgtaattagcttattatttcttaaaatgaatgaatattttaaaattttctcagttttaatttccagtacagaaaatatagatataacctgtagtaagcaaaaggtctttgaggtcctcaataatttatttggtcctgtttgcagtatcgtacatgatcaccaaactgctgctagaatgctcacacctgttacggcaaattcaaaacccaggaaaggcgtctcctgggaatttacttgaggtcagggtcaggctgtctggtacatcaataatttatttacgagtgtaaaggggtcctgtgatcaaaaagtttgagagccactattttaaaggatgtaaaaaggggttgtttatccaagtgaatgaaaagctaattcggaattatagaatgttatgaagagaaaccattttcagtaatttcaaattcaacagtagtgtttttaaataaggtttctgataattagcatattgtttgaatataaagtagcatagagtgcgcttagaaagtcttttttggttttgcctccaaaattgcccttattttacccagtggatgattttaataaatgttttccatggtggggcccttcagtcatgaatcctcaaataacaaagtctagattgcagatgtttagagtatggtagctgttgggagatgtgcaaatttagaaacagttactccgagatcagatacttgtttattaagatttgcagaattaaaatggagaacttccatgaatatgatagaaaacatcactccttcagtagagttgttaggaatatttaacctttataaagaaattcagtcataactatgttaaaataaaggagggaaggcaatttaaattcggtttgcaatttgaaatgtcattggcttcctctaatgactcagtaagaatgaattacatttagaatatctatccttggatatcagtaggtgcttccagtgggtgtttccgaagtaggtttaacactcccttcgaaatatcttttagcaatatgcttagcagatgtgcttatttttgttacaacagagactctatacccagtccttttcttctctctttttcaaatggcctaaagtctctaggctgtcagtatcagcctcttacctgtttatttgatcgttcctgaatttggttttcagaatatctgctacgtccaacctgggctcggtcaggctagaccacgtgaggggtttgctatggaagaatactatgtgttacctaaagtacctgcatttaagccccagatgcaggcacctcagttctgccagttgacacttggaggcgaatgggatggtgatgagccaagtagtagtcactccactgattttagggtggaagattctactggcatcccaggccccagagcataaatgaataacagagtcaaggatgccagcatgagtacccctctaccatataagctttacagtgtctcatgccttcatggtgtgggaccccttaaagcccgtatgaatggctgtttatctgttaagatctttctaaagagccttattgaggtataatttatatactataaagatcactcatgttaaatgtacaatttaggcctggcgtggtggctcacacctgtaatcctagcactttgggaggccgagatgggcagatcatgaggtcaggagatcaagaccatcctggctaacacggtgaaaccccatccctactaaaaatacaaaaaattagccgggtgtggtggcaggcccctctagtcccagctacttgggaggctgaggcaggagaatggcgtgaacctgggaggcggaggttgcagtgagccaaagatcacgccactgcactctagcctgggcgacagagtgagactccttctcaaaaaaaaaaaaaagaaagaaagaaaagtacaatttaattatttttagaaaaatttacagagttgcataatcatactaaaatccagcgttggaatttgtctgtcaccccgcgaggatctcctgtgcccatttgtagttagttcttatttccacccccagccccaggcaactgtggatctactttctgtctggatcaatttgcctgttctagacatttcatatgaatgaaatcattcagtgtattgtttttcacagctggcttcttttacttttgttgtatttgaggtgcatcctttttattgtagaattagtgtcccatccaatgtatataccacattttgctttgttcattcactggttgataggcatgtggatcatttccacttcaggctattatgaataatggtgctatcgagtctttgtagacaagtctgtgtggacataccgtttcatctttcttggggagctacctaggagtggaattgctgggtcctacggtaactctatgtttaacattttaagatactgctaaacttcttttttatgtggttgtaccattttacattctcaccagtaagatcttaggggttcttctccttcagccattatgtctgcaagtattggggtacagattacaggggacatcttagatgaggggctggtaagcaaaggcactgagacagggtgtgtgtaacgtatgcttcaggtgcattgaggtgtgttgcagctgaatcttcactggtaatggaaagataggtgagtagaaaaatttggaaagagaaggaatccagaatttagttgtgacagcagtagggagcagtcggtgttttaacaatttttcagtcaacagagtaatgggattctttttactgagtgttacagagactctgcattttgccttttctagttttattatattttccttttcatgacagcctcttactcatttcctttctatttcttttgccctctttttatttactcctatgtgttttaattctacagcgtatttaattacaaagagagaaaaggtgattttgcaggaatggaagggaagggaagaggttcctctctttttcagcagtacctgaacctgacgcttaactggtaccttctttaagccaggcactgtgccagggctaagcacatacttgatattatttaatccttgtgagatacatgtgatgagtcccacttcacacatgaagaaatcaaaccatacaaaggcaaagtgacttctgtgacatcatattgctagtaaatgccacatctgctagactccagaatccatactctttgtgtaaacctgtgcatggcctcttcagggagcacggttctgtcactagaaaccatcccaacatagcttcacttaaatggaagctaatggtgattgctgaaggatagcagccttggtagtttctctttgaagtcctgtcattatgagatgctctggtgtgtttacatgggagctaaggtgtattttcatatatatgttctgtatattattatgttctgattttttttaaaaagcctttcttgctgggaaaagactggcctttctgggtctagccaattcttagagtaggaaaatgattctgtctaacagaggatagtccaggagcctgcttttcatatgcaaaccaaccagtccagaaccagacctcctctatgtggtccaggcaccccaggatacagtgttcctctgccctaatcattccctggaatggtaccagacaactagggaccacctctgaagcttagagccagctggagttattcgaactagtcaatccttaattggtcactctgtttcccctgccctgcccatggaaagcccaggaaaggctctggtctaagctggcctcttgtcttctgcctcctgaccaccctagtatctttccatgtggcccttgatggcctgccatgcttcctgtcttggggacctttgagtgtaataaatttttttcctgaacttctcctgtgctctgtggccgcacctgactgaccatcacataaaagaatacaaaacgtaaggtgaataaactattaccaggaaattcaggttggagtctaagtcttaactagacaagttagtgagatcctgcaactaccattaggagaaagcagtgttgtttttatattatgattatgaaggtataacattctagacagttgggaatatataatttttaattcagtcctaaatgcatcatgaatataacctaatgtgatacatatttatgtagttttgatcaaggaatacgtgaaatctgacactccacttttataccttatgaaatatcatgttagctatatgtcagtatacttcaaattatctgtttttttttttttgagacagtgttgctctgctgcccaggctgaagtgcagtggtgtgatttacacacatggttatgtgtgtaaataaccatgttgctttctaaaatagttgtagcagttactctctcaggccatgcatgaatagaccaggcatcttcatcagccttgactggtgcaatttaaaacaaaacaaaaaacaatcttctattgtcacttgttatttgagttcttctacatctgcttttattttttcttcctactcaaaagtcttcgattcttcctcattctctgtagaaacaatgattactattaaggttgaaataccatatttcttcaattctgagacatggacttgttcccatttcaacagttctaaaattggaatgcttctgtcagttgatatccaaagcactttgccacattttctttatatccagtctattattgaatactatgcagccataaaaaggaatgagatcatgtcctttgcagggacatggatgaagctggaagccatcatcgttagcaaactaacacaggaacagaaaaccaaacaccacgtgttttcactcataagtgggagttgaacaatgagaacacagggacacagggaggggaacatcacataccagggcctgttgcggggtggggggcgaggggagggaacttagaggacaggtcaataggtgccacagaccaccatggcacacgtatacctatataacaaaccagcacgttctgcacatgtatcccagaaattgaagcaaaattaaacaaaaaagcatcttctccacccctaggcagaggagtaggttgtgactggttattatcacctgaccctggccagcatagaagacatcttgccattccctggacaccttagttgagttatttgcactttatagtaccatagcagttgaattttagcttaaatttaaatccctaattaaaccatctcggaaaattacgcattgatgtggcattgaaattgttattatggttcaagaggagttttggaaccagattttttataaatgaggcaagtacttgtactggcagctagtcatacttcttttttccttacaaaacatgatcaggtgctgtgtaggctctaggaaagagggatgtccacccacaaatggatgaagctgtgcttcattgcagcattgagattcaggcagatggattgccagtgacgtggcagacagtgcaattaatgtaacaaaatgtcaacagccttgggaattgatcatagattgaattcccagagctagaagacatgagtatgattcagtcatgcatcccgaaggacaaaaacccaagtgtagctcacagctgactgtcaaaagcagttaatttctagctatatgaagtttacagaaggaaataaaattacagatttaaccaaataagacatgcaattgagactaatacctttggaggggcctcagaattctatttcctgtcctaataatgttcaagggtgtcaagattggaaacactgctctaaagaaagctgtatgcttttaacattctattcataaacattataacccaaaactattcataataataattagtacagtaaaggcttagtcttaaactttgattggaataataaagaagaaagcaatatgaaagtgaaatcttacggatttgtatcatgttgccaggttataacaaatttttaaatatacatttaatatttctgctttcactctaatcattatcaaattagtcatatcttagaaaccaggatatatgatgttatcctatacttatttaaaattgttttgtattttaaaattcttgggattatgatcattcagtgtaaacaatactgtctacatagttacttaatttgctttttttttttttttttgagatggagtctcgctctgtctcacaggctggagtgcagtggcacagtctcggctcactgcaacctctgcctgtcgggttcaagcgattctcctgcctcagcctcccgagtagctgggattacaggcacctgccactgtgcccagctaatttttgtatttttggtagagatggggtttcgccatgttggccaggcttgtcttgaactcctgacctcaggtgatccacccgccttggcctcccaaagtgctgggattacaggcgtgagccaccatgcctggccaatttactttcttaacctattatttttaaaggaagaaaaagcaagcctacttttactaaccatagcagatgtgagaagattttataaaacaaaaaaaggggaagcaagttacctggaaagaggacagccattagaagatgcttttgtcttggtagaaatgaaatcacatttgttcaacaaaatgacagtcactctacataaaactgggttttatttaaagagaagaaactgggcgcacaataacccagcagaacagaccccacccccattggagtctcagcttgtttctaattgtattctgcatggtttagattggaattgtagacctgagtctgtcatttggaaccaaacgtcctgttgctattcatggaagagggagttaacagtacgaaatcgtttgctttccacatgttttgaactgctatcaggaaggaggggcctttcagctcaataagttttccatttctccctacttctgtctcatctcaaaatgcgttttaaagttaactgaacaatattaagtgatgaaatgatttaagtagaagaaagattagtgagaagtatcacgatattcagaggtacttgggggctaatacatgttaaattttaagtagactgtggttacatgagtctttttttttttttttttaattatctcttgataggccctgctattgtaagcacaggaagagagaaatcaatacatttgtatatctgcccattttggtttgttttcgtaagaaaaatatctggagcttgtgagcactttctgtggtgactgctgcttgggattgctccttcctggttcccgaaccctggatgccaaacttctttgtaggcctttctaagggagcgtaccctgtctgtggcctgtgttcagtgctgcaatgtatataatagattttcaaggctttttttttttaagttacctggaaagttattttatttcaatcagtaaatggtcctaaagaaattgctgtgcattgggcactctgccacattgccaactcacattaccacctgagagtttgttgaggaatcatccgcaagcaattcgtaggaggaaaaggagacctcaagagactcacttgaaagcttttctgggccatctcgttgctagaaagtcattcaacaaacatttgccaatgtcgtctttgcttctggaaaactgggaagcagatgtgattgagagttctgatttgcaggctcagggtctggtgagggatggcagacatgtgggcaggtgaacaacagcaccgaggggtgggagctgtagtggaagtgggcagaagttgctgtggaagcacagaggtggaaccctttttgcctgagaacatttcggaagggctcacaaagacatggcatttaaacagaatcttgatagaatttggtcagtgcaaggggagtgagaaggagttttcagggcagtggatactcatgtacagacaaggagtcctgggaggtggcgagaggtccccatggccactggggcttaccgaactcagagaatagggagagatgtgggtggaaacactggtcacaggggcattcacttcgaaagaccacacctgaatcctctgaaagcctaaaacgtagtaggaatgaaatcatggatttcacaggataggatagcttggaaaatgagcacaagagcttacattgcttttcctcccatcctcttctatcaaaccacagatacttctcttttttttaaacctttgactctgaagtcttcagggcttccgggcagaatctcttgcattgggagttgccttgacctggaggaattcattccaacagctattcctaaaagactttctgtcctgggtccttcggctctgtgattgctaagaaagcccaggtcaggggtctgtcccttccttctggggccatttaattccactcccttctgtggctacagactgagatgctaagccacgatcccacctgagctgctgccacaattagcttgattcatgctgtcacctttaccatttcacctcaagaaaaacctgagaaggaaagaattgatgtgccatagtcggggtggctgcatattttcagacccagttttgcaaggcgtagttggattaactggacacttcagggatctcagtcagttgcttaaaactgaacctaggcccttggtggtgtgagagaccccctctccatgtgcaggtaaagatccacggtacctcctaccccccagtccaccccatgttaatttactttttaaattaaaaaagtgatgcaggtttgttatgaatagtttgagcagttgaaaagaatatagaataaaaagtgagatcctccttgcacacatacatgcctgtggtcagccagatcccaaaatttggaatgtatccttttagacttttacgtatgtatctacaaccattatacgtatacatatacatcacttgtttttactaaaaagggattatgctccaagtgtttcctgcaacttcattttccctacctaaagtgtcttggacatatgatgccttttacagcaatgagaatttgagggtaagtctcagtttttattctctgtggtaaaggtttcttgataagtagagttgtcagatttatcaggttgcccagttaaatttgcatttcaaataaacagtgaatacttttttggtgtacatgtcctatacagtatttggtatatatgttcatatgtactgaaaaagtatttgctgttcatttgagatgtgagttaactgggttccccgttttatctggcagctctgcacttgttagttcacttacgtatcattggcttggggttgttattgttgttctatgaaaaacttttcatgcacaaaaccttgaaaccataaaaaggtcctgtttcctgggaaaggtggtgtctgggccagtgttcacacacctgatgaatgagaaaggtttggggccagctcagctgggcacccagaattcattacttgcctctattggaaagaactggcccgtgtagctgctttgtagttggagctgagacctgactctttcatcctagccactatgtgaagttgccactagtggtcacctgaagttgtgtgggtgatattaattgaatttttgaaaaactaaatgctggtatttgtaggaatttgcagtgcagacgggcagcctttcaaccagtgcatagcataattagagcaagcttttaagattctttgaagtgccaaatgtttatgaaattcaaataggggtgccaatctgcacaataaaggggcccttggtggtgtttttaaaaatcttctattttgtagatgtaaatatatgccataattagcgggaagtaacttgaagagccacggctgagtttattcctattattcttatttaaaacagctgtggcaggcaggctacagctgctgtctcatcattgggttgggcagggcataagggccgaagtgaacacactcaaagactcttttctgagggcagctcgttcactccccctacatgctggcttccttgctggggagctgtctcacggttggcccagcttccccacccaccccaagcctctgaatgtcaatgggactggcttcaagggtcttagccagaaggcacttgcctgcaaatgagagggcgaggagccttttagagcagccagctttctccagacctcccccttctctctgcccatggcagtgctgcctctaggggcactgttgccccacagccccaggcccagtgcagagcgattgtcctttggtgcctgtgggagcagctgcaatgccgcactgcgtgccctgcctggccgagccttaccatgtggcaggcctggacggctgcccgccacagggcccagctcccagcaccgcctgccaaggagccagatgctaccattggaaaaaattgcttcacaatttgaaatcttggttctttgatcattgctcggagaggatgaagaagagaggttcaaagtagtgttttaaaatgccagcgtctcgttgcagccatcagtgcctattagactgtctctggttggggacagtcctcttgatgttttcatttttgcaaccaggtcattctccccagctcttccaagccctctggataggaagggaaggtccacagcctgctcctgaccctgtgcccctgctgtccccctgcctcgcgccttagaggttatctgcttgcctttgttccagcaggcttttccccaataaagcttgtaacaaagttgttgtcatccgccaaatgctgccaccgcgtgagctgctcactcccattcttcactgggcaggagtagccttcacttcctgatccttctgcccccacagccaggtctccagaggacggaggttttgcagggatgatccactctgtcccctggcctagcacccgcctccaaggacttcagatcccacatacttgggtgaggcttcattcttccttacccttgaaatgggaagggtcagtctttggagagtgttgcatttttcatatttactgccaaaaggcaaaaacatgaaatttaaaccaaacagatccaggatggctgggcatggtggcccacgcgtataatcccagcactttgggaggccgaggcaggtggatcacgtgatgtcaggagttcaagaccaacctggccaacatagtgaaaccccatctctactaaaaaatacaaaaattagtgtggtggcgcacatctgtaatcccagctacttgggaggctgaggcagtagaatctcttgaacccagaaggtcgaggttgcagtgagccaacattgtgccactgcactccagcctgggcagcagagtgagactctgtctcagaaaaaagaacagatccatgaataaatgggcttactgagtaagaggtaatagaggagaaacgaatccagactcttatctggggactaaactgtttcagttgtggaagtaatgagtataagagaaggatgatttgggaaagaatttggaaacttttgatggggtgtatttttgttttctgttgctgtccgcttcctctgcccatcattgaaaccggcttctgcttcgactttttgttgtttttcaggacttgcccacaaatagaccctaaagtctttaattcactcaacacacgtgttaatgatggccttttttttagtcccagaaagaattctataacatgtctaatcatgccttttgagaaatttatacctgtttgagctgttatactcaatacgtaagacccgtcataaacacaaatcagaaaaagtcctaatttttctgtttggaaaaagccagtgttgcatctgtgccacacacccgacaaacgtgggttggggccaagactggctccatggtgacagtctttatcgtgtttattgattacagactcttgtctcgttgaggaaaggtgtcagtgtctctagatgtgatttgaggctctgtcttcatctctattgtggtcaatatttcaaattgacaagtgaacaggagtgatgataggtattgttaatgactgtgaattttatagtacattatagattacaggtgaattttatatgcattatctcctcatattaccaccgtggcctttggaaacacatcatcttccctgtggataaagatgagaaaagcgagacccaaaaagtgattccaaatctctcacttctgctgcctgtgctgtcagtccagtgtctgagatgagatgacaaatgagaagcagcattcacagacgcctggaccagtgtcggactggatgggatgagtggaggactgaactttgtagagtttaacaaaagtaaatgtaaaacttgaatcttgggaagcaaacagaacctgaagaactatgtgggtgaggaggaggagaggaatggtgaagttaaggaggaaaggagagaaaactgcagaattgtgttacagaagtgttcttcggtctgtggtacccgaagttctggatggaagttacagaggagctcatttcaacttaacagatgtaataggcagcatcatggatccccagacatgcctcctctgtagccatggaatctgtggataatggtacattacatggcaaaggggaattaaaagttgttaatcagcagatagaatatcttggattatctaagtgggcctagcatggtcccaaggtcccttaaagcagaagagggagacaaaaaaagacatccagagagacgacagctggcaatgtgagaaggattcggctggtgtttctggctttgaaaatggagcaaggggctccgggacaaggaatgtgggtggtctcagaagctggaagaggcaaggaaacagaaccctcttcagagcctctgtctagtaaggagttgcgtcccttctagttccttgatcttagccagcctggagctgaattaaatttctgacctacaggaatataaaataattagtttgtcttgttttaaggcactaaatgtgtgataatttgtagcagagaaaattaatataacagaaaaaagcattaacagttaaggctgtctggcaatattattattatttataaatagagatggggtcttgctgtgttgcccaggctggtctcaaactcctgggcgtaagtggccagcgtgcctggcccagcagcattattgaagtgattttcctgtgtctgaaagtatttagctttaaggcagtgcaggtcaggatgctgtggaaaggatttctgcttttggaggtaggagagagttgacctctgaactaagtttcagcttagcgtttagggtctctgtttctagagcaaacagggagaagatttcttagaaggactcatttccctggacttaccttccccagccatatttctaagtgttgttttttaacactgcagaacctggcctatgaccagcctttttggctagcttgtgcccagaagatgggatatggtttgactttggaatttattggaaagataagttttactagttttcaactgtttcttggatttttgtttttatttacttttagaaaatatcctgtggttaggtaaaagctgattaggcagaaatagtttgtatctctgatagtggtacatttttaaaaactcattttcttgccttcagaactacatgaaataggtttgctttccacctggagtgattttcagttgggaggggggacgtgtcagtagggtagataatgaactctgcaaatcccagacttctttgttgttgacttaatgctagcattctttctttgatattaccttcacttcatgggagttcagtgactgcatttctttctggaatagccataacactatcagctgacagataattatatatatataaaattatatatatcttgataattatatatatatcttgataattatattttacatcaatacttcctcctagaaaattcctgaagagcatctgtgatatggttggatagctacataattattttccatgttcaagggtaattacaaagcagttgtaatggcaaattggttatttactgttagttgggaagccttttaaaatctaatctcttaaatttacactaataattaaatagagaattttctcagactgtttctccctacctcttatctaaatgaaggataaaatgcacgtagactctatgaccgagtaattacactcctaggaacgtccaacagaaacacatccatatgtccctcaaaagcatattcaagaacgttcatagtagcactcttcttaataggtccatttggaagcctcgcaaatgtccctaagtaatagggtggatagatcgtggcatttttcattcaatggaatattctacagtaatgaggatgaatgaactatatacaacaacatggttgagtctcacaaataaaatgctgagtaaacaaaactaaacactgtaaaccctgttgcacttgcttaaagttcagaaaccagacaaaactaatgtgtgatgtttcaggatcatggttacgctggcaaggtgtatagatgattgtgcctggaaggaaggatatttgggggagagagggacttccatttcttcatctgggtgctggctcacttgatgaaaattaatcaagctgtaaacttccagtttgtgtacttttctgaatgtatattttaattttatgtaaaactgttaactttgacagctttaaaacatgtaatttgttgggatggtttctgagggtaggttgggtattctttaataactttgttttgaataattctatcattgtaactacagatcatccattccaaatggaagctatattaaagttgtttggggagttctaagagataatggtaaaccaatggtgaggtggtaggaatggtctgccgcagctgcaagcagtaaggactttgcttggctgtagggaatttacaaacaatggcaaaaccatctaaaaaatcaattttctttttattatcaccatattaactgacaaaacctcctttgttggcctgagtcctaaataattggtgaagttagtgttgaatttttttaattactttttttttgagacagcatctagttctgttacccaggctggagtgcagtggtacaaatcatggctcattgcagcctcaaactcctgggctctaggaagcttcctattttagcctcccaggtagctgggactacaggcacatgccaccatgtccggctaattaaaaaaaaaaaattatttgtagagatggcatctccctatgttgcccaggctggtctcgaactcctgggctcaagcaatcctcctgcctcaacctctgaaagtgctgggattataggtgtgagctgaatttttattttttatatatgtatgtatacaacatatgttgaatttttattttatatatagaacatctatatgcttcaaattagcaagcacattatccattatattacttctccttcagtaacacatgtggactcagcctagtactcatttcaggtgcagtctgagtccacagtccccatggtgctccttgttccagtggttaaacagatttgtcaatgagcaacaatagtagaatgattatgaagatgaggaaacagaactttttttccattccttcattctctgtttctgctttgggaatttttacgtttacaattttaaataactgaagtagagtgctggttattgttgaaagtcattttgtcaaataaaggaaggcggtcttaaaaatgcgtcagatctgctaggtgtgccactgctgtgggacagctgctttcaccagcgttacttaagcatggaacctcgtacagacagaaccgtaacagttgtgaacatattcagcaattttactaacatcatgatgaataataccattctaaacttagttaacattttaaaattatatatattgacagattattttttctgttttaaggttgacagtttttaaaaacaatctatttactctcccagtgacccacctgcccccatacacaattgcttatttcactgtgttcccttccatagtccagtctgtacaccaaaatcactagactgctttcccccatgcttagaaatagggtcttgctacgttgcctaggctggtctcaaactcctgggcttaagcgagcctcctgcctcagcctcctgagtaattgggactacaggtattctaccacacccagcttgctagactgcatttgattatttactagtctttcagaacaacttgattaatcaaaatcaactagtacaatgttagcttacagtgtattcatagcacatggagactctttttcaaagctaggaatttaaagttgaaagaaagaaaaataatttctaatgcaccttttctgctcaacacaaacttattgcagcatcattgggaagcatcatagatattcatcagtagagcgtgtattaaattatggtgtatctgtgccatagaatagtgtgcagccactagaaagtgtggctgttcattatttcaaatggctgtactttatagtactgaaattccatgttagtactatatgagttctaagtggcataggtatatatatatgtttaacgcaaggttttagaaaagttaatataatgtgctactgtttgtgtgataaaggaggaatgtatatgcttgaatacctaagtgctgaatatctctgaaaggacacttgagaaatggataacattggttacctttagggaggttggcaaattttggggttcatgcccattttacagttttatttttcccccgtctttaccacatgcatgttttcacttttttaaaaaatgttgggctgcgccaggcatggtggcttaggcctgtaatcccagcactttgggaggccgaggtgggcggatcacctgaggatgggagttcgagaccagcctgaccaacgtggagaaacctcgtctctaccaaaaatacaaaaaaaattatccgggcatggtggcgcctgcctgtaatcccagttacttgggaggctgaggcaggagagtcgctcaaacccaggaggcagaggttgcggtgagccaagatcgtgccattgcactccagtctgcaacaagagcaaaactccatctcaaaaaaaaaaaaaaaaaaatctggaacgttttggcacaggctacatcataataataacagcattaatcctgccaccataaagcacctgaactgcttttcacagcgaagtattctaaggtgtcagcaaagcgaggcagtggcagttcttgaaggtaacactgccatgttgaaagctcgatgggaattccagtgttcagagcccctgtgtgcctgaggtgtatggtagcccctctgccctggagactggagctcagttagacccaggggcctcttcagccttgggagttcagatgctgatctcatttagggaaagacatgcatgatttcctgctgagctgctcttttgtggagccaaatgttaaacctttgaatgtgagaaaaatgcacacctgggtatttttgtttgtttatgatttataccccataaaatccaaaatgcagaatgtgaggaaagctcactacatttatgggtaacataaaaccggataagtacaagttaaagcagattggaaaccagtaaaaggagctgtaccctgactgttagtagctattagaagcacctgagacaagttaattattgtagttgaactctgaatttagctttgaatttcttggcacataaggtgaaaaggggaatgtggagtacatggttctctttatttgtagacagaaagtaggaagttttgcctaaggagttggacattttcctaataaccaattcaaaaaggaaatttaaatgtagatacttattttaaagtatatgatgactcaagtcttagtggttagtgcctgtcaaggtataaannnnnnnnnnnnnnnnnnnnggaaaccagtaaaaggagctgtaccctgactgttagtagctattagaagcacctgagacaagttaattattgtagttgaactctgaatttagctttgaatttcttggcacataaggtgaaaaggggaatgtggagtacatggttctcttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgaccttgtgatccgcccgcctcggcctcccaaagtgcggttctctttatttgtagacagaaagtaggaagttttgcctaaggagttggacattttcctaataaccaattcaaaaaggaaatttaaatgtagatacttattttaaagtatatgatgactcaggtcttagtgnnnnnnnnnnnnnnnnnnnncaagtagctgggactacaggcgcccgccactacgcccggctaattttttgtatttttagtagagacggggtttcaccgttttagccgggatggtctcgatctcctgaccttgtgatccgcccgcctcggcctcccaaagttgttagtagctattagaagcacctgagacaagttaattattgtagttgaactctgaatttagctttgaatttcttggcacataaggtgaaaaggggaatgtggagtacatggttctctttatttgtagacagaaagtaggaagttttgcctaaggagttggacattttcctaataaccaattcaaaaaggaaatttaaatgtagatacttattttaaagtatatgatgactcaggtcttagtggttagtgcctgtcaaggtataaaaattagccagtcagaatctgccaaatctggagcaatacggtgcctcacacccgtaatctcagcacttagagtggctgaggtgggcagataacttgaggccaggagtttgagaccagcctgggcaccaaggcaaaaccctgttactactagaaatacagaaattagttgggcgtggtggcacatgcctgtaatctcagctactcaggaggctgaggcgggagaatccactgaacctgggaggtggaggttgcagtgagcctcgcaccagtgattccagcctaggcgacagggccagaccctgtctcaaaaaaaaaaaaaaaaaaaaaagtgccaaacctcacaaaatataaaatctcatttgagtgtcagatccacgtacctctgcttcaacaaccaccacggcagtccacatttatcatctctcgcttggactgctataatggcctcctagtatatatatatatacatactttctgctctcttccggagtcttctccgagccatggtcagaggtgccttttggaaggcagagctggttgtgccctgtcactgttccaggcctgtctgctcactgtgtcctttggtctcaggatatttcacctctccagctctcctgccatcctctctctcttgctttctctttagcgcttctttctggctctgtgccctcttctctcttatggaatgcttctcttgcctaagcctcgtcttctttcttgggatctgagttgcatcatcattagaagtgtccctgaccctgggggcccactcctcaccgtttgtgctcgtgtccccccgtacctctctccctggtgcttagttccgtgtggtatgttcctcacttaattgtaagcctcacgagagcaggccctggctcagcttttgctttttttatccgcagctctgagcattgtgccggatgcggagcagggggttggtagatatttgagggaaggcagctattactctgtggctgtctttggtctgttttgtgctgctacaacagaatgccacagcctgggtaatttataaagaacaaaaattcatttctcacatttctagaggctgggatgtccaagatcgaatctgtagcatctggtggaaggcacatgaagggccagagagagccagcttactcctgaaagccctacttatagcagcgttaacccatatgcaagggcagaggctcaacacctaaacccatcccaaaaggcctcacctccaacactgttgcactggggtttaagcttccaatgcatgaatttggtgggggcacattcagaccactgcaatgatcaaacgctgcagcagccagtttccccagtggacattgcatcctgctgaagacatttctctctgaagcacagtgctaatcataccacttccttggcacgcaggctttcaagggagtatccatttcctacaaaatacaatctaaactgtcttcttcgcccccataacctgtgcccaagttgcatttccaaactcccagtctgaggtccttaatccatgcccagaagctagaatgcagcactccaggccttggcctgcactgtacccccagccttccctgcatgtgccagtctaaatcattcctcaactgagaccacctgtggaaagtcataccttccattgctgcaactctaagtatctctgacatggtacttattttctatctgaatgatagttattttatgtatcttccatatcagttgtaggcaaaacccgtacattgtctagcatgaacctttcatagtaggtgcttaataaaaatgtgttaaatgaatggcaacttaagtcattatttaacatctttgtaagccagtctttaataggaaccatttcccctccagatattctaatttttaagaaagtttctgtttgtacatatatgacaaatggctagtcagctgcagtctcttgttttttttaaaaaatatctctaaagatgagtgaacatgaatccaattaatatcctgctttctgtgcatatttcaaagaccttgtggatcttttattgcaagggtatagtagtattctgatactgaatgcaagaaagtaaaacaaaattgatacttgtagcatgtcatttcaagagaggactgcccaaattagcaaactctttaaaaaacgacagatgggtattgaacttgtttctagatgagcatcaccttcccaagccagccctcttcattcagccaagcagaggtcttaccctgaaagttactgctcggtgccatgactcctgggatgagagaataacccacacctccatttcctttccaacaggctgatttaaactgcaatattcaagatgatgctggggctttttatggtgtaaccagtcagtacgagagttctgaaaatatgacagtcacctgttccaccaaagtttgctcctttgggaagcaagtagtagaaaaagtagaggtaagttggcctctgtatactggaaacttcattcaagggcagactgttgccttcctttaaaccttccttggggcagagagttgtatttttggatgtctgcttcttaccttctgtattagtccattctcacactgctatgaagaactacctgaaaatgggtagtttatgaagaaaagatgtttcattgactcacagttccacaggcttaacaggaagcatgatttggggggtgtcaggaaacttagaatcatggtggctgaaggtgaaggggaagcaaggcacgtcttctcatggtggcaggagaaaggtgggtgggaaccaccacacacttttaaaccatcagatctggtgagaactcccacagtatcacaggaacagcctgggggccacctgccaccaggcccctcctctgacatgtggggattacgattcgagttgagatttgggtggggatacaaccaaaccatatcaccctccttctttctcccacttctttttcctgttaacttctaaaaagccaaagtgatttggaagcacctgaaaggaagcaaataggatgtcccgtgccagtcctctgactgtgtctgaagtcagctgtgccctgctcagccagtgctgtgcacctttgcttgaggccttgtggggtagtgtggtatgaaagctgggtcgagataggccctgccactcagaatgatgccctccctacacccaacccctaggtccaagggcactcccaggcattgtagatagacgtcaaggtggtactcagctgattggcacctgccctctgaaaccatgataccttgagtttgatattgttgcttttgccatttccactgccttcgcttttaattgttttagatagagtttattatatattaggatccaatctctttttacggcttttatgtttcataccttcctccctttaaaaagatgtatatttgtttgatcagggtgagttgctttgttgaataatgtttgttgttggcattccttaaaggttgtattttttagtgtcttctatccatcacccaattaattgatccatgttcagtgagcagtttttatttgcagtggccccagacctttcaggttcaagagcccaccttagctgtacaaagactttgtgctgaggagggagagagggagaaggatatatttcttaagaccctgggctaagcaatgaggatttgggatgctgcaggccctcgtagcacaagccccctgagcaatggacaggccttatgagaatgttgttgaggaaaggttatgctggcagaagaggatccaggggagttgactcagatggacaatttaagcttaggggtcatgagctttcccacaatggtggcagtgggaatcctgtaagatgttttgaatggaacttagaaactaactggatattaatgaggaggaagagtcaaaagtcacactcacattttatgcttggaaggatggtactgccactaatagagataaggaaataaggtgttcaagaggaaataggcaatgattatagatgcaagactagaacttggatgacaggtaaagactggaaatataaattgggaatcctgagcattaaggattgggaatggagacctagctgcagagagggaatagaaagggcacaggaataaggattaaatttggggagcagccactagccctaggataagtagagggagacataaacagaagaacagaggacaaaaatgagtggggagggcgggaattggctcaacataatgtctaggaagcccaggaggtgagaaggtggctgtatcatgaaacatggctgggacgcctggaaccagatgacctcctcgcctctaagaaggaggaagcaaagttacctgtgggtgattgggagtgtggaagatgagtgttaggcaatgttagtgaatagctaagttgtcagggatgttctctgtagttgaaattccctgcctggacaggtgcatttgagaaaagatgaaccagacagcttactcaatttcccaaatgtcaaattactggtgtcctcagacgatacacccaaagctctatgcaaattcagggagcagggaaaggttgctcttgactgataaaatcacaggaatttttatggagaaggtggtgtgcatggtaggtggggttttacctttaagccttttatctgtttagaatgtgtgtctgcatttggtgtgaagtagtagtccacttatattttcttccagataggcgtttgtatcaaaaccacttatgaaatgattcattctttcccagttaaacagatctgtcccctttaaattaccatatattctgagagctgttcctggagtcccactgttctattccacccactatttgtgtctacgtatcccagtaccatgtggatttgattacagtggctttatagtatatactgatatttgatgaggcgagtcaggctcactattctttttcatatattttctaagctagtaaccaacatttattcttccaaataattcaatcacttaaacatataaagaaaaacaaaaaccttgtttgagcaatctaattgtaattgcatcaaacttagatgttcttttggaaaaattttatattaaatatttctaatcaagaatgtatttgcattctcatttcattttatgtatttcaataagattttatcattttcattatacaggtttgtctctttcttgttaaatatatttctaaatattatataatatgttgtaatttcctgtttctagattcgaattaatagagaaaagctcttgattttgcatatctgtcttcaatatggccatcttagcaaattctcatacttaactttagtttttcccccagattcctggggtacccttgtatagttaactgatgttagttgaaaaagttttggtgttttgccctttaggattatatttactgtaggcttttattaatggtctttattactaatttaagtgttttctttctattcctattttacttaggatttttattagttacagctgcaatacgttatcaaatgcttttcagcaactgttgctatatgatttttcttccaagttgttgacataacaagttaatacatttcctcaatgtgtatgaaacaccatagcatttctgaaacagtcttactttggatttattgttgcattctatttgctgatattttacacagaattttcacattacatttcataagtaatattcgtctatacttttttcttttccttttttttttttttttgagatggggtctcactctgtcacccacactggaatgcagtggcatgatcttggctcactgcagcctcagcctcactgggctcaagcaatcctcccacctcagcctcctgagtatctgggactacaggcctgtgccaccatgcctggctaattttttgtattgttttgtagaaatgtggtttcgctggtctgaaactcctgggctcaagcgatctgcctacctcagcctaccaaagtgctaggattaaaggtgtgagctgtcacacccaactatatacctttttcaataacctgtttgccaaatttcagtcttgaatgtacactagtttcataaaaagaataacactggaaataactattctttaaagattacataaaacttactcctgtgaaactatttggtctttatatgttttttagcatctacttttaattaattatttttaattgatagataaaaattttatacatttatggtgtataacatgatgttttgaaatatgcatacacagtagaatggctgaatcgagctaattaacatgtattacctcacacagcttaccaatttttgtggtgagaacacttaaatactctctcagcagttttcgaggatacagcgccttggtattaactgcagtcaccatgttgtacagtagatctcttgagcttacttctcctaactgagattttatatcacttgtggcctccacctttttcagtggtaaatagctaaacttgttagttgtggtcatttccacaatgactgatctatttgttgacattttccccttctttttgactcagtgttagcaagttgtatttttctgggaaagcatctctatctgctgtgttttctttgctttgccgtgtgtgtgtgtgtgtgtgtgtgtgtgtgtgtgtgtgtgtgtgtctgctttagggttatgtgaaataatctcttatgtatcttctaatttgtactgtaattgtggttttgccacttttcttttttctcctttttacttgtatgaagagtttattttgtctgtctaaaggaccagtttttaattctgtctgcattttaaatttctatttcattgatttgagcttttatctttattaattcccttttcctggcttcctttgatttctttgtggtttgggttttttttttaaggatgtgtgttttattctgtaaatttttacctttaatgatgaagacatatgaggctacttcattaagtttccttcaagtgcagcttcatcatggctgatacgttttgatgtaaaatatctcccttttcattgctctttagtttataattttcttaattccttttgatccaaggttatctaggaagccttgtttcttatttctgagttattgaaactgcatatatactagtattttcttagtttcttcctttcataaacaggtgacattcaggggctcatgatccgtgagaaataatcagttttttctaaagtagagagattagctatattggttgttaacctatgaggctttatcacaataaagagattttctttgaagaactgtagctagctggggcctgctcttacagatctcctccaggtaaagcatcataattaggcagttttatttttttctgacctttgctaaaaggatctgtcaacgcttcttaaagctctcatctttccaactaattttttaaaaaacttccagaaaaataatggattctatgtatagcaataaatttggagatagtttttttttaattaagtagattacgtaagtagtatagcatatagaagatgattcatgttgaaaaactaaaatgcttttatgggcagtaatatctgtttcatgtgttttggagtcaaaagtgtaaaaatactgaaatccttttttcctcacagacggagtatgcaaggtttgagaatggccgatttgtataccgaataaaccgctccccaatgtgtgaatatatgatcaacttcatccacaagctcaaacacttaccagagaaatatatgatgaacagtgttttggaaaacttcacaattttattggtaatggttttgtctctttcctctgtgggcagatgctgccatgaggcttgacggaagtgaggaaggtgggcctgggaggcgctgggcctgcgccgagggaactgaccaggttgttggattgggttcctagtggtcagtcagcagttgaatttgcatcatccatagggaaaacttgggcttgattctgtagaagagaaggggttttatctggctggggtttctaaggttcgcagaactggaattcagttgggtaataaaaagtgatgtgtttttatctctggctgcagagtagaaaggcctggagaacttttaaacatccggctgtatcctagatcaattaaatcaggatctgtgagaacaggacccaggcatgtgtatttttttaagttccgcaggtaatttcaacattagccaagttttagtctcagcagcaacatggtatgcaaatcaggcaaaagctgagttggtatgtttgtacttcaaacataccttgacatgttccatgatggacttccaaggccttctaagaagttacatgcattaaggcaggaaaatataagctctcagtaccagaagaaatataaattagaatagaatgcatggaatgcagtgaccaggaggaggaaaatgttcttcataggctaaaaaatctggctaggctgagtacagtggcttatgcctctaatctcaacactttgggaggccaaggtgggaggatcccctgagcccaggagttcaagaccagcctgggtgacatagtgacaccctatctcaaaacaaacagacaaaacaaacttaatgggcagctaaaggaaagggaaaatagtgttcaaggtccatgatgggaaaactcaccagtgcccctggatggttctatgtgggttttcccctaatacttaactttaaaacaaatttcttctgggagctttatttggggacttcagaagttgttaggaacaatgtcatcctcaaaatagaaaatactcagtaatgggtttcataaggctcatttaaaaaagtaacattacttgattaaagggaaaatgccaaaacaaaacttgagggaaacaatcttagcaaaagaggggcaacaaggctatactgtggccaaatactcctctgaaagcctactttattcctttttgttactaggattaagaatccatacagcaggaattctttacttggtgtttttggttccattgggacagtggctttcaatcagcagtgttctgtttttttgttttgttttgttttgtttttgttttttagaaaggctgtttcccagtttcccaaaactctaatttataccttttacctatttctgtggtgtaaatatgcccttcatgggcaatttcaagctaccgatagctattcagctaatgaaattccttaatatttaacaataatttttatgagccagtaggagccagcttctatacaccattgtataaaaaaaaataagtaacatttaaaaataaaaaccctgtgcatattagattcatccaggaaggtttaaaacatctaaggcctaggccccaccctggatgaataaaatgagtccctggagatggggcccagcatcctggtttttgtttattttttaagctctgcatgtagttgaagtgtgcaaccgggtagagacccactgctgtaagagattgggaaatgagccgcaaggactctcagagtttatagacacatgattggcatacaactagcaaacagataattttgcatataattttcgtttgttccaagaagagaatcttaatgggttctcagatgtgcccatgtccttctaaaatttagaagccagcattcaggggaagtttggaatacatgctctttaataacattgatcagtattcctttctttaatggccctttggtgaaaatagagcaattcaaggtttgcaggactggcatatagcaggtgcttgacatataggtgcttcctgttgctatctaagaatagatgcatcactttagcagtcagacgagtagaaggtaagtgtgacatctactgaggatcttaagtggcctcaggaattaaccaaaactctgaatgaatggcttccctgcctctcttgggggggagtcttagctgtttattaaaaatcaattctgattctgtttctgcatgctaaggatgcatgttctcagtccgtaaaactctacctcagagagcacagctaagataaatgtggcctggaaaagtgttaaagcccctgttacccacagaacctgactacagttgtgcactgcatagcagtgtgaagggcggaccacgtgtatggtagtgctcccataagatgataatggaggtgaaaaattcctgtcacctagtgatgatgcaactattatataatacagcataattatttttaaaaataaatttaggttagcctaagtgtacagtacaaaagtttacagtagtatacagtgatgccctaggccttcccattcactcatcacttactcagtgactcacctagagcaaatttcaggcctgtaagctccacgcatggtaagtgccctatataggtgaactactttttaccttttataccatatttttactgtactttatgtgtagatatgtttagatacaaaaaatacttaccattgtgttgtaatagcctacagtaatcagtacagtaacatgctatacagatttgtaccctaggagcaataggctacaccatatagcctaggtgtgtagtaggctgtaccgtctaggtctgagtaagtacgctctatgctgttggttcgcatgacaaaaccacctgattacacattaggaggtgtcctcattgttaagcaagtcatcactgtatatcattaatgctgccttgcaaaatatgacttcaaccaatacagccatccagataacttagcaggttagattaatttcaaaatgtgtcattaagcaactaaataaattcctttaatatggagaattaatacctatcaatcaatatatattagaattaatagtttagttttagaaaaactgaaattaagccagcactcttggattttgaaaataaaatcatctaattgatgaacaggagaaattgtacctcatataaaatgacatagtatttgcagataacttatacaaatcatctcttatactttaaatcatctctagattacttataataccaaatacaatgtaaatgctatgtaaatagttgttatactatatttctaaaatttttattatttttattatgtcttttttcgtccccaaatattttccaatctgatattgattggatctgccagtgtggaatcgcagattgggagggccaactgtattcttatttaatagaaagcttgcaagaagtttgaataggttgtagaggtgccaggtgctgtgctagaccctttgtaaatgttatgtaattctcactttcagactatgaggtcatttttctcattttatggataaagaatgtcaggccaccccgaggtcacagagccagtgatggaaataaatttgagataccatctcacaccagttagaatggcgatcattaaaaagtcaggaaacaacaggtcctggagaggatgtggagaaataggaacacttttacactgttgttgggactataaactagttccaaccattgtggaagtcagtgtggcgattcctcagggatctagaactagaaatacaatttgacccagccatcccattactgggtatatacccaaaggattataaatcatgctgctataaagacacatgcacacgtatgtttattagagcactattcacactagcaaagacttggaaccaacccaaatgtccaacagtgatagactggattaagaaaatgtggcacatatacatcatggaatactatgcagccataaaaaatgatgagttcatgtcctttgtagggacgtggatgaagctggaaaccatcattctcagcaaactattgcaaggacaaaaaaaccaaacaccgcatgttctcactcataggtgggaattgaacaatgagaacacatggacacaggaaggggaacatcacacaccggggcctgttgtggggtgggagtagaggggggagggatagcattaggagataatacctaatgttaaatgatgagttaatgggtgcagcacaccaacatggcacatgtatacatatgtaacaaacctgcacgttgtgcacatgtaccctaaaacttaaagtataataaaaaataaataaataaataaagctaaacttaaaaaaaaaaaagaatggatagaaaagaccttgcaaggtatcttatggtcatgaaatcaaaagacttgagtttaagactttatggccttggtcacttagtcttcagacatcagtttcaccttgatttataaacagaatgctcaagtctgcactttctacctcagaggttatcattgaaatattttaattcagctaagctgtgagagatggtactgccttctgggatacaatgcaaataaaacccagcacttgtcacgtagtaattcatggtccttcaggatgaaagaggcaggtaaataaaccattgcaagcaaatgatggctgtagtgtactcgtgaaacaggtacctctgaaatgcagagtgatgaggtagggattctcagggatgttgcctcgatggataaggagacatctttctgattactaagaataggggtatcccatgggtacatacttaggtaccaggggctggggtgctatggtgaattaggcaggtgggccgccatcctgggttctgatgcaggaggcaggcatgcatcaagtcatcacaaaataaatgaaaactgtagctcttgctacctggcagagggacgcagggcattcgtagaacaggggaatttgacctagttcaggcggaagctgaggaaggcttcctgaggaagaaacagttgagagctctctgcgtggtgaatatgcaaccatgaccaaacgaacctctcagctccttccctgtcaaagagcacccactcctagaggtcgtatgatatcatatgagacaatctgtgtaaagcatttgatactgagtagatggatagtaaacactcaatatttgttggctattctgatgtgaattttcattcattcagcaattatttatttatttatttatttatttatttatttttgaggtagagtcttgctctgttgcccaggctaaagtgcagtggtgcaatcttggctcgctgcaacctctgcctcccgggctcaagtgattctcctgcctcagcctcctgagtagctgggattacaggctcccgccactgtgcccagctaatttttgtgtttttagtagagacggggtttcacagtgttggccaggcgggtctcgaactcctgaccttgtgatccacctgcattggcctcccgaagtgctgggattacaggcgtgagccaccacgcccggcccagcaaatatttattaaatgacttgtgtgccatgtcctcaagctagttgctgggaaacagggcccctgttccttaggaacttatattccactgggtgagatggatattagaaaaaaaattgtacacgccagtatgtgtttaccaactgtatagcatgctgtgatgggaaaatgagatgtactgcaagactattctttaagtagggactggaagcttggataccttaagagcaagggaaactaaacaggggaaacagcctgatacttagagggaaattaggcctataacaaactggaagaggctctcaagttcaaaatgttttcattcaaacaatgctttggcgtaatcaaacacaaaagtaacagagtcactgacgcgtttcatgtttttgcttgattagatttgctcttagaaagttccttctgagaatagcatggggaattgagaccagagtgaggacagaaaggagtcagggtctgtgtggtgtggagggagctgcaatgatttgggctggagaactcaaaatacgagggataattagagggattcaagagactggaggggaagcatgagtatttcacaatacattttgaaagataaagcccatgtctatggaaagaatgtcattccacaggattctacctatcccactgttccttgattcagcagatacttttctgggtctaggcactactggttaacatagtggtgagggaggcactcctgcagcttctctgtccttggctgttgtgaaacaagatttagcagaagtttaagactaggatgggaaaaagagtggattttaaatgttctcatcacaaagaagtatgtgaagtgcttggtatgttagcctgatgtaatcgtcccacaaggtatatacatctatcatcacattgtagcccataaatatatgtactgcaagactttattcttttaggtagggactggaattattacttgtcaatttaaaaattcagataaaaaataagacaatttcttagagtaaatgattgccttgcgggacagaattaaagagaattctttgttgtaaagaaatcagccccctaaaaaacaaaaacacaaatgtgctaatttttgtggtcctttcttgggcatagattatgagtgaccctatctagaaggtatttcttacttatgataaccacgtttagatgggcttcaggtcatagttgtagtgttctgaatctgtgttagaggacacagagtgaggctgagcaaatctctcttggacttaagacttgttcttctccaattaagtcatagtcgtcatacacagatggaatatgttttcatccttttggtattatatactttttttttatcttaacaggtggtaacaaacagggatacacaagaaactctactctgcatggcctgtgtgtttgaagtttcaaatagtgaacacggagcacaacatcatatttacaggcttgtaaaggactgaacatggttatttatatatatagatatctgtatatacacacacacatatgtgcacacacacactctctctccattatcgaacgactgactgtaaacctcaccacacagggtggtgccctggccccgaggtcaccccgacttttctaaatcttgtttgagtgaagtcattttttcatgtgttcatactatcattgtagctgtgaagttctggtacagttgtaaaaagagaaattgagttgtttctctatgttcttcagatgtgcagcccacaattcctcgggaaaggtgaacctgaacaacccaagtctctctctgcagagccctgtttctaattgtggtagaaaatattgagacagagcatttgccatgggacatttacagcctttatacaaatgtatttagttctcttttttccaacataaaattcttgttttaagatacaagtaaaattaatctttaaatataaatgtaaattagtacacaaaactaagaatctttagacttatctttgtaactaattagggtggaagttatgaaagaatgtaattcactaaattattttttaaatgaaacctttttttttctttttgaaaccaaatgttaaactatagccttaagaaatgcttggtagaagtgtcctaatgagacaaatttgtacttttatcctcaaggttaacactaatctcctaatccattaaactcttgaacaggtattacaaaggaagaaaacttcaccccttatccttaacatatatagtatatttaaaaaatataaaattgtattgtactaatgtgatgatggattatttaatgaaaaagaaaaaatggctctttttgcaataagtagatacatactgaaaaaatctaaacttacaatgtttatagtcttgtgtgtgcagttatattttatatggacgaccaaattttttattaagatgagtaaatatttgaaccactgaattttaataacaaaattttaaaattggcatgaatacggaatactgcactgtgagatgcaaagtatacagaatctgtggctgggagaaaatttcatcaaatagacaagtaaaaggctcatcagttttagcatctctgctccccagaaaattgtaagcatcctcaccagcctgtggatacattctttatttctagtgacccaatatgcatattaacctgctataactagggctatatgtgtaggtatgtgtatacatatacacaaatgcacatatagagttaacacatttagtgaacacttgtttagtgtcactcagtttgctaggtgctgatatgtacgtatatctcaatgtgtctgtagacttagatacatcctcttgaagcacatccatttctttagcgtctctcagtaagttacagtacttgtttgacttaggtttaagaggcccagctacctatctctgaccttttcaaataggctcatttgggagattcttttgccaggagagattcaactttccaatctaagtattccagagcattgcccaggcagagttggtttgatgtggccagatgttttgagttatttcccttaagtgtttcactggggagagaacagggagtgctcctccagcttcccaaagaaatatgtttttgtaagtggtaggaacatgtgcacacaatagaacatgaaataagttttttaacttgtaaaacatgtcaagatttttccaccaagctagaaaataaaaaacttagttctaccacatccaattaacttacacacccccttccctgtctcaacacctgctttgaccctgcttttctattattacatcagtcagcatcttgtggtccctaacatgaggatgtggctggctcgtgggaaacagcaaaacactaagcctgacctctcccaaattgggaagaccagaggagaaagtgcaaaactgtccccatttggaatgcccattccttctagaaagcagttggacagtgctcctctgcccttcataaacagactactgttgggtccctgattcca

SEQ ID NO: 13714 - DNA, 13104 bp, Human
cgcctcctgggttcaagctattctcatgcctcagcttcctcagtagctgggactacaggtgcgtgccaccatgcccaatttgcctggctaattttttatatttttagtagagacggggttccaccatgttagccaggctggtttcaaacccttgacctcaagtgatctgcccaccttggcctcccaaagtgctgggattacaggcttgagccattgcgcctggccatttgacaccatttttaggaaacaatttcttgacttggctttcttaggtcttctatatccacatcaccctgaaaaccttctctgctgctctttttcacttctcctaacctgcctgacctccagatgccgagtgctccatgttaaccatcctcaggcctctcttgtctttctgcatccgctctttggtgaccccatctagtctcatagccacttccacactcccagctctgacaagtgcatctgcagctcccagcagctgcccactcaccctcctgcctactctccatcactccctggatgccaaataggctttgcaaactgaatgtcttcaaccaaactcctctctttggcattgtccctgactcctctctttcgctcactccctacatctgatcctttagcaagtcctgtcagctcaacctcaaaattacattgaaaactgttttttagagacagggtctcactgtgttgcccaggctggtcttgaactcctggcctcaagtgatcctcctgccttggcctcccaaaatgctgggattacagacgtgagccaccaccacatctaaatccacaactaccaccctagactattagcctgtaattggccaccacttctatcccccgtctcctcaataagcttcttccccacccggaagccagagtgaccttccccaacctaaggcagatcaaggtgtcagctgcttaaagccatccaggggctccttgtctcaacccaagcaaagccagagctctttgagctgcacagcctccttgttctctgatgtctgctggctcctggtttctgtttctccttcccagccttgctaattgttctccagccaggctgcttcccatgtgggtctcacacagccaagccccctctgcctcagggactcaggcttttatacttggggtttcttctggtacccctctccccctagattttcatatgacttgcacctcattttcttttcttcttcttcttttttttttttttttttttttttgagtcaggcccaggctggagtgcagtggcacaattgtggctcactgcagccttgatccccggggctcagacgattctcccacctcaccctcccaagtagctgggattacaggtgtgcaccactacgcccggctaatttttgtatttttagtaaaaatggggtttctctaagttgcacaggctggtctcgaactcctggactcaagcaatctgcccacctcagcctcccagagtgctgggattacaggtgtgaaccatcatgcctggctgccccctcattttcttgaagccttttaaaatgctaccctaacaaaagaagaccttcctgcataaaacagccacctcccagaattctgttctgtcctctctgctccagtttcccccgcagcactggtacccgcagcactggtacccgcagcactggtaccacttgctatagtatacattggtttgcttctggcctctccacaccactgtaaccctaagttccaggaatgcagggactgtgactgttttagtcacttgctgggtcccgagtgtttagagtagaggcttgcatgaagtgggctcccagtgaatgtttgttgaattatcagacaaaggaagaaggaacggagcacccggtggtggagacagtgctgggctctgacatgtgtttctctactgcccagatctggaagtcggaatcagcactgtgctgtgaccactcccacccacgctgacttctgtcttgtgtcttcttccaggtctacggctctcgcaggctctgtgagggctttgctatgacctcagtcccctcacggagccacgactgccccttgctgccacagcctttccaagaccctgcccggccctgccccatcctcagccccgagtcaccatgggcagcgtcagtagcctcatctccggccacagcttccacagcaagcactgccgggcttcgcagtacaagctgcgcaagtcctcccacctcaagaagctcaaccggtattccgacgggctgctgaggtttggcttctcccaggactccggtcacggcaagtccagctccaaaatgggcaagagcgaagacttcttctacatcaaggtcagccagaaagcccggggctcccatcacccagattacacggcactgtccagcggggatttagggggccaggctggggtggactttgacccgtccacaccccccaagctcatgcccttctccaatcagctagaaatggtaagcgggggtcgctggcaagggtaagtgggttggaaacgcaggagaaagcaaaatgggggtggagagcctgggggttcagggggagtggtgacctgagcattcagactcctcaaaaccagagcggcaggggtgccggcggaagcctgtggccacaccgcagagatcaaacgtttcacaaaggaattagagcatcgctcagtccccctgaagcagaagtcttgggtcaggccataagcaaagagcacaggggatatgtgagctttctggagtcccactgaaatgtagctggattgtcaacgtaggatccaggcgtttgccaagcctcgggaaggagagggagccctgttctcatctggaagcacagatgaagaggatgcaggccgggagttaaccgcttctctccccgggagactcgtgggggtgggtgcggtcttctcatttgctgccctggtgtgcattagctccttgttcaagctgcgcctgggggcatctttgaatacaggctggagttttgtcatccatttaccagagactagggcaaaggaggcccaggcactgagaaatccagccctcacaccagctcaagccctcgtgcgtcccacgagtggacactgaaatcaattttcctattcagtcctctgccccttgccctggggaaatgaatccccggctttgatttactaggaaagagcctcttatgtttgcatagagcattcagcttttcaaattaaggggcttgtaaactgtgaagcactctaccagggaaaattacagttttaaaaaaggatcgtgatttggagtgagcctcccaaccctgtaaggaggccaggtccgtgtccttgctccaggcttaatggaagaggcagtgaacaggaagaagggatggacctaaagagggacagcaagctcggccagcctgatgccctaacttgccccacacagagacctagagcaggagcctcaagatggtatttatcacctcgggagggctggggcaagctggtggcaggttgctatttcatagaacaaagtgcccaagtcgccattagggtttttccctcctaagagagatgacattcagctgcttcaaagcaacaggcaaggtctgctgagacaattgaccaagaggggtgctgcgtgcgctcagagagcccagactggctcaaggtcggcacgcgtgcctggggagggagggtgcaatgcgcgcgcaggggaggcatgagtcaccgcggtccttttcctctacagggctccgagaagggtgcagtgaggcccacagccttcaagcctgtgctgccacggtcaggagccatcctgcactcctccccggagagtgccagccaccagctgcaccccgcccctccagacaagcccaaggagcaggagctgaagcctggcctgtgctctggggcgctgtcagactccggccggaactccatgtccagcctgcccacacacagcaccagcagcagctaccagctggacccgctggtcacacccgtgggacccacaagccgttttgggggctccgcccacaacatcacccagggcatcgtcctccaggacagcaacatgatgagcctgaaggctctgtccttctccgacggaggtagcaagctgggccactcgaacaaggcagacaagggcccctcgtgtgtccgctcccccatctccacggacgagtgcagcatccaggagctggagcagaagctgttggagagggagggcgccctccagaagctgcagcgcagctttgaggagaaggagcttgcctccagcctggcctacgaggagcggccgcggcgctgcagggacgagctggagggcccggagcccaaaggcggcaacaagctcaagcaggcctcgcagaagagccagcgcgcgcagcaggtcctgcacctgcaggtactgcagcttcagcaggagaagcggcagctccggcaggagctcgagagcctcatgaaggagcaggacctgctggagaccaagctcaggtcctacgagagggagaagaccagcttcggccccgcgctggaggagacccagtgggaggtgaggccacacagggctcatgggtttgggtggtcagcggtttggcgccagtacccccctctccttctggtgccggccaatagcgtgcaaacacagaccgcgcaggcaagcggggctaatgtgctggctttatcacccaaagaaggggctccctgcaaaccatgttgggggatcgacttacatctgagcttcctcctgtccccaccatcaccctcatggctcctagatttcagtttcccaagtgagccattaaatcatgaagccggaagccagatgaccaaggcccagccaggctgtgggctgacctcccttccatcagctcccaggaggctcagaagaagaacaagccgtgcctgagttcaggcggggccaggggcccaagagagcacagaatgcatttgttgctttggagggagggactgcacccactagtaagagggaccctattggtggcaggtttcagtgatggaagtggccactccttgctgaagtgtaagtggaacttctatttggtgagctgagatggaaacctaggagaggaagtaaagagtcccccactcacacacttacacactcacacacactcactcacccggtcacacgtggaaatgaggcatctgtacctgaccgtgctggagaaccccataacctctgcatctattagtgggaaagcagcttttctcaccagcctggtggtctggatgactcatggagttcaagcccatcgttgaggctctttacatgctcgcacccagcttggtctgtccacgtgcctgcctcacccccagttcagagtccaaatctcagtctacacgcaaacccctggctatgtgcaagtcaacaaccagtggtttaacttgcccactgctggcagctgtatcacccccatttaacaccaatggtattggttttggtgtcagcctgatttctgtcatcgatgtttatgcccacatcctctgacctcacccctgcatgcacccagccctcctctctcctgtctactggagtaaagactacctcacaaattcactgctgtacccagtgactagtatcatgctggcttggatgcagagcccaatccacatctgtcaaacgaggaatcattttcttctcctcttgctcttcttctctatttccacccctatcccccatcaaaatttggccaagagcaatgatgaaaaccgaagccacaggttagacccatgtgtctctggatcttggccatctggggtcatgggagaccaaggccagtctggctgaatcttaagagtgaatgaagtccagagcatgtggctctacagaatggattcttggaactagcctggaagccaccttcacatttcctttcacagtagaaatttccccttgccctcagtgaaacactgcacagtcctggagaaaatccgaccctacccaggatgcgtgcttgggaccaagaatttcattccaaggccaaccctgtattcatgccacgaagggagtgacacagtcatggctgaggcatgggcctggctttgaacctcagcttgaccacttatgatccaggtgattgtaaatacattagccatggtggcaatggggtatagtgattaaactgttgggatcaaatctctactcttatactttatattttatatatatatatatataatatatatatatattagccctcaggctggtcacttcaccagctgtttgctatcataacctctctgtgcctcagtttcattgatgtaaattgaggactactaatagtacctacttcatcgggttgtaaggaatagatgagcaaatgtatggcttggcacttaataacactacaaattattagtgaaagtatgtttataataatatacttctgtgtggctaggcgtggtggctcacgcctgcaatcccagcactttgggaggcagaggcaggcagagcacttgaggtcaggaattcgagatcagcctggccaacatgaggaaaccccgtctctactaaaaatacaaaaatcagccaggcatggtggcaggtgtctgtaatcccagctacttgggaggctgaggcaggagaatcagaggggaggcggaggttgcagtgagccaagatcacgccactacaccccagcctaggtgacaaagcgagacttctcaaatattaacaataataatatactatgtgtcattatacatgatgattattattttatcattttactatatagcctagctcgataacctggggaaaaggtcacagcaatgttcagcttactttcagattggacaaaggctggaatgcctaacaccgggccaccgcatccggagtggcttggttattttaggcagctgagctgtcacttccctgggtaaggacactcacctcttggcactctgtctccaccccaccctcggcaggtgtgccagaagtcaggcgagatctccctcctgaagcagcagctgaaggagtcccagacggaggtgaacgccaaggctagcgagatcctgggtctcaaggcacagctgaaggacacgcggggcaagctggagggcctggagctgaggacccaggacctggagggcgccctgcgcaccaagggcctggagctggaggtctgtgagaatgagctgcagcgcaagaagaacgaggcggagctgctgcgggagaaggtgaacctgctggagcaggagctgcaggagctgcgggcccaggccgccctggcccgcgacatggggccgcccaccttccccgaggacgtccctgccctgcagcgggagctggagcggctgcgggccgagctgcgggaggagcggcaaggccatgaccagatgtcctcgggcttccagcatgagcggctcgtgtggaaggaggagaaggagaaggtgattcagtaccagaaacagctgcagcagagctacgtggccatgtaccagcggaaccagcgcctggagaaggccctgcagcagctggcacgtggggacagcgccggggagcccttggaggttgacctggaaggggctgacatcccctacgaggacatcatagccactgagatctgaggggctgcctgggaaggcgagtctggggacctggcactgggaggcagggctctcccgtgcatcccccctgctcagcaattcagacccctctgagagacgccactccctgggacacagacccaggacccccgaggggagggcaggatggcctttccttccctctctgatgtcccagtgctcaccagccctgcagcccaccagacgtcaggccctgactcctctggctttcccaggagatgggtccaggggtctgtctgctttggttaagggctccctaaactttggcctttgttcgaaatagatatcctctccccctcctccagggaaggtggccacagcaagtacagcggctcccctccgcttctcatcccaacctctttttcctcctggacacattggaatgccttggaaatagaaagaagccatatatgaccagaagccttggaaccagccccatcagaacctgagctattttcctctggccgcagaggtgtaggggtggaatgagccgcggggaagctggctttgaaacctcagggctgtcccagccccggcaagccacaggaaggaggggagagacaggcagcccagcagtgtggagaccctgccacagccagaggagggcagagggagaatccaagggttgagagccagtggcgggtgatggccagcccctggggcccagcccctgtttactggttcttgcaaatgggagctgagcagcctctggacagccagtgacctttgacctcggtgaccactcttctttaagccatagaccctgaggccctgggctgggtgctgggaagggagggttgaaaccaccgtgaaccagagggtgtggctttccaggcaccctcagggagcctccccatctgtccagctggggccagaggctgggagtccctacctgcttcacgttggccggcggctactctggaatgtttttccctccccagaatcaagcttttgcttgatccagaagagcccatatcactaagatggcatatatgtgatctgggcattttcctcctctgcctacagccaggtttagcggcaaacctttcccccttagcaccttcagggctgagttctgggtttctagaggtcaggacggctcctcagagcgccaggaagccagagccccaagcaggacgaaaaagaggcatacacacagcagtgtgaatagcctggccaccagccatcctccctccacctcaagacccccatttgtccgagactaaaggatccagagagcagctccctttctcaggagcttgggcagtgccccagggagtccagggtttctctgcagatgtgcggagcgggaggcggtggtagagagagataaaaggtggagtttctctgttgtttggttcagggattttatttttaattttatgagacagggtcttgctctgtcccccaggctggagtgcagtggcatgatcatagctcactgcagcctcatactcctgggctcaagcaatcctcctgcctcagccttccaactagctgggactacaggtgcgcgccaccgtgcctggctaacttttcattttttttgtagggacggggtctcgttttgttgccaaagctggtctcaaacttgtggcctcaagcaatccacctgccttggcctcccaaagtgctgagattgcagatgtgagccaccgtgcctggccagatttttcttttattcttctttctttttcttttttgctttcttgtcttttcagaagcaagccagacctagcaggctgttccatgttctatttttgactgtagccacagctgctgttctcaggacagcatcccttcccacatgcctgcgcctgctgcctgctgagatgaggaggggagcgtctgggaacttgcgagtccaaggccagtccccatttctgcctcgctcaccgctggcccttagagaccccgaggtaggggtggggagatgcttctctccttgccccccgccctcatgggtcctagcccttccctgagtgcgggctgaggccagagtcaccttttctgtggctggctctaccttcctgtccctgaggttaaacggtgcccatgctgccatcctcaaacgacagaggagcttttctggaatttcaaaccattgctcttagtcccaagctaggcttaaacctggaatctacaagccaaaagtccctccctgcctgagggcagtaccctccattgggcacagtccagacccaagtcaaagatgccccattccttgcgactcagccctcagttccttcatttccaccaggccgtgccttgtttgagtttttcctcccagtgagactgccccacggagacagaggaaagggctggctccccctccccaggctggagacccccccccaactccaggaaagagcagtcagagtccagtgctctgcctcagacgttgcctgagaagaagtggctgccacacccaggggaaggccctgaggcggaggctgtgctccgccatggtgtcccggtaccttccatacacagaggagtgcagccttctccatatctccatggccctgtcccaggccggcccagatgtgtcccccccaggccttgtcctacgtccaaggtggcagatgtcttccctgggctgccaccagcccccgccccagagtggcccaccgtggcactagaatgcaagtatcctgcgaccttgcaacctcaccttcctgtgggtgttctttcctgccctgtccaaaagcgccctcactattcttggaccatgccagattctgcctctctggaaagaggctctggacagcagaagcctccaagcacagagcctggccccaggccccagacagggtgggcttcctgcccttccctctgggcacgcctgctggccgacccactgacccactcggatggaccaacctgctctgtccccaaaggacgcctgcaggagagagcagcactccgcatcacctcaccaaggatcggactctgcccctggacctgggaacgactggactgtcacggggttccctcctagctctcccagtgaactcctgccaggcacacacagcccctatagcactgagctcacatgggactgggatatgggggcatctcttccccagagaggcactcagtgagcctcctgtgcctggccccagcctgggccatctcttaggtgagacagttgcccgaaactaagccaggcctggctggaggagcagcagcttggggagagggatttccctgcagacctcaagccatcatgcggtgggtgctgccatgacagaggctgcacccctgggccagcggggctgctcacccacctcttgtgcaaggtggcctttgtgctgcgcctgcaggcagagctggagcccccagcagaggcaggctgggacggaccagcatctggaagatgtacatagttatttttctctttgtggtttcttgtttggtttggtttgcttttgacagcttcattttatttttgacgtcactttttggccatgtaaactatttgtggcaattttatgtttttatttatgaataaagaatgccatttctcacgccctctagagccacgtgtatctgccctcctctcccctcgctgcggtgtggcagctccctgggacttctccccttggaacaggaaagatgacgtcccttccaccagcgaagggggtgaggaaggcagcacagggcagtgggaaaggggcccccggggtcagacaggcttcagctggcccctgcccccatcgcctaccccgggaccttatctgtgaaatgagaggaaaagggacccagggacaggtgtccatgtagagtcagagcgtcctctccaaaagagagcccctccccacccaaactgcacgccctaccgtctgctcacctcaccagccaactcctgggtctactgcatatggcctcctggcaaaagaccagcatggctacaattgccactgccccagggccccctggtggggcaggtgcagtcaccatcatggccatctgtccagccttcttggttccagcctacctggtgcccccttgacaaccttccctaccatcccgggcccacagcctaggcccagagggctgctgctcaggtggtgggagacagaagggacatgttacgaggaaattgataatgcaaggcagcatagggggcacataaggggcagatgacaaggcctctgcggtggggaaggttagtgtagacgggggtccggggagatgcaggcaggagaagacctggggcaagggtaggacacaagaggagcgggagagaggagaagaccagaaaagtgtctccggggcgggcgttcacacagctccctgcccacctgtgatgggaaaagagcagcaccggggactggagaggcaggagggccagggtgcaggggcccccagagaagctcaactcactgagccaggacaggagccaagttgtgattaacatataagccccagctttgggacaaaggggtcatgtcagacctgtggtaactcttccctgtcttcctcctagacctggcccaggctggtgacctcactaaaacatccctctcactaatcacacccttgggtcaccccttcctgtttaattctagtaggcccagagactcattttaaccaatgggatagagcaggagtgatgctctgccagttttagcctaagcctagaaggcctagcagcttctacttctattctattatttgagacaggatctcactctgtcactcaggcttgagagggcaatggtgcgatcatggcccactgaggccttcacctcatgggctcaagcaatcctcctgcctcagcctcccaagtagctagaaccacgagcatgcaccaccatacctggctcattttttattttttttctggagatgggagggtctcactatgttgcccaggctggtctcaaactcctggcctcaagccatcctcccaccttggcctcccaaattgctgggaatacaggcatgagcccctgtgcctggcccacttccgcttttatactctcgggagccctaagctgccacagaagaagcccaccctcccattttgctggaaaggccacgtagggtaggaggggccacttgtcccagagtctcagctaggtcccgtatccagctgagtgcagctgagtgactacccaggacgcagccgaccccatggggagcagagccttgttccccactctgccctgccacagtccttaccctcagatccctaagcaccgtaaatgaccatgtgtttaagccactgaagtcagggggatctattacatggcataaaaatacatcaccagaatgcctatcagcacgctcctttgcttgccacttgacaagcctgtctccatccaaagggctcagaatgacataaaaaaagcacccctagaaaagcacaaggcgggccaggtgcggtggctcacacctgtaatcccagcactttgggaggctgaggcgggcagatcatctgaggtcaggagttcgagaccagactggccaacatggcaaaaccctgtctctgctaaaaatacaaaaattagctgggcatggtggtg

SEQ ID NO: 13715 - DNA, 125902 bp, Human
  misc_feature (1)...(125902): n = A,T,C or G
tttatgttaagtacttacgtgaaatgttccacctctggcatcatattggtgctcaaaaaatttcgaattttgcagcattttggattttcagatttgagatgttcaacccatatattcatctatctttatatagtatgcatgaattagcagagaaaccaaaccattatccccaaattaaaattttctcccataataaaaatcaaacagtaaaccaaattccggctctgtgacatctttatccctttcgaatgaatttttttcagtagttgcaaacactgggaattagaagaaaagacaggtattttaaacacagggaaactttaatccaaatggaaagttcatattttatccagtgtttacacatagtgtttccgttcccattttggagttaatttcagttatttctggctacaccctagatggcaatggaataatttcatagtgcttttacaacaggcaatatctacgtcagtggatggttcatctaaggtcaacctggttcaggaaagatatgcaaaggagagcttcatccacctcttctcccaaccctacatttccagtggttgttttgttccttctttgcagtggctcccgtcctgtctaatttaagcaaaatttcagtgtagtacctccattaactgatactttttataaagcaaattgggaagccaaaagaataacaggagaatgatcaagatttgagaattaaaaaaaattgaattaagatgcaagtaaacacagtgggagagggggatggcgagtcaattgtatatagtatatgtgtatgtataaaacgcttcttttctgcctcattcactctctttagactgcataagctaaaatgagtaagttctgactcagaaacagggtcaaagatatatattttttctcctttgtcatcaaaagaagacctgaccacgtgcacagtgtataaaggatgccagtgggaagattaactttactgtcaggcattgtaaggaaacagaaactcacatatggtgagatggtaaaggagttcaagaggaattcatggtaatataatatgaggaatggggctacaattgcgtccccaatgagactatagaaggcacacaatccaggccagtgcgatttaacatcatgaaataatctccaaaaattaaaatcaaataaggtagcattttactctcttcttgtaaattttataccattttaatttttactggaggcctgctgctgacaagggtgtttaaaagagatccccctgggtattttagagctccttaactggatggcaaggaccaaataaatgccttgtgcttttctgccccacctgtgcctgcacctgagctgcgcacgcggtggcactgagccctcgactcactcatttgacaggtggaggtgggatggggaaggccggagaccgaccaaccccaaaggcggtagcgtgtggagccgaacgcgggagggggtcggctgaggcggattgaggggggggacgccgaggtgcggcgacaggacgcggaggacgaaagacctcaagcagcggtggccggcaaatgaggtgggcactgggggacccaccctgcgaggaggcgggggcggggacggggggcgcggcgcggcagggcggggcggcagccgggaagccctccttccccgcggcggaggtgactggcgggcggggggcggggggcggggggcgggagacgctctgtcccacgctttcccagcgctcggtggtttaaagatggcggcggcggtggcggcggcggcggcggcggcgttgggggcgcggagccgcgacaggaggagggaaaagcagaatctgtgagtcgcctggaggcagcgcggcggctgccgtgaggaggccgggtgcggagccgccggtggcccagccactcagggccagggcctgggctgggagggagagaccggagcagcgccaggagcccgaggccggagccgaggaggaatgtgaccaggggtcggcgggggcgcgggagtacgcgagagcagggatggggcagcaggtgggccgcgtcggggaagctccggggctccagcagcctcagccccgcgggatccggggcagcagtgcagccaggccctccggccgcaggcgggacccggcggggcgcaccacagagaccggcttcaatatcttcacccagcatggtgagtgtgtctgggagccggcatgagagcgtgggggaggccgggggtggggtcggggcggggtgggtggcggacgggctgcccgaggggtcggagggtggaaggtgcctgagagtgggggcggaatccgctgccatctggtccagtcctgggaggcgagtcacacccctcccccctcgcgtctctagcctggctggcagatcccgggggcggagaaggaaagagaagtgggtttggggaccctggatggtctgtcctctactctgggacgggactatgcggctgcagaaagaaagtgaatggcagcttcaggagagggaaggatgaagggcagtattagctcagtcccagaggtgggagcataaacccgtcgttagtgaaggggaaatgggttgtatcctaagggattgggaaatgggaactgaatttcaggagattgtggagtacaaggtatgtgtttacgttaggtgatgagcagtgtcaggatagtgaactgtggacagtgtcaaatgcttttctgtagggaagatgaagttagcatcatcttatcacttttgacatgcttttgtggtttattttgttttgtatttcgtttcttactagaaatgaaaggctttgccaaagcctctgtactatgcttcagagtaggacacacaattctgagattgctggcaagggctagaggttggtgggcatggttaggacgtcagtcaggatatgaacaagttttcctttgtagtgtgtgcgtgtgcccatatacatacatacatgtatgtatgctccctgtagtctgaaacctattattttgatctcattgtcaatgtatttttagaatagttgtctccaaactttttttgtcttgtttttttgttttgtttttgtttttgttttttttgagacagagtctcgctttggtccccatgatggagtgcaatggcgggatgtcggctcactgcaatctctgcctcccgggttcaagtgattctcctgcctcagcctcccgagtagctggaactgcaggtgtgcaccaccacgcccggctaatttttgtatttttggtggtggtgggattttgtcatatactcctgacatcaggtaatctgcctgccttggcctctcaaagtgctgggattacgggtgtgagccaccaccgttcctggcccaaactcttttttttttttttttttttttggagacggagtctcattctgtcgcccaggctggagtgcagtggcgtgatcttggctcactgcaacctctgcctcccaggttcaagcgattctcctgcctcagcctcggagtagctgggattacaggcgcccgccaccacacccggctaattttttgtgtttttagtagggtggggtttctctatgttggccaggctggtctcgaacgcctgacctcatgatccacccgccacagcctcccaaagtgctgggattacaggcgtgaggcactgcgcctggccacatgtctcctattgaagatgtgcttgagtgtctctttcgggtatatgaacactttatgaaggtgatatatgagctaatctttattaaaatcacttcctaaaacacaggatggaagaatggattagtagtttacagggaagaaatcatccaagtaagcttcactttgtgggaagtgttactatgcattaaacttggcctagtaggcaatggtgatcctcttgctttactatcttattcggtatgtaagattttccaagaaagaggaagtcatgaagaatggaataggaagacattttgaggatttggatctatggagagggagaacaatttgggtagaagaaacaacttgaacgggaacatgggaatagatataatttgttgatgggctagtgaggagacagctgtcaggaatgaagcatcattatgagttggaagaaaaagatcatagagcaaaaattggaagagtcaagttctggttctggctccacctgcctgggtgattttagtcaccatctttgggtttctttatctgtaaagtgaggaggttggactggatgatctctaagatactttctggttttaagattttatgattctaattaagaagcagtagaaagaaaattttgataggctggatgggactgggttatggaaaatctggcagagaagtttatatccatttacctgattggctagtctttacctgaaagactggccttgagtggtggcagtggaaatgggaggagtaatttcaagggtcctttcattcattcaacaaacaagggttttttttgagcacctgttatgtactggattgtgggaatgttgctgtgaacataacagagtccctgccctttggaacttaaaggactttatgatttgatagaggatgaaagaagagagatcactttggagtatttgttaagggcatgaactctggacccatttttcctggatttgaaaccttgcttggctgcttatgagctttgtgacctgggacaagttatttaactttttgtgtcttggactcttcatttgtaaagtggtgataataatagtacctagtattaaatgaatagtggctgggcacatagtatgagctaaatgtgtgtagctgctgccattactaatactactgttattattaaaaacaggagtaattcggccaggtgcggtggctcacgcctgtaatcccagcactgtgggaggccgaggtgggcagatcatgaggtcaggagttcgagaccagcctgagcaacatggtgaaacctcgtctgtactaaaaatagaaaaattagctgggcatggtggcacgcgcctgtagtcctagctactcaggaggctgagacaggagaatcgcttgaacccgggaggtggaggttgcagtgagccaagatcgcgccactccagcctgggtgacagagcgagactttgtctcaaaaaaaaaaaaaaaaaaaaagtagggataattcaaagatgacaccaggatttagaacctggctaactgggatgatgaagattactattgacaagtttggaagttagaagctgattgaaaaaatgggaataggtcgagtttattgccaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgggcatggtggctcacacctgtaatctcagcacttcgggaggccaaggcgggtggatcacgaggtcaggagatcgagaccatcctggctaacacagtgaaaccccgtctctactaaaaatacaaaaaatattagccaggcatggtggcgggcacctgtagtcccagctactcaggaggctgaggcaggagaatggcatgaacctgggaggcggaggttgcagtgagctgagatcacgccactgcactccagcctgagggacagggcgaagactctgtctcaaaagaaaaaaaagttaagtgtaagccagtacactgacctctccatgaacttttcacagtaggaactttaacactttccgcagagtatcctgttcttctaggcttttcatagaatgcgaagttaatggcatgtgatgttccatagcataatctgctaaaaagtgatcatctccttggaagaaaagccgtgggctgcaatcacacatccaaattgacagacatctgaatggattctatatagaaagaaaagattcgtgtcttctggaatatgaatgtccacttttaataaattcaaacagatcctgacataaacatcatgggttttacgtgacccatcatttcatggatccttggcaccaaatctttgggcattgtataacccaacccactgcagtagggaggaaacaccttgaaaggacactcctggtatgaaatacgtttttttttttttttggtaaaatcctctatgggaataattatcaattaggggataacctgtgaaaaacttctctgagtggtttaagtttaaaagatactacactaaattgccagtattgatgaacacataagtgtctgttgtcatgatgtagttggcaatggggcaaaactcagttacccacctgaatgccataataggttgtttttgttgtttgtttgagacggagtcttgctctgtcacccaggctggagtgcagtggtgcgatcttggctcactgcagcctccacctcctgggctcaagcaattcttgtgcctcagcctcccaagtagctgggattacaggcacacgtcaccatgcctggctaatttttgtattttcagtacagatgggttttcaccatattggcctggctggtctcaaactcctggcctcaagtaattcacctgccttgacctcccaacgtgctgggactacaaatgtgagccactgtgcctggccagttttcaaggtcaggtttttgtatgtgtctaaaaaatctcgttggattacatcactataaagaagatgttaatcgtccgaggacagtgctaacagtttgtcttctcttttagcccgttggcctactaagaaaaatgtgagaacctcatatcgccatcaagacttttttcaccccaagtaactctaatggcctgtctggctttcacatctgaggggtgggaggtcactaggataaccagaattggattttgatcagagcagtttgaatgctctcaaaatgtgaagtgaaagcctcatctgtaaattggctcatacttgtaaaagtacatccagtctacatattctgtcacattgtagtggggaaggctgagaggtaccacatcaggaggagagtcaggagtggcagcagcaggagaccccatgtgagagatctcagtgggaagggcagtctggagagccagggccatccacagcagctcagaagcttgcgaactgcaagttcttcttgattgatttcttctgagtgaaaagaccttcagtttcaccagttgaacattcagcagtatgtagctgtcagaaataatgctactgaaaaccagactttcagactggcttaaaatcctgccatatactgcttataaaacacatacctgtagaatttcagcagagattaaagcactagctgaagtttgttttctgtattccatgctttagtcaaaacactcaagatttgctgtgaactactccataaacagaaaaaaagacatggtttggtaatttcttccttggtagattttcctgacaaagtgaccatcgcctaaacaaggcactgtcctgtgcggcacatacccagctcacaagtggcaggcagctggtgctcaacctgctttaaacggaaaacaaaaaccaaacaagaaaaaccagcatctccccaccattgtatgtttttattcctctttacttcagtctctttcaaaatagggaatgataatgtttgtgtagtttttagagcttttgaagaagaccttttatgtctttcatctcacttgacctttacaactactctgaaataggtgaagcaggtattaatcttcccattttgtagatgaagagtttagaaaattaagtgacttcttgaggttacatagctgttaaatgatagagctgggactgatagttttgtctccaagtcttgccataatgtggagatttagagaatgtgggttttaaaatcagttataattggatataaatcttgctttgtgtctgacattggtacatggtttatccctcacaacaggttgttgaaataattaagtgataaaattgtacgagactcttaagtgccaggcactgtggtgctcaataaatatcagttttattgtcattatttacctcaagatgattgtgaagattatatgagttgtatgtgaaaatgttttgtaaacctaagcactgctattgttatcattgtgatggcatgccaaagtgtagaattgccttagcatttatatttattacttcattttctcttcttattaagctactcttattagaggactttcagaaagcagtaaaaggtaagggaattttggggatctgaaatcacaggagaatctgaaatcactttaggtctaccttccttgtaaggtaagtgatatcctctctagaccatttgtctttgtcttagggactgggtatcagtatatgtagtgcctggttcttgtagacatctttttcttccatcaaagaacttgaaccagaaacactggccaatgcaaatttaaagttgatagagacttcattctaagttggcccatttgtttgctggttaatagttaatgacttttttaaatgactttgttgtaaccttcttcatctgacatcctttaagacctttttttttcttcttctctgtgttatttttacctctggatgtaaagtttcttcttaaaggcttgtttaggccaggcatggtagctcacgtctgtaatcccagcactttgggaggccgaagcaggtggattgctttaagctcaggagttcaagaccagcctaggcaacgtggcgaaaccctgtctctacaaaaaatagaaaacctagccaggcgtgctagtgcacacatgtagtcccagctactggggaggctaaggtgagaggatcacttgaggccaggaggttgaggctgcagtgagccataatcacgtcgctgcactccattctgggcgacagaatgagaccctgtctcaaaaagaaaacttgtttagtgtgattatcttcttgaagttgtgagtcagatgggctttttcttaatgtggcactgcacatacagagatttcaaaatacttaagaaccttttccatgttaacagatgtcttctggacgaggtaaatatgtagctacttcaaatcatatagaacagttctgaaacttgagcgtggagagcttgttaaagcagattgctgggtcccacctccagggtttctgatttagggctgaggaggagctcaagaatttgcatttctggcaaattttcaggtgttacaggtgctgctggttggggaccatgctttgagaatctcctgctcatgtgagattaagaagagtacttggcctggtgtggtggctcacgcctgtaatcctagtgctttgggaagccaaggcaggtggatcacaaggtcaggagatcaagaccatcctcctggcctacatggtgaaaccccatctctactaaagatacaaaaattagctgggcgtggtggcgtacgcctgtagtcccagctactcgggaggctgaggcaggagaattgcttgaaccagggaggcagaggctgcagtgagccgagatcgtaccactgcactccagcctgggtgacagagcgagactgtctcaaaaaaagaaaagaaaagagtacttgatcagaggtgattgaatgactgtcagaaaacaggatgtaatgtactaactctcttcaaaactggttcagaaattcatttgttcctagcctattagtgtccacatgcaagtcaccacagtcttataccatttttttggtggtttatctctaaaagttcgtacattagaggtctcttgagagacacatttttgaaaaaaatctggagttatcagggaaaggggaagtagaaaacagttctgctgactcattcttgagcagattgggctacagttcctggaagaattgggtaatgaaataattgccatttattgagggctgtgtgccaggcatgttctaagtactcaatatctgttttttcttttaaaactcataaaaccctcgttgctcaaattaaaaaatattagagaccaaagaagatgggatgtctgtttgtgattctatagttttggtatatgctggtgcctagttaccttttagaatatgtgtgtatgtagttatacatatgtatgtatatatataatacaaagatttttaggtattttttaccccatctgtcttgaccagtgatgaggttttcagactggtagaccagggttagatttgtatagtatgtggctatggattgagtcttagatatatatgatggtctaatgaaggagaggtgggaactcaccataccatttggaatctcatggtaatgttgaactcctgtcttaatctttaggcttagtgttactaatatttcttttctttttttttttttttgaggtggagtcttgctctgttgcccaggctggagtgcaatggcacgatcgaggctcactgcaacctccacccactgggttcaaacggttctcctgcctcagcctcccgagtagctgggaccacaggtgcatgccatcacactcggctaatttttgtgtttttagtagagatggggtttcaccatgttggccaggctagtctcgaactcctgacctcaggtgactcatccaccttggcctcccaaagtgctgggattacaggtgtgagccaccacacctgactgagccacaggccgagcggctctttttttttgagatggagtctggctctgtcacccaggctggagtgcaatggtgccatcttggctcactgcaacctcggcctcttgggttcaacctcggccttctgagttcaagcgattttcctgcttcagcctcctgtgtagctgggattacaggtgcacgccaccacacccagctaatttttgtatttttagtagagacggtttcaccacgttggccaggctggtcttgaactcctgacctcaagtgatccgcctgccttggcctcccaaagtgttggtattacaggcgtgagctcccacgcctggcctccaatcatcttatattagaatctatgtaactggccgggtgaggtggctcatgcctgcaatcccagcactatgggtggccaaggcaggcagatcatgaggtcaggacttcaagaccagcctggccaatgtggtgaaaccccacctctactaaaaatacaaaaattagccgggcatggtggcgtgcgcctgtagttgcagctactcgggaggctgaggcagaagaattgcttgaacccgggaggtggaggttgcaggcccagatcacgccactgcagtccagccaaaaaaaaaaaagaatctgtgtaaccacatgatatatttagcttattattgcaatatgcaacttataaagaccttttcccccaggtgataatggcaggagaatttttaaaaaattttagcttaacactccagagcattttctatttttttattcatttattctgtactaattgcctatgttgatggctctgagagaatttttagatacaatttagacagaactgctatctaaaagaatgttgctgatcaaatagatgttgatgaacatccttacgaaacaactaaaaagagatgtgtgtgtctgtgtttgtgaggatattttgtacaaaaactcttggttgcctttttggattgagtgcataatttcagtatgtaaatttgttgtcattatactaattagaacattttgtcagtattttcaaatgaaattcactcaaattcatggataaatacacattaaatatattactatccaacgtttaaacttagttgcttaaaaatatgaaaacagcacttagcttttttcccacttgctggttgctgtaaatgtgctgattctgccgtggtagaactgccggcttctctatagtgaactctgccattattggcttttgatccagcagaacgctaaagctgggcaggcccaggccatttgtattctcgggtttgctttctagggagaagaagtgttcaaaaacctttcacttcatgtggacaaggtcaaaaaaatattctggagcttagtataatacataatatgtacacatgtaattttgttaacatgtttctctctgtgtgctaattccagcaaattaaaaaaacagtactgagttaggactgaagattaccacttagcattttgtttctaggtaattgctaagaaaacattaaaaaaaactgacaatactaacaagtacaatttgtatcactcatctgttccttataggaaagaaaggttgatacctgaaggtttttgttacagtagctttcttttactcattttgaaattggcacttttcttttcttttttttttttgaggcagagtctggctctgttgcccaggctggagtgcagtggcatgatctcagctcactacaacctctgcctcctgagtagctgggattacaggcatgtgccaccacgcccagctgatttttgtatttttagtagagaaagggttgttagccaggctggtttcgaactccaggcctcaagtgatccacccacctttgcctcccaaagtgttgggattacaggcgtgagccacagtgcctggccatgcatttttcagttgcataaaaatatacaaaggtatctcaaggttaaaaaaataataattcagaagcatatagactagacatgaaagtcccctttgacattcttggcccaatacatattcccttattagaagaaactactgtttgtggttcgataggtgtttcccacacccagccatttcagaacttgctgtgtatttacatatatatgagtatatatattaacacttctcttgccgtttcataaatggcattatactgtatgaattttctccccaatttttttttttttggagactgagtcttattctgttgcctaggctggagtgcagtggtatgatctcggctcattgcaacctccacctcctgggttcaagcgattctcctgcctcagcctccctagtagctgggactacaggcgcccgccaccacacccggctaattttcgtatttttagtagagaaggagtttcaccatgttagccagtctggtctcaaactcctgacctcaggcaatctgtctgccttggcctctccaagtgctgggattacaggcatgggctactgtgcccgacccacaatttttgtgtgtgtgtttatttatctggaaggtctttctattccagtatttgtagatttctcatcctttttgacagctttatagtgtcccatgctttagccatatatttaaccactttcttattgatgaatacttgtttataagaatatttaaatatcttctccatctttcctgtgttttttctttatgtttgtaatttgaatccatccgaagggtatatatatttgagcttggaacaaacagtgtttttccattgtattaatttgtgaatagtccatcaattctccactgatttgaaaagccatatttatcatatattctcatatatatatatatatatatatatatatatgtcattttaaaactgttgttccattgatctttgtctcctcctgcacattgttaatatactattttaattattgtaagcttatatagtgtgtatgtgtatgtggttagctccccaatcattatgttgttcttaaaattttatttagatgttgcatcttatatcttccaaagatctttaggattatgttgttaagatttaggagattttgatggtcatatcaaattataggttaatttgggggtgaattgatgttgcattattgtgtttttatggccaagaacatgacatccctttgccagtccaggcagatctttttttgcccctcagtaaaatctttttcattttcttaatcttgtttttggacattacttggtaggtttattagtgggcattttatgatttttgttgttaagtataatctttcctaattgcttattgctaatgtataggaagccttgattttgtatgtccatcttgagtctaggtttggttgccttacttgtattgcatctaataactttgtactgatatttttattttattaaaactgatatttctagataatttttttcttttaagagatagggtcttactctgtcacccaggttggagtgcagtagtagcatgatcatagctcactgcagcctcctgggctcaaacaatcctcctgcctatagcaggnnnnnnnnnnnnnnnnnnnntgggactacaggtgcccgccaccatgcctggctaatattttttgtatttttagtagagacggggtttcactgtgttagccaggatggtctcgatctcctgacctcgtgatccacccgccttggcctcccgaagtgctgagattacaggtgtgagccaccatgcccagccacatcttctttaatagagatacaattatataaagtaataagtataacaaagtatttataggtataaatatatagccatatatagatatcattggtataacaatattaatacaaaaggagaaagagggaatagtgctatataagaatagtatttcttttttcttttttctttttattttttttgagatggagtctcgctctgtcacccaggctggagagcagtgcgcatcctggtaatcctagcagtttggaaggctgaggtgggaggatcacctgagcccaggagtttgagaccagcctgggcaatatagtgagaccctttctgtatttaaaaataaataggctgggcacggtggctcatgcctgtaatcccatctctcagggaggcagaggcgggaggatagcttgagcccaggagtttgagacctgccttgggcaacatagcaagactctgttctccacgaaaaggaagaaaaaaaaagacaaaaataaaaataagcgtaaaaataaataaataaatacaaataagctaattgagaagtactgtaataaaatacacattatgtttcaaaactcagtatggaaaaaatgaatataaagtactgcattaatttttttatattgattacatgttttaaataatattttagatagacatatatataaaaattaattttttgaatttaaatttttgatgtagttactagaaaaagtaaaatggcatttgtagcttgcattatatttcttttttttttttttttttgagacggagtttcacccctgttgctcaggctggattgcaatggtgtgatcttggctcactgcaacctccgcctcccaggttcaagcgattctcctgcctcagcctcccaagtagctgagattacaggcttgtgccaccacgcctggctaattttgtatttttagtagagacagggtttctccatgttggtcaggctggtcttgagctccagatctcaggtgatcctcttgcctcggcctcccaaagtgctgggattataggcatgagccaccacgcccagccagcttgcattgtatttctttcttttttttttgagacggagttttgcccttgttgctcaggctggagtgcaatggcacgatcttggctcaccacaacctccgcctcccgagttcaagcaattctcctgcctcagcctcccgcgtagctgggattacaggcatttgccaccatgcctggctaattttgttatttgtagtagagacagggtttctccatgttggtcaggctggtctcgaactcccgacctcaggtgatccacctgccttggcctcccaaagtgctgtgattacaggtgtgagccaccatgccctgcccagcttgcattatatttctaatggacattgctgctttagatggtaagacctgtgagaacaggaacttggtcttgttcacccttgtagtccctgtacctttaatggtgccaggcactcagtagtatttaaatgattgatatattcagcaagtaggatgatgtggtttggctctgtgtccccacccaaatctcaccttgaattgtaataatccccacgtgtcaagggtagaaccaggtggagatgattgaatcatggaggcagtttctcccatgctgttctcctgatggtaagttctcaccatgtctgatagttttataaggggctttccccttcacttggctgttctctctcctgctgccctgtgaagaggtgccttccaccatgatttcaagtttcctgaggcctccccagacatgtagaactgggagtcagttaaacctctttcctttataaattatgcagtctctggtatttcttcacagtagcgtgagaatggacaaatacataaggagagagtattttcctcattgtacactcagagatattgtacctggcatgttacagtgcagattttattccacggaggtgctttgaactaatctgagttttctttgcagttattgattggtaaacagttatttaaatttttttttttttttcgagaaggattcttgctctgtcacccaggctgtggtgtgatcttggctcactgcaacctccatcacccgggttcgcagtgttgaacaggctggtctcgaactcctgacctcaagtgatccacttgcctcggccttccaaaatgctaggattacaggcatgagccacaatgcctggcctaaatttggttttattctcctgtatatgtttttcctttgattactgtatttttagtttaattgcacttataaaaattttatttttatttttattttttgagacgggatctcactgtgttgctcaggctgaagtgcggtggtacaggctcactgcagccttgacctcctaggctcaagtgattctcccacctcagccccctgaatagctgggactataggcacataccaccccacctggttaaattaaaaaaaaaatttttttagggattacatctcttttgttgcccaggcagatttcagactcctgggctcaaagcaattctcccgcctcagcctcccaaagtgctgggataacagatgtgagccagcaggtccagcctaattgcacttttaagtcttagactgaaaactttatgaaatcctatcttcatcactatatgtcttgttttctgttttattttgttctttcattgaccctgatatttggaaaaattctaatgcttttataagttctttgatctaattgtttcaagtcttctgtttcctgaaattattaactatctttaaagagaaaagtcatcttggctatatgctgtggttgtcaaggtggcgtcagctctgagcaaatatttttccaagcttgcaagcttgagtattctcaagtctgaggtcatgctcatctatttatatttaaatatttattctttcttcctggcagtatatgaaatatttttatttttatttattattattatttttttgagacagagtcttgctgtgtcgcccaggctggagtgcagtggtgcaatctcggcttactgcaacctccacctctcaagttcaagcaattctcctgcctcagcctcccgagtagctgggactacaggcgcccgccactaagcccagctcattttttttgtattttgttgtagaggtgaggtttcactgtgttagccaggatggtctcgatctctgacctcgtgatgcgcccacctcggcctcaaagtgctgggattataggcgtgagccaccacgcctggcgaaatatttttatttttatcctttaaaaatttttctcttaaagcttttttttttctttttttttttttttgtgagttagagtcttgctctatcactgttggagtgcaagtggcatgatctcagttcactgcaacgtccacctcccatgttcaggcgattctcgcctcagcctatcatgtagctaggattacaggtgtgcaccaccacgcccagctaatttttgtatttttggtagaggtggggtttcactgtgttagccaggatggtctcaaattccttacctcaggtgatccgcccacttcagcctctcaaagtgctgggattataggcatgagccaccgcacctggccggtgttgttttttaaaatcattttttttctcatttaaagtatttgcttttaacatatttctgtcctggtacagtggctcatgcctgtagtcatagcacttgaggaggctgagggggaagattgcttgaggcaggagtttgagaccaccctgggcaaaatagcaagacccctgtctttaaaaataaaattaaaagttagctgtgtgcctgtagtcctagctactagggaggctgagttgggaggattgcttgagcccaagagtgtgaggttacagtgaggtgtgattgtgccactgcactccagtctgggtgcagagtgagaccctgtctctaaaaacaaaaataaacatgtttcttattacttgaaatgtttggctgcagtttaagagctggccattttgggtcatttctctgaatctctgaatttctctgaatctcctgctggtttgtttttctttttcctgagagtgagtatttgtatgagggtgttggttgtttttaagataaaatttttgattttggtagctagagagacataggtataaaaatttagaactggaagagactgtagaagtcatatattctaatatatttgaattacagatgggtaaatgatacttgggtagttgaaacaagttgattatggacccatagcttagcagtagatgtatggggagaaaaagtagttattttttcctcatccattgctaggttcatggctgagaccactacagcaaagggcagattagtgagaagaacatacaaatttatttaagttttatgtgacatggagccttcagaaatgaagacccaaatcaacagggaaacttatgtaattttatgggttaggtttgatggagagtggacagcgtgtagaagtctgatggacagagggagaatgatctaatgataataacctggggggaacttagcaaggcttgtttggtcatagtcttctcaatgtccctgtgtcttcagagataaggacattcctttcctctgagtaaagggagggtacctctggaatgagggtcttataacctacttcagagaagaagatgagataattcttctatggtctgcttcagaggagaagggctggagaaggtcagagagacctctttgcttctgctgtttcctcaaatgccaaggtgctgtattttggactagtgtgccctgaacccagtcttagagcacagaaagactagaatctaacccatttttctagatttagtttctagttattttttgttagtgcctattttttgcttttggtagtattattacatcattgagcatttatgtgccaacatttctgtaaactttatctcatttaattcttagctgataaatgatgaaaacagttttcagaacaaggcatataactccaaaaattacactcttaactgttgtgctttagtggtagaatggtttagggattgggtgcttgtgtgtcagacacattatcctactacttcatttaatcctcagaactgctctaagagctgaacatactctctggctttacagacaaggacatttggctaagagagattgtcttctgccttcagaccacacagctagtaggttgcagagcttgattgtaagttttgttgtttcccaattctctgctacatctgaggggagatatccctcattgatattccggtcttcccaaagccttcatgataatatgataagagaaaaaagcaaatgtatacatgcagccataaaaaagaacaaaatcatgtcctttgcagcaacatggatgcagctgaaggccattatcctaagtgaattaatgcaggaacagaaaaccaaataccctgtgttctcacttataagtgggagctgagcattgagtacaaatggacataaaggtgggaataatagacactgggaactattagaggggaaggaatggggggggcaagggttgaaaaacctgttgggcaccgtgcttactacctgagtgacaggattattcgtaccccaaaccttagtgacacacaatttacccatgtgacaaatctgcacatgtaccccctgaacttaaaagttgaaaaaatatatatataacatatacaattcactttattaaaggttaataaatataactgatttatttttaggctagtcttcgtgtactatttttgtgcctttctcagatattttgtggacttgagtctgaagtaaatatttataaagggaaagtagataactgctattaccaggaaaatacttattcaaaaaaaaaggatatttaagagataattagaatgactttactgaccttgttttcttacactaataattcatgaagcatttagattttctgattgagtgttttctgtgacaatatcagtcagagatgtaatcatttataaacatgctgttaatggcatggactctggtgtcagtctgtgtgggtttagatcctctgttaaatttctgattttggtagcttgacataggtataaaaaaatttacaacctgaagagaccttagaaataatgtattcctgggcaagttattcattcgctatgtgtcccttttctcaccagtaaaataggtatgctaataatacctacctcatagagttatgagaattaaggaattattacatgtaaaattctcagctagtgcatgattaatggtaagtactcaaaaagttatagctgttattgttttttaaacattattttttaacatttttattggttgaaataggtttcagacaattgtaaataaattttaaaaaattaaaaaatgttaaggctgagagaattttgagaccttaatacaaggtagtatattgtatcaggcttgttctgtgcctaggcttaattaccagatttctgtgcttctggacttataatgtatagttgtcgttttaatgctaacattctgattggatacgtccagcacttcacttgggtaaatcacaatctttctttcctccctcacaaaggacactttgaaatgatcctaaaataccttcttattcagatagatagaacagctagtggtagaggccctaacaaaaaaaaaaaaaagaaagaaaagaatggagaatcagaggagctgacttcagaaggtaatggaagggactgttgttatgtgggcatactggggatcacgacactccatggacaggcatcaccgtacagctgtgcctgttggaaactggagctggcaagctattagaaattaagactgcatattctgtctctctctttcaggaactgcaaggtttggcatctctttttcgctctgtacatctgttcagttttcctttcttccagctggctttctcagtttcagcttgtatgtggagtgtaatggctgctcagctcctttatcaagagaattctcaatctatcctttcggcatttatccctgctgctaaatggctgagttttttaaaaaaatttaaatcatttgtttgtttattgaagggtcagtacatttatgtggttcaaaattcaagagatacagtttgaagtcttcctgccactccttttcttcagccacccaaattttggcaatccaaatcaccagttcgttgtatatactttcagagatatattatgcatgtgtacctgtatccgtgtatattctccccattctttttttttccccctagatggatgctattatatagcttatgttggacattctttcatgtcagtaaataaagaacttgcttttttttttttttttaaatggatgcatagcatttcattgtgtggatgaattatataattactttgttttcagttttttgctgttgtaaacagtgtcctagtacaaaccctaatatgtgtcattttagacatgtgctagtatggctatagaataaatgccttgaatttggaattgcttatagaaagggggtggggatttcagaataaccatgtgttgaataagcttttatccacctttttgtatgctaaatcctgtgtgcatttgattctatttctgcactttatgttctcttaatttgcctgtcaaataatgtgccaatatcacagttttaattattgtacttttataatgtacatgtatacattataatgtataatggtagttaagggtatagacttgaactaagctgcctagctttgagtcttgtctttatcactttcttagctgtgtgaccttgggcatgttattcaacatccctgtaattcaatgtccttatttgtaaaatagagatgataatgatacctatctaatagagggctgatgcaaggattaaattagttaagctatataaagtgcttagaaaagtacttagcctgtagttggtgttgtataagtattaggtctttatttttttgctgttattggcagggctagttcctcttcattgttattttttcagaatattcctggctgttcttgtttgcttacattttattttaactttagaatcagttggtctgtctaatcaggatagactaggtaataagttagtatccacaacaacaatcccccttacccgccctccctaatctcagtggattaacacatccaaagtttgtcacttgtaatacatgtcccatatggatcaggaggtgggtcttaccccctcagaccccccaaaggaggtgggaggtgggctatacccattttttatcacccagagacccaggctgacagagtcttcaaccatcgttctagaaagctggcagttagcattgcagagagaaacagagtaatgagtcaagtactagtggaaactaaaagccagaagggatatatgtcacttccttttatatctcactggccaaagcaagtcatgtggtctcatgtaatgccggggggcatggagaaagtgtagttttgttatgtgcctgggagggcagctggaaatatttgatgaagagttgtaatgggccgggcgcagtggcttatgcctgtaatcccagcactttgggaggttgaggtgggcagatcacgaggtcaaaagtttgagaccagcctgaccaacatggtgaaaccccgtctctactaaaaatacaaaaattagctgggtgtggtggcacacacttgtaatcccagctactcaggaggctgaggcaggagaatctcttgaacccaggaggcacaggttgcagtgagccaagatcacgccactgcactccagcctgggcgacagagtgagactcagtctcaaaaaaaaaaaaaaagaaaaagagttgtaatgactttgctctgctggttgctaaatatttgggtcacccattatgttacatgcagcactctgagccccttcgttggagacactactcatgtttctatctagtaactacatttatctgaaactctagaataaccgatgtacagagtctattaatcagattcagaggaggtttctcttggtctagacaactgtgaatgaaacaaataagttatcagttggtctaaaacaatcatcttagtttttttgtgtgtgtgtttgttttgctttttgagacagggtcttgctctgtcacccaggctggagtgcagtggcgtgatcttggttcactgtactctctgcctctcaggttcaagcgattctcatgcctcagcctcccgagtagctgggattacaggcatgcgccaccacctctggttaatttttgtattttttagtagagagggggttttgccatgttggccaggctgttcttgaactcctggcctcaagtgatctgcccgcctcggcctcccaaagtgctaggattacaggtgtgagccaccagacccagctcatcttagtatttttgtaggttccttgctgggtgggagtagagatgcggagggaactttcacttttaactctgcatatgtctgtgttatttgaatatttttttgcagtgagcagatagcatgtaaaaggaaatattttgccggaggtggtggcttatgcctataatcccagcactttgggaggcagaggcgggtggatcacctgaggtcaggagttcgagatcagcctggccaacatggcaaaaccctatttctactaaaaatacaaaaattagctgggcgtgatggcgcccacctgtaatcccagctactcgagaggctgaggtaggggaattgcttgaacctgggaggtggaggttgcagtgagctgagatcaggccactgtactccagcctgggcgacagagcgagagactccatctctaaataaataaataaataaataaatggaaatattttaaaagcctaaaacttttaatcctcacatcagctctttctattagataggtatcattatcatctccgttttacaaataaggacattgaattactgggatgttaaataacgtgcgcaaggccacacagccaaggaagtagtaaagagaagggtcaaagagccaggcagtttagctcaagtgtactgccttaaccaccaggctatgctgcctgttataaaaatgcagtatttaaaacagcgtgatactggcacgtaatttgacaaaagaattctcttatcccaatttcatactaaatgaaataatgtatagcatgtggggccagagctggaacatgagacctgagacctaactgtaagctattgcctaccaagatgcctttcttaatgcatgggcttctttgcatagcttgttacaataatacaaatagaggttattttttttttcttatttgcagtgaacatagcaacaaaaaaaaaagactgtttactttgagaagaatgatctttgggataataatacttgaaaatgagggatgatccaggaaagttacctggagaggatgacctcagtgagagggcagtctgtactgatagggagggtgatggtgcatactaactggtttccaatttgaagatcttttctggagtacttagttgtattttatttattttgatcactgagttttaaggaaacagcttacaaaggcaacagaagagaggaaaaccttcattctttgtgcaagtataaaatgtttattaaaacacagagattttgttttgacgttaggaaatagaaaaaatataagccatttatatactacattcttcctttacttctctgatgggaaatgaaaaaaatgatttgttctttttacaaatgcagtatgttttattacgggaaaaaatcaagcaaaaactaaaaacaaaccccatacccactttcctactgggagacaacaatctaataaaagttctggggtgtatccttttaagcctctttgatgtgtgtatcattttgtattgctaaccaaaacatatacaaagcaattttttgttgtcatttttcactcatgtattttgaaccttctaaactggagatcttaaattgaaggagaaagggtttttggtggttggtttttgtttttacctctttttagaacttacttcacatttatttcttttcacactatttaacatccagtacttttgtcttacaatttttattgttatttgtttcttctgttagattcagttccttgaaggcgtctgtattcttcattctgttgagctcatattaagtttacatgaggacaggacatatgttaacagaagtgattgtaggggaaaaaggcagaagacatttcagcagttatttcagggtacagatcaatcactgattcacttacagtccagtgttacttaatttgctggtgtaaccaaaaactaaggaagtacacatttgtatacaggtatttaggctcctttcctattttttaagctgaggtaaaatattcttgtgatgttaatttttttatgtgacctgttgaacagaacatactcagtctaagatactgttaactattgaaaacaaaaatgtgtaggaggacagcaaggctaattccttttaaaatgtcatgagttaatttcttttaagaagagggaagcgtgggtttcctgactagtttttaggtggtgatttttaaaagaatagcacttccatattgttagcagctaatctggaaatttgcatattaattggtaataagcagaaataagagccaagattttcttttctttgctgaaaaagtattaatagttaccaattctgttacagtatagaagaccaataatgatatatatgttaaattgcatcaaatgatatttatcccagtgtgctgagattattttttttttttactatctttaaatctttttttttcttttgcctcaaaaagtgacatttattcaaagaaaaaaaaatgacaagatgtccatcccttggctcccttccctcccctctcctgctgttcctcggacccctgagattgagccctggctggggttgggtggcaggacagcccctcagatgaggtcggcaacattgaggggcatttcctcaatggaggtgttgtagagggtcttgatgtctcaaagagtccttttgtcttcttctgtcaccatgttaatagccacacctttatggccaaactgtccacctcaaccgattctgtggatataattttccctattggtgggaaggtcatagttgatgactaaagaaacttgctgcatatcaatgcctctgacctacgtcaagaaagacaactcttcagcatgtgcacaagaggacacgctatcccgaaaggaagactcttgggtatccatgtaggcagccaaggaaggcagaggaaataaccagccctgttccccaaatgccttaggcatgccagattctgttccaggttgctactttcctgagaggggcactggatgttccccttggagagggaatcaccttggattactatctttaaatcttaaagggatttttctcatagatattctacttaagtatagacaaataatttaatcatcccataatgtatccaccatatttgtggcttgtaaaagttttaaaagttgggcataagtagctgataagttacaaaaagatacaaatttcaataaggtaattttagttaaagtgacaggaaatgggggtgcattttgaatagaaaaacacagaactccaaaaacaagacaaaaaaccatgttatttccaaagagaacatctcagttgtgcagaaagaattaacatagcaggcctgattgagactgatatgcttagcgaggtctgcttgcaaggttggcccttggctggcatctaggaacttagatttggggagggttcctacatttccagaaccaaaaagagtggcccattgtgcctaagctgtttgtataaacaatgtggtttatagagaacacctttctttctgggagtctggaattttgctgtgtagtaggcagagggtgcttatgtgatcaccccctaagaagaaccttggagacagcattttacacatgttgttttaattcattgctggaggaagtaagtatgtcttgtgtgactccactgggagaagacttggacacttgcgcctggttttctctggacattgccccatgtacctttttcctttgctgattttgctttatatccctttgctgtgataaagcacggccatgagtacaactatgtgctgagttttctgagtcctcctagtgaatcatcaaatctgagggtgttcttgaagatttccaatacaatagtggatcagataagtttataattggaatctccatgttcatacaaaatctctacatggaagctttcaatgggtaggtagcattttttgggtttaagttgtgcccaaatggggtgggagatagaatatgcgaaactaaaagtttgggatctgaaggagagaaaaaaaggctcttaatttgtgactgaaaaacttctgtttaacttttatctttgtgaaactgtaccttgctgtctagctatctgataaggttctgtactgtatagaaatatattattcaggaaggagaactgaaagtgcgacaacataaatgtaactcaagaaagcattgtgggccaggcgcggtggcccatgcctctaatcctagcactttgggaggctgaggcaggcagatcacctgaggtcaggagttcaagaccagtctggccaacatggcaaaaccccatctctactaaaaatacaaaaattatccaggtggagtggtgtgcacctataatcctagctactcaggaggctgaagcacgagaatctcttgaacctgggagatggaggttgcagtgagccaaggctgtaccactgcactctagcctggaagacagagggagactccgtcttaaaaaaaaaaaaaaaaaaaaaaaaggcattgggggccaggtgcagtggctcatgcttgtaatcctagcactttgggaggctgaggcaggaggattgcttgagtccaggaatttgagaccagcttaggcaacacagtgagaccctgactctaccaaaagttaaattttggctggcatggaggtacatgcctgtagtcccagctgctcgggaggctgaggtgagaggattgcttgagcgcaggagttcaaggctgcagtgagccatgattattgccactgcactctagcctgggtgacagagagagaatctgtctcaaaaaaaaaaaaaggaaaaagtgtatgggttttggaactagatagatctatgttaaaattctggtattaactgtcattgtttaattatttcttcatttataaaatgaggataatgcctgctgcatagggtggtttgagaattaaattagatactgtatataaaacttctaccactatatctttcatataataactcaaaatgttagagtacatgtgctgtgaagatgtagagagattggagaagtttaaagggggagaaaaagagagaaggtaaagtttgtgtttctcttctgtttattgtttgatgtgaggttgcataggaagattagtaggagagaagaaacattaagttttggaaaatggaattttaaatggatctccacaatcacccactgagactttttatagtttaagaactaggaatatcataaatacaaagtcatttagaggatggaagaggcatagaaactgtttccatacctttacagtgaggttgtcatgaattattgacacctgtgtgttagtaggtttcaataactgatttaaacacatccaacctcattccctcatcacaaatgcttccagataataatgggataatttgccaggtgtggtggctcacgcgtgtaatctcagcactttgggaggccgaggcgggtggatcacctgaggtcaggagttcgagaccaggctggccaacatggcgaaacccccatctctactaataatacaaacattagctgggcatggtggtgtgtgcctgtaatcccagctactaggggggctgaggcaggagaatcgcttggacctgggaggcagaggttgcagtgagccgagatcgtgccactgcactccagcctgggcaacannnnnnnnnnnnnnnnnnnnnnnnnnnnnnnnnnnnnnnnnnnnnnnnnnnnnnnnnnnnnnnnnnatgttttcatgtttgaaaagaagtggcatcttgaaacagtaattgtgtgtgattctggtatatgtggctttgtttttttttttttttttttttttggagatggagtcttgctctgttgcccaggctggagtgcagtggcgtgatctcggctcactgcagcctctgccccgctggttccagcagttctcttgcctcagcctcctgggtagctgggattacaggtgcctgacaccacgcctggctacttttagatttttagtagagacgggggtttcaccatgttggccaggctggtctcgaactcttggcctcaggtgatccacctaccttggcctcccaaagtgctgggattacaggcatggccactgcgcctggcctgggtgggttttttaaaaataactttttaatcttgaaatagtttcaggattacagaaaagttgcaagaatagcacaaacaactctcatgtgctctttgcctagattccctaattgtcaacattttgtctcatttattttatcgtattctctccctctttacctttccttccttttccttctcttttaaactaggagtgtgtatcaaaatcacctggaaaacttttttttttttttttttggcacagggtttcactctgtcatccaggctggagtgcagtggcgtggcacaactcgttgcagctttgacctcctcaggctcaggggaccgtcgcacttcagcctgtcaagtagccgggactatagacgtgtgccaccacgccagctaatttttatatttttagtagagacatggtttcaccatgtttcccaggcttctcttgaattcctggactcaagtgatccgcccgcctcagcctcctaaagtgctaggattataggtgtgagccactgtgcccagcagaaaacaattttttttttttttttgagacagtttcgttcttgtcacccaggctggaatgcagtggcgtgatctcagctcactgcagcctctacctcctgggtttaagcaattctcctgtcttagcctcccgattagctgggactacagtcacatgccaccacgcctggttaatttttgtatttttagtagagacaggatttcaccatattgatcaaggtagtctcaaactcctgacctcaggtgatccaccctccttggcctcccaaagtgttgggattacaggcgtgagccacctcacccggccttttttttttaattttttttttttttttttgaaccaagcaggtgtattctggaagaaaatcagacaccctccctggttaagaattagttaactataatgtattggtgaattgagtttatagtcttttggtgggggtaaaagggccctcaaagtcatagcaggtttagttgtacagccttgaagagtatttgatttgctctttagctttttcaatatatattttttattatcccttgggtgccattgttgctattgagaaactgtcagtataattgtcctttctgtagacaatctgtcatttctatctggtggttaaatttttttttttgtctttagtgtcttgcattttcactggaaagtgactaggtatagatttcttattatcctactagcaattttttgtgcttccagaaactacagcagtttttggaaaagtctcagcaattatatcttcaaatattgcctcgttctcatttttcttttctttccctcttgaatggtatttagatatgttggacattctattctgtcctcatgttgcataacttctgtttgatatattcaatttttgtatcaccatgctacattttgtgtattcacagtcatctttagctgagctaatctgctatttgattcatccattgaactaatttcaattattatgtcttttatttctgcaggttctgtttgattctctttaaaatctggtcttataaaaaaattgtggtaaaatacatgtaacataaaatttaccattttaaccatttgaaaatgtacaggtcagtggggtttttttttttgtttttttttgtttgtttgttttttaagactgagtttcactcttgttgcccaggctggagtgcagtggtgctgatcttggctcactgcaacctctacctcctgggttcaagcgattctcctgcctcagcctcccgagtagctgggattacaggcacctgccaccacacccggctagtttttgtatttctagtatagatggggtttcgccatattggccaggctggtcctggaactcctggactattctattccaagttgctacttcctgagagggtcactggatgtcccccttggagaaggaatcaccttggattaccatctttaaatcttaaagggatttttctcataggtattctacttaagtacagacaaataatttaatcatcccatagtgtatccaccatatttgtggcttgtaaatgttttaaaacttgggcataagtagctgataagttacaaaaaagatacaaatttcaataaggtaattttagttaaagtgacaggaaatgggggtgcattttgaatagaaaaacacagaactccaaaaacaagacaaaaaaccatgttatttccaaagagaacatctcagttgtgcagaaagaattaacatagcaggcctgattgagactgatatgcttagcgaggtctgcttgcaaggttggcccttggctggcatctaggaacttggatttggggaggaactcctggcctcaagtgatccgtccacctcggcctgccaaagtgctaggattacaagcgtgagccattgctcttttcatactgttgtgtaaccatccatcactaccatataaccatacatgaccaccatccatctccagaactcttttcttcttccagactgaagctctgcatctgttaaattataattccccgttttataatttcctctagcccttggcaaccacattttactttctgcctttatgagtttgactactctaggttcctcatataaatggaatcatatagtatttgcccttttgtaactggctcatttcatttaacttaatcttcaaggtacatctgtgttgtaacgtgcaggagaatttctttttttttatttaagggctgaatgatatttaatggtgtgtatgtagcccattttctttatccactcatctctttatggactactttgattgcttccactttttggctattgtgactaatgctgcagtgaacatgggcatgcaagtatatctgagttcctgctttcaattcttttgaatatatatatacagaagtgaaattgttggatcatacagtaattctatgtttaatttttctgaggaaccaccatactgtcttccatagtggctttaccattttatattcccaccagtaatgcacaagggttctagtttctccataccctcaccaacatttgttattttctgtgttcgtgtgtgttttagtaatagccatcctaatggctgtgatgtggtatctcactgtttttttgttttttgttttttttgagacagagttttactgtgttgcccaggctggagtgcagtggtgcgatctcagctcactgcaacctcagtctcctgggtcccagcgattctcttgcctcagcttcttgagtagctgggactacaggaatgcactgccatgcccgggtaagttttgtagttttagtagagatggggtttcaccttgttggccaggctggtctggaactcctgacctcaggtaatccacctgcctcaggctcccaaaatgcagggattacaggcgtgagccaccatgcctggcctctcattgtcgttttgatatgcatttccctaattattagtgatgttgggcattttttaacaagtgtttattggctatttgtgtatctgttttcgagaaatttttaagtcctttgcccatttttgaatctgtttgcttttttgttgttgacttgttggtctttgttttatagtgccattttcttcttactatcattaccctctttttttctttaagcatattaaacgcaacatatttgttcctgagtaaccagttattcccaaatttagcagcttaaaacaaacgacatttattctgagtgtcagaaatctgagagtggcttagctgggtggttctagctcagggtctctcacaaggttccagtcatactgctagctggagcccttgtattcttcagtggattttaattatttgcagaaatatgaagtgttttgtgtgtagagttttaatatgtgtgtaaatagtgtgttgataccttaaaaattgttttttagaaatccttattccatgttagcagaaattatatgatatgtaaaaaaatcattttcaagcctccatcagtagtttctcaaatttatctttgataacccctggctctttaggaagcactctacttaatgttcatgatttgattgttgacatttagttcagtgaagtagtttaatttccataaaaacttcctttgcccgttaggaaactattaaggatgattgatttttcacttactaaattcgtgctcatgtaacaagattcttgaaagaggttattgtatttgaaacactggaaatggtatttgtcaaaaaaaatgtgtttctaccttgtaggaccttcactgtagtcaaaattatgaaatttatgaaaactaatgttaactctgttttgaccatgggaaaaaagatatttaggtgagattataaaaaagtgaatttattatgacagagtttgattagtaagtcaaaaaactgttcctcaccagtccactaggggatactccagtacttaggaagaaaatccagttgttgctatcacttaaaaatttggccaggatcgagaccatcctggctaacaaggtgaaaccctatctctactaaaaaaatacaaaaaattagctgggccacatggtggcgggcgtctgtagtcccagctactcagaaggctgaggcaggagaatggcgtgaacctgggagatggagcttgcagtgagccgagatcgcgccattgcactccagcctgggcgacagagcgagactccgtctccaaaaaaaaccaaaaaaacaaaatacaacagcaacaaaaaattaggccaggcacggtggctcacacctgtaatcccagcactttgagaggccaaggagggtggatcacttgaggtcaggagttcaagactagcttggtgaacatggtgaaaccccatctctactaaaaatacaaaaaattaggtgggcgtggtcgcaggcgcttgttatcccagctatttgggaggctgaagcaggagaattgcttgaacccaggaggcagaggttgcaagtgagtcaagattgcgccattgcactccagcctgagtgacagaatgagactctgtctcaaaaaagaaacaaacaaacaaaaaattaaatcccacttgcttacctgaaaaaaaaaaaagcagacatttagggctggtttgagttactgatttgacaataatattcacctttagaaagaacctagtacatttttaaagtttagaaattttgtgtgatttcattggccactttttctggtagtgttgccacaaattgacttctttgggcactttagaaaaacagattattatattttttttcttgatacatgaaaattatggttctcatttttttttgcaagttgtgcccttttttggaaattcagaaaggctgatatttggtgtgagtttgtataattttctccatcataccatgtatgctgtttaaatgtttaccttagaaaagtatgaaatatgatatgacctttgatatagacaacaacgcagaagataattcattctgttaccaaagatattttaagagtttaatgttatcttgatttctttctagtaatttaagtagtaattcaaatagacataatacagtgtgacttaatgctttaaagaaaaatacgtgaaaagttctgtacttgaaatagcaaaattttaagaaaataattcagactcttgtatttattaggaagaagttatcagacttaatgtttcagaacatactttgaataaccaaaatttattaatttacttaacctagttttaaaattttttctatgtgatgtgattgtacagtttttctgcatgccatgtgtttcattcttttatgtctggcacataagtaattaaaggttaagtcaattgtcagatttaactcaacctgcttgagttaatttacttgatttttctggtacttacaggtacaacaaatgggtgaattggtgtgccattatgataacatgacttggaaaatggaaattcaggcagtgtgggacaagaacaaggatatttatttgtccagtgagaataaaagtggtctaggatttattgagagtttgttgtaattcgagcttgagtgataattttataggatgttatggagataacagtgttggtggaagggtttgacattccacatttgacattctcttatcatattttttggtttgtctctgtctccctaatgaaatgaaataggaaacagctagagagtggtgggatatgagtagttgtgcatttggatagattgactagcatgctcaagatgccagccatatctacctttggtagagtgagagccaaggtattcctgtggattgtttttcgtaactaaatctgtaactactgagtatagagtccctgctatatacgtgactaaccaaggagtgaaatatgattggttcaaatattttgttatattttgactgtaggggaatggtaaaatgtcaccaagtataagttactcttctgctttatactttgtttgcaattaaatgtatttttcttaaagagaatataaaagcaaaggaaaaaccatttgtaatgcttttgcttaggtccaaccttaatttttatatgacagtttccaattgattgtcagattttctgtctcatttcaattgagtaattgttccatctgtcatttaacatgacacagactgtttcttagtaattgttttgaaaactctttagtgatttttaaaaacctttacagagtgttgattatttaaatgatagcagaatatgtatatatgaagtaatttcagaggccggacaaggtggctcatgcctgtaatcccagcactttgggaggccgaagtgggtggatatcacctgaggtaatgagttcaagaccagcctggacaacacggtgaaaccctatctctactaaaaatacaaaaaattagctgggtatggtggcacatgcctgtaatcccagctacttgggaggatgaggcaagagaatcgcttgaacccaggagacagaggttgcagtgagccgagattgtgcctttgcactccagcctgggcaataagagcgaaactccgtctcaaaaaaaaaaaaaaaaaaaaaaagggatttcatacagaaagattaaggttctcatactatcatacaacatctaataatttaatatagaagaattggaaaagtatacagccttatttgattttgaaaattaagtgcaatcatctattaccttatagctggcagaaatcagtgcttattctttctaactttgggtttataatccttaccctttgtgatgtagtaagaatataaagtactgggaagaccattagtctagtattggtccatgaaggatttcattactgtcatcattctgggttttcttttctgaaagtgacgttcttcctgtggccttcttggcaattgagaggaccgctgttttcaagagaactgggagtggcttcctatctaaatagggactagctgtggttagaaggggaagtgggaagtggctggatcgctgcctctactttttcctattaaacgctttttcctctcaactccattaccaggcctaggaccttaaattctggatataatggaccatatcctggaatattgttttgttatggcaactttggtgacagaatttcttataacaatgaaacattatgtgatattgtgaaatgtatatttggtctttattccgtttccccggccaaaaaaaacctcctaaaattctaggactctcactggtgattagagcatcttttgtatgctaatgaggtgactggaggctggggacccctagatagcttcaggatggggactggtcacctgaaagactgaggagaggcgtgattagaaggttggggctttcatcactcaccccctcacccccctccatcccaccccaccccccacgtctctgtggaggggggagaggctgaaagttaacgtcatcaacgtcatcaacaatggccagtgatttaatcaactatgcctatgtaatgaagcttccacgaaacctagaagtactgggttgagacagctttgggatagctgaacacatggaagttcctgaaggactctgctcagcccctcttctcccacaccttgctctgtgtatctttttatttggttgttcatctgtatcttttgtaatatcctttataataaataagtaaacgtatgtaaagtgtttccctgagttccgtgagccactcttgcaaattagtctaaccaaggagggggttgtggaaatcccagtttattgccaatcaatcagaaatggcatctgaagtctgggacagtcatgtgggcctgagccctggacttgtggaatctgacactatctctaggtaggtggaattagaattgagttaaattgtaagacacccaggctgggcccggtggctcacgcctgtaatcccagcactttgggaggccgaggtgggcagatcacctgaggtcaggagttcgagaccagcctcaacatggagaaaccccgtctctactaaaaatacaaaattagcccgtcatggtggtgcatgcctgtaattccagctactcaggaggctgaggcaggagaattgcttgaacctggaaggcggaggttgccatgagccgagatcacgccgttgcactccagtctgggcaacaagagcaaaactccgtctcaaaaaaaaaacaaaaaaaatggtaagacacccagcttgtgcgcttctgtctctaggtagatagaagtgagttaaattgtaagacaccagcttgtgcactgcttgcttggtgtgtggaggaaataaccccacacatctggtgttagaaatattgtgttgagtggtgagagtaggccaaaacactttggggttttgttttttctatcctcagactcctcttaccgtttggtagctgtgtcaccctttatgaatgaataaatgaatgtacataacgacttcctagtgacaagacgattgctaattaagatgtaatatgatacaagagtagggaacatttaagaaagtaacatttaacttgttctctgagaaattcctggagagtcttattaaaataccctagaacagggcagggcgcggtggctcatgcctgtaatcccagcactttgggaagccaaggtgggcggatcacctgaagtcaggagtttgagataagcctggccaacatggtgaaaccccgtctctactaaaaatacaaaatagccggctgtggtggtgcatacctgtaatcccagctactcgggaggctgagacaggagaatcacttgaacctgggagacgaaggttgcagtgagcctagatcgcaccattgcactccagcctgggcaacaagagtgaaactctgtctcaaaacaacaacaataacaacaacaaaaaacacccgagaacaacatgaagattgtcatgttttggccattagtgttccacatcatgagaatgcagaattaaactggaaagttaatgtaattcagtcattgttataacctgttaaattaacatgttacattttgtttaattttgaaaaattaactcgttaatatagttcaagatttaaggggtatacatttaatctccctatatttctctccctttagcctcttctctagaggcaatcaatagtctcagtttaaatatacttttaacatttattatttaaaggacttctttggtgtgtatgaataattaaagttgataacatggattctagagtcagacattttagattttcatctactcaacagttactgagcacctaccaggtagtttcttggcactggaaatacagcactgaacaaatcacagccttcttggaaattacattatagtgcgtggagacaggtgctaactaaatatttatttactatacaatgtggtgattagtggtaggaaggaagatagtgctgggtaaagggagagagtgatagtagaggtgctgttttaattttatttttttgagacaagagtcttgctctgttgtccaggctggagtgtggtggtgtgatctcggcttactgcaacctctacctcccgcgttcaaacaattctcctgcctcagccccctgagtagctgggatgacagacgtgtgccaccacgtcccgctatttttttttttgtattgttagtagagatagggtttcgccatattggccaggctcatctccaactcctgcccttaggtgatctacctagcttggcttcccacagtgctgggattacaggcctgcgtcaccacgcccagcagatgtgctgttttagattgggtggctggggaaagcctctgatggggtaacgtttgagcagagaattactgaaagagtcaaacttttggcttttgagataaaaacatttcaggaagaggaccatcaagggcaaaagtctggagactgtatttacagtagaggtgtatatccttccagaatggcagaagaggctagactggctggagaagaaggctgaaggagaatggtaggggataatatataagaggaaaaagaaagtaaaagaattgtgtgggagtagtgatggggattgctgatgactggttatgtaggatttgtatatcataaggaagtaggattttattctgagtgggatgggaatcttttggagagtttatagggttcagtctagctgatttgtggacaataaactcttggggacaagggtgaaagcagagagattagttatgagtctgaaatagccatagagtatacaacactgtactagatacagtgagctttatcaaatttagttagtattatttcttccctagatttgacttttaccccttgaggaatggaggtaagaagtaaaaatgaattcataatgaacatttatatttgtaaatgataactttaggaattacagttaaactctggagggattcaaatttgtacagatcccttatttcaagaaatatggtaaaattccccaaagaaactccaataccttttatagttatattatagcatacaataattttttttcttaggccttccaaaaaaggctgtgttgcacagttttgacaaattaaatattgggtactattttttcctccccattttgactagatgacattttgaatttgaaacttctttggtttctccaatgtatatcaaagtgctagaaagtatttaaaaggcaaaatccttagactttaagcaaccaagttgctagtgatgaaaataaatggaatataaaaatgtcaacttggaaaatttaaactgacagaataatatgtttgaatttactggcaaacctgctgcatctggtattgcagaaaggagtggaatgtgggaaatctgaaatctgaggatctcagaactcctaataactaactgggtgaatgaaggcccttgagtcaaaaatgaaatcacatataagagagacaaagagactagacatggtaaagatgtagaaaatggaaaaccaaggtggacactgaaaagtacactataaatggtaatggggccgggcgtggtggctcacaacagtaatcccagcactttgtgggggcaggtggatcacttgcagtcaggagttcgagaccagcctggccaacatgacataaccccgtgtctactaaaaatacaaaaattagccaagcatggtggcatgcacctgtggtcccagctacttgggaggctgaggcctaagaattgcttgaacctgggaggtggaggttgcaatgagcctaggttgcaccattgcactccagcctgagtgacagaacgagactctgtaaataaataaatagtattggaagcagaagagaaatgggaaatgaaagttaaatggaaagtccggcatattgacaaaactttaaataaatatttgctggatccagtcaggtttaagaaagaagttgaggccgggcacagtgtctgaagtcaggagtttgagaccagcctggccaacatggtgaaaccccgtctctactaaaaatacaaaaaaattagctgggcatggtggtgggcgcctgtaatcccagctatttgggaggctgaggaaggagaatcgcttgaactcaggaggcggagatttcagtgagccaagatcacgccattgcactctagcctgggcaagaagagcgaaactccctctcaaaacaacaacaacaacaaaaaagaagttgaaatggctgataaacccaaacacacacgctcaaaaagaattgtgaaataaattccaaggctagtatacattactcattaagtagttgtagcccagaagagggcattgccaattttttttttaagacagcgtctccctctgtcacccaggctggagtgcagtgatgccatctcggctcactgtaacctctgcctcccaggttcaagcgattctcctgcctcagcctcccgagtagctgggattatagacacgccccaccatacccagcaaatttttgtatttttagtagggacagggtttcgtcatgttgtccaggctggtcttgaactcctggccttaagtgatctccccgcccgggcctcccagagtgctgggattacagggtgagccactgcgcccggcccattgctaattttctctactctcaatttctattaatttggtttgcttgtctaggcttcctaaaataggacttataaaagtagctattaagtatttcaagttaatggtttagaaggtaattttttaaattaaaaaaatagtattacaggagtaactttatccagggaaagcattgtatattcttattaataaattctcattatatatcttcatgggtttttattattgctataatctttatgtacagctacctctttttagtcaaaaacaatataatgctacttttaactcaaacttacatacttttaatttctgtttaaaataagaaaatgtaatatggcataccacactttgggtcatggaatcataagatgtttgagctgaaataagttttttcctttgtggacacatttagttttattataacaaagtgacttatacaaagcaacttgtacacttttaacttttaaaactgagcatcatctttcctttccagtgaaacaaaaaaattttttttaaaaaaaacagggtgaaaattacaatagagaatgtcaattccacataagatactacaggttttgctgattctcccattgagtggcagggctcaagtcatcattaggagagaatttattttaaaagtattaccttaaactgcaaggatgtctgtcagacacctcaatttaacatgccaaaagagaagccatgttgtcaaaatgcccgcttaacccatccaaacatctcaaatccaccctttgctgaccttctctaaccccattttttaaagttttctttccccctttttaaacaagagaaagtagacagatgcatattggtaaatgctaactgtccatattcacgtagagacacagtgtactgtctgagtccagtatacagagaaaggagaaaagaagctagaattctgtgtactactacacaggggcctagcaccctccagcttccagcagagtgaagggagcaggtttttctttttttccgacagagctaggtggtggtgattccatacagtttttgttcagacaggaagggataaaaatgaatttggaacagaaaggggtagagactcttttaccataatactctgctcaaggtatttacctcccaaataagttgagaatcatggtgtatagaaaagagacctcaagaacagggcaagtgagccacaagagggggaaaaaaaagactgcaacttactcccagggactggagaaaattttaaaaaggaaggttgaatccatcagtgttctattagtcatcttctccttcaccctactgtccttccttccctttatcatcatcatcatcttcttcctcatccccttcttcatcaatatcttctaatccttcctcttcctcctcctcctcctcctcatcttctcctccttcttcatccatatcagtcggtaaccaagtagtactgtaatgggatgggacaaatgtcatctttgatgaactttcctaacatatgagcacctgcatcagaatggtcagtaaaccagataaagaagctctctggtgcctcatgctgcctcttcctgctggctttattctgtgtttgacttgaatgtttcatcgcatcctttccagctttccatttgatttcagtggactttgaagatggaataccactctcattcaaatgaaattcgttgaagataactttatttttaaaggaaggattttcatcaaaataaaagtctattctgtaacctgacttagtatcttcaaattctgtcacttcaactttggtcagataatgcagtgcgtctttgtcctcctccctaagcagtgcagacacttgaggatggttgacaaacgttgtaaccccaaaacttggaactttggcgatcaattctcacctcttctgaaaaagtggctgacagagtttattttctgttctgctttcagaatctcctcccttagttcattaagcctgtctatttcattttgtacttcatcaatatgttcagttgcttcctgctgttctttttctctcttcggcaagtctagagaggctgatgatgtctcttccagtctcagaacaggaggtggtcttggtttcttcttttgaggtgggcgtggagactagcatttaggggccatgctgctaggaaagtccaagaaccagaccacaagtctccttgctcatcaggaagaagctcagaaaactctgaaataattttagagtgatcttttcccctgctccttaattttacagatgaagaaatggaaacacagtaaaattcccgtatctagttatggcagagaaaagaccagaactttggtcttctggcttctggtttagtgctctacaacattttaacttacgtttgtattataatttttttttaatcatttcagttgtacatgaacaaaaacaggaattatctttttttgttagattgttgctttgtgattaattgacctgaattgagtgctttctgcatacatagaaagatgcactctttttgttgagaaggttaacagccttgtgattgtcttcctttaagtgaaaatcaacctgtactttctagggatacatatttatctaaactttctaatgtttttgttgttgttgttgttgttataaatttaagtggtacaagtacagttttgttatgtcgtggtgaagtctgagcttttagtggaaccatcacctgaataatgtaagttgtacgcattaagtaatttctcatccctcacctcccgccccacccactgagtctccagtgtcctattctacactctgtgtccatgtgtacacattatttagcttccacttgtgagaacatgcagttctctatttgggaggctgagtaggagatcatttgagcccaggagatcgaggctgcagtgagccgtgatcttgccactgcactctggcctgggtgacagagtgagacactgtctcaaaaacaaaaacaaaaaacttagctatttgttaaatcaagagccccagtgattcttaccagcaatactatgacaatccacttccagttttctgtacctcaaaaaaaatgctgatatcctaaaatattcctagtatcctaaaatattccataaatcagatatcctacaaagccaaactggtccttcttgttaaaattaataagattctataagctgttaaccaaaaaagtttccactaacactgcatacttaactctcctaaataaatttaaatatgcaaaatgttaattcaaatcaaaataataataaacacaaccataaagctagcaattaagattaaaaggtttatgagtgtctattaaaggataaatggataaagaaaatgtgatatctgtatacaatggaatactattcagctataaaaatgaatgaaatcatgtctttttgtggcaacgtggatggaactggaagccattatcttaagtgaaacagctcagaaacagaaagtcaaatatgctggaagatcttctctgattactttaattttctaagccaggtcattggcttagtaagaaaggaagctattaggagtttgaaaagagaggagagcatataattgtctagaaagtgggaaagtgaatggactagagaaatacagtatgatcaccaggcagtgttaagggctcatttgaggctaaaggttctgagttaaaagtgaggccagtcagcttggttttgtgcttttttttctccagccaccttcactttaggagtaggagaatagttgaatttacccagcttgtggttctgcaaagtgagtatgtccaagtgagagaggagcaagtgattataatgatggaccatggaacttaagctggtaaggagggaagagaggacttcacagggtgagaaacagtgaaaagatagtttgaagataggctgggtgcggtggctcacacctgtaattcccagcactttgggaggctgaggcaggcgggtcatgaggtcaggagatcaagaccatcctggccaacatggtgaaaccctgtctctactaaaaatacaaaaaaaaaaaaaaaaaaaaaaaatagccgggcctggtgacacgtgactatagtcccggctactcaggaggttgaggcaggataattgcttgaacctgggaggcagaagttgcagtgagccgagatcatgccattgcattccagccggggcaatagagtgagactctgtctcaaaaataaaaataaaataaaataaaaattaaaaaaagatagttcaaagatagcggtcagtagatgggagatctggtggggtcacaagattatatgaattcgtgtattagaaagaatgagctggaaatataaaacatggtattcaaaaagagttgcatgaaattgagattattgacagggtgcattagagtgtgctgagttagggttacatttagctctttgcttttcacagcagcaccatgatatagatagtgtaagcatcattaagcatgtttcataaatgagaaaactgaagctcagcgaggttgggcagttttcccaaggtcacaaagctgctgataggctagttatttaggactcagatcccattactctgattctcaatactcactcctctaccatactatatcagttttctgaaagttagtaacttatttccctatctttgcacctagattgcaatctcaagttgaaacttttgacaaatatacattaccaaaattattttcctcttcagaaatcttcagactctaatcttagggcaatgttggaggggtttactgccactatttttacctagctgatcttattgaaaacacacatatattagaggcttaaatatgatagttttgtttaaactccgtttcataatggggcttaaggtgggtggaagatggaacaagaaggaatgtactgttctttcagcagcatgcctggacagacagctgtactgttagaatgtgtccaaatccatgtgtgttctttttggtggcagtttgcaccattgcaagtctaaaggatagttggttattggatgttgtccatttgggatatgattctcttctttcccccaatgaaataattatcacgctttttgcatttttgcacatttagctttgtggtagggggcggacttggaagaattctttaaatgtgaaggaagaatgggggaattattattaagtatactctgaactgatctttatcattttaaatgacagaatagaaaaatgtttcacctaaatttcagatggtttttttcttttaaaaattattttaaattgtgataaaataaacacaacataaaatttactttgttatcagatgttttaatatcctctattattttgttggtataatgttctgtttaaaatatgaatagttccctggaggtgacccttatgcaccttggccacgggaactctctttcttctctgttacttttctgtttcctacctgctactggtactggacctttttattccactagtgaagtctgatgatagaacatgggggtagagaggtggtaggccttagcagcagagtctcattcagtatctgtgaaacatgggacatatcagctccttcctctcctctagaaccttcgtggcagctcctcagagggaacgtataagaaagcctgagtcagggtatatacaactctgatcttattgcttccttgcttaccagcttttattgatttcttaccatcttcagagtgaggtcccaactccttaacagagcatccaaagctttcataatttggtgcattcccaatctcatacatgctcctgaggctgtagccatactaaagtacaggtgggcctgtaaatatagcctgtccttggcatacagtaggtggtccagaagtatttcccccctttttttttttgtttttttaagacagggtctcactctgtcacccaggctggagtgcagtacccaggctggagtgcatggctcactgcagcctcaacctccctaggctcaagtgatcctcccacctcagcctcccaggtagcttggatgacaggcgtgtgccaccaacacctggctaatttttttttttttttgtatttttagtagagacagggtttcgccatgttgtgcaggctggtcttgaacccctgacctcaagtcatccccctgcctcgcccttccaaagtcctgggattacaagcatgagccactatgcccagccaagacatatttcttgaatgaaagaatatagtattaatatatatcacagttgtactattttacatgctaacttgcttttattcagtggctaactcttgagtttcctttaagactcaggccaagagtcctctttcaagagggcttctctgcgttttgtgtatcctagtagacactcttgctctatgataccaaaaacattcaggccatatctctgtattataatagctgatttacttttttgtttttcccgtattagtacatgaggttcttgagggccagggaccatgtcttatttttaccttagtaccccctaactctgggcctgttcttcctaggtactttctattacaaaaaaaaaaccctttaagatagctgttgctcttgtttcctaatatttacattatataacattatatattgaatatctcggcttttaaattttatttttttgccttttcaaggtcaaaattgcttagacacttgacttgtgaaataatcagtattccaatgagtataaatcatgacagtcataattagtataatgtgattgcctattatgggattgggacgttgggtaggaagcttagaattgcagagttaatcctcatgtggaggaattatctgagcactttaaataattggacaacattatataagccttacccttttaggtctgagttttgcacattttaaactggtgactcattaaattgtattcctgcttaggatgtaactgttgttaatgtagttgtgtttcctaatttccactgttttatcaatgctccttttcttttatactctgatgtcaaaagttatgtaatctgggtattcctcagatttaatgacttggtcagtgggtattaacattatttgttcctataagaaggctttattttagatgttcttccttttcttgagacagggtcttgctctgttgcccaggctggagtgcagtggtgtgatcatggctcctcaactcactgcaacctccacatcccgggttcaagcaattctcctacttcagcctcccgagtagctgggattacaggcaccccccccagcccaccacactcagctaatttttgtatttttagtagaggcggggtttcaccatgttggccagacttgtcttgaactcctggcctcaagtgatccacctgccttggcctcccaaagtgctggaattacaggcatgagccaccatgcccgcccgatgttcttactttttaaagtccagatcttgatacttttgccataagtttttattctctctgttcctaattttagttataaggtcatttagttgaaacagtggacgaggaaactataagcttactaaaaatgccttgggtttctggagcatgaatctgcatactctaaagatttcttacacaaataatttttttttttttttttttttttttttttttttgaggcagagtcttgctctgtcacccagtctggaatgcagtggcgggatctcggctcactgccacctctgccttctgggttcaagcaagcaatcctcttaccttagcctctcaagtagctgggactgcaggtgcatgccaccacacccagctaattgttgtatttttagtgcagacagggtttcaccatgttgaccaggctggtctggaactctttacgtcaagtgatctatccgcctcagcctcccaaagtgctgggattacaggcatgagctactgtacctggtcactacaagctttaatatagttgttactttcagtagaattttggcatgttggaacttgaaccttttatttccaaaatttgtgtattccattttatgtaattatatccctgcagaaatattagtataggcatatttacatagcaccttaaatacatagcagaatgttttatacatacaatgagtagggagaccagagtcttggatcccgtattgtgggtattctattagaagtctgtgatgcccaaatggaccataattcattacggaaaagaaattttaatagcaatttttcccttggttactgatgactgaggtatgagaagttcttattctccaaccaaaaagctacttttatactggtttcataacctcttaatacatagtctaactttgcagaaaaggactgtccactttttattcttaaatattttaaaagttgattttaccacctgtggtttcccagatagtccctgaaatactagatttacaaaagaggtaactgttttaccacctccaattaaatgaattaattgttatcaaattaaatgaattaattgtggttaaatcccaggttccttaatctactgtttcttgaagttttgttggataaggaaggaaacagtagtaacaactgactgcccttctgaattctgctgttagtcctagggcaagatgctcccagaaacaatctccctgaggatgactgtagttggagggggatggtatgccacgactattcttggaacttgacttggctgtttctgtgcctctttggcagaggccagaagggctgggttgaatctcggggcatctttggaataatcaggatgcttagtatagcagcctggcttgcaactagggttcagtggtcttgacagtgtttgttggcttgtttttttgtttatttctcacattgtttttaatccctgttcttcttgtcagaaataggaacctgctcctcacttgctcatctctcctaggctagggtgttaaattaagtctttctcttctattgattcattcactctcttaagtgttggacatcaaaagcaaggttttatttcaaaaaagaagtgtacctctttatagttttcttaggataagaaaatgtaacaacacttggccgtgtgtgttggctcatgcctataatcccagcactttgggaggccgaggtgggcagatcacctgagatcaggagttcgagaccagcctgaccaacatggcaaaaccccatctctactaaaaatacaaaaattagccaagcatggtggcgggcacctgtaatcccagctacttgggaggctgaggcaggagaattgcttgaacctgtgaagcggaggttgcagtgagccaagatggcacctctgccctccagcctgggtgacagaatgagaatctgtctggaaaaaaaaaaaaaaaaaaaaaagaatatgtaacaacactaaaaacaaatgctgactgctgctaataaaagccatattatttttgttttcttgaatagcacttgaatatgccagatatttgccttcagctcccaaagtgagataatcttaaatagaactttataacagccttttatgcatatagttaaaaaggagtgattgattttgatcaatttcttagaaactttttaaacattttttgtgggtacatagtgtatatatttatggggtatataggatattttaatacaggaatacaatgtataatagagtatcctgttaaacattgggaaaatggggtatctatcacctcaagcatttattctttgtgttgaaaacaatccagttatactcttttagttatttcaaaatgtatggttaaattattattaactagagtcaccctgttgtgctatcaaatactagatcttatttattctatttttctgtacccattaaccatccccaccctcccaccgccctcactaacgaacttgtgactgtagagactgtggtaagaatgtgtctacttggccaggtatggtgtctcacacttgtaatcccagcactttgggaggccgaggcaggcgggtcacttgaggtcaggagttgagactagcctggccaacatggtgaaaacccgtgtctactaaaaatacaaaaattagccgggcgtggtggcacacacctgtaatcccagctacttgggaggctgaggcaggagaattgcttgagcccgggagacagaggttgtagtgagccaagatcgtaccactgtattccagcctggccgacagaaggagccctcgtacacccctcctcaaaaaaaaaaaaaaaaaaagaagaatgtgtctacttgtctagcagtctagcatgcagtcttctttgttaatttgcttcatcattccctttcatcagcctttagtctcactgcctagggcatgagctcacatcctcatttgttagacttacaagacagtgacatgccagacagtagtaaaacctccctaggatatctgtctgctaagagactaaaattaagagctagatattttctcccttaaggacatccatttaaggacagtggttcccccactatcctaccccgaaagtagctcatttatttcatttaggtaacttcagacttgtctgttgtaatattctaattaagtcttcagatgttaactaagcttttattattgtgaaacattcttggcaatggaagtctggtctctgccagttccaagtgactggtggtggcttttctgttctgggcagggcagggaacagaggacccattcaaggggaccagggaaaagggtaaaggagctagctgaacaactgtcagcctggtctaacatcttgcctctctttattttctctctctggcattgacatcctattgctattgtggctatgtttggtaccttacccatttctgctaaaaacataactaactcatcttttctcctggtttcgaaataaaaagtgctctaagaaatttcagctgggcatagtggctcatgcctgtaatcctagtactttgggaggatgaagcaaaaggattgcttgaggccaggagttcaggatcagcctgggcaacatagcaagacctagtctgtattttaaaatactatttttttaaaaaaactaagaattccatgggggaaagacactaaaagatcaggggataagcacccttttatatttctctactttctcctttttgcttagaaccaatagaattattattattattattattattatttttttttttttttttttgagacagagtctctgctctgtcacccaggctggagtgcagtggcacgatctggcctcactgcaacctccacctcccaggttcaagtgattctcctgcgtcagccttctgagtacctgggattacaggtgcgtgccaacactttgaggtctcaaactcctgacctcaagtgatcagcccacctcaacctcccaaagggctgggattataggtgtaagccactgtgctcagccccagtagaaaatttgaggagtataaaaaagttgtagaaggttttaagactgcgcctgggctgaagtaatatgaagtagtagtcattcatatatacatacatacatatatatgtatatatatgtatacacacacatatatatatttcaaagtattagcctcccgagtagctggggttacaggcatgtgccaccacgcccggctaattttttgtagttttagtagagatggagtttctccatgttggtcaggctggtctcgaactcccgacctcaggtggtctgcctgccttggcctcccaaagtgctgggattacaggtgtgagccaccaggccccagccttaccagtatatttgaaaccttttttttttttttattggagacagagtcttgctctttcgcccaggctggagtgcagtggcacgatctcggctcactgcagcctccacctcttgggttcaagtgattcttctgcctcagcctcctgagtagctgggactacatgcacacaccaccacgcccagctactttttgtatttttagtagagacagagtttcaccatgttggtgaggatggtcttgatctcctgaccttgtgatccgcccacctcggcctcccaaaatgctgggattaaaggcgtgagccaccgcacccggccagaaaccattttctttttcttgcaagtaacaatatcatacttcagggttttcttgagaaggtggcattgtaattattcctttaaaaaatttttatgttttgcttttatatagtcacatccagtcagtgttcaaatctcattctttttcagctttttaaattaatatccaggtaagatctacacatcacaatgatacatttaataattgatataatacttaataatatgtccaatggaattgatccgttatcttaagtctcttttgatctgtagattctctgcctaaaataattagcttggtattgtttggggcaaagtaaattattattctaaaaacctattaaaagcctttctggnnnnnnnnnnnnnnnnnnnnatggtgaaaccccctctctaccaaaaatacaggcgtggcggcacgtgcctgtaatcccagctgctagagaggctgaggcaggagaattgcttgaaccagggagatggaggttgcagtgagctgagatcgtgccattgcactccagcctgggacagagcaagattccgtctcaaaaaaaaaaaaaaaaaaaaaaattacagcctttctaactttaatgtttgtggctatgttattctaattgtatgagctatttcctaaaacatactttcaaaatacttcttgatagttttggaagaatgtatgtggaatgaagacttttctgttaacttacgttttttttctgttgttgtttttttttttttgaggccgagtttcactcttgtcgcccaggctggagtgcaatggcacgatctccgctcactgcaacctccacctcccggcttccagcgattctcctgcctaagcctcctgggtagctgggactacaggcgcccactaccaagcccagctaatttttgtatttttagtaaagacagtgttttgccatattggccaggctagtctcgaactcctggcctcaagtgatccatccgcctcagcctctcaaagtgctgggattacaagcgtgagccactgtgcctggccgaacttatgatttttaatagtttataaatactcagggcttactgtatctatgttttacagtgcaaagtaccacataatattctgggtggacatttgtctaaccctgttaatttagtatcttaagagatttgccacttttaggccatatgtatttataagagggatagaataggctttcttgcataatttgaggaatatcagcagtgtctccttgccttcttgttaatgcctaaaattctcttttcgagggaaattgcttttattttaactctgtatcctatgaagatataaatatttctatggtcagggagattgagaaccattttttctatattaacatcttagtacaagttatttatcagattatctttacattctaaggctctagagcagagaccttgccctggatgaataaacaccctcaacctttagctcctgtgtaggtaaaataaattgaattcattctctttctcctgttaccactcagcaatcaaagataaagtcacttcagtctttagattgaaaaagactgacttagaacaatgtgcatgcacatacacatttgcgtatgtgtatatacagagagtggtagaggtatcatgaagggttaatagatagtaggacaaattcagcaagagatcagtaaaggagggtgcctgccaatcaaggcctcctttataatcttccctaggacaagacctaataaggaatttccttttctttaagtgtagcatataccaacttttaattctagtctttgctatttgaaaatgctgataatctgttatttaagatgtttaaagtgaatttatttgctttgtactttgccatgaattattttgggctctagctctgtgactaccttcagtaaggacagatgtatttatttgtggtatacattgggattttttccattttttcccccttttgttcttggggaaatattctaataaataagaaacgcctttgaccaatggttaaatggtggttagttttgagttttttctcccatcaatgattttattctttttcaaaaatgaagaaataaattaggctagagtttcctggatacatgaaaacatggacatgaaaagtcaggctagtcatggtggctcatgtctgtaatcccagcactgggaggccaaggtgggaggattgcttgaggcaaagggtttggacaacagagtgagaccccatctctacaaaaacataaaatagttagctgggcatggtggcaagtgcctatagtcccaactacttgggaggctggggcgggaggattgctggagccttggagtttgaggctgcagtaagccatgatcatgccactgtactccaacctgagctatgatggtgccactgcactgaagctgggtgacagtgagaccctgtgtctttaaaagtcattctttgaggtttcacagagttccttacagaattttatttatattttttaatacctacatgtagcataattaattacatactataatttatttcataacagtgtaaaatgaacttgttctagcgaaatctctaatgtagatattaagctccttgaaaggagagtctctgtgtcttttggttttgtattcccattagtatctagctaacagtaaaatcctactataagtggggtataaaatctggcatattgttattaataggttagtaaaatcatcagtgtgattttgcacagacggccaatagttataaaggcaatcaccagtcatatcagaactgcagcctcctggtaagaatagttgctcagagttttttcagtgaatgaggatttctgtttttattaattatgctaatacagattatttaagttcccacttttcatttaattctaaatacaactacgttggggattattattatttttttaagaaaggtattattgccagatgaggtggctcacgcctgtaatcccaacattttggtcaggagtttgagagtagcctggccaacatggtgaaaccctgtctctactaaaaaatacaaaaattaggctgagcgcagtggctcctgcctgtaatcccagcattttgggaggccgaggcgggcagatcacctgaggtcaggagtttgagaccagactggccaacatggtgaaaccctgtctctactaaaaatacaaaaattagccaggcatggtggcaggtgcctgtaatcccagctactcgggaggctgaagcaggagaattgcttgaaccctggaggtggaggttgcggtgacctgagatcgtgccactgcactccagctgggtgacagagcgagactccctctcaaaataaataaataaatacaaatacaaaaattagctgggcatggtgacgtgggcctgtaatccgagctactcgggaagctgaggcaggggaatcgctttaacacgggaggcagaggttgcagtgagcctagattgcgctactgcactccagcctgggtgacagaataagagtctgactcaaaaaaaaaaaagcattctttaatgtttggtcacaatgactaaaataatcttcctttgttaccaggttgccatagtttgattatgtcccccaaagcttgcatgttggaaacgtaattgctattgaaaaagtagtaggaggtgggatctttttaagaggtaattaggtcatgagggctccaccctcatgaatggattaatctcattatcatgggggagtgggttagttatttcagaagttggctccagataaaaggatgagtactgttgagtatgctttctcaccatatgatgcctcctgccatgggatgaccttcaccagatgttggtgctatgcccttggactcctagtctctagaactgtgagccaaataaacatgttttgttgttgtcgttgttgttgttgttttttgagacagaatctctctgtcacccaggctggagtgcagtgtggtgatgatagctcactgcagccttaaaatcctggactcaagctcctgccacttcagcctcccgagtagctgggactataggcacatgtaactctgcccagccaattttttaatgttttatagagatctcacttttttgttgttcaggctggtcttaaacttctggcctcaactcagcctcccaaagtattgggattacaagcatgagtcattgtgtcagccctacattctttaaaaattacccaatctgtggcattatgttattgcagtgaaaatggataaagacataggcttttctatagagttggatagaattaaaattttgttcttaaataattcaacaagaactacctcaggttatttcctgtatttgactttccccacttatgtttctcatacctgtttaatgtctcttagtctttttttttttttattttgagatggggtcttgctctgtcgcccaggctagagtgcagtggttcaatcttggctcactgcaagctctgcctcccgggttcatgctattctcctgcctcagcctcccgagtagctgggactacaggtgcccgccaccacgcccagctaattttttgtattttttgtagagaccgggtttcactgtgttagccaggatggtctcgatctcctgaccttgtgatctgcccgcctcggcctcccaaagtgctggcattacaggcgtgagccaccgcacccggccagtctcttagtcttcaactgttattgtttctcatagtggtggtatgcctggtgaaagactattaaaaccccatttttgggcaaaagggtttactcctgtttgtgttacactgatatttcatttctattttatgattttcatttctaactctcaactctctgaaagaattaggcaagcagaaaatgggagaaaattctaattctggggtcttttaacactctccaatattactaaccattctgtctaaagatgaaggtagtgtccagatgaaattagactatatcatcctctgtggatattgtggagaaatgcaagtcttgactgcaaggcactgtgagttgcttatcggatatttttggcattatttatattagtaaatgaactagaatttcattgaaaatttaaagccttagaaattggactacgaagtcatgctagttagtgtcatatagcagtgtccttattccttttttgttcacatacttccttaaaaaatttctgaaagctgtgtatgtgggaagaggatgtgactctaaagggatagcacgagggtcatgtatctactctgtgtcctgtacaagcaggtggtgagtccataaatctgtgcatgtattaaaattcatagaactgtacacaaaaagaaaatagctatctactctgttgcacatgctttgcaagagcatctaagagctttgggtgacatctaaaacctttttcactacaagttttaaaaagtgctaattctatcatttttgttgtgttataaatacagtcagtccttcacatctccaggttctgcatcttggttggattcagccaagcacagattgagaatatttgagggacaaaaaacaataaaaaatatacaacggaaaaaaaaaataacaaatacagtataacaactatttatgtagaatttacattgtattagatattatcagtaatctagagatgactaaaagtatatcagaagatgtgcataggttatgtgcaaataccatgctattttatataaaggacttaaagatctgtggattttggtatctgctaggggtccctgtggaaaccgtgggacaactgtaatgtcattttaaaatggaactgcatcagcattattttaaatgtatccaggaacctaatattgcaggaatttgttacttaccattatctatttaaaaatatacatgaacaagctcttctttaacagctgaatttgtaacttatctctgtttttatttggatttgtatttctcttttaatttgttgttgttgttgtttgtttgtttttgagatggagtcttgctgtgtcacccaggctggagtgcagtggcacgatctcggctcattgcaacctctgcctcccgggttaaagtttctcctgcctcagtctcctgagtagctgggattactggcgcctgccaccacaccccgcagagttttgtattttttagtagagactgagttttgccatgttggccaggctggtcttgaactcttggcctcaagtgatcttcccaccttggtgcccagcctgtatttctgtttttaaaaaaatgtttaattgctacatatttttacatttattgggtatatgtgattatttgttacatgcatagaatgagtaatggttaagtcagagtatttggggtgtccatcaccttgggtatttatcatttctatgtgttgggaacatttcagatcctcttttctagctacctagaaatgtaaaatacgttgtttctaactatagtcactccactctgtcaatgaacattagaacttacttcactctgttaatgaacattagaatttttaatcttcttacagttaagtttatacccattaatctctcttcattcccacctcccactcttttcagccatctataattttatactctcgctccatgagatcaactgtcacataaaagcgagaacatgtggtatttgtctttttgtgcctggtttatttcacttaacataatgaccctcagttccatccgtgttgctgcagatgacatgatttcattctttttttatggccaaatagatttcccttgtgtatatgtggtatatacaccacattttctctatccatttgttgatttatagacacttaggttaattccatatgtttcctattgtgtataatgctgaaacaaacgtgaatgcaggtagtcttttgatatactaatttcttttcctttggattaatacctagtagtgggattgcaggatcgtgtggtagttctatttttaattttttgagaaatctccaactgtttttcatagtagctgtactaatttacattcccaccaacagcatatgagatttcccttttctctgcattcttaccagcatctgttattttttgtctttttaatagcagccattccaagtggggtaacataatatctcattgtggttttgatttgcatttccctgatggttagtgatacagaacattttttcttttttttttttttttttgagatgaagtcttgttctgtcaccaaggctggagtgcagcgatgtgatctcggctccctgcaacctctgccttccaggttcaagcgattctcctccctcagcctccagagtagctgggattacaggcaggcaccatcatgcccagctaatttttgtatttttagtagagacggggtttcaccatgttggtcaggctggtctcgaactcctgccctcgtgatccacccaccttggcctcccaaagtgctgggattacaggcgtgagccaccgcgccctgccaggaacattttttcatatacctgttagctatttgagaaatgtctatccatgtcctttttccacttgttaaatgagtttgattttctttttttttttttttttagtattgagttgaattctttgtatattctgagtattagttccttataagatgaatagtttgcaaatattttctcccattaaacaggttgtcacttaactcttgattgttccctttgctgtgcagaagctttttttggcttaatatagctccatttgtctgtttttgtttttgctatctgtgtttttgaggtcttagccataaaatctttgcctagatcaatgtcctgaagcatttttcctatgttttcttctagttgttttctagcgtcaggtctgacgtttaaaagtcttgaatctgggccaggtgtggtggctcatgcctgtaatcccagcacttagggaggccgaggcgggcagatcacctgaggtcaggagttcgagaccaatctggccaacatggtaaaaccccgtctctactgtgaatacaaaaaattagctgggcgtggtagcatgtgcctgtaatcccagctacttgggaggctgagacaggagaatcgccggaacctaggaggcagaggttgcagtgagccaaggtcgcgccactacactccagcctgggcaacaagagcgaaactccgtctggaaaaaaaaaaaataaagtcttgtgtctggctgggattatatactgaggtagaacatcatgatttagctattatctcaatgatctagtgtgtgtttttgttatttccctggcataactgtcccctcccccataatccagaaaagtaaaagtatgtatttatctagaagaagcactcttgtaaattgttactgttatgttaatggcttctcaatgccaacaaaataaatctgaacttcgtagtgtgacattcaaggccatctaagatctggtccttgcttacctcctctactttaatattcttagcacatcatttctatgcacacataccctctgcacaaaaagcaaatggaaaatctggggctgtactagtttttttttttaatttccaaaacgtattatggagttttgttgtcatcagtcaccctctacctggaatgccttcttcctcattcactttacctgcttcaaatggttgatataaaaatgacttgctagtgcctttaaactggaggtggtacatggggacacagatctcatccttccagtttattggtatatacctggttcctgttacagtagttggcacatagcaggtgtttactaaatatttgagtaattaatacattgataaattatagttatgcatttataacttttacatgctgtgtcacaatgtctgcatcattcacctcacttcatctcatcatgtagctattttatcatctcacattatcactggaagaagggtgagtacagcacaagatacatttgagacatagatcacattcacctaacttctactacaatataaattgtaattattatatttattctattttattgttcatctcttgccttacctaatttatgaattaaactttatcataggcttatttgtgtaggaaaaaagcatagtatatatagggtttggtactatccaaggtttcaggaatccactggcggtcttggaatgtatctcatgagagcaaggtgagactactctacacagatacattcatatatatttcatgcatagaaactatagtgtatgagtaagcagttgttgcatgcttccatagtctcaagggaaacagctgactgcttgggttacaaaggattgtattgtagatcttgaggaatgatctagttttatttgcaagtccctcctcaggaatgtcagctctgaacttgaggtcatagtaccaggtgctagcaacattgagtttgggaattctattagggaaagaggattggcacattcctttcatcccttagatatttcattatcttttgcctaaataacataggcaatggtgtttttctgaagatgcaaagatcttggaatgctgaattccacatattttatgtgtttaggaaggaccttactttcacctaaacttttgttacaattctgagcagaaggtaattatatctaaaataagtgtggaaatttaaaattcaagtgaagctgcaaaattctcatctgtagttattcaataataactatgtgtcctatgatatgacattcatggcatgactttttattatttacatataactggcatgaaaatgtgcttcaacacattttctgctttttttctcttaatttaaaaaatcgtcacacagtaaaatggattttgttggtttattgtacggttctgtgaattttaacacatgtaaattcgcataaccccacaaacagcggaacagtttcatcaccccaaaagactgtctcatgcaatccctctgtagtcacatattccccccctttaatccctggcagccactgatgtgttctccaccactagagttttgtctttcagcagtgtcatagagctagaatcatatagtatgagatcttttgagattggcttctgtgggagactcagcaaaatgcctttgagattcatccaacttgtgtctatcaatacttcattcctttgtattgttgagtggtattccatagtatggatgtgtaccacaccttgtttatcccttcattcactgaaggacatttaagttgctttcagtttgggacaattttcttttctttttttgtttttttgagacggagtctcactctgtcatccagactggagtgcggtggcgcgatcacagctcactgcaacctccgcctcctgggttcaagcgattctcctgcctcagcctctcaagtcactgggattacaggtacctgccacaatgcccagctaatttttgtatttttagtagagacagagtttcaccatgttagccaggctgttctcgaactcctgaccgcaagtgatccacccgcctcatcctcccaaagtgctggggttacaggtgttagccactgcgcctggcccagtttgggacaattttcaatagagctgccataaacatttgtgttcaggtttttgtgtgaacttaagtttccatttttccagtgtaaatactcaagaatgggattgccaggtcctatggtaagtgtttgactttataacaaactgcccaactgctttccagagtggctacaccattttgtgttcccctcagcaacatgtaagagttccagttggtctgcttgcttgtcagcacttgatgtcagtattttctgtcttagccattccaataggcatatagtggtgtctcattgtggttttaatttgtattttcttaatggctgttgaacatcttttcatgtgcttatttgctatttgtataacctttttggtgaaatgtctgttcaagttctcttttggtttttaaatgggttgttagagcctcaactcatttttgcttgggctttgtaccaacagtaatgtttcttgttcccattgcttttcttattttctttcctttccaccacaccccataggactctctttgatatttttttcttattaaaaagacaatgttgcaggacttcagagacatactgttggctaggttttaaatgtgggttctgctataattcaccttgtgatctcagacaagttaattacttgataggattattgtgagaattagataattttaaatgatgtatatgaagtgcttgatacatagctgtatttaaacctttctttttcctctcagttcttatctcaagagtccattccctataatactagtcttctgagatgcttagtgaaaagaatatctgtgagaaaagaaatctgagatacattacatgctctagctattttttggggttttttaaatttattttttaatttttttaaaaaacagagtctcgctctgttgcccaggctggaatgcagtggcttgatctcggctcactgcaacctttgcctcctgggttcaagcaattctcctgcctcagtctcccaggtagctgcggttacagacgtgtaccaccatgcccggctaatttttgtatttttagtagagaaggggtttcgccatattggcccagctggtcttgagttcctgacttcaggtgatctgcctgccttggcctcccgaagtgctaggattacaggtgtgagccacctctagctatcttttggatggtttctaggaacgtgaatatattaatggcttttataagttagccatttctttattgttggacttgttatattcagcattttccaatcttatttgactatggaacacttgacttgtgacatctatttagcctacttttatgaaacacactttgggaaatattgactcattcagcatgtgtgttagtccattttgcgttgctataacagaatacttgagactgggtaattataatgaacagaaattcatttctcagagttctggaggctgggaggtccaagatcaacgggccggcatctgtcttgctgcatcatggcagaagacatcacctggtggaagggcaaagagagtgagaaagagagcacgaggggttgaactctcagcctcaagctattttatattgacattaatccatttatgagggtagagccgtcatgtcctaaacacctcccattaggccccatctcccagcactgttgcattgaggatcaagtttctaacatacaaactttgggggacacattcaaaccacagcagcatgttacctcagtatggcacctgataagtactcgttatttctttattgagagagggtctcgctgtgtcatccaggctggagtacattagcacagtctcagctgactgcagccttgatctctcagcctgaagcaatcctcctgtctcagcctctagagtagtttggactacaggcacgcgccaccacgcctagctgattttattcattttttgtagagatgaggtctcactatgttgcccaggctgatcataaactccagagattttaccaccttggtctcccaaagtgccagaattacaggtgtgagccgccacacctggccaagtactcattatttatcaaacatattcatgcatggtatcatttagtttttaaatctgtttttcctttttttttttttttcttttgaggtagggtatccctgtgttgtccaggctagtcttgaactcctgagttcaagtgatcctcctacctgagcctcccaagaagctggaattacagatgggcactattgtgccaggcttaaatcttgaaaattagcattataaaaatactgtaattcataccttgagaggggtatgtagcttatcaagtcttttgctttttttaaagaaaaaatgttctctgttaatgaccctttatccctatttgtataggaagttctaggcagtttggtccctagactactagcattggtatcacctctgaatgatattagaaatgcaggctgggcatggtggctcacacctataatcccagcactttgggaggccgaggtgggaggattgcttgaggccaggtgtttgagaccagcctttgcaacagagaccctgtctctacaaaaaatgaaaaaactagccaggtgtggtggcttgtgcttgtagtggtatctcattgtggttttaatttgtattttcttaatggctgttgaacatcttttcatgtcccccactgcctcgccacacagaattatttggctccaaatgtcaatagtgtcatggttgaaaaaccctggcttaaatgattacatttggaaaattatgaattgtcatatatggtacataatgtttgtcttattattaagaatataactaagatatttttaaaagactcatatctcagtatttcaaagcatgaatttttatcataaaatatataaggaagatgaaggaaattggagcaaatctgtgtaatcttggacaagttatttacctgataggattattacgagaattagataatgtagatatgtactaattgtatacatactaatctaataattatatatttatatttgttccaaaagtttggaatttcagcttaagtggtattttgatatataggaatgatgtagaagtatatacttttacaaaatgttttattttttattttaaaatttattttatttttagagatgggggtctcactatgttgcccaggctggtcttgaactcctggcctcaggtgatcctcctgcctcagcctcgtgaataattgggattgcagatgtaagccaccacccccggctgaagtagatacttaatatttatgagtattaatagttatatgaatattatagaagttatataagtatggtatacaagttatataaaatacaagttatgtatgtttttgttttggttcttgaggtggagtctcactctgtcacccaggctggcgtgcagtggcgccatcttggctcactgcaacttccaccttccgggttcaagcaattctcctgcctcagccttccctgtagctgggactacaggtgcatgccgtcatacccagctaatttttgcatttttaatagagacagggtttcaccacgttggccaggccagtcttgaactcctgacctcagttgatacgcccaccttggcctcccaaagtgctgggattacaggcatgaggcaccacacccagcctttatgttttatataggttatatatacaagttatatatataagcattatacaagtatttttataagacattattttgtattaatataagcagtttcagaaaagcctgtacttcattacatcatttaaacccgtatttgagagattaataaaattctgtattagtctatattggtcaagtataaatcagtgtagcagcccatggctattaatcaaaattttaggaagtcttcaaggtaatgacagttgcaaaaacaaccaaaaacgacacattttgaagtgacaggctaccatattttctagctctttcttaaacagatgtatctcttaaattcatggtcagaaaatcaacaaatcagctgaaccagaaatcccatcataaacagctgttgccgatagtttatggaatgatgtcagtatatttgagccaatatgttgagtaggactacttattccttcaccagcaagctgtgataatcttcatgtgttctgtgactattttactatgtgttaccttgcttgtggagcagtggtgtagaccctctttatgaattggaaaactgattgaccttagactacaggttctaaggattacagattaaagaggttatctgtacttacagcatgtattttattcacattaagttgaatttaggttacatccaagttatactgttcacttttagatgaggaaactgaagaaatgctgttaacttgatcacagatgtagtaagtggtagaattagtattcagacccagggaatctggctctggcatctatgctcttgaccaccatgctctactgctgatttatactcataatataacagctgccatgcagctattattataattaaattaatttcatattgcctcacacttcacatgtgttaggtactcaataaatgggagatgatattatattctcattaagtacaactagaaagttctacaaggcatgactcttttctgttaatatgctgtattatatattgatttccatatgttgaactaaccttgcactctagggacaaatcatagttggtatagtaaaataatcttattatcctgctagatttggtttgctagtattaaataatttattgaggacttttgcatctatattcataaggaatgttctttttgtgtgtgtgcgctacccatgtctggctttatgttttcttaaattcattcttcaccatccactccctcatcatggaaaaggacttacgttagtcactggtttctagccttaggtcagaggccagtttcactacgtaagtgcagaaagacaatcaggtggttgtgggggtcccttaaactttctggttgtgatagtccaagaaaattgatctctgaaccaggaggcagaattccaaatcctattccagaattgtatctctacatcttaccacatggtctgttcatctgtgaaatgggataatataatatttttagcagagttaacatgagggttcattataatatatgtaaagcacctggtttatataaccaagtattcaacacctgttatgtattatttctctcccattctctatcttctaaattgctcttggatattgtgatgctcaaaagtccagaatttaatttttcctgttgtggagttagtatttcattgcttttctctaccttttgcctattctttcctgtccccaatcctagtcctcacaatctggctcagcattcaggaagaaatttgatgtctgatttgtattctttccttgactctcctatggtctccttttatttgtgaacaccgtattccacccttctgccatcaagatagaatcagtggaaatctagcaaaactgaaaaggaaaatggaaatgaaccattctttcgagacggtttaaatacacaaagtcattcctttcttagcctgggcccagctatcctggtgaagaaactctactagctcctatgcttaaagattctgtaatttgggccaggtgcagtggctcatgcctgttatcctagcactttgggaggctgacgcaggaggatcgcttgaggccaggagtatgaggctgcagtaagccgtgattgcaccattgcactccagcctgggcaacagagcgagactctgtctcaaaaaaaaaaaaaaagattctgtaatttgtcttttggataactttaaagggcctttctttcctcactccctcctacctgatcaatggactagtgcactagaaagacattacaggctaagtatcccttatttgaaatgcttgggaccaaaagtgtttcgaattttggatgtttttcagattttggaatatttgcataccagttcagtattcctaagtttttttttttttgagacagtctccctctgttacccagtctggagtacagtggcatgatcttggctcactgcaacctccgcctcccgggttcaagtgattttcctgcctcagcctaccgagtagctgagattataggcacacgccatcgggcccagctaattttttgtatttttagtggagaccagggtttcaccatgttggccaggctggtctcgaactcctgacctcatgtgatctgcttgcctcagcctcccaaagttctgggattataggtgtgactgtgcccagaccgtatccctaatttgaatatccaaaatcctaaatgctccagtgaacattttccttgagtgtcatgtcagtccacagaaagtttcagattttggagcattttaggttgttggattaagaatactcaacctgtattggtagtggtggtggagttaaagcagagttgttgctgctgcatgatttttacctctcataaataaagccagcgataacaatgagctttattgtgagtcattcactgtttgatactgacagagcatctattaaaaattaatttaatagagttttatttatttatttatttatttatttatttattttgagacagactctcactcactctgttgcccaagtgggaatgcagtggcgccatctcagctcactgcagcctctgtttccctggttcacgcaattctcctgcgtcacctttccaagtgaccgggactacaggtgccaccaccacgccaagctaattttttgtatgtttttaatagagacggggtttcgtcaagttgaccaggatggtctttgaactcctggcctcaagtgatccatccttcttggcctcccaaagtgctgggattacaggtgtgagccaccatgccaggcctagtaaagttttattaactaaggtatgtaatgaaaaatttccagtgcttttgtaacttccatgatagtcttgtttgaagctggagaaaaatgatgttcagcagtgaaagcacagggactgaatcctgagcatgcttttataaattatttgagcaacaacaaaactatattagtgtgtcctaaaccaaaattttgtaatttcaagtatggtttttctccttcttacttctaacacattctatatggaggatcagaattctattgctttgggtagccagtagctgctgaaataagggtagtgaataggtgctttgtttctcttggttaaggcagtttgagttcagccagtaggaaatagcttgcagccagtacccaaatatatgtagggagtgtatatacatatagacatacctcttcataaatattggagaactagctccgcaggtctgaaacaagaagaacctgtttttttgttgttttgttttgttttttatttttaacatcatatgaaaagcttgttatgttagtacattatctacagtacagtgacaggtgtcctaaaagagtaaggttagggaaactttataagaaatatttcctaatgaatacccacacatacattgtcttttttggtgagatgtttgtgaggtgagccatatattagggaagatttttgttcagctcatcctttttttgaggaaaaaccaaagggaaggacactgtgtattcaatttttggtccaaataaggttgttccaagaagagatggaaattgtccagtcatactagagaaaaagttattttttttggatggattctaagttctggcatgagctgtataattttttttttttttttttaattgagatggagtcttgctctgtctcccagactggagtgtagtggcccgatctcggctcattgcaacctctgccacctaggttcaagcgattcttgtgcctcagcctcctgagtagctgggactaaaggcatatgccaccacgcctggctaatttttttgtatttttaatagagacgggtttcaccatgttggccatgctggtctcaaactcttgatctcaggtagtccgcctgcctcggcctcccaaagtgctgggattacaggtgtgagccaccgcgcctggccgagctgtataaattttaaaaactgttctctgagtcattgtgcattcactttggaaaaatttgtgattaccctgttgctgggagtaaatggcagacatttccagtttcctttgatgaaatggattgtttggtaagcacatgcatatcgttccgattagtctgttaggtttaactcttaaatatcatcacgtgtataggcagatgaatcaagatcagccgactttggggcctggctgttttcaaagtcttcaccagaagataagaaaaggacttttccagttctttttgtaccactctctattgcattagagaggcagcctggtatagtgaaaagagcatgggctttggaattagaaaagacctagtgttttgaatcctggttacaccaactagctttgggacttgaacaagttaattgacatttccaagtatttgtaagttatgataataatgcctgtctttcagggctgtaggtaatgatgttataaattacagtatatcagaagtacttggggctgctatgtgcaaggtacagtgattaaatacagaggaaaatccgtgatcatactgtcaaatgctaacagctgtttaaagatgagtctttcccaaatgtgaataccgtaataattatctcagaacacctataccttcaataagaaggcaaataataatctaataaataatgagaagggatgctattagggagatgatattaagaggttcttttggccagaacacaagaatccctgtgttctaccataggtcagtccttcagccagtattctgtttcaaggatgaaatctgcacatggtactaagtaaggcaggattacactttctatcatcagcagtaggtttggcctcaagccccggtgaagaaacataattggttaggaccgaattagagatcttacctttctagttgcatgaaagggccatacttttaataagaggcaggaggaaaacacagtagacacaatatgtggctcagtcagagtttccgaatataataaattatagcaagtcctctatttccttgaggatagagtcgaaagacaagatcctgtttgatccttgtgagaagaatgaagagctgggtgaggagagaggagacgtggaacatgtatttcataaagaccgacacataattaagtgtaacatttaaaaatcacaaactcattggaataaatttctgaagtatttgaactttgaaaacttagctatttgacttggggaacttgtggggattatttatacttttgggcagttggtttttggccataatgtgataaatgaatgttgtagcagttcaggcaaggaaataatgaggagctgaattaagataatggtaccaaatgaagaggaacggatgggtttgagagatatttaagaggtatgattcataggatatactcatagagtgaattagggaagaaagaggactctagaatgatcatgatgtttctgggttggatgcctggatatgccattagcaacaacaaaacatacacatgtacatgtacatgaaacagaagagaaacaaaccaggagtaggaacaaaatggatttttgttgcctttaggatatccaaaggtatctacttatccataggctataggaatcaggcaatctgttaatcaggaaaatgttctgggctggtgacatttgggagctatggtaggttgaaaagtaccccctcaaaagatatccatgtcctaatccctggaacctatgaatgttacctctcatagcaaaaataaagttgcaggtggggggaatttttggtctttatacatgtgatggggggcttatcctggattattgagttggaccctaaatgccatcacgtgtaacagagggcgatttcacacacacataggagaaggcaatgtgaacctggaacagagacagatttgaagatcctggccttgacgatgggttggattacaagccaaagaatgttggcagccactagaagctggaaggggcaaggaatggattctccttggagtctcccgctgacacctttattttgtcccagtgttgctcatttcagacttccggcctcccaaactatgagagaatgcatttctgttgggttaagccatctagtatatggttatagcagctgcaggaaactaatacaggagccaatagcctagagtttataactgaaagaattgtatgtgaatgacttcacctagggaggatgtacgaaatgaacaggaaagagtaatgaggttagaaatttctgttatccggcaccatccagaaatgtattattttggtttagaaagtatttcagaaattgagtataaaatcttacaattattgccactcttttcattgataaaaatgtttttgaatgctaataacttcctttttttttctgtaaaatgttgagccatgtttattacttctgaatttgtgtccttaatggaaataccccacttacattctagtcttgttcttgcaactctttctttgatatctgggtgttactttatattcattttgctccaaaccagagatttaatatttgtttcctttccgatatcctttatttccagataattatcaaatcccttctccaaaagatttcttgaatctgtctgttctccattctgtggccaggcccttatcatctcactttagttttctgcagcagacttttagttattctctgcaacttcaggtggtctatgagaagtcttatagatcagtattctttaagtagcacattgtgctgctactactcacaaacctagaatgattccttgttgcttactgtgataagtctgaattcttttgtctgaatgtcaagaacatgtcatttggcccacatatatttcaccttattttatttacttacacacaaacacaaacgcacacatgcacatgcacacacacagtcatctctctaatcaggccaaattcatcatgcaaaaaactcagtgagctggattaaggaaagtaccacctgagctcctcttcagggagttggtttctgaaggttcacaggaaatgtaacaagatgaagaaatggtttactaaaaatactctcagagaaggtattttatgtagctttgggaaatattttcataagcagtttgggctagtgtgtgagaccaccaaaggacatgccaaactgacacttgaggtcagtaattctgattaactgcagggcttttagctgaatcaagactccaagttagggacaaaggtgaattcttcaggaccagagcagaggtataatgtaaacttcaggcttctccctgagtaaatgttgaacacacatttggtactggtttgaagaagtgttaattattagcctacccaggtttccacatcttgatctggccttgaatttggactacctttccccgccatgtctttgtttatattgtttttttctgcttagaaaaatgtgctcttcctttatctgtaatagaagactttgaatccagtaggttgatacctatggttacataatcagaaaaggctcctactctaccaggagcaaatgcatcctgtttgaacctttaagtatatggtttagataggtatagagcatgcattttcaacaggggtgataacaacttagatagttacaatggtttgtgatcctccaaagctcaatgctacggtaaagaattttatcatttcagcatttaatttctcttgttagggagaaattgaattaaattaaatcaatgaattatagttacttaaatttaattttattccatagagtaatggttatgaaaaaaaagttgagaaatactgatggagaaaaagagaaaaatgctgttacagcttttactttttgtggcaagaagtctcatacgtactggatttttaaaatgagttaatcctttttttgtcaattattagcaaagcactctgctgacttcattggaagcattgattctgtacctacagaaacttgagaaaaaaagacataaaaacaggatgtataaattatattaaatatagtatagaggatgtcccatattagtataacaattgctattttaggcaatgggtgctttgagcttaggcaaaggaagagattacttaatctgaaatgaccagaggtcaggttcaaggagaatctaggaacttaaactataccttgaaagaaatataggatttgaatacacagagggggaggataagcatagttctgattaaaacgccatcttgattttttgtgaatgtgagtgtatgagaggtagggaactatcctctttaactatagtcataccttggagatattgcaagtttggtttcatgccactgcaatgaagtgagtatcaccataaaatgagtcaaacaattttttttttgtttcccagtgcatataaaagtcgtgttcatgctatactgtggtctactaagtgtgtaattagcattatgtctattaaaaaaggacatgccttaattaaaaaatacttcattgctaaaaaatgctgatgatcatctgagacttcagcaaatcatttttttggtggaaggcctggccccaacattgatggctgctgagatcagggtggtggttgctggaagttgggaagttgggaagttggggtggctgtggcaatttcttaaaataagacaacaatgaagtttaccaaatccgttgacactttctttcatgaaagatttctctgtagaatgcagtgctttttgacagcattttacctacagtagaacttctttgaaaattagagtcaatcctctcaaatcctgctgctgcaaactaagtttatgtaatagtccaaattctttgtcataattaaacagtattcccagcatctttaccaggaatagattccatctcatgagaccactttctttgcccactcataagaagccactcctcatccgttcaggttttgtcatgagattgcaacaattcagtcacatcttcagactccacttgtaattctagttctcttgctgtttccaccacatctgcaattactttctcccctggagtcttgaactcctcaaagttatgcatgaagattggaatcaacttattccaaactcttgttagtgttgctattttgacctcttcccatgaatgatgaatgctcttaatggcatctagaatggtagatcctttctaaaaggttgtcaattgattttaacagatccatcagagaactgactgtggcagctattactgtataaaatgttttgtttcatttttgagacggggtcttgctttgctgcccaggctggagtacagtgtaccatggctcactgcagttttgacctcctgggctcaagtgatccacctcagcctccctaatagttgggactacaggtgtgcgccaccatgcctggataattagaaaaaaaaaattttttttttagagatggggtctcactatgttgcccaagctggtcttgaactcctggcctaaagcagccctcccaccctggcctcccaaagtactgggattgcaggcatgagacaccatgcccggcccaaaatgtttttcctaagtaatgagacttgaaattactcattgatttatgggctgcagaatggatgttgtgttcacaggcatgaaaacaacatatcattaaatgtaccaagtgaccaagtgcattatcaatgagcagtaatatttggaaaggaatcttttttattctgagctgtaggtctcaacagtgggcttaaaatattcactaaaccatgctgtacatagatgtgctcttattcaggctttgttgttccatttatagagcataagtggaatagatttagtgtaactcttaaaggtcctaggattttcaaaatggcaaatgagcattggcttcaatttaaagtcaacagcaacattcacccctaaccagagaatcaacctgtcctttgaagctagacattctcctctctagctatgaaagtcctagatgtcatcttattccaattgaagggtgtttcatctacactgaaaatctgttgtttagtgtggccacattcatcggtgatcttagctagattttcttacttgctgcagcttctaaatcagcacttgctgcttcaccttgtacttttatgttaaggacatggcttcttttccttaaatctcatgaaccaacctctgctaccttcaaacttttcttctgcagcttccttacctctctctgccttcacagaattgaagagagttggggccttgctctggattaggctttggtttaagggaatgttatggctggtttgcagaccactcaaattttctccatatcagcagtaaggctgttgtttcactttcctatcatgtttgtgtttactagagtagcacttttaattttcttcaggaacttttactttgcattcacaacttggctaacttgtacgagagacgtagttttttagcctatctcaacttttgacattcttgcccactgaacttatttctactttttggtttaaagttagagacatgcaactcttcctttcacttgaacacttagaggccattataaattggtctaatttcttttttttttttccttttttttttttcaagacggagtcttgctctgttgcctaggctggagtgcagtggcatgatctcggcgtactgcaacctctgcctcccaggttcaagcaattctactgcctcagcctcctgagtagctgggattacaggtatgcaccaccacacccagctaatttttgtatttttagtagaaacggggtttcaccatgttggcgaggctggtctcgaactcctgaccatgtgatctgtccacctcggcctcacaaagtgctgagattacaggcgtgagccactgtgcccagttttggcctaatttcaatattgttgtgtctcaaggaataggcttgaggagagggagtgagacagggaaacagctgatcagtggagtggtcatgattaattttgctgtctcctatggcgcagtttgtggcgccccaaaacaatgacagtagtgacatcaaagatcactgatcacagatcaccataatagatatgataacaattaaaaagtttgaaatattgtgagaattaccacaaggtgacacagaaacatgaagtgagcacttgatggaaaaatggtgctagccaggtgcggtggttcacacccgtaataccaacattttgggaggctgaagtgggcagatcgctttgagctcaggagtttgagagcagcctgggcaacatggtgaaaccacttctctacaaaaaaatacaaaaattagccgggggtgatggcacacacgtgtggtcccagctactcaggaggctaaggctggaggattgcttgaacctgagaggtggaggttgcagtgagctgagatcatgccactgcactccagcctgggcaatagagtgagactttgtctcaaaaaaaaaaaaaaaaagaaaagaaaagtggtgctgatagacttgctcaatgtagggttgccacaaaccttcaatttgtgaaaaacacagcgtctgcaaagcacagtaaagcaaagaataataaaacaacatgtacttatactattattgactaacctaaagagagttaatcttgcaaaagctgaggtctctctattgcttttttaaaaaaagtttatagatttggagggtacaagtgcagttcttccatggatatattgcctagtggtgaagtctgggcttccagtgtaaccatcacctgaatagcatacatgacatgggacccaataggtagtattccaccttttggagtctccagaatatattattccattcggtatgtccatgtgtaccattgtttagctcccgcttacaatgagaacatagggtttttggctttctgtttttaagtcatttcacttaggataacgacctccagttccaaccatgttgctgcaaaatacatgattttattcttctttatggctaagtagtattccatggtatatctataccacattttaaaaactccagtcatccattgatggacacttaggttgattccatgattttgctattgtgaatagtgctacaataaatatatggagtgcaagtgtctttttgatagaatgatttcttttcctttgggtagatacccagtagtgggattgctggattcaagtatagttctacttgtagttctttgagaaatttctatactgtttttcgtagaggttgtgctaacttacatttccaccaacagtgaataagtgttcccttttctctgcatccttgccaacatcagttggtttttttttttttttttttttttttttgcatttctctgatgattagtgattggaccatttattcatatgtttgttagccacctatgtgtcatctttggaaaatgtctgttcatgttcttagcctactttttaaattttttttttttaaagacagggtctggctctgtcatgtgggctggagtgcagtgctgtgatcttggctcactacagcctcaacctcccaggctcaggccatctctgggctgataagagtctatagttgtcaccagtaaaggagaatttgtatcctgtctttaggtagaaaagcaagaggatatggagagcttttcccctattcattgctttaggctcaaaaataatttttatgtcagagacatattttggggtgatatatctttttcctttcctttttcctcatggcagaaggcaaaggagaaacaggcaccttcctcacagggtggcaggatggagtgagtacaaggagaggaaatgccagacgcttataaaatcatcagatcttgtgagactcaccatcacgagaacagcatgggggaaaatgcctccatgatccgattatctccgcctgatcctgcccttgacacgtagggatttatggggattacaattcaagatgagattttgggtagggacacagccaaaccatatcacttgggactcaacctcaagatatctcattatatatatgcacatattctaaaatctgaaaaaattttaaacctgaaacacttcaggtctcaagtgttttggataaggtatactcaacctgtgctactgctgcttctcagtgaattacatggccatctacccagttacagttaagcctaaaacctggcagccattctttattttctccttctctcttatgttgtatccaagtaatctgcaagccctgttgattccctcttcaaaccatatcgttaagttcttccacttttctttgtctccactgccaccatcctattctaagccaacatgatcccattgctgaactactgcatagttttctgcttctaatttggttctcaatgtaattcattttttttcatgtaataatggtcttttaaaaaatggaaatcagcagcctggccaacatggcaaaaccccatctctactaaaaatacaaaaattagccaggcatggtggtgcacaccttgtaatcccagctacccaggaggctgaggcaggagaatcgcttgaacctgggaggtggaggttgtagtgagccaagatcacgccactgcaccccagcctgggagacagagcaagaccctgtctcaaaaaaaaaaaaaaaaatggagatcagaccatatggccatcctgcttaaaactgttcactggatttccattgcacttggaatagaatcctaaatccctaagcacttgatttggccagcccctgtctaccttactttgtttcatgctcatcttttgacttccgtaacagtagccacacttcttatttcctgtacataccaggttcttttcctacctcagagtttttgcattgaacttgctacattgtctactcagaatgcccccgctcctcctcatctttgcttagattcttcttttgcttctggccttagtttgtcacgttcattaaagtaatgcacttttccacctcagcctattaaagagatttgcaaaaactgaaaatgctactcttatcttcttaattcttttttgaaaatagttttctttttggtaaaaatatgttattaacataatgggtttattgttattttagaattaataggtattcaaatttctcattaaaatttcaggtttaatttcaaatatagtaaatactgatagctataacataaacaaaaggcctttggagaccttagtaattttaatttttaattatgacaaagtatcagaatttactattttaactattcgtagatgtacagtttagtaggattaaatatattcataatgttgtatagccatccatttgcagaactagacttccagaactagaaaaattctaaatatttcatgtaagtagaattatataatatttgccttgatgtgtctggcttatttcacttagcatcatattttcaaggcccatctacattgtagcatatatcaacatttcattctttttatggctaaataatacttcattatatgtatagaccaccttttgtttatccatttatctcctctttattccaaattatgctataagtaattgaaaatgtaactactaattattggtaatttaaatagaagatttattgattaaatagtaaaccatatggtatagagtctacatatggatagaatgtggatgatgaagatcctttcccatacctttttttctataatccggagaatgagatattcaatctggtatttgaaattcttagtcataattgtggtaacctttagtcatctaactcttttatttgtcccttgatgttgaaagtactggctttataaaggataattttattgaaaacataagctttgttattttaaatagttaataattacctacattaaagttattctttctctaataaggttaagttaccattttatttttcaattttctctaaggctgtttcagtcctgtcatcctattatcttaccctgttacttatattgacctagaacaggggctggtacatagtaggtgcttaataaatatttattgagtgaatgagtgttctcagatacacagttaaacaaacactcttttttttgttttttttgagatggagtctcgctctgtcgcccaggctggagtgcagtggcgcgatcttggctcactgcaagctgcacctcctgggttcatgccattctcctgcctcagcctcccgagtagctgggactacaggcgcccgccaccatgccgggctaattttttgtatttgttgtagaggtggggtttcactgtgttagccaggaggatggtctcgatctcctgaccttgtgatccgcccacctctgcctcccaaagtgctgggattacaggcgtgagccactgcgcctggcccaggaagataatgttttaatgaacgttagaaccttttgaaagaaatggataccctcactggaattactgcagagaggattccagattagcctacatgacctctaagtttctttccaactctatgacacttgagtcatgtgtcaaaacaaaacagccgggtgcggtggctcacgcctgtaatcccagcactttgggaggccaaggcagatggatcacaaggtcaggagatcgagactatcctggctaacaccggtgaaatcccatctcttctaataaacaaaacattagcccggctgtagtggtgtcgcctgtagtccccactactnnnnnnnnnnnnnnnnnnnnaggcaggtgtgatcacgtaggtcaggagtttgagaccagcctggccaacatagtgaaaccccgtctcttctaaaaatacaaaaaattagctgggcgtggtggcgggcgcctgtaatcgcagtcacctgggaggctgaggcaggataatcacttgaacccgggaggtagaggttagcagtgagccgagatcgcgccactgccttccagcctgggcgacagagcgagactccgtctcaaaaaataaataagtaaactaaaaataaataagtaaataaacttttaacactcaaaagttttcaacactatattgccatgtttttaacctttattaagctatagagccagattgttagcaaaggcagttatttcttggcttctgtgctcatgaatcagatcacagctatttctttgactttggctttgtggtttcttgaactatttaagtgatgtaaaagatgagtcttgttaggcgtttcctttcttttaaaagtgtatttcgtgttttattgtaaacagattttctccaaggaaacttttctctctagtctcacctcatcatctccctataaaatagagatatattaacttctacattgttttattattaggctatttgttatacatatatatgttggtttttattttacttacattttaaaagtgttctcagagattttgaagtaactccattctgactcagtcttttgcggattgctggaaattttcctttaggtcactctccacccactttgggaattgtgaatgctcaccattttattggttccctctggccactgagtacatgagtaaatgtcacatgcatgtggtattgcttgtcagagaatggaattctaagacttcctctttacacagaacagtttaacttttgtgcttctgggcagaggtatggtccttgggacagttctccttccacctaatagttatggcagagatcaggacacttcactttgctgcctgtgcactgaggcctcagaatctgctctacccgacttaacaggtatggttcagagttgatagtttcagggaggcttgataaccacattaatcaagtgtgaatgaagatttcaaaaaattcatcttatctgctactgtttttgtcttcattcttggtcagtgaaagtttgtgtgctttcttgggggaatatctcatagtaggatctcaataaatactgaatggaagaatgtatggataatatgtagtattttgtaataataagatatagatggcttgatgtgaagaacttaagctatattgaaaactgttgaataatttaccttacataatttttaaaagaagttattaaaacttattagcttcttagagaatatacagtcagataaagtagaattctggcaagataatgtttataaaatacttgaaaatgcctaaactaaaaatttgtaatattaatttctcctattactacctgacaaatttctaattaaactgataaaagttactgaatgactaactggtgaaaagtatttttaataaaattaaacatgaagcttaggaattttctcaatttcagttttattattttgggttttaactttttcaatcatgataatttactttgtacaagtggctattctgttttgctttatttttgttgtagcctgcaactgtagcaatagaaaaaaaatgccttttttaaattgtgataatatatttctgttatctaggttctttacatgtgagtgaaaatcagtcttctcttatcccatcttaaatctctgatctacctctatagcagtgaataatggaagataagttaacttgatatctaagttacctaatttatagtagtcatttcattttgttcaaaaataaaccattcccagcccacacacttgcatttgggcgtatacagtacatctgaatcatccagacatgtctgtcttaaccaatgaggaaagtgacatagactatagctactgggtaacactgacatttacttgctcttcccacaggcttttgttttcttttgtttttgcctttattccttatcttgttccccctcatttagttcccttactctttatgattcaaaatatgttcgttcttagcttcagaaaaatgttagggtgtttttctctttgaaaaagttttccttttgtttggtgctaatgggtagaatggtgtttaagtggatatcctgtgcagacagattgtgcaggaaattgaccctaagttctttgagaacaaaagaggagtgggaagaaagaagaaaggaaggaaataagatcttttgactcaaccaaaaagaccgtaaaaccagagacgggaagaaggggaatggggaataagaaggattgttttctaagttgtggttcttttagtactttggcctcaaaaattacttttatcctatagttattactttacatatttcagaaatataatattgtttggcctgcatatatcttctaaatttacataaaatcgtgctgtagatctcattctgttttctccttttgtcagataacacaactttcaggaagttgacttgtctttaagagtcctcttttgggttcagagtttccccttattataaacatgtccttgcgtattgacagtctgtcactctactgtcatcagtgcagaattcctattaatctaatttttttttttcttaaagacagggttttgttctattgtctagattggagtacaatggtgtgatcttggctcactgcaggctcaacctcccaggctcagacaatcctacctcagcttcctgggtagctgggactacagttgtgtgccactatgcccagccaatacttaattttttttttttttttttttttgagacagagtcttgctttgtcacccaagttggagtgcagcagtctgatctcagttcactgcaacctctgcctcccgggttcaagcaattctcctgcctcagcctcccgagtagttgggattacaggcacccgccaccacacccagtcagggttttgccatgttggccagactggtctcgaactcctgacctcaggtgatccacctcggcctcccaaagtgctgggattacagacgctagccaccacacctgatgaagtctcatgatgttgcccaggctggtcttgaactcctggcctcaagtgatcctcccgccttggcttctcaaagtgctgagattataggcatgagctactgtgcctggcctgcgttcatccagtttaaatgtttatctaattttaagtctgaaaccttgccagactctagagttttgttttatattctttcctctcatagcatcctctgtgagtaaggatgtatacatagttcattcattcagcaaatcttttttgagagcctcttatatgtagacactgttctggagtcactgttcagtgaacaaaacagacaacaatcctggtcctcataaaacttacattttagcaaggagacttagatacatgaatataataataaataagtaaattatacactatgtttggtggtaataagagctatggagataaaataaatcaggaaaggagtcagtgggggatgtgagagtgttatcaagaatagatgtactttaaaatggaataatcagagaatgacatactgagaaggtaacatttggtgaaatgtcatggggaagagtgttttaggcaaaaggaaaagccagcgcaaaggtcctgaggcagaagtgtgcctgctttgttcaagcaatagcattgatgtcagtggccagaataaggtagaggaatagcagcaggagatgctgggcaagaccaattgtgaaggaccttgcagggcctttaaggattttagcttttactctaaaatggggaacctttgaagagtcttgaacagaggagtagcaatctgacttatgctctgaaagatggctggtatgttgagaataaacagtagggaacaagcacggaagcatggaaatcaggagtctagtgaaatagtctacatcagtggtcccaacctttttggcaccagggaccagtttcatggaagtcaattttttcacagactgggtggggagcggtggtttcacatgaaactgttccacctcagatcatcaggcattagattatcataaggagcattcaacctagatcccttgcttgagcagttcacagtaggtttcagctcctgtgagaatcaaatgcctccactaatctgacgggaggtggagctcaagcggtaatgctcgctggcccgctgctcacctgctgctgtgtggcccagttcctaacaggccacagacctgtctgtggcccaggggttggggtccccttacctagatgatggtggtcatgaagtggtactgaatgagaagtggttagattctggatatatttttgaaggcagtgccaatggaatttctgagtgaattggatgttgtttgtgagagcaagaagggagctgtgtccggaattggtgggttcttggtctcactgacttcaagaatgaagccgcagaccctcgcggtgagtgctacagctcttaaggtggcgtgtctggagtttgttccttctgatgttcagatgtgttcggagtttcttccttctggtgagttcgtggtctcgctggctcaggagtgaagctgcagacctttgcagtgagtgttacagctcttaaggtagcgcgtttggagttgttcgttcctcccggtgggctcgtggtcttgctggcttcaggagtgaagctgcagatctttgcggtgagtgttacggctcataaaagcagtgtggacccaaagagtgagcagtagcaagatttattgcaaagagcgaaagaacaaagcttccacagtgtggaaggggacccgagtgggttgccactgctgggtgggtggcctgccccgcgggaaggcagctaaggcccagcgagaaattgagcgcagcaccggtgggctggcactgctgggggacccagtagatcctccacagccgctggcccaggtgctaagtccctcattgcccggggctgacagggctggctggctgctccgagtgtgagtgcggggcccgccaagcccacgcccacccggaactccagctggcccgcaagcgcggcaggcagccccggttcctgctggcgcctctccctccacacctccctgcaagcttgagggagtgggctccggccttggccagcccagaaaggggctcccacagtgcagcggtgcgctgaagggctcctcaagtgccaccaaagtgggagcccaggcagaggaggcaccgagagcgagcgagggctgtgaggactgccagcacactgtcacctctcagagccatgaaggattccatggtttttggcctcaacatttgaaaagatggaattgccattaactgaaatggggaattcagtgagagaaacaaatttggagggaaggatggatgatagttttgcatattgagtcccaatggtgttattagtgatttctcatctttatattctgaagcccagcacagtgccttgcatgtggtattcactcaaattactagggatttctttttccccaataaacatttaaaataattaaacaggctgggcgcggtggctcgtgcttgtaatcgcagtactttgggaggccaaggcaggtggatcgcttgagctcaggagtttgagaccagcctggacaacacggcaagaccttgtctcaataataataattaaacaatatctgacagccactggaaaactctcctaaactggcagcattttggagcttgaaaagatccctgggtcattctctggagctgtaatcaaagtaactgagttatcagcatgattaatatccaggcagggggcaggtttcatagtgaggtttaatgctgtgtgcttaaaacaccccagctgttttcagaaatacaagaaatcttaagttgcactgtagattccctgagcgtccatcctgagagcttgggctgttgcagatgcagcaggcgctgacatgggaggagctggcaccacctgacagcagaggggttcatggaggcatcagtttaatcaatcatccttcttaaacttgctgtggatgtaaggcacccggtccagaattggcctccagtcagtggcccacagcagctccacagtgcccgtggcgccccttatgtccactgtggaaatccagttcttggccagctcctgattgtgtgagcccaggaagctgctcaatattgcatcactgtcctcaccctcagggtgatcaaattactgttttgtaaactttaaaatttaatatactgagtttcacaaagtaaggtataactatatgacatttgctggttttgtcctgataggggttaagagttggcttctgcttattactatttctaacttggttgttgatagtaccaaagttctttttactgttgagtttttctcttataatttcaaacaaggggaacttttcctgtactacgaataattaaataaactgataatcattaaacagagtatttataaacattgtaatgtgttaccagtgtcactggcaaaaatatatatatatatttataagtgtggattatgtagtgttcagtaatgggtgctaataaatatggatattttctgtactttttttggcatttttttcattttaataaaggattggcattttgtagccagtggaaattctgctagagtagataatttttgcattagaataaagacaaatacgatatatgaaaccggtttgaagaatgttttttacaatatggatttttgttgatttggtcatcccaaattggctatcttggtatagaatacagctgttcccattcaccataattctgcatttaaataaggaacaacataactactttaactttccatgatatcagaactttttttaagtttatcataatgtaaaacaaaattgaattaactggaattttaaatatatattctttttgagagaagggaatatgaaactctgaaactggagaattacagagccaacctacaacaggaatttctgtgtgtatatcatgtagaagttatgaagccttttttttttttttttttgagacagggtctcactctgttgtcacccaggctggagcacagcggcgatcttggctcactgcaacctccacctcccagactcaagcaattctcgtgcctcagcctccgaagtagctgggattataggcatgtgccaccatgcctggctaatttttgtatttttatttttatttttatttatttatttatttatttatttatttatttatttattttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatgcagcacatgtttcagggagcacagggttgggggtaaggtcaccgatcaacaggatcccaaggcagaagaatttttcttagtacagaacaaaatgaaaagtctcccatgtctacctctttctacacagacacggcaaccatccgatttctcaatcttttccccacctttcccccctttctattccacaaaaccgccattgtcatcatggcccattctcaatgagctgttgggtacacctcccagacggggtggtggccgggcagaggggctcctcacttcccagtaggggcagccgggcagaggcgcccctcacctcccggacggggtggctggccggacggggggctgaccccccccacctccctcctggacagggcggctggccgggcagaggggctcctcacttcccagtaggggcggccgggcagaggtgcccgtcacctcctggacggggcggctggccggacggggggctgacccccccccaacctccctcctggacggggcggctggccgggcagaggggctcctcacttcccagtaggggcggccgggcagaggcgccccctcacctcccggacggggcggctggccaggctgggggctgacccccccacctccctccctcccggacggggcggctggccgggcggggggctgacccccccacctccctcccggacggggcagctggccgggcagaggggctcctcacttcccagtaggggcggccgggcagaggcacccctcacctcccggatggggcggctggccaggcggggggctgaccccctcacctccctcccggatggggcggctggccgggtggggggccgacccccccacctccctcccggacgaggtggctgccaggcggagacgctcctcacttcccagacggggtggctgctgggcggaggggctcctcacttctcagacggggcggctgccgggcggaggggctcctcacttctcagacggggcggttgccaggcagagggtctcctcacttctcagacggggcggccgggcagagacgcttctcacatcccggacggggtggcagggcagaggtgctccccacatctcagacaatgggcggccgggcagagacgctcctcacttcccagatgtgatggcggccgggaagaggcgctcctcacttcctagatgggatggcggcccgggcagagatgctcctcactttccagactgggcagccaggcagaggggctcctcacatcccagacgatgggcggccaggcggagatgctcctcacttcccagacggggtggcggccgggcagaggctgcaatctcggcactttgggaggccaaggcaggctgctgggaggtggaggttgtagtgagccgagatcacgccactgcactccagcctgggcaccattgagcactgagtgaacgagactccgtctgcaatcccggcacctcgggaggccgaggctggcggatcactcgcggttaggagctggagaccagcgcggccaacacagcgaaaccccgtctccaccaaaaaaatacgaaaaccagtcaggcgtggcggtgcgcgcctgcactcgcaggcactcagcaagctgaggcaggagaatcaggcagggaggttgcagtgagccgagatggcagcagtaccgtccagcttcagctcggcatcagagggagaccgtggaaagagggagagggcgaccgtggagagggagagggagagggagaggctgaggctgcaattttcacctatgctggtttatgacctagttagagaagacatcatagggcattatttaggtaataaaatacagagagaaaagagccactggcatttctaaataacgttcctgtgtttcctactgtaagtataggaaagtaggtgttcgcagatgcagagaaagggcatctccaaggcctcggaggaaacttttgattttataaataacttgatggtggaaggcaaacgccatcccggttcccaagcaggctccacgcagcctccacgcagcctccatggccgagtccatctcctcgcccaatttttgtatttttaatagagatggggtttttcactatgttgatcaggctggtctcaaacttctgacctcaggtgatccacctgcccagtctcccaaagtgctgggattacaggcctgagccaccgtgcctggctgaagccaatttttaaatactgtttaatgtgattttaaaattaagatacatgttgtttcctgtcacttatatgtttgtgtaatttgggcatttgtttagctaacagttattaaacacatactatgtaacttttggtaggagaagaataccattccagatacaaggaacatgttatgatgtttggggaacaaacatacgtagaatgtattattaatatagagataaagatagagtattaatgcagcaactgtgatgcttttgagagtacagatgggaggtgcagtagcccccattatccagttttgctttatacagtttcagttactggcactccaccccagtcagaaagtattaagatattttgagggaaaaagagagataccacattcacataaattttattacaatatattgttataattgttcattgtattattgttaatctctttctgagcctaatttataaattaaattgtatcatggttatgtatgtgtaggaaaaacgtagtatatagtggatttggtactatcctgattgattttaagcatccactgggggtcttggaacatattcctcatggataagggggactactatatattggagctgagtattacaagtagaaatcagccagtcaaaagaaaagtggggtgagaacccattccagttagtctggactgtgtgaaccaaggccagaagatgggaagcagcatggtgtatattaaagtttacaatttgaggtatggagtagggagaggcgaagctggagaagtaggtagagacctgatcatgaaaggcctttgaatgccatgaaaaggagactttagcttgatgttaaactattgaagaagcttaagaaaagtgacgtggtcaatttttttcttaaatagatcactttgccagctgtgtggaggatggatttgagggagacaagactggaggcagtagtccaggtgagagatgttgagatgttgcagatttgaactaaggcattggcagtagagatggagaacagggaatggatttgaaaataaatggaaccacaaattcaagggtttttcctttcatatatgataaaactatttttatattaaaaataagttggcctggctgggtgtggtggctcacgtttgtaatcccagcactttgggaggccaaggcgggcagatcacaaggtcaggagttcaagaccagcctggccaacatggtgaaacttcgtctctactgaaaatacaaaatttagctgggcttggtggcgtgcacctgtaatcccacctactcgggaggctgaggcagtagaattgcttgaacctaggacgtgaaggttgcagtgagcagagattgtgccactgcactccagcctgggcaacaaaacaagactccatctcggtggtgggagaggggtgcggacggggaataagtcagccgggtgtggtggctcacgcctgtaatcccagcactttgggaggctgaggcgggtggatcacctgaggtcaggagttcaagaccaacctggccaacatggtaaaatcctgtctctactaaaaatacagaaaaattagctgggtatggtggcaggcgcctgtaatcccagctacttgggaggctgaggcaggagaatcacgcttgaactcgggaggcagaggtttcagtaagccgagatcacgccattgcactccagcctgggcaacaagagcgaaactccatctcaaaataataatgataataataataataatcataataatcataagtggaggaagagagacataaaagtgttgttatatgacatagacatttggatagtttgcctttgtagacaggcactaaaaatagtctgatcaagaaaattgatactggaaaaactgttttttgtataatcgatctgggctgtgagaagcaggtgatctttaagatggtatagggatcacctgtgctatgtactatgaataaatttagaaactgtaaaggcttaaggaaaaaacaggtcgtaaaaggcttggaccactttgagtagaaactcaataaatgcccgatgatagtaatgttttctaggctcttcaattaagttattgatatttacaaaaaatcactgctcaggaaaacaaaatagagtttaaaagtcattcaggccgggtgcggccacatttcttttgtttttttaaaacgaaaaaaagattattttttgccatgttggccaaaaaaagatatttttctaaaagcactttttaaataattttttctatacttaaatagagggcctggatttatacagtattacctaattctgaaaaataatccctgttgtcttttctacagtttgttttctgtggagagagaaaggaataagggtagtttgagtggacttgtaagaaacttacaatcatttcttccttaaaactacaaccactactacaacaaaatatcctctatgttttataaagctagtaaccatttctctttgagattcttttttccattttgagaaaactgcgtttcctattagtttatgtctgattttggtgagtgcatataaatcacggctaaactctcattttgtggtcttttctctgactaccttgttttacattttcaacaagtaaattgcttcctcatgcttaggagacacagtgcctatttgctaattcttcataacactttatactgtacagttctttcctactctggagccagcagctgaaatactgtgtatataatgaattcaaacaaatgtttcgctgttgaactcaccgtgaattcccttcccttcttatgtctttcagaagctttgcatcgtccctatggttgtgatgttgaaccccaggcactaaatgaggctatcaggtggagctccaaggagaacttgctcggagccactgagagtgaccctaatctcttcgttgcactttatgattttgtagcaagtggtgataacacactcagcatcactaaaggtgaggcttctatgtagcatcctttcacttttcagttttcattaatgattaagagataaaggggcctggccaggcacagtggctcacacctataatctcagcactttgggaggccaaggcgggcaggtcacctgaggtcaggagtttgagaccagcctggccaacatggtgaaaccctgtctctaataaaaatatgaaaaaaattagtcaggcgtggtagcccatgcctgtagtcccagctactcaggaggctgaggcatgagaatcacttgaactcgggaggcagaggttgcagtgagctgagatcacaccactgcactccagcctgggtgacagagtgagactccatctcaaaaaagaaaaaaaaaaaaaaattatcctgaaatacatttttttccccggcagtggctttcatatgttcaaaaggtaagaataagcttaggcagactagcaatccagttcatgtacacaaggataatctccccataatcctatttctttctcataaaagttacttttttttgcctttgcatgcgtgtgtgcgtacacacacacacacacacacacacacacacacacacacaaaatcaataatgattgattttatttggtcatgttcttaatgttcccttttataagaatttcccacggaaataaactaccactctcttgagaatattactataatggaaatcaaataaacctttcctaccattcctttcactaatctatataaacacaaacaatagacatttatgttgtctaggccagtgctactcaaaaatggtccacaacaaggtaagatgcttatgccagaatgtgaaacactgaactactatcttcatgcagaaagccttgctccaaaaggtaaaactattagctgaactaagtaataaatagtgtgcttagtgatatagttggtttacatttagttgaagttcttaatctcactgtggactagtaatgaatgaacagtcctcagataggcagtcaagttcgcagacattctgagtagcagtgaggtctggcaacatggctcatcttagccacagttcaattagaataggtgtgaccaggcacagtggctcacgcctgtaatctagcactttgggaagccgaggctggtggattgtctgagctcaggagtttgagaccagcctgggcaacacggtgaaaccccatctctactaaaatacaaaagacattagccgtgtgtagcggcatgtgcctgtagtcctagctactcaggaggctgaggcaggataattgcttgaacttgggacggggaggttgcattgagctgagatggtgccactgcaccccagcctgggcgacagagtgagatgccgtctcttaaaaaaacaaaaacaaaagaataggtgtatagtgagtctaaccttcatggtagttgcatgtgctggccaattgtacataggacagaattaaaagtgaaagtaaaagtgcatcatctcctagtgtcagttttacttcctgcttttggatagttttggggacaggatgatacatgttatgtatgtgggggttgtgtttatgcagttgtaggaacattttacgtaaaatttgaggatagaacaaaagacatcaaagaatttttttttttttttttttgagacagagtctcgctctgtcacccaggctggagtgcagtggcacagtctcggctcactgcaagctgtgcctcctgggttcaagcgattctgctgcctcagcctcctgagtagctgggattacaggcacgcaccaccacgccgtgttaatttttgtatttttagtagagacagggtttcacccgtgttggtcaggatggcctcgaactcctgacctgtgatccacctgcttcagcctcccaaagtgctggggttacaggcgtgagccaccacgcccagccagaaagtttatattgtgtagtagtctctttggactacaatatacttgattttacctttattaattcttcactggagaaatttgtgaagtgatgactcagaaattctttcataggtatgttttcctgttgttttttcaagatagcccagtcatcaaggaaacattgataaagaaagactgttgattcctcacttatgggttatgactggcctttatcttatgaccaacagtggtttctcttaaaatccacagaatgccaaatttttatatcaggttctcactaatttaaaatgatgtcatactaaagctattttattattttaaaagacaagaaaatatatttaaaaaataaagcaacactttagtttttgattgaaaatgatattttgcttgaattttttttttttaaagttctaccagccaagcgcagtggctcatccctgtattctcagcactttgggaggttgaggcaggaggattgcgtgagcctaggagttcaaaaccagcctaggcaatgtagtgagacccctgtctctacaaaaaatttaaaaattagccaggggcagtggcatgcacctgtagacccaggtacttggggggctgaggtctgaggatcacttgagcctgagaagttgaggttacagtgagctgtgtttgcaccgctgcactgccgcgtggcgacagagggagacctgtttcaaaacaaacaaaaaagttctccctagggttgctctgccagtttggccaatatttgaatccatactagtcatccccctatcagtttccatggtagtcaaaacttccagggtagaaaaattttcctgataactgacaaaaaaagaacaacaaacaaaaaatcctggggtctttgactgtatcttaattatgatagcctgttattaccaattcttttcaaggaagcaacaatattaaaaaatgtatatatagatatatatacaaagtactaatattctttatttttagctcatgtggactaacagagaaaagctacagagcaacaggttttcttcagtttttctagcaggattcttttttttttcttcctgtaaatatgattggcaagtatttgtgcacttatgcatatccaccgctacaccagacttactcttatctgtatatatgtatattttatgtacccataggtgtatatatgtacatatactcttgtgttttttctcattatctcatatccatgtgtctaaggtgagatggtgtctgatacaaagttattctatggaaacgtttctgaaggccactaaaaaaggacagatggttacaaggataattatttttagttctcctaaaaacttttgcctgatacttctggccatgtgctttttttttttttttttagcagtctcactctgtctcccaggctggagtacagtggtgcaatctcggctcactgcaacctcagcctcccgggttcaagcaattctcctgcctcagcctcccgagtagctgggattacaggcatgcagactatcacacccggctaattttttgtatttttggtagagatgaggtttcaccatgttggccaggctggttttgaactcctgaccttaggtgatccgcccctctcagcctcccaaagtgctgggattacaggcatgagacaccacgctcagccatggccatgtgcttttgattgacttggcttccttctactttttgacactgaagaagtagatgtgaatgctgtaggaagacttgcatctcttagagataagagcctgaggcactacaaggattctttagattagcatttatttatcactagtgatatctctttcactttttctgttttgtcaaagaaacctaatttgtgctgcaagtatcggggcaagttatatgttgaagtctgaacttgatgttcacaattttaatagaaaaattaagaacattgaagttgacagcaaagatacactgagtgacttgggttttggtttccaacttcagagtgagcttgccattccacacactgattttaatgtggaatggaaaggagtgattcattctttgtgggaactaggaaggaaataagaaagctatagctatttttaaacttgcattctggaagggattgtgttttgggagtcctaactgcccattcccctcaccccactaaacagttttcttgctgaaaactctgtggtccgtgtttttttttgtttgttcattttttgtttttgtttttgtttttttacatcagtggttttgttgccttggtgccaagtgaaatttagaagtcactttgtatctcacatgtcttatccctaatccttgattgttgttaacattgaatcatatataagatacattccttgataaacttttgagggaaagtgaattttcttcttttgaagagtgagcactgtgtccttttccagccattttagtaacctgtctggcatacatagaatttcctaaggatattttttaagttgtatatagacttttaaaaccctgtagtaaatgccagaaaaccatttgtgaccatacttctgtggttaagctaaaagctaaagagagcaatcaggatatgatgaacagccaagtttgttttcattatttaaaaaaaaaatttggcataaaagttctagattcttttttttttttaatgagtttaaagtttgacagtacactgcttcagttgaaataaagtcttaacatcgtttctttcatcctgtgatgaccttatggctaggtgaaaagctacgagtccttggttacaaccagaatggtgagtggagtgaagttcgctctaagaatgggcagggctgggtgccaagcaactacatcaccccagtgaacagcctggaaaaacactcctggtaccatggacctgtgtcacgcagtgcagctgagtatctgctcagcagtctaatcaatggcagcttcctggtgcgagaaagtgagagtagccctgggcagctgtccatctcgctcaggtacgagggacgtgtgtatcactacaggatcaataccactgcagatggcaaggtaagactccctggtcaccacctttaagcatggactggctactctgtgaaataatattcaacgtgattgaagtgaaataatagattttatgtctgacgtgaaataaaatattcactagctttgtgagtttgggctttttggcatgttagagcttgtactcttgaaaaggatatggtaatagaaatttttaaaaacagtattatattaatattttaaagataagctagatttgaaggtgaagaatgaagggaactgctctataagttagctgttcttataatcagtacacaaatatacacccagtgcactggtatagagtttatcagttaacattgtatcattgaaaattagaataatatctaccagaaagttcacagagtaagaatttagacttttgagcttggtgtcgatcattaatgtatattaactgaaacggatcattcagtcattgaacagtttgtatattgggaacaccaaccatgttagttagaatggatgtgttacagtgtgtttacacattataaactacagagcatgagcttatgtccgttggttatctgttgagcagtaaatttaggttgaattatttcttctattctcctctatgtgataggcaagctgtgggggaagcacaggctttggagcaagcagatctgattgtgaccttacataagtctcaatttccctgtctgtaattagatcccactttattgggttgttgtaaggattaaatgaagtaatttctgtaaaacataatgactgatacaaagtagaaaataagtaaatttttaattttctttcacttttgcaccagcatacagacatagtatgtttcctcttgaccaaacagaacagaatcagatgtgtaataatataagagtgacttagcagttctagttatttacctaatagaaatgagtgcatatgtgtgccagaagacatgtataggaatgttcatagcagcattgcttgtgatagccaaaaactagaaacacccacagatctaacaacagtagaatggattaataaattgtggtatattcataaaatgcaatttcattcaacaacagaagcgaacacagtactgctacacacaccaccaccaggtaaaactatggccctccagccgtctgcttttttttgtaaataatattttattagaatacagccacacccatttgttcatgtattgtctatggtttctattactaggcagtgctgagtagttcacagttctgacacactatggccacagcctaaaatatttattatctggcccttatgaagagtttgctggcccctactctagatgagtgttagctgactcaacaacttcagcaaagttgaaggattagtattagccaggggatgaggatgtggggagtgggaaggactcctaatagatatgaggtaatgagaatgttctagagttagatagtcatgatggttggacaactttgagaatatgctaaaaaccatgaaatggtataccttaaaatgatgaattttatggtatctgaaatataatgcaatttttaaaagttgggtggaaaaaagcagacataaaacaatacatattgtgtgattctgtttgtgtatagttcagaagcagaggccaggcatggtggctcacacccgtaatcccagcactttgggaggccgaggtgggcctcatcactggaggtcaggatgtcagccccacaaacatggtgaaaccctgtctctactacaaatacaaaaattggcctggcatggtggcacgcgactgtaatcccagttactcaggaggctgaggcaggagaattggttgaacctgggaggtggaggttgtagtgagccaagatcgtgccactgcactccagcctgggcaacagagcgagactctgtctcaaaaaaaaaaaaaaaaaaaaaagcagaagctaatctaagatgttagaagtcagcatagtggctatctctgcaagggcaaatagctggagagcataagggaggcttctggggtgctgatcatgttataattcttggtgtgggtgatgtttacatgggtgagtttactttgtaaaaattatcaattttctgtttatgaattgatactttatacactaaaacaaaagcttctttttttttttttcttttgagatggagtcttgctgtgtcgcccaggctggagtgcagtggcgcgatctcggcttactgcaagttccgcctcccaggttcacgccgttctcctgcctcagcctcctcaatagctgggactacaggcgcccaccaccacgcccggctaattttttgtatttttaggggagacggtgtttcaccatgatagccaggatggtctcgatctcctgacctcgtgatccacccgccttggcctcccaaagtgctgggattacaggcgtgagccactgcgcccgaccaaaagcgtctttaaaaaaaataaataacaggctaggcatggtggcctatgcctgtaatcccaacacttggggaggccaaggaggggtagatcacttgagcccaggagttcaagaccagcttgaggaatatagtgaaacctcatctctacaaaaaattttaaaaattagctgggcatggtggcatatgtctgtggtcctagctactcgggaagctgaggcaggaggatcacctgaacctgggaggtcaaggctgcagtgagtcatgattgtgtcactgcactccaggccgggcaaccgagtgagacccttatttctcaaaaatacataaaaattaaggctcccttgggagagaaggccagagaattccctcttactttacatttcttattgcttagcaaattaacaactattttgtaagcaattctgtgaaatccagtgtggctcttttcttttttttagatggagtcttgctctgtcacccaggctagaatgcagtggcgtgatctcagctcactgcaacctccacctcccaggttcaagcaatcctcccacctcagcctcccaagtagctgggactgcaggcacgcaccaccaagcctggctaatttttgtatttttagtagagaggaggtttcaccatgatggccaagctggtctcaactcttgacctcaagtgacctgcccacctcagcctcccaaagtgctgggattgcaggtgtgagccactgctcctggccaccggtaaattgtggctctttctttaatggcctagacactcaactgcacgtcataattaaaattatgagatatttgaatactcttaccaaaaaaatctaaatcagtggttttcaagttatgttttttacaagattaaggtgatattttgtaaatttctacaagaggccaagtccttgcttgcctactttgatcagggtatctcttctttacgtatcttctgtagttgagtccatagtcttgtggcttaaaaatatttgaagactggccgggcgtggtagttcacacctgtaatcccagcaatttgggagactgaggcaggcagatcacttgaggttaggagttcctgaccagcctggctaacatggtgaaaccccatctctactaaaaatacaaagaaaaaaattagccaggcgtgatggcgcatgcctgtaatcccaggtacttgggaggctgaggcaggagaatcacttgaacccaggaggcggaggttgcagtgagctgaggtcatgacactgcactccagcctgggcaacagagtgagactctgtctcaaaaaaaagaaaaaaagaaaaagaaatatatatttgaaaaaatacataatttgagtatatatatatttgaaaatatatatatatttgaagaccaatgagcttgattatccagagagagatcttggaaggtttttcccaagactaatttaggaagaataggaaaggcagattaaataagattaaactgaagttctgtgtttacccttgcaatcatcatttaacttttttatttacctcaattaagataaactcttgctgggtatactggcccagtctgtaatctcagcaccttgggaggcccaggcaggaggattgcttgaggctggcgtttgagacctgcctgggcaatagtgagaccctgtctgcagaatatttttttttttttttttttttttaaagatagccttctatctatatcttcaggccagtgaaatatgggctttaaaaaagaattcctaggccgggagcggtggctcatgcttgtaatcccagcactttgggaggctgaggccggcagatcacgaggtcaggagatcaagaacacggtgaaaccccatctctactaaaaatacaaaaaattagccgggcatggtggcgggcgcctatagtcccacctactcagagaggctgaggcaggagaatggcgtgaacccgggaggcggagcttgcagtgagccgagatcgcgccagtgcactccagcctgggtgacagaacaagactccatctcaaaaaaaaaaaaaaaaaaaaaaaaaaaattcttaatctcttttcaagttgtttagcttttctccttttcttaccaggtgtatgtgactgctgagagccgcttcagcaccttggcagagcttgtacaccatcactccacagtggctgatgggctggtgacaacattacactacccagcacccaagtgtaataagcctacagtctatggtgtgtcccccatccacgacaaatgggaaatggagcgaacagatattaccatgaagcacaaacttgggggcggtcagtatggagaggtttacgttggcgtctggaagaaatacagccttacagttgctgtgaaaacattgaaggtgggttgctgagaattacagttttcaggcatctttttcttttgtgctcaatcacttggaaatatcagcatgcccttctttaactttggaacactttccacccactagtgccaagcacatcagcaaattgagatgattaaccctagtgccattgctgacaatgcagaggtagattattcactgcaatgcagtgaaacccacatgtgggaaaggtctgtctctggaggctgttgatgtagatcttagtgggaggttagaagcaaattaaaagttataaaagcaaaataagctcttttgcttcctgagaacgacccctgctggacagaattcttgtctgagagtcatgggcctctttcttgttctgtcctttctctcccttgttcttgttcctcctgtctctttgcagttagatcacttcttaatattaacagaaatctttttcgtagtactactatatgtctcctttaaacatcccagtatcaaattataaggttttcactcacttgattctcccagagcctcagtaactgtctctggtgtatcacttataagggctattctttagctattaagtagtagtcagttctgtttcttaagcatattctgagtgtgaagcaatatataaggccttgctctctaagaagattatgatctaagcaagaagataagtatgtaagcagctaagtgctctgtctcgtcattcaaagcctgagatatctggagaagtaaactatgagagaactgaactatccaatacagggctcctgtgtttcagttgattataggacacgattgctgaattttgctcctcctgctaatttttactccagggcatttttctttctaagttggacttcttaaaataataattatttcagctgggcgtggtggctcacacctgtaatcccagcaatttggggagctcaggtgggcgaatcacctgaggtcaggagagcatcctggccaacattgcaaaaccccgtctctactaaaaatacaaaaagtagccaggcatggtcgtgcatgcctgtaatcccagctacttgggaggctgagccaggagaatcgcttgagcccaggaagcggaggttgcagtgagatcacaccacttcaccccaacctgggtaacagagcgagaccgtgtctcaaaaaaataaattaaattaaaataataattatatcttgtaatatgctaaaatattcaaaagatagtttttacttttaaagctgaagctttatgattgtgagatgaatgaaatgattttaagttgagggtttgtccctctcgttttcttctttcttacctttccctttttctaggaagataccatggaggtagaagaattcctgaaagaagctgcagtaatgaaggaaatcaagcatcctaatctggtacaacttttaggtgaggaaccttgcctgaaccatagatttcctccaaaaatgcttgccctttaaccccttgttatctccaaatgctttttttttttctttttaaatatagagacagggtctcgctctgttgtccaggctgctgttgacgtgatacttccgcctgggcctttcaatatgttgggattacaggcatgagccaccatgccccgccttttttcctcccccaaacctttctttttagtcaccatggtggaagctgcaggtttgaatccacttcaataaatagttattttaatcagtaggttctgtgtttaaaaatagcccaagaaacagtggcctggattgattttggtgtataaaactgctcagtttgtactaattgccccagattcaaagttcagaagtgttcaaaatggtactgaaccaaaaactcatgaaatgtttttgcaaaataaagagacattaaacaaaggactgttgaaaagaagcaaattaaaaactgtgaccacacccctcagtttacctttacaagcaggaaatgctttattatgttagattggcttttcactgttcaggtcacaaagaactctcttactaagcctttttcctttttaaaaatagggccaggtttttttttttttcttttttttgggggggtgtggggggtgtttttttttgtttgttttttaaatacagagtcttgctctgtcaccctggctggagtgcagtggcatgatcctggctcactgcaacctccacctcccaggttcaagctattctcgtgcctcaacgtgcatcaccacgcccagctaatttttgtagtagagacagggttttgctatgttggacagtcaagtcttgaactgctgggctcaggcgatctgcctgcctcagcctcccaaagtgctaggattacaggcatgagccactgcacccggcctcttgttggttttttataaggaatctgccatatatcagtgaaatccttgactatggaaatgatgaaaatcattttgcaaagcagtattgcaggtggggctcacatagtcttcagcttgtgcacaattgctattacttttgaataagtattgttagcctgcagttgaggagaatcatgggccatgtgcaaaactctagacatgttggttttcttggccccttatagaattaatacaggtaactctgcttttgctcaaatagacaaatactcagaggcatatgaattcccagagaacaatacagtgaaagcaaggactcccttataaaccagcttcttagtttttgcttattaatttcagagaacgtggtggtaagaagggaaaagattattgccgaactagacctgaaaaattgtcaaattattcttggccaaagtggtttggagtgtttgaatgtacactaataaaaacaagcactattgttcaacttttaggtgtgtgtactttggagccaccattttacattgtgactgaatacatgccatacgggaatttgctggattacctccgagaatgcaaccgagaagaggtgactgcagttgtgctgctctacatggccactcagatttcttctgcaatggagtacttagagaagaagaatttcatccataggtgtgtaaaacttacctctgaccaaccatgaagccatcttgcttgacatgcagataaaaggaagaatgtgagaaccttcccagaaaatttcagatgattcaagaaagtaattttgtatttcacagggcccattataatgtcacttctaacttgtaaacctactgtactctgattaaagtattaataaggggcctttgctattctcaaacctgagaactctcttaaaaaaaaattgcaatagtgatggggtcttgctatgttgaccaggctggtctcaaactactggcctcaagtgatcttcccatcttagccttccaaagtgctgggattataggtgtgagccaccatgcctggccagagagctctctttattttgccagcactgtatccaagatcctttttcaccatctagtggctttttttttttttccttcttgagacaggctggctccatcgcccaggctggaatgcagtgatgcgatcttagcttactgcaccctcagcctcctgggctcaagccatcctcccacctcagcctcctgagtagctgggattacgggaatatgccaccatgcccggctaagtgtttttttatggtttttttttgtttgttttgttttttgttttttttttgtagactgggtttcgccatgttgccccggctggtcctgaactcttgagctcaggagatacacccaccttggcctcccaaagtgctaggattacaggcgtgagccaccacacctggcctagtggctgaatttttaaaatagttttctgcattagtaaataacttagtcttgtagaaaagcatctattgctcacctatcccagtgtacttataaatagggacccattttataaagcctgctttattccgcatcttgatgagtgctctacagtgacatatcattagtggctttctaaggtgttagtgattatcagaagatactaccatatttgtcagcacttacttaactctgcctataacacaaaaccaagaatagagtgttcatgaccattttcctcaccatctgaatggaatcacattagggttctctttcccacagagatcttgcagctcgtaactgcctagtgggagaaaaccatgtggtaaaagtggctgactttggcttaagtagattgatgactggagacacttatactgctcatgctggagccaaatttcctattaagtggacagcaccagagagtcttgcctacaataccttctcaattaaatctgacgtctggggtaaggttgaaagggacttttttctgtgtcattttatttttttttttataaatgccttgattctttagagcttctcttacgatgttcagtatcctctacctttacctgccattcttcttcagttattcagcaagcatttgttaaatacctcctatctgccaggactgtgttaagaactttgcataaacagaagtataggcctggtgtggtggctcacgtttgtaattacagcactttgggccgagatgggtggatcacttgaggtcaagagttcgagaccagcctggccaacatggtgaactcccatctctactaactacaaaaattagccaggcgtggtggcatgcgccagtaatcccagctattcaagaggctgaaggctgaggcaggggagttgcttgagcctggagggcagaggttgcagtgagccaagatggcgccactgcactccagcctgggcaatagagcgagactctgtctaaaaagaaaaaaaaaaaaaaaagtataaagaagaaagtttagggccaggcacagtggctcatgcctgtaatcccagcactttgggaggccgaggcaggtggacaacctgaggtcaggagtttgagaccagcctgaccaacatggaaaaaccctgtgtctactaaaaatacaaaattagctgggtgtggtgatgcatgcctgtaatcccagctacttgggaggctgaggtaggagaatcacttgaacccgggaggtggaggttgcggtgagctgagatcacaccattgtactccagcctgggcaacaagaacaaaactctgtctcaaacaaaaaaaaaaaagaaagaagaaagttttaaaaaagaagtccctgccttcagagagctcacagtctagatctcttattgcattggagtgctaatgatcctccctctgtaaagcatcctatttccacattaggttttttgtttttatttttgagacagagccttgctctgttgtccaggctggagtgcagtggcacaatctcagctcactgcaacctcccatctcccgggttcaagcgattctcctgcctcagcctccagagttgctgggactacaggcatgcatcaccatgcccggctaatttttgtcatagtagtagagatgaggttttgccatgttggccaggctggtctcgaactcctgacctcaaatgatccacctgccttggcctcccaaagtgttgggattacaggcatgagccactgtgctcagcctcacattaggttttatcactcatttgcagagtactgtgacacagagcttttttttttttcgagggaagtgtgatgaggtttcctctagaatttgtcctaattgatctggtttctactgctctgagaggtaatatgatttggttgaagcttagtagactgaacaatctggaaatttggattgtggaccaatagaaatagtcataggattctaagtcattttttactggaaatctcaaactcaaataactgagacaaaatcaaacaaatttttttctgctctgaattttatctgattttaaatgaatccatttttattttactcctcttgtattagctgactttaaaactgttatgcttcttagatacagtggttctcctttatcctcaggagaatacattctaagaccccccccttggatgcctgaaaccaaggatagtgtcaagccctggatatataatctttttttgatctgataaccgagaggtcttctcagtgactaaggggtgggtagcatctacggtgtggatatgttgagtaaaaggatgatttatgtgcgaggcgggaaggagaagcatggcttgagagttcatcatgcaactcaaggcagcatgcaatttaaaactttagaattgtttatttctggaattttctatttaatatttttggaccttggttgactgtgagtagctgaaactgtgggaagtgaaaccatggataaggggtgactactgtatatcaaaaacttttctaagaatagttggattatgcctcagacttcttaaatggtcatagtttattttccctcattacagtaaaggaaatctaaataaaaattgggaaatttaaataaaactgtcttgagattatctgcagcattcctgttgcaaatattttagaaggacaaatcatgctgtaagaattgataaaagagtatattatatattaatgttgttgtaacagtgtgtgaatgttacctaaaatatgaaagagaatcacctaattatgtaaaataaataatcggagaagaaacactaagtgctttttttaattccttatgcagcttttggggtattgttgtgggaaattgctacctatggaatgtcaccatatccaggtattgacctgtctcaggtctatgacctactagaaaaaggatatcgaatggaacagcctgagggatgcccccctaaggtttatgaacttatgagagcatgtgagtatttttgcatgttttaattttgaaggcataagctagcagttcagaatagttaacaaaattagaaacatttctcctctcagtgttgttagattgaatccagcctcatgacatttaaagagtttatcattgatcagccagttgtcatatcatataccattgaatcttattggaatcctaagcatagttgttatggcccaaatattgacccagtttctcagagacatttgcatatttaataagataagaaattgagtttagagattaaggtggggagggccgttttcaactagataaaaatgattgctaaagactatgaagaatgcataaaaataacctctgtggtagataaacagaagcatccgattgcttgcagatgaaaaagtaggaaagtgaatagtggattaaattgcagggttttgtttgtttgtttatttgtgttgttgtttttcaaacactcttgctttgttgcccaggctggagtgcagtgacgtgatttcggctcagtgacgtgatttcggctcactgaaacctctacctcatgggttcaagtgattctcatgcctcagcccctcagtagctggaaccacaggcacgcacaccatgcccagctaatttttttttttttgagacggactctcactatgttgcccatgctggagtgcagtggcacaatctttgcaacctccgtcccccaggttcaagcgattctcctgcctcagcctcccaagttgctgggattacaggcacctgccaccacgcctggctaatttttgtatttttggtagagatggggttttggcatgttggccaggctggtcttgaactcctaacctcaagtgatgcgcccgccttagcctcccaaagtgctgggattacaggcatgagccaccacgcccggcctaatttttgtatttttatttatttatttatttattttttgagacggagtctcgctctgtcgcccaggctggagtgcagtggcgcgatctcggctcactgcaagctccacctctcgggttgatgccattctcctgcctcagcctcctgagtagctgggactataggcgccggccgccaccacgcccggctaattttttttgcattttttagtagagacggggtttcaccgtgttagccaggatggtctccatctcctgacctcgtgatccgcctgcctcggcctcccaaagtgctgggattacaggcttgagccacagcacccggcctgtacttttagtagagacaaggtttcaccatgttggccaggctggtctcgaactcctggtctcaagtgatctgcccgactcagtctcccaaaatgctgggattacagatgtgggccaccaggcctggtcctaattgcagttgtgtttgaacataagtctgtgttgtttcctcattgaacattgacgttctctgttgcactttgtcaaaaatgaactctgagatcctcctttttgatatccttttatatttctgaatgtatacagttgattatatggttaggctgagtttgaagacaggttttacttcttttattttcaagtggaagaaaacttgccattttctaaaacatctccttgtttctcctcatccttttattagagggaataggagctgaggctaaatcgaagcaccagccttagaaagtgggttaatggccaggtgcagtggctcacacctgtaattctagcagtttgggaggccgaagtgagcagattgcttgagctcaggagttcaaaagcaacctgagcaatgtggcaaaatcccatctacataaaaaatacagtagcttgagatcgctgtgtgtgctcactttggctgggtgcagtggctcaagcctgtaatcccagcgctttgggaggctgaggcgggtggatcacctgaggtcaggggttcgagaccagcatggccaacatggcgaaacccctgtctactaaaaatacaaaaattagccggacgtggtggcgtgcgcctgtagccccagcaaatcgtgaggctgaggctggagaatcacttgaacccaggaggcagaggttgcagtgaaccgagatcgcgccactgcactccagcctgggtgacagagttagattccgtctcaaaaaaaaaaaaaaaattagctgggcgtggtgttgcacacccatagtcccagctacttggggagctgaggcaggaggattgtttgaacccaggaggtcaaggctgcagtgagttgagatcatgccagctgcactccagcctgggtgacaaagcaagaccctgtctcaaagaaaaagaaaaaaggaatttagaaagtgggttcattatacctctgagtctagagctgagaagtggctatgttgctatcattgtgaacatgctgtaactgtactttaataagtgtgcatcatgatgcatagaactcattattagatacaccactggatattgaatttctgcaaggagtttgtaatattttttcttctgttacataggctggaagtggagccctgccgataggccctcttttgctgaaacacaccaagcttttgaaaccatgttccatgactccagcatttctgaaggtgagaatctgttggatttactgttggtgactaattctgggtagtggtggtggtggtgataatggtaattacatttcaaaaatgatcaacttttgtggagtttgagactctgtttcaacttttaactacaaggacattgcatcagagtatagtttataatagtgagaaattatgaacaacttatatatctagtggactgtaaattattacaaccatatagctgaatatttaaaatgatattcatatatatacttttttttttttgagatggagtctcactctatcacccaggctggagtgcagtggtgcgatgtcagctcactgcaacctccacctcccaagttcaagcaattcttgtgcctcagcctcctgagtagctgggattgcaggcacctgctaccacacctggctaatttttgttatttttagtagagatggggtttcgccatgttggccagactgctctcgaactcttaaccttaagtgatccacccacttcagcctcccaaagtgctgggattacatgtgtgagccacagcgcccggccttcttggatatattgacatggaaagtagttaaaggttaactttaacttagtaaacgaggatatccatatgtccaataaccatgtttaacattactcatcatagagaaatacaaaataaaaccacactgagataccaatccacagcctaccaaaaaggctaaaattaaaatcaggcttggcaggcacagcagctcacacctgcaatcccagcactttgggaggctgaggtaggtggatcagttggggtcagcagttggagactagcgtggccaacatggtgaaaccccgtctctactaaaaatacaaaaactagccaggcgtgatggcaggcgcctgtaatcccagctacttgggaggctgaggcaggagaatcacttgaacccgggagacggaagttgcagtgagctgagatcgcacctctgcactttagcctgggcaacagagcaagactccctgtcaaaaaaaaaaaaaaaaaaaaaagactgagcactgtggttcacacctgtaatcccagcactttgggaggctgaggcgggtggatcacaagttccggagttcgagaccagcctggccaacatggtgaaaccccatctctactgaaaatacaaagaatagctgggtgtggtggcgggctcctgtaatcccagctatttgggaggctgagacaggagaatcgtttgaacatcggaggcagaggttgcagtgtgctgagatcacgccattgcactccagcctgggcaacagggtgagactccatctgcaaaaaaaaaaaaaaaaaaaagccaaaaataataacatcaaattttagcaagcatgcagagtaaccacagctttcatgcaaaatagtatcgctatttggggacaggttggcagggcctaataaacctgaatacacgtataccctgtgatccaccagttctcctacattgtgccaatcagacgtgcataacattgtgaaccaaaagacacagagcaggatgatgctagcaacgtattcatagtaactccaaactggaaacaacctaaacatccatcaagaggagaacaggtggattgtggtatattcacacgttggcatgctacacagcaatgagaacccctgccacatgcagcagcgtggacgaatctacacacatgatactgggcgaaagaagccagacaaaagagtacatactttatgattccgtgtatgtattttagtactctacttgccagttctttctcagttgtgtgccttttctgaaaagaactccctttttctgctatgaaattgttctttttattggtccccttgtcttcctcacagaggtagctgaggagcttgggagagccgcctcctcgtcatctgttgttccatacctgccccggctacctatacttccttccaagactcggacactgaagaaacaggtggagaacaaggagaacattgaaggggcacaagatgccacagaaaattctgcttccagtttagcaccaggtatgggtcccttagcaggtagaatcaaaatagaaactgccttgtttaaagaagcatggggtgtgaggcttttatgtccactttcatgcccgtcctccctggggaaagcatggcgtctcttttacccacccatgaagcccttggctatccatccaacatacaactctggctccagtttcatctccgtacccctgggttcccaagtatgtatcatctttacagttccatcaaaaacttcgctgaacccgatagaggagaagaggttgcgcagtggtttttaaagaaaggatgagtgttgaggtaataaccagcaggttatctcctcccccattttttttttctttttttttttttgagacggagtctcactgtgtcgcccaggctggagtacagtggtgcgatctcggctcactgcaagctccgccttctgggttcacgccattctcctgcctcagctttccgagtagctggaactacaggcgcccgccaccatgcccagctaattttttgtagttttagtagagatggggtttcatcgtgttagccaggatggtcttgatctcctgacctcctgatcctcctgcctcagccccccaaagtgctgggattacaggcgtgagccaccgtgcccggccccctatcttcccccatttttaacttacatcacatttggaacaccagtcactgtgaaatgataatgtatttattatttgcttctgagtcctgccaacacctgacctttgataaatgctgacaaaactcataatgcagcctcggtaactcaaatgtaatagattcacttcttgtcttttaagttactgatcggccatttctcatcagggttcatcagaggtgcacaggcctctagtggatccccagcactgcctcgaaagcaaagagacaagtcacccagcagcctcttggaagatgccaaagagacatgcttcaccagggataggaaggggggcttcttcagctccttcatgaagaagagaaatgctcctacaccccccaaacgcagcagctccttccgagaaatggagaatcagccccataagaaatacgaactcacgggtaacttctcatctgttgcttctctacagcatgctgatgggttctctttcactcctgcccagcaagaggcgaatctggtgccacccaagtgctatggggggagctttgcacagaggaacctctgtaatgacgacggtggtgggggtgggggcagtggcactgctgggggtgggtggtctggcatcacaggcttctttacaccacgcttaatcaaaaagacactgggcttacgagcaggtaaacccacagccagtgatgacacttccaagccttttccaaggtcaaactctacatcttccatgtcctcagggcttccagagcaggataggatggcaatgacccttcccaggaactgccagaggtccaaactccagctggaaaggacagtgtccacctcttctcagccagaagagaatgtggacagggccaatgacatgcttccaaaaaaatcagaggaaagtgctgctccaagcagggagagaccaaaagccaagttattgcccagaggagccacagctcttcctctcagaacaccctctggggatctagccattacagagaaggaccctccaggggtgggagtggctggagtggcagctgcccccaagggtaaagagaagaatggtggggcacgacttgggatggctggagttccagaggatggagagcagccgggctggccttctccagccaaggctgcccccgtcctcccaaccactcacaaccacaaagtgccagtccttatctcacccactctgaaacacactccagctgacgtgcagctcattggcacagactctcaggggaataaattcaagctcttatctgagcatcaggtcacatcctctggagacaaggaccgaccccgacgggtaaaaccaaagtgtgccccacccccaccaccagtgatgagactactgcagcatccgtccatctgctcagaccctacagaagagccaactgccctaactgcaggacagtccacatcagaaacacaggaaggaggaaagaaggcagctctgggcgcagtgcccatcagtgggaaagctgggaggccagtgatgcctccacctcaagtgcctctgcccacatcttccatctcgccagccaaaatggccaatggcacagcaggtactaaagtggctctgagaaaaaccaaacaggccgctgagaaaatctcagcagacaaaatcagcaaagaggccctgctggaatgtgctgacctactgtccagtgcactcacggaacctgtgcccaacagccagctggtagacactggacaccagctgcttgactactgctcaggctatgtggactgcatccctcaaactcgcaacaaatttgccttccgagaggctgtgagcaaactggaactcagcctgcaggagctacaggtttcttcagcagctgctggtgtgcccgggacaaaccctgtccttaataacttattgtcatgtgtacaggaaatcagtgatgtggtgcagaggtagccactgttagcctggtgggaaaatgcacacatttctgaggggagagggaaaaggacttgttttcctgtgttcttgttttcagaaaatgaaagactcatacttgagtgtgtttatgtgaagtacctcagatccctgagttctcacgtttacagtttcatctcaaaaataagaagcaaaccacataagtataggagaggtaaattaagtgggggcaaggcagtagtggacagggttggaaactgcactggaaaatagggaacatgtgtatgtcataaggaaggcaatgcagcccatccctacctggaatgctgggaagtgctaggcagggctgctctcagcaagactgcagcagctgcacccagacctggggctctggtaggtactaatggtgattatgctccaatttacctaatgaatttggtgggacagcagaaaagaaagctgggaatgtaccaagagaaatttttgttcagggctgttggaagtagctgttagccttgcttccacaaggccattgctgctgtaataagaactgcaaatcagagtgctacaacataaaactgggaaatatggccctatctgaatgcctctgtcctattttccgctggtgtatcagttagtgcaggaagtaaagaatgctggaaagttgaatcagaaattgaaaaccttctaaaatcttacacagattagcagaagtcacttctcccagtctggtatattatttcataatggaccaggatcggcttcctgcctgttggtggctatctgtaaaccataagtacaggggtctccctagtggttcttctctgtcttttgctgggcaggctgtcttcctttattcctggtagcattcagagcattaaccagtgttgattttgaaaatagtagtccctacaggttctcacaaaggaatgaatcctgttctgatacagttcccctgcatactgacatactggccaaggacttgagcagctgtgtatttttctttatcaactaaaataccagggagatggtcttttcttgaaacccagtggcctgtatgtgactgagaggaaaagctggcttggtcctaatggctgtttctctgtacctttcccttcccttaccaccttaagcccaatccaggtagagaatagggagaggcattctcctctctatggatttgaagtgaatcacccccacattattctcacatgcttttcttctctcacatattcctccctactcccccacccaatcattgtgcttatttgtacagatcttattgggaatattctttatttattttgtcatttcacttctattttaagaatgcataattgaaggagtagtcattttcagggagcaccaggtagaccctgggaacctaatgacttaatccttaaatatgttttgcccttgaaaaataggccttttccttccttccttagttataattgtggaagctaattaggatggcatggaagtgaatctaatgagttaggtattattaatgttcttggtatcgggtctaattccagttactgcttcattctctttttaaagctttatgaatacttcccccatcctccccaaggagagctcaatacacacatatttttattttattctctcaaaggaatattagcttaggaagataggaattcaacattgagcactgagttttcttctggctctgtcattgatacactgtcaaaccacagcctcatctcttaatctatttaattaaggtaacagtacatgttctcaagggtgttgcaagtaagtgtgcagctatcccttggagagcctctctggaaagctcttttagtgcagtgttgttatgctgaattgttttccattatcttatttgctgagtagaaaatattaatgaaattaagaattgttgagattatatgaattgggctagaatactaaggggaaaactatgttttgaatagagtttggcatttttgaccaagaacaaaattgagttttcattggaaagaaaggaaaccttg

SEQ ID NO: 13716 - DNA, 14452 bp, Human
cgcagcgctgctccctggaagctcaccttgctaaggtgcatggacagccggccagctacgcttaccgtgagcgccgcgagaagctgcacgtgtgcgaggactgcggcttcaccagctcccggcccgacacctacgcacagcaccgcgccctgcaccgcgcagcctgatacggtgtgccagcgtcctccccacgaggcaaataaacacagaaaactcacgcatggaatctggtgtttattacactcgggggagagaggaggtcactcggtccagcggtggccgcagtgtggggctgtgcacacgtagtaaaggcgcatggcgtcctggcagaaatgatgcatggttaggaaggatttggacccagcagcgccttaccccaaaagaacaggcaagagaacttcaccaataggtaagggcccggcagagttccaagaagcgcagggtcacccacattgatatccccgcccccagaaaggaccaaacaagccccagatacttagaaagccctcgcgccacttacctcggcccgcgcactgtgtgactggaagaacacagcctccttgtggccgcacctgagagggtaggggctcggtcaccggaggcttcacacccttccctcctcccttcgcccagtgaggagacgagcctcactttacctccccagtaccagctgaacgctcacttttggcacgggtggtcctcggtccgcggcaacgtggggtcctgggacacgtcggcgataatctgggtcagttcgctgcagggacgcgggggtgcaaaattacgctcagacccagcctccagagccaacacccccgcccccagctcagggcccgccactcactccacttcgtgcgtgatcttgttgacatagatgcagctgttgtcggcctcctgctggtaatcacagttccggcactacgagagggcgagtgtgggggaaagggggtcacggaaggattccagacaagattgggaggagagggcagggtgatcccggaggatatgacgacaggactctctttggggatgggcaggacatgagagtcaggatcacttgaggtgcagcggagggcgaacagggagtccgatcacagaggcagggggcagggcggggccacgctgggaacaggtggacctgccggggaagaccccggcgctcaccgcgtagagcagaatgcggttctccttgtcttccttggggtacagcatgttgttactgtggggagggggaggtgccaggggttagtcctggagccattcctcgcccgccttctaacatcacccgctccctccgcctcaccattcctggcagaagcgaatacccacgaagcccggctcgtaagtcccgtcgggctccatggcgacgcgcagcccgcgcagccctcccagccttccgcgcttgctccgccgcgctacaggtcgcgggaggggccaggcctaggtgcttcgccaaaagagggcggagctgcgcacacgtgctggctccccgccgcctcgggctcggctctctccgcgcagaggtttcatggcttgcttcaatcttttgatatcttagagtaattgcttccaatttttgggcatcgccgcctcagtttacagaatagtatggatctggtgccagagccgggaaaacgatgcgcatcgtaaaccgcaaaacactgagcatccaggacagaagccaaggcgcttggcttggttgaaggccagtgcgcatgcgcgagtttacccttcgcggactgggcgagctcttgccactcctacctccgggcttcagtcttcgccgcctgttctggtcctttcccgggccgctattggaagaaccgtgaactatggaaggcccctctggattggctgggctggcccaagagtaaggagagccctcttcctggcggtggggaagggacggcggcgattggcggacgctcctggcaggagagcgcggattggtcaggcacggagcaggaggcggggctgatagcccagcagcagcagcggcggcggcggctgcggagcgggtgtgaggcggctggaccgcgctgcaggcatccgcagggcgcggcaagatggaggtgacgggggtgtcggcacccacggtgaccgttttcatcagcagctccctcaacaccttccgctccgagaagcgatacagccgcagcctcaccatcgctgagttcaaggtgtggccatgggggcggggtccggaggggcggggcgaagaaattggggggttcccggaagggggaggctgggaggggccggggagtgactgggcgggcccggaggtgatcccaggctgcggaggctggggacccggtcgcggcggggcgggtccggagagaactcgagagtgcagagatgagggccgggtccagcgaaaaatccgacggtccagagggcgggggcaagaggcgaggggctggattgcggccccgtgcgtcctgactggggggtcttttggaggaaaagggacgtggcgatggtcattgatgcaaggggcggggcctccgtggcctccttcttctcaccctgcctcctcctcacagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtgaggactctctatctgggacactcccccaccccacctttcatttggttattcaacagacacttgctgggctttgccctcagtcatacccgagataggtcctgccttcgtggagcctccagtgcagcctgacgagagacagacccatcattagacagggacagcctagagtggtctgggctgggatcaggaaatcccaggggactggagccaccaagaagaggtgcctgactccacctgggagaatcagagagggcttcctggaggaagggatgtctgagctgagggatgaggaaagggtgacttaagagaaagaggtggaaaggagggagcagggtgtacagaggcctagaatgtgaggtaggtcacagtgagcgaccaggctggacagcttgggagaaaccagaacacaggatctctttgtgcatccactcagtacatcctttctgtctttttttgagacagagtctcactctgtcacccaacctggaatggagtgcagtggcactatcgggctcactgcagccttcacctcctgggttcaagtgatccttgtgccccagcctcccgagtagctgggattacaggtgcccacccagctaatttttgtatttttagtagagatgggtttttgccatgttggccaggctggtctggaactcctgacctcaagtgatcagctcaccttggcctactaaagtgctgggattacaggcgtgagccaccaagcccagcccctttctgtccttattccctcccgacctcactcagtctgtagcagccacattgctccttgcacagtccaggtgagctcggcctctggatcctgggcctgaatggttcttttgtcatatgcctgcgtgcctcacccttccttcctgtcttaatttaaagtgtcagtattctagtgaagtcttcaccggcctcagtgttaacgtttacctcattcctttccccttctttgctttattttagatttttgtgtttacaagtaattctcctctgacacactctggatttctctcatctggtttatttactctctgtctccctggattcgagtgccctgagggtggaaattttgatcactataattcactactgtgtccccagtacttggaatagtgcctgggacagggaggatagtccgtgaatcgttttttgttttgttttgttcgagacagagttttgcccttgttccccaggccggaatgcagtggtgtgatctcagctcactgcaacctctgtctcctgggttcaagctattctcctgcctcagcctcccaagtagctgggattacaggtgtgcaccaccacgcctggctaattttgtaattttgtattttaagtagagttggggtttcaccatgttggccaggctggtcttgaactcctgacctcaagtgatctgcccacctcagcctcgcaaagtgctgggattacaggcatgagccaccacgcccagccctgtgaatcattgttgaatgatgaattgaatccataaagtaagaccacaaggataatgtaattatccccattttgcagaagagaaaatttagcttcagggtggagtttatttatttattttttattttttttgagacagagtcttgctctgtctcccaggctggcgtgcagtggcatgatctcggctcactgcaacctccgcctccccggttcaagcgattctcctgcctcagcctcccgagtaggtgggattacagatgcccgccactacaccagggtaatttttgtatttttagtagagacggggtttcaccatgttagtcagactggtctcgaactcctgacctcaggtaatccgcccacctcggcctcccaaagtgctgggattacaggcatgagccaccgcacccggcccagaatctactttcttaaggatgaactgtcagtagcattttggccccagtctacatgactctagagagaactgcttcttttttctctcgttgattaactgttcattccccatctgtgttgtgccaggggtttcattatgactgcatctgagaagttctagtgtatgaggcagatgttggctaaatggccagaggactgaatgtgaagggtcaggggagacaagggttgtgtaggagatcatgaagctgggagaccctatcctggggtacctgatgcatcagtgacgtctgggaggacatcctggaggtggtgctgctggagcagagacgagaagaataaaaagaattggtcgggcatggtggttcacgcctgtaatcccagtgccttgggaggctgaggtggacagatcacttaaggtcaggagttcgagacggtgaaaccccgtctctcctaaaaatacagaaattagctgggcgtggtggcagatgcctgtaatcctagctactcaggaggctgaggcaggaggatcacttgaacccaggagctggaagttgcagtgagctgagatcacaccactgcactccagtttggatgatagagtgagatcctatctttaaaaaaaaaaaaaaaaaaaaggttaactgaagatggggaaggggtgccctaggagtggggcacaacccagcaaacactccaaggtgggagggagcgcggtggggattaagacaggccacttctgtggccaaacactgtggaagctggggaggaccctgacctggctcaggtgttcacaggccccctctggctgtgtgtggggaacagatggtggaggacaggaagagtagggagaccaggaaggggctgctgtgagagtcctgatgaggggacgaggtctggagctgtgggtcaggcctctgctgggtgcacaggactgagcctttgggccaccctgggcagctgaagctaaggggtgcgggtgttcataggcacctcataggcagtggcatctttgagcaggtttcataacaggcggttcaggtacacacagacctcccaggccactcaaggaaggtgttccagagtggagccactggggaatttttacattttctaaaattctttttctctttataaatatcacccatattcattgtttaaaataacagaacttcaaatttgtgaaaattctcaacagaaattctcagtgacgcttcatccggaggtaaaggccattcctattttgccatgttagcccagtggcttaggccagacacctcagggtgttccttgggcccgctctctccctcacccccacatccactctcatcaaatcctctcggctccacctacaaaaacttccctgaccctggtccagcctccatccttcccccaacctcgccatcccggcagcttcctccctggcctccccgctccccatctcagccagagggagcctgggaccacctgagtcaggccagggccctcctagctcagagccctgccctggtggcacttcgctccagataaaaaccaaagtctaggccaggtgcggtggatcgtgcctgtaatcccacccagtacattgggaggctgaggtgggaagatcacttgaggtcaggagttctagaccagcctgaccagcatggcaaaatgtcgtctctacttaaaaatacaaaaattagccgggtgtggtggtgtgtgcctatagtttcagctgcccgggaggctgaggcaggagaatcacttgaatttgcagtgaggcagaggtttccgtgagctgagatcacaccaccacactccagcctgggtgacagagcaagactccgtcaaaaaaaaaaaaaaaacccaaagtctccagcagtcccttgtgtcttccactctccctctggctcgctccaccccacccgcaccacccactctagagcgtgaaggacatttctacctctggccgtctgcacctgccgttcttgctcatctttccagccttggctgaaacatcccctcttttgggaagcctaccctcccatgctccttaagcctcttccctgtcatatttttctccatagccatcctccagtgtttcataggtacctgttcctttgtttgtggttggccttctccctgcacaatgagcacagcctgagggcagagtgcgtctgtgtttacactgagtccccagcatgaggcccagctgggcccctgggagctcggaaaccaatgaatgaatgaatagtgggggcagaacaggaagagatgctctggggcctgaggttggggccagcttaggagagtcccagaggcccatcgaggagatgcgctgtgcacagggctgtgggcaaggcctgagctctgccggttggactctgtgactttggggcccttggcgatgttgatgccagcaagcggggaacttctggggacagaggcagcctctgggagcttggatgggggtgaggaaggggaggtggccagtgtacgtagctacttctcccttccgctgggctcaggagagaagagaaggctgcagtacaggcgagggagggagatgcgtttttcccagatggagacactgaagtccctgcacccagcacccaggcctccctggccagaccctgatccccacggagcccctcccctcacacaggtcattgaccacagtggcgcccgccttggtgagtatgaggacgtgtcccgggtggagaagtacacgatctcacaagaagcctacgaccagaggcaaggtacgggcaggtgggcgtcgaggggtgcgtgggggccagagggagtatgtgcaggtatgagggcgggcaggttagacagggcccctgcagggaggccagtggtgtagacggggggccgagagcttgggaggatataggggtgaggctgggagtggggacagacggaggcctggggtgggaatgagggccgggaggtgtcaggggtatgggcagtcagacgtggtcgggggagggctgggaaagtggagggagttgaggggtaggtgtgggggctgggtgttgtcagggtcagatgggggcatggggcggtcggacggggtgtggagggcaggacaggtggaatgcgagtggacagggtggcggtcagtgagggcgcctgggacggatcgagtgttgggggagaccgggggcctcagggccggaggagggcggaggaggaaggcggatgatgaaggcagatgtgcgctgaaggggtgagagaccatgggtcctgtagtgaggggtgcaggcggcaccctttccatttacgattgtggagttggggggcctaggagtcctgggagaggctaaggctgtggtgggagacctggggcttgggtgacagccctttgtcacctggaagagagagttcctccgtgaacgtgggcccctcgtgggtggagcgtcatcctgttaggcccggccgacgccccaactgaccccagccccctctgcccacagacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtgaggtgcgggcggcgggacaatcccctcgccggggcaccgtcatgtatgtaggtgcgtggctcgcgggcccggtcccgggctccagggctccaaggccgggaggaaatgttgggggcacagtggagcctcggagaccacgctctgcctaggggcgcggggttgggggggactcgaaacgatctcagtccctggaggtgacggaaccatctgccgacactgacggcccagagtgtttgtggagggaagtgggaggcgcaggcggagtgatctgtccagcgagggaggaagcagaagccagaggcacgcggcctgtgcgcttcgaagcgtggggcagtgtcagtcgcagtggggaaacgggcggcgtgaccaaggcaggagtgagggaacacagggggctgtgtgagcccagaggaagcacctggaggctgggagcatctgaaggaaaggaggcagcagccaggtgaaaagggaggaagagttcccgccagaaggagtagcgggtgcaggtgagcagagcgcaggaggtccacctggggaaggggagcgggaggagaggggagaagtgtagtcaggggcatgggcagggcggcgtcacagtggagagcagtgtggatttttttaaaaagaacaggctaggcatgatggctcacgcctgtaaactcagcactttgggagaacaaggtgggaggcttgcttgagccccggagttggaggttacagtgagctatgattgtgtcattgcaccctagcctgggcagcagagaaagacccagtctcaaaaaaaaggctgggtgcagtggctcacacctgtaatcccagcactttgggaggctgagacaggaggatcacttgaacccaggaatttgagaccagcctgggcaacataatgagaccctgtctctacaaaaaaaaaaaaaaaaaaaatcccacaaaacttttgtcagttgtggtggtgagcacctataggtgccccagctacttgggaggctgaggtgggaggatggcttgagcccgggagttgaggctgcagtgagctatgatcgcaccactgcactgcagcctgggtgacagagggagaccctgtctccaaaaaaaaaaaaaaaaaaagatacacggggtacatatatgtattgttacatgggtgtgttgcctgctagtgggtggggaccgggcttctagtgtacccatgacccaaattgtgaacatcgtacccaacagataatttttcaaccctcaccaccctcctgtttctggcatccccactgtctggtatttccgtctttatgcctgtgtgtacccatcccccagtcgtcttcagccactaatttacgtctgtctctaatttgccgattctggatgtttcataggaataggatcatgcagtctgtggccttttgtaactggcggcttccactgagcagaatgctttcaagtttcatccgtggcatgcctgtgtcagtgccacactgttgccaaatagtcctgcattgagcgcctagaccacagtgtatccagtcaccagttagtggacattagggtcatttccactttttggctattatgaataatgctgctatgaaccttcttcttttttttttttttttttttctaatttgagacagcatctggctattgcccaggctggaatgcagtggcacaatctcggccatttcagccttaacctcttgggctcaagccatcctcccacctcggcctcctgagtagctgggaatacaggtactcatcaccacccccggctaaagttttgtggttttttttgtaggatgggatttcgccatgtggcccaggctggtctcaaactcttcccgctcaagtgatcgtcctgcttcagcctcccaaagtgctgggattacaggtgtgagccaccatgctcggcctgaacattcttttataaatttctgtgtggctgggcatggtggctcatgcctgtaattccagcactttgggaggccaaggtgggcagatcacctgagatcaggaattttgagaccagcctggccaacatggtgaaaccccatctctactaaaaattcaaaaattaactgggcgtggtggcgggtgcctgtgatcgcagctacccggaaggctgaggcaggagaatcgcttgagcctgggaggcggaggttgcagtgagccaagatcacaccactgcactccagcctgggcaaccatgcaagactccatctcaaaaaataaaaaatacatttttatgtggacatttgttttcatttctctgtgcctaggagtggaatccctgggccacatggtaacactgtgcttgacttttttgaggacctgccacactgcttcccacagccgctgcagcagttttcattcccgccagcagtgcagaagggtcccattttgtcctcatcctcaccagcactttagtctgtcttttgcttacagtcatccactgggtgtgaagtggaacatcatcatggttttgatttgcacttctttggcagctaatgatgttgagcatctttgcatggccatttgtgtatcttctttggagaaatgtctattcagatcctttgccttttgttttttgacacacagtctcactccgtcacccaggctggagtgcagtggtgctctcagctcactgcatcctctgcctcccgggttcaagcaattctcatgcctcagcctcccgagtagctgggattataggtgagcgctacaacacctggctaatttctgtatttttagtagagacagggttttgccatgttggccaggctggtctcaaactcctggcctcaagtgatccacctgagctggtggatctcccaaagtgctaggattacaaacatgagccactgcgcccatcggtatgtcggggtttggttttgttttttttcttttgagacgtaatctcgctttgtgcccaggctggaatacagtggcatgatctcagctcgctcgttccaacctccgcctcccgggttcaaacggttctcctgcctcagcctcccgagtagctggaactacaggcgcccgccaccacacccggctaattttttgtatttttagtagagacggggcttcaccgtgttagccaggatggtctcgatctcctgacctcgttatccaccctcctcagcctactaaagtgctgggattacaggcgtgagccaccgcacccggccagtatgtcgtcttttgagaagtgtgtgttcatgtcctttggccatgatcgtggctcactgcagcctcaacttcctgttgcccactttgtaatgggattttttttttgcaaagtgggtgttctttgagttccttgtatattcttctgctcagtttttcattgggatgctgtcttttgtcgctgagttgtgtattagtttgctaacaaagtaccactcactgagcaacttaaagttatttctcacagtaatggaggctagaagttcaagatcaagctgtcagcaggttggatttattctgaagcctctctctctggcaaggcagtagtgccatcccccttaggtttttacaaagccctcactggctggtgtcttcacccagtgaatgggggacaggggtggaagcagggacaccagtgaagtggctaccatattagtcccggcaggagctggaggtggtcctagtggtagcaatagaggtagcaagaaatggttttcaccaagacaggcttctactcaatgggtaggcatggatccagggtgatcctgaaatttcatggggatttcttctatgtccagaagcttcacagggatttctcttctgttggcaggtctcacagatttcaagcctggctactggattggtgtccgctatgatgagccactggggaaaaatgatggcaggtaacaagaattcccactcaggtgtctgtgtgtgcatttgtgtgtaagtccatgcgtgctgcttgctgagctgcccatgccagcttctagagtggagccatgtgagggtcctctgaccacacccacccctatcctttcctgcagtgtgaatgggaaacgctacttcgaatgccaggccaagtatggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgaccccattttaattttattcattttttcctttgccattgatttttgagactcatgcattaaattcactagaaacccagaaagtatttagaggacttcatgatttggggacccactgggtaaatagtggcccttcggtatcaggggccagcctctgtctcctcatatcttgctgttcccccatcttctcatcattcccacctcatctgctgtagctaccaggaagaaagggaagggaagggaggggatatcctttgcctttaaaaatgatgtacagccagctgggcacggtggctcacgcctgtaatcccacactttgggaggccagggcgggtggatcatgaggtcaggagatcgagaccatcctggctaacacggtgaaaccctttctctactaaaaatacaaaaaaattagccgggcatggtggtgggtgctgtagtcccagctgctggggaggctgaggcaggagaatggtgagaacctgggaggcggagcttgcagtgagccgagatcatgccactgcactccagcctgggcgacagagcgagactgtctcaaaaaaaaagatgtacaactctggctggatgtggtggctcacacctataatcccagcactttgggaggccgaggcaggcggatcatgaggtcaggagatcgagaccatcctggctaacatggtgaaaccccatctctacaaaaaataaaaataaaaaaattagccaagcatggtggcaggtgcctgtagtcccagctactcaggaggctgaggcaggagaatggcgtgaacccgggaggcagagcttgcagtgagctgagatcacgccactgtactccagcctgggcaacagagcgagactccgtctcaaaaaaaaaaaaaaaaaaagatgtacaactcagccaggcacagtggctcatgcctgtaatcccagcactttgggaggccgagctggcaggtcgcttaagcccaggagtttgagatcagcctggacaacatggtaaaacttcatctctacaaaaatgcaaaaaatgagtcaggtatggtggcgcatgcctgtagccccagctacttgggaggctgaggtgggagaatcacttaagcccagaaggtcaaggctacagcgagttatggcaccactgcattccagcctggatgacagagcaagaccctgtctcaaaaccaaaaaaaaagaaaagaggccaagcacggtggcccacgcctgtaatcccagcattttgggaggccgaggcgggagatcgagatcatcctggccaacatggtgaaaccctgactctactaaaaatacaaaaattagctgggtgtggtggcgcgtgcctgtaatcccagctactcaggaggctgaggcaggagaatggcttgaacccaggaggtggagattgcagtgagctgagatcgtgccacttcactccagcctggggacaagagtgagactccgtctcaaaaaaaagaaaaaaagccaggcatggtggcttatgcccataatcccagcactccgggaggccgaggagggcagaccacttgagttcaggagttcaagaacagcctgggcaacatggcaaaaaccctgtctctacaaaaaatacaacaacaacaaaaattagccgggtgtggtggcacgcacctgtagtcccagctacttggaaggctaggtggtaggatcacttgagccttgggaggtagaagctgcagtgagctgtgttcacaccactgcactccagcctgggtgacacagtgagactccatgccgtgacaccagcacgtggcgtgtcacattattaaggattatacagccaacagttactgggctggtttcctttaatcctcacagcaggccctgtccgcaagtctttcaccgtttcccgtcaacactccacctttcctgcccaaagtttggggttgggagggaattcccaggggttcccaggacttgggctcgcctcccagatcccgcaacctttgcgtgcctagcctcggcaatgaccgcccatctgccacgagggggcggcagcgcaccgttcagacgctgcgcccctggtgcattatgggtcgcgtagtctcaaaag

SEQ ID NO: 13717 - DNA, 8111 bp, Human
ctggagataattctaggaggcggtctctaaggggatatccttaggtggggttccccattcttgggggcttttgttcactgaaaggggagttcccttgcccctcctcccttttaggttccccgaaagcccactgatgctccctgtcaactatatttggcttacacagaatgctgccctttgagcagtctccaactctctcgatcatcaatgagcaaaccagcgggggagctgagtcacaagcacatgatgtggggctggaaagcgagggggccacactcagaggggtgaccatgtaatcgtccagacccctgtacctttcctcatccctggggctagtccctcagggctttccgcactccttccttgtcttgagggactctgtatttctgtgttggaggaagggtgtttccctctgcgtacatacatatcagagggactgatgctttatgtgtcttttatatgggtgtggtggtgtgaggaattggaaagctcagaaatggaaaatagttaacgttcagagtagcagatgaacacagctctcacatttgcattttccctttcgttctgactcatcttcccctctccccaccctgttgcccctccaccagcctcacccattgacacaccctgtctgatctaggaagggttaacatgtgcctgcacccatgtggagggaaggcgtggtaggcctggaaagagagagtgggaggctggtctgaacattcgagggtcctggagccaaaggaagaaacgggagcttagggacagtatttgcatctaggaggggacaaggactcttagatccttcccccttaagagaagcctatgggaggccgggcgcaatcccagcactttgggaggccgaggtgggtggctcacttgacatcaggaattcgagaccagcctggccaacatggcgaaaccctgtcactactaaaagtacaaaaattagccgggcgtggtggcgggcgcctgtaatcccagctactcgggaggctgaggcaggagaatcgcttgaacctgggaggcagaggtcgcagtgagctgagattgcgccactgcactccagtctgggagacagagcgagactgcgtctcaaaaaaaaaaaaaaaaaaaaaaaaaaaagagaagcctatggggaagccgactgtgccttgtcaccagagcagcttaccagtacctgacttgtttatcttccagtcatttactgtgtatctaatatacgccaggcacatatcataaatgctttatccgctgggcgcagtggctcacgcctataatcccagcacttcgggaggccaaggcaggcggatcatttgagcccaagagttcaagaccagcctgggtaacatagtgagacccctgtctctaccaaaaattcaaaattagctaggcatggtggctcaaacctgtagtcccagctactcaacaggctgaggtgggaggatcatgtgagcccaggaagctaaggctgcagtgagccgtgatcgtaccactgggcaacagagcaagaccccgtctcaaaataaacatgtcatcaaaatttgttggataaatgaaaattttgctataggatcagggataagagaataataagaaacagaaaaagaaagttgagcctctaagaccccatcccttccccagattaaagagttctgaagtgtgaaaagaggggaaacctccggggaccttgaccccttgggcaggaagtgaaagaaacccaagtcctgatttcagagaaatgtcatttgtcatcagcccaagaaaaggagatttttctcttcgaagaccaccacacgtccttcctggggttgcccctttcagagcttgatgggaggatctgagtcactcacacacccacccccaggtcattcccaggcagcaaatgaggcttcccagtaccaagtcagggagagggaggaggccagcttctggctcctccaccctattcttgggatccaaatgtttcaatcctttttacttctgcagctgtgtgctctgccgtcatctctaagaaacaaccataccactgaatgctactgtgtacttacaaaccacactcatattcgtcacgtcatttcatcttcacccccacctccaaatgaggtaagcagatattatgcctatttcatgaatgaggttactgaggcccagagaagtgacttgcccaaggtgactcaaatagtaaatggcagagatgaaactcaaaggcagggctgattattccaaggtccttgctgccacagatacacttctttgactctaggagttcacaaacgaagtgaggagacaggaggctaggggcagaatgtgtgcattctggaggtagagggggtggtctctcctgcaggcagaaggcagaggcagggttagaaaaccacaccccttcggggggactgtggcagactgatacttgggacatccaatggaggcctgtgaggtcaggggcggggctagctccagggggggccccaggagccccaacagtagttcagagcatgcggtgtcctggaagaagctacaagcggtgagtgatagcctctctccagctgaggccttcttcccatcacaactctttctgtctcctccctgccaacctagagccctctccctgaggtgtccaagtgcagccctccctgccccaagggcccttgctcacagggaacctgcacctaggactctgcctgctgggtgctaagacactgaggttctggttctcttcgtatctgggttcccagctctcttcttaaaagccaatgtggtggttttgatgtgtgagaaactcctgcctggttgggtgctgtctttctattcttcactttttgtcttatgaaaaacaaattaaaccatctccttacccgaatcttgagaggaaacagcctccctgtctccagtccccacgtcctttcctcccatctcctcaggagtccattctccaaaaggtctctccatcattgggtcaggagcctcctctcctgtggcttctgcacctgctctcctctttctctggatgggaatgtctggttccttccctgaggatgtgttctagaagcttcagcttcacagtgatgactgccggatgccttagcgcctgcgctcctgcagccaggatccctatcatgctgccctctctgcctttcaggagcgatgggcttttgggggaggacccactagctttctaagctctcccgtgaaactgtgtcatgctccatcccttagtgccggcgttgactgggttttgtggtgatccttgtctggaatgaagaaagcctggcttgcgcagaggtgtttccctgcagaggggcttggagaagcagaagtggcagtatctgctatcttttacgtcagagactgccaactggcagacttcccgcacgcctgtcttaaacccactactagatatttctgttaactgactggcccttgctctttaagtcctgaatttggtctgatttccattctctcgccaccatgcctacctgctatgattctggataagctccaatcctctcttgggttactttatttgctcactcaggacagagggctctgatctaggaccagcaactcacaccctctcccctcacatccacaggcttgaaatgagatgagatgttcctccctcccctttcaaccatggacctcacactgtggacttcctcttagagcctctgagttaggtacccaagccaaggcacaatgtccctgccccccataagactgcccagcccctatggctctgatcggctggtacagctagcagccaggctccggccagcactctgtgatactctgatcaccgtagggagccaggagttccccgcccacagcctggtgctagcaggtgtcagccagcagctgggccgcaggggccagtgggctctgggagaaggcatcagcccttctacctttgcccagctcctgaactttgtgtatggggagagtgtagagctgcagcctggagagctaaggccccttcaggaggcggccagggccttgggagtgcagtccctggaagaggcatgctggagggctcgaggggacagggctaaaaagccagatccaggcctgaagaaacatcaggaggagccagagaaaccctcaaggaatcctgagagagaactgggggaccctggagagaagcagaaaccagaacaggtttctagaactggtgggagagaacaggagatgttgcacaagcactcgccaccaagaggcagacccgagatggcaggagcaacgcaggaggctcagcaggaacagaccaggtcaaaggagaaacgcctccaagcccctgttggccaaaggggagcagatgggaagcatggagtgctcacgtggttgagggaaaatccagggggctctgaggaaagtctgcgcaagctccctggcccccttcccccagcaggctccctgcaaaccagcgtcacccctaggccctcgtgggctgaggccccttggttggtggggggccagcctgccctgtggagcatcctgctgatgccgcccagatatggcattcccttctaccatagcacccccaccactggagcctggcaggaggtctggcgggaacagaggtgagtggcggggtctagtgctctgcctccaggctgggagggcatggcccaggaggggcagccctgctgggtggaagggcactgcatctctactgcacagttcctgagctggggaagagacaagaagctgctgccacagggcacgccaaagcccagcccccgggggaggacttgggataccccctcttcacgaaggggccaggctcccaggtttagccaaggctgtaactcttccccaccccatcccaggatcccactgtccctaaatgcccccaaagggctctggagccagaaccagttggcctcctccagccctaccccaggtaagcccctcgctgtcctgcatacacctgtaacatggtgtcttctctgggctggggctcgaggagtccagcctgagcagggcccctacctcccactgttccttccaggttccctcccccagggccccgcacagctcagccctggggagatggaagagtctgatcaggggcacacaggtgagtcgggcgggggcactcgtgcctcagccccactgtagcccttgatttcctgcctgaatggtacagtgagttggcgctgggattcctggccctgccctcctttgccttctctgtccccacaggcgcacttgcaacctgtgcgggtcatgaggacaaggcaggctgcccacctcgcccgcaccctcccccggcccctcctgctcggtctcggccctatgcgtgctctgtctgtggaaagaggttttcactcaagcatcagatggagacgcactaccgagtccacacaggtatgggcgccctgccctgtgtgaactgtcggctttcttcccaactccgctcctgagtctccacctgtgtgcccggttcccgcgcaatcccctagccccgtggcccgatccacccctaacttggccagctttcgccgccttcttccttccttcaccggcctccccttccgaccgctctaggagagaagcccttctcctgtagcctttgtcctcagcgctcccgggacttctcggccatgaccaagcacctgcggacacacggggccgctccgtaccgctgctccctgtgcggggccggctgtcccagcctggcctccatgcaggcgcacatgcgcggtcactcgcccagccaactcccgcccggatggaccatccgctccaccttcctctactcctcctcgaggccgtctcggccctcgacctctccctgttgtccttcttcctccaccacctgacggggtgtcggtagcgtcttagccaagagtccaattaaagaacgaaaagcgggccggctcggcttctgacctggcaccgctgctacggcggcctagcaaattccgccccagaagcgccccaggaagggcgccgagtgccctctcctggacgatcgcgggtcgcagaagcccaggccagcgagccctacagagtgaggacactgaagtgtgcaggagcgaaggttaacagtaggggagattgtcgatctcatcaccataataaagagtttcctgtgccctcccttcaggactagaaagccgagtttagtctgtgcacacccccgcccacgccccttgtcctgtagcggcccctggtggccctgcgtccgctgtccagcgggatggacacttcttccacccccgaggcgccccgtcctccccaggaggcagccggccccgaggactcggtgtccgggcacaccttgcggcatgccggtcctggactggtgggggctgtgcgaccgcaagtcactcgccccttccactgcaatccacggcgcgcggagtctgatctgggaacgctcggcccgggagagagaggaacgcgtgctccgaccctgctttcggccacccgcctcctctccgggagcacacggaccccgagaccgcggcctctccggcgtcttccctccacaccgtgccaagccgccgccaggtcgcgcctggaacggagactgactatgctttccaccgctccttctccagcccacgcctcctgcagccgcgaactgcatttcccagggcctcgggggtcccggggcccgagcccgcggcaccctgggagtggtagtccacgcgggccgccggcctagccaagaacaatgggaggagcctggggctaggaccacacctcccggagacccggcaacccgctttccgggtcctggccgggaaccccgccgtcccggccctcgcgccctggctgccggcggaagaagcgaggcgtccggactacatttcccggaggcccccgcggttcgcccctctgcggccgcgacgcgggggtctgtgctccccaggtgcggtccgagggcgccggccggccgcggactccctctcccgtggtgccctgcgcgtggccggcccggcccccggtctcccgcggcggcgctggttgttgtcgtgcgccgcggccgccccgccccgcccccgctctctcccctccccccggccctgcgcacgggccgcccctccccccgcctccccggcccctctcacggtgccaagatggcggcggcggcgggcggcggcagttgccccgggcctggctccgcgcggggccgcttcccgggccggccgcggggcgccggcgggggcgggggccgcggcggacggggcaacggggccgaaagagtgcgggtagctctgcggcgcggcggtggcgcgacggggccgggcggagccgagcccggggaggacacggccctgctccgtttgctggggctccgccggggcctgcgccggctccgccgcctgtgggccggcccgcgggtccagcggggccggggacggggtcggggccggggctggggcccgagtcgaggctgcgtgccggaggaggagagcagtgacggggaatccgacgaggaggtgaggcggttggaggcgtccccggcgccgggtggggcggaggccggggcttccaggggtctgggttgtcccgggggcggcgtgggcaggccgggtcctcagggttccttcggagagacggggcacggagggagggcggctgcatgcagcttccgggggaaagggcctctggaagtgggtagagaagccccggctgcagccaggcactcgcgcccgatgtcggtcccgctgaagtgtcttgggccgatccttttcggcagctggcaaagctagggcggtggaggtttgggcgaggaggcagtggggactgcatgtccagccagtcgtggttgacagcggcagcgtggccttggcagacaggttggagctgtctgggctcttacctgtgggccgccccgccgggcctcgcaacctcctggtttctccagggccccagtttctcttggcatctcaggtagagtggtggagggcttcctcttggggctcgggttgaacaggagtgggatgaaggccgggactgggcactctagcaggtcagagctcagctcaggatttctcccccagcctttcagaacaggcaggaaggtgtgggttgcgttgccctggacggttaataacaacctgagagctcgcagtggagcctgtacgaaagccatc

SEQ ID NO: 13718 - DNA, 14411 bp, Human
tgcacaccaccacgcacagctaatttttgtatttttagtaaagatggggttgcaccgtgttggtcaggctggtcttgaactcctgacctcaggtgatccgcctgccttggccacccaaagtgctgggattataggagtgagccaccgtgcctggcccccatcaaggggttttaagcagggaaagggatttggattttaggaagatctcattgcaggggatgaatacatgcatgtaaacaggtaattccacaaataatcacaatgttgatggacacagaatgtgtaagaagaggtccctgacccaattccatctggacactgcaccccagatggtatgtgagaggctttagaggccagatgggggaggaaggaaagcagttctctttcatagctccctctcctagtccctagatgcttccttcatttccacaagaaattcttgcattcagcaaatatttatagaccacttcctgtgtgccaggcactgctttagatacaatggtgaatgaataaggcagacaaaaattcttcctttatgataattcttttctgttgagggaggcaaaaagaggtaaacataatgtaaaagaacagatatagccgggcacggtggctcacgcctgtaatcccagcactttggaaggccaaggcgggcagatcacctgaggtcaaaagttcaagaccagcctgaccaacatggacaaaccgcatctctactaaaaatacaaaattagccaggtgtggtggcgcatgcctgtaatcccagctactggggaggctgaggcagaagaatcgctctagctcgggaggtggaggttgcagtgagccaagatcacaccactgcactccagcctgggcaacaagagcaaaactctgtctgaaaaaaaaaaaaaaaaaaaaaaaaaaaaagccaaattggccaggtagggcagctcacgcctgtaatcccagcattttgggaggccgaggtgggcagatcacctgaggtcaggagttcaagaccaacctgaccaacatggtgaaatcccatctctaccaaaaataccaaaattagccgggagtggtggcgtgcgcttgtaatcgcacctactcgggaggctgaggcaggagaatcgcttgaaccgagtagacgcaggttgcagtgagccaagttcgtgccactgcactccagcctgggcgacagagtgagactccgtctctctctctatatatatattttaagggtagggatttttgtgttttgtgcagcgtgctttctcaacccgtaaagtgcctgatggctggatacggtgggtcacgccggtaatcctaacgctttggaaggccgaggcgggaggatcgcttagagaccaggagttcgagtccagcctgggtaacacagcaagaccccatctctataaaatgcatatatatatccaggagtagcggtgcgcatctgtaatcccagctactcgggaggatgaggcgggagaatcgcttgaacccaggaggcggaggttgcagtgagctgagatcgcgctactgcactccagcctgggccatagagtaagaccctgtctcaaaaatttaaaaaaaagaaaaaaaaaatttaaagaaaagaaatacctgacacagaaaaagcgttcaataaatatttcttgcatgaataaaagtactttcgctgggacatttttctccacacctaccctccagccagccccgggatctataacactctctccgagtgaagacacagaggtgatgagatcgggtaacccacgggcgcccgagccccagccgcgcaagctcacgattgggccagaagtgaggatgaacaagcatttagcccaatagaaagtcgtagttctcttgctgggcgtggcttgaatgacttcagtggcctcctcctgggagggagctgaagccgctcgcaagactcccgtagtccccacctctctcagcttccggctggtagtagttccgcttcctgtccgactgtggtgtctttgctgagggtcacattgagctgcaggttgaatccggggtgcctttaggtgagtgtggagggttctgtaacctgggaccccagtctagcgggctgaggagccggaccccagcttccctgagaacgggttgaggcttccggctggcggcgtccggcctccctggaccccggggccctgttctgttcatcgtaagagctaacaatgatacggttcttccttgatgccaggcaacatcccaaacaactttaattaatttatttaactctcccaccagccctatgagatagggcctgcgattatccccttttgtcagtaaacaggctcagagataccaagcgacctagctgaacctacacagcgaccaggatttggcccaggagtttgtcctccagggctcttcatggctaattcacaggcgtggcctctcgcggcttgcctgggccgcagcctggctcccgggtgtccagtccatcctcccttttggacgttggaggggccgcagcgtcatctccgatgcaccctcatcctcagataccgggtagagatctcgccggtaacgatccttcctactgcgtctgtgccccagcagctggtgttttacaccccacttccccaccgaaagactgttttagtgctccagacccccaccaccaccttgcgtcgcttgaatttgacactgctctgcaagtctctgtatagccccacgactcctaggattccctggaatatagatacttttctctcaggctcccgacgaacactgtcacttcttcagagacattatattaaaggtgtttaaccctgggtccgcagagttggtagaattcaaggaatgctagtacttgaattggggtggggggtggaattgcatctgtgtttttactaaccttttgaggcagcaacctcggtagtactagcagcagcggtgattttgttagcaatgaaaatcatagacattccttttttttgtttttctccttttttgagacagggtcactgtgtcacccaggctggcgtgcagtggagaaatcttggctcactgcaacctctgcttccctgtgcaagcgatcctgcctcagtagctgggaccacaggcacgcgccaccacacctggctaattttaatttttttttttttttttgagacaagatcttgctgtatcgcccaggctggagtacaatggcacaatctcggctcactgcaacctccgcctcttgggttcaagtgattctcctgccccagcctccctggtagctgggattacaggtgcacgccaccatgcccagctaattttttgtatttttagtagagatggggtttcaccatattggccaagctggtcttgaactcctgacctcaggtgatccacccacctcggcttcccaaagtgctgggattacaggcgtgagccacctcttccggccaattttaatattttttttgtagagatgagatggggtttcaccatgttgcccaggctggtcttgaactcctgggctcaagcgatcctcccacctcagcattccaaagtgctgggattacaggtgtgaaccattgtgctccacccaaaatcacaggtattcttataccacattataacagcaaatgtcacaaaatactatattcattcatgattacttcaaaattgtatttttttttttttttgagacagtgtttttgctctgttgcccaggttggagtgcactggcacaatctcggctcactacaacctccgcctcctgggtttaagcgattcttttgcctcaacatccagagtagctgggattataggcacctgccaccacacccagctgatttttatatttttagtagagccagggtttcaccatgttggccaggctggtcttgaactcctgacctcaggtgatccacccccctggcctcccaaagtgctaggattacaggcgtgagccaccgcacccggcgaaaattgtattccttaatgaatcctcagctggatataactgcttttctttgtgatgctgtgcaggtttttttcacttcatgtactcatggagcctatgcaatttttaaatacatttaaacatattcaggccgggtttggtgtctccgttctgtaatctcaacattttgggaggccaagccgggcagatcatttgaggtcagaagttggagagcagtctgaccaacatggtaaaaccttgtctaaaatacaaaaaaattagcagggcatggtggcaggcgcctgtaatctcagctgttcgggaggctgaggcaacagaattgcttgaatcttggaggcggagtttgcagtgagcctaggtcgtaccagtgagcctgggtgacagagcaagactctgtcttaaaaaaagaaaaaaaaaaacattcagcgagaggtttctgggattcatcagactgctgaggagtttgtggcaccaaaaagattaagaatctttgcagtgtagattatgccaacaacggaggcagcccaccagttatttttatgccgtttaaccgtaggaagtcacttagacaccctgttccttcctcgtctgggcaatggtgatagtaatagttcctaccttttagagtggctataggagtaaagtgtgtagaacagcgcctggcatgtagtaagcactcagtgagtgttagctcatgttatttggggaccaggcttgattttgctgaggagttgtaccccaaccctgccgcgacctcgacactcagatgtgtggattcgccctgcccctcatctctgtgtatgttgagaggcaggaacttgttcacacccagcccattgttccgtgcctgccctcttccattgatcctgggtagtctggcttgctcagggcccctggggcccctgctgacacccactcctttcgcctccaggattcagcaccatggcggaagacatggagaccaaaatcaagaactacaagaccgccccttttgacagccgcttccccaaccagaaccagactagaaactgctggcagaactacctgggtaagcaggacctttccctggccacatacctcgagtcactcaccgcttgcctcttcctaggggacccatccaccccagcctcctcccttttattctgaacatccttactctggaaggcccatgcctctcatcacctgctgttcaggtccaggctagggttacaaactttagttcctgcaatgattttttttttaatttaaattttttattattattatggtttggttttgtttttttccagagatggggtctcactttgtcacctaggctggagtgcagtggtgcaatcatagctcactgcagcctcaacctcctgggctcaagaggtccccctacctcagcctctcgagtagctgggaccacaggcccacactactgtacttggctaatttttttgtagagaagaggtctcagtttgttgcccaggctggtctcaaactcttggcttcatgcgctcttcctgcctcagcttctcaaagtgttgggattataggtgtgagccaccgtgcctggcccctacaatgatttttttttaagctgtatgtgtgtgcgtactgtaacatgtacagaaagcacataacaaacatgtacagctaaatgaataattctaaagtgaaccccttgtgcaaccataacctggagagaaaagcagacattgcccacactctcatctccctgccttcttttttttttttttgagatggagttttgctcttgttgcccaggctggagtgcaatggtgcaatcttggctcactgcaacctccgcctcccaggttcaagcaattctcctgcctcagtcccccaagtagctgggattacaggcacctgccaccacacccagctaattttttgtatttttagtagagacggggtttctccatgttggtcaggctggtctcaaactcctgacctcaggtgatccacccgcctcggcctcccaaaatgctgggattacaggcatgagccaccgcgcctggcctccccaccttctttatgtcctgtctggaacacagcaccccgctctccccagtagagaagtgacgccactaactgggggttatcacatctttgtttttggttttggtttttgtttttgagactgagttttttgttttcgttgcccaggctggagtgcaatgtcacgatctcggctcactgcaacctcttctgcctgctgggttcaagcaattctcctgtctcagcctcactagtagctgggattacaggcacccgccaccatgcccagctaattttttgtatttttttttttttttagtaaagacaaggtttcaccatgttgatcaggctgatcttgaactcctgacctcaggtgatccacccacctcagcctcccaaagtgctggaattacaggcgtgagccactgtgcccggcctcacatctttgttttttaccaccatgtttattattttattttattttatatatgttatgttgttatgttattgatggagtctgtttcttgttgcccaagttggagtgcaatggcacgatctcagctcattgcaacctctgcctcccgggttcaagtgattctcctgcctcagcctcctgagtagctgggaatacaggcgctcgccaccacacccagctaatttttttttttttttttttttgagacggagtctcgctttgtcgcccaggttggagtgcagtggtgcaatctcgactcactgcaacctccgcctcccagcttcaagcacttctctgcctcagcctgccgagtagctgggattacagtcgcctgccaccatgcctggctaattttttttttttgtatttttagtagagacagggttttaccatcttggccaggctggtcttaaactcctgacctcgtgatccacccccctcagcctcccaaagtgctgagattacaggtgtaagccaccatgcctggccaattttatttatttatttgagacagagtctcgctctgttgcccaggctggagtgcagtggtacaaccttggctcactgcaacctccgcctcccgggtttaagcaattctcctgcctcagcttcctgagtagctgggactacaggcgcgtgccaccatgcccggctaattttttgtgtttttagtagagacaggatttcaccatgttggccaggctggtctcgatctcctgacctcatgatctgcctgcctcggcctcccaaagtgctgagattacaggcgtgagccaccgtgcctggccaattttttgtattttttttttttttttgagatggagtctcgctctgtcgcccaggctggagtgcagtggcgtgatctcggctccctgcaagctccgcctcctgggttcacaccattctcctgcctcagcctcccgagtagctgggactacaggtgcccgccaccgcgcccagctaattttttgtatttttagtagagatggggtttcaccgtggtctctatctcctgacctcgtgatctgcctgcctcggcctcccaaagtgctgggattacaggcatgagccactaggtccagccacttttttgtatttttaatagagacagggcttcaccatgttgtccaggctggtctcgaactcctaccctcaagtgatccacctgccttagcttcccaaagtgctgggattacaggcctgagccaccatgcccggctaccaccgtgtttagattcacctctttgtgaactttatacatactgtgtgtattcttttgtgtttggattttttcattcagtaccttctcagatccatacatgctgtggcatatagcttgctcattttcattgctgtccagttttctacaatttattctatgcctgtacacttgtgtgatttccattttggagttcttacaaatggtgtggctgtaaacatctttataaatgtaattttgctgggtgcagtggctcacgcctgtaatcctagcactttgggaggccgaggtgggcagatcaagaccagcctggccaacatggcgaaaccctgtctctactaaaaatacaaaaattagctgggcatggtggcaggtgcctgtaatcccagctacttgagaggctgaggcaggagaatcacttgaacccaggaggaggtagaggttgcagtgagctgagatcgcaccactgcactccagcctgagtgacagattgagaccctacctcaaaaaaaaaaaaaaatgtgttccaactcttgatctgggctgacttgaacccctttcttcacagacttccaccgctgtcagaaggcaatgaccgctaaaggaggcgatatctctgtgtgcgaatggtaccagcgtgtgtaccagtccctctgccccacatcctgggtatgtgcctcctgccagggcccttgggatgctggggtggggtcttagcagaggggagtgtggtggcttggtgggagctcatctgtgaggggcagagggaggacagggcaccacactgtcccaggactcagtgcctttcctcccgcctagaattacctccctgtctccttctgctgatgcctctcaaccagtcagggctctcagctgaggcgaccagggtgctttgctagatgtagctcactcatgcactctccaaatacacactcagcactgggctcccatccctgtgtagctcacaattctgtgcagtcctgtccttttttattaggaacatttttttttctttttttttttctttttttttttttagacaagggtcttgctgtgttgccaggctggaaaggctggagtgcagtggcgcgatcttgcctcactgcaacctccgcctcctgggttcaagcgattcccctgcctcagccttccaagtagctgggactacaggtgtgcaccaccatgcccagctagttttttgtattttaatagaaacggggtttcaccatgttagccaggatagtctcaatctcctgacttcatggtccacctgcctcggcctcccagagtgctgggattacaggcgtgaaccaccgtgcccggccctattatgaacattttcaaagcagagataataattcattgacctcaaatacatccatcacccaaagtgaatagttatcaggatttatccacggtttcttcatctaccccttttcgttttcttctttcctttgctgaagtattctaaagcaagtcccagacacgtcatttcacccctgcctacttcagtgtggacttctaaataatgacacagtaagacagtcctttcagccctgatctgaccaaatctgtcgtcaatatttaatagctctttgctatgcccctgccctttgtttaaaaaaaaaaaaaagtttttaaagacaaggtctcatgatgttgcccaggctagactcgaactcctgggctcaagtgttcctcctgtctcagcctcctgagtagcttggactacaggcatgtgccactgtgcctgtctctctctctctctctctctctctctctctctttgtcgccctctcgctctctcttgctctctttctctctcgctctctctttctcactctttctctctttctttcctttctttcttttctttcttgagccttgctctgttgcccagactggagtgcagtagcatgatctcagctcactgcagcctcagcctcctgaatagctgggactacaggcatgagccaccacacctggcccaatttttgtattttttttgtagaaatggggtttcgccttgttgcccagactggtctcgaactcctgagctcaaagcagtctgcctgcctcagcctcccaaagcgctgggattataggcatgagctaccgcacccagctgaatctttcaaaataaaaaaaattaccctttaacttggcaattccacatctagggatgctacaaaaatcttcatgtacaaagatgcccattgcagagttgttcgtaatggagaatatttggaaataacccaagttaaaacattgatcttgatagtctttatggagactatggtgatctacatgctagcacacagaaagaatgctaagacacaggaaaagtaagttgcagaacaatctatatagtaggagtcaatttgcaaggatggagtttttatggtgtggtatgtgtatgtaaataaagtaggcacataccgctggcacttattatgggccagctatgttgttagacctttttttttttttttttttgagatggagtcttgctctgtctcccaggctggagtgcagtggtgcaatctcagctcactgcaacctccgccttccaggttcaggcgattcccctgcctcagcctcccgagtgtctgggattacaggcgcctgccaccatgcccagctgatttttgtatttttagtagagacagagtttcaccatgttggccaggctggtctcaaactcctgacctcaggtgatgcacctgcttcggcctcccaaagttctgggattaccggcgtgagccaccacgcccagccatgttagcactttacatcacataaggtcaacatgctaacacaaccgtatgaggtaggtactattgttagtatcctcattttacaaaattggaaactgaggcccagaaaggttgagtaacttgcccaaagtcacacagctaggaagtgatggagcagggattcagattcagcctctctgttatccatgctttcatccactgttcgttcttgcaccagtggtcctcaccctttttggcaccagggatgagcttcatggaagacagtttttccacagacagggttggggatggtgtaaggatgagtccagcatattacatttattgtccactttatttctgttattattacattatataataaaataattatacaactcaccatactatagaatcagtgggagccctgagcttgttttcctgcaactagatggtcccatctgggggtgatgggagatagtgacagatcatcaggcattagattctcataaggatcatgcagcctagatccctcacatgcgcagttcacaatagggttcgcactcctaagagaatctaatgctgccgctgatctgacaggaggtggaactcaggcagtaatgcgagcattagggagtgcttgtaaatatagttgaagcttgtctcgctcacctgccactcacttccagctgtggggcccagttcctaacaggccacagaccagtacctggtaggcactggttggggctcggggacccctgccttatagcataaaatgtgagcgtgtatgtatataaaaacgtttatgcttgtaactgcttgtgaggtccacaaagagtagagtgttactttcagggagtgttaacttgacataggccttatatgggccttttcattttttttttttttttttttttagagacagtcttgctctgtcaggctggagtgcggtgtgcagtggtagcatcatagctcactgcagcctcgaactcctgggttcaagcagttctcccacctcagcctccctagtagctgtgactacaggtgcatgccaccatgcctggctaagttttgtattttttgtagagacagggttttgccacattcaccaggctggtctcaaactcctgagctcaagcgatcctcccacctttgcctcccaaagtgctggaattataggcgtgagccaccatgcccggcttattttttattttttgtagagatgggggtcttgccgtgttgtccaggttggtctcaaactcctgagctcaagcagtcctcccacatcggccccgcaaagtgctgggatgacaggtgcgagtcaccacacccagcctccatcattgtttatactgagcatcgcctgtggtcagtggtgggattgcactgtgtattgtttggcaccttttttgcacttgactatgtatcttgaagatccatccattcatgccagaacataaatcagcctcgttttttttcacagctgcctgctattccatctcccctgtttggacaaacagcatagtgttgacttgaggttttcaaagcagggcccacccttggagctctgtacagtgacacatctccccatcgacagctctgcagtgggcctggggttttcctgcccattactctcctcccagcatgtcagcttgttcagaacagtgatttctgtcttttggggtcactgctgattccccggcctctagaatagaggttggcacacagcaggtacctgtggatattggttgaacaaacaggtgggcaaagtgaggaagataagaagtccatccgttcagtttccccactgcggagggaataacactgtctttccacaggtcacagactgggatgagcaacgggctgaaggcacgtttcccgggaagatctgaactggctgcatctccctttcctctgtcctccatccttctcccaggatggtgaagggggacctggtacccagtgatccccaccccaggatcctaaatcatgacttacctgctaataaaaactcattggaaaagtgagactatgcgtgtgaacgggccaggcagtggcaagaagctgggctggaatcagtgccctgaccagggaggggcttgaatgagtattttctctgttttgtttttatttatttaatttaatttaattttttttttttttatgatggagtctcgttcttcacgcaggctggagtgcaatggcacgatctctgctcactgcaacctccacctccagtgttcaagcgattctcctgcctcagcctcccgactagctgggactacaggcacaccccaccacacctggctaatttttgtatttttagtagagatggggttttaccatgtcggccaggctggtctcaaactcctgacctcagatgatccacctgcctcggcctcccaaagtgctgggattacaggcatgagccaccatgcctagcgttttttaacttaattttattgaaccttggccaccctctctgtgccagtcaatgagtcaaatagttgattatacagaataacctaagttcctatgtgtgcaaccaccctacataattttaaagcaaattatatagattataatataatataaaatacataaagattatattttatccagaaataagaaactatatgtatctcttggagatacaatttttttttttttttttttgagacagagtctcaatctgttgcccaggctggagtgcagtggtgtcatctcagctctctgcaacctctgccttctgggttcaaactattctcctgcctggagatacctatttttttaacataattatttacacctaagaaattagttcttaatggccgggcacagtggctcatgcctgtaatcccagcactctgggaggctgaggtgggcagatcacctgaggtcaggagttcaagatcagcctgggcaacatggcgaaacctcgtccctactaaaagtacagaattagccaggcatggtagcacatgcctgtaatcccagctactcgggagtctgaggcaggagaatcgcgtgaacctgggaggcagaggatgtggtgagccgagatcatgccattgcactccagcctgggcaacaagagtaaatctccgtctcaccaaaaaaaaaaaaaaaaaaaaaaaagagttcttaatatctaataagcaatctcctgcacaatgtgtaacttctccccgtgttgggacctgctctttcatgctgatcatgatggtagttggaagtcatttaagtaggccaagttgagagctgttcttcatggtgcccccaaaagaattgccacacaataacagcccagaatatccccaacagactcgtcaacagggacctagctagcatgaccagccggaacactcttatggctgaattggtgtgtcctcaaaacctttcaaatggccggggtgtggtggctcacacctgtaaccctagcactttgggaggcccaggcgagtgggtcacgaggtcagggattcaagaccagcctggccaagctggtaaaaccccatctcttctaaaaatacaaaaaaaactataaaaatacaaaaattagccaggtgtggtggtgcgtgcccctaatcccagctactggggaggctgaggcaggagaatcacttgaacctgggaggtggaggttgcagtgagctgagatcacaccactgtactccagcctgggcgacagagcgagactccatccccaaaaaacaaaaacaaaacttcaaatggttacaaacttgtctgatgcattcacatgagcagggatgattcttgtatggagaaaaatggccccagagatagatcttgtgaaatagctgctcatgaagaaaagtggctgtaggggccgggcgcggtggctcacgcctgtaatgccagcactttgggagaccgaggcaggcagataacctgaggtcgggagttccagaccagcctgaccaacatggagaaaccccgtctctactaaaaatacaaaatgagccaggcgtggtggtgcatgcctgtaatcccagctactctgga

SEQ ID NO: 13719 - DNA, 14797 bp, Human
ggcttttaaggtgggggggtgaaacatgtctccctgatacctgccgcagggactcttggtgcaaaccctggaccccgggctcctccagcagtcagtgacaccccccttccctgcagccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaaggtgagggccgccctccctggcgtccagaccgtccctgggcccccagccggtccccgcggctcatacccttctttctttctcccttgcagaacttggccctgagtcgggaaagtttagtcgtctgatctgacgttttctacgtagcttttgtatttttttttttaatttgaaggaacactgatgaagccctgccatacccctcccgagtctaataaaacgtataatcacaagctctggagagaaccatttgttcggccgcgcggggcgggggaccggggctgctcccgtatgcgtctgtaaagcgccgcgtcccgggggcaccggagtccggggccgggaggaagagacccagcctggcccggcccgcgcccgcgccgccggccggagaacgtgccccgcgcagccgccgcccgcctgcgtgcgcgccccggccccgcccaggcgtgcgcatgcgccccggccctccgccttcgcgcaccgcaggctggccgtccgggacgcgcgcgcgctcctctccccttccagcccatcccccccagccccccaccgacctactttactgtctccaaactcgggcagcccacctggcccccgacgaccccagcccctgcaccgggtaccccgacgttccatccagacccgcgtttcaccagggcggcgcgcggcgacctcgcgccccgcggagccccgggctcgcgcgcgcccgcccgcccccggagacagaccagcgcgcgcgccccgggccgcctccccccagcgcgcgtccgccccggggctcgcgccgccgccgccgccgccgccgcgcgcgcgcagctcaagtaaaggaggaaaaaaaaaagggggaaaaatagaaagcggcggcggctgcagcagcgatccgccgccggactgggccaagccgggcggcggccgcgcgagccggcgatccagggcactggcggcggccagccagggcgggccgtgttcaaaaaaaaaagtcgcggcggcggcggctgctcagggaaggaggcctgagggccgcgtgcagcgggcgggcagctgggtgggctgggggcggccgcgcggcgtcccggagcctcgggccgcccggagccggcgggcgggcggaggcggaggcggcggcggctgcagcggctgcaggagcggcggcggctgcggcggcggcggcggcatctcctcctcacatgaccccactgtttgtccccgtgatcagcgcgagcggctcccgtatctcctccgtcccctcctgccgcgcggcgtgagcgccgggctcggggcccccccggccgcccgccccctcccctccctccctcccctcccctcccctcccccccgggccccgcgccccccccgcccccgccccccccatggacatgctggacccgggtctggatcccgctgcctcggccaccgctgctgccgccgccaggtaagatccccggcccggccgtgcccccgcgccccggccccggccccggccccgcggcctgcaggccggggccgccatgatcccgagcggccgcgggcccggctcaaaatggaggccgccggcgcgggggggacctggcgcctcccgcccccggcccccggcctcggcggcgcccccggcctcaggcgcggccgggtgggactggggccctgcagctgggcgcgggggcgggggcgcgggcgcgggccgcgctgaccctgctccctcctgtgcccctggcagccacgacaagggacccgaggcggaggagggcgtcgagctgcaggaaggtgagtgcttgccgggccggccgcgcccggggagggctgggggcgctcggcgcggccctgaccgtgccccgaccctcctcggccccaggcggggacggcccaggagcggaggagcagacagcggtggccatcaccagcgtccagcaggcggcgttcggcgaccacaacatccagtaccagttccgcacagagacaaatggaggacaggtgagcggcgggccgcgagggcgaacgggcgggcgggcgggcgcgccgggaaggctcggacctggccccagcgccggcctcgccgctctgccgccccctgcaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggtaggtgccctgccacccctgggtgggggggggagggagtggagaggggacactggctctgctcttggggagccccgggggtggggcaggtgtcgcccagcggatgctgccttcaggcctcaggctgcatggggccagatccctgttgtgcaccgtgaaacctggggacagtgctcttggaatttttttttcccgcaaaatgggaatgatgtgtcttaagaggaaagtttcttagagtgcgaaacggatttgctcagcaagtgatcgctgacctcccgccatgttccagggctgtttgaaacacaggacagaatgctacacgcagaaggagtccccactcctgttaattgcagagaatgcagtaaaccccaagcacagcaatgaggggacgggatggaggaacagagaaagctaagggtagcctctgccctcctactccccaggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggtgaggagtagaagtcagattggcaggtgggggaggcaacgggcccagcagggagggaagcccccccagccagttctgacttcaccctgccttgccactaaccccccactctccctgcaggccagttctacgtcatgatgacgccccaggatgtgcttcagacaggaacacagaggacgatcgccccccggacacacccttactctccgtatgtgcaggggacacctggagggcctggtgttgaaatggaaggaagaggggtttctggagtagaagctgggcagttagcatgaagtgggcacatggtgtaatgttttttttctttgcctgtttctgctgctctagtgcacataaagtatcatgtcttttgtttttgcagatggatttaccttgcaaagataattttcaaatctaatacttagcagatgcttgggcaaacagctctgcgataatacatgccccctttttttttcctcctcttgtagaaaaattgatggaaccagaacaccccgagatgagaggagaagagcccagcacaacgaaggtgaggacaaggtgtggctccgggtccccctgaccaccaccctcacaggctcagccagccctggagtgtggagtgacagagagagaagccactcctgggcaggccacaagtgctccagagggctttgctggacgctgtaaaggtagaaagtgagcaacgaggggagagtacagtgtcagaagtagagggacagggagtgtgaattggaactggccatttgttgacccggctggtgatcttgaattcatggcccacatctaagatggtggacttcacactcccatacggattgcctgccccacttgaaaaatggggctgaccgggctcacgtgggctgacctttccacgtggcagctgtcatgctcacatcccgcactcccatgcctgcctggcctccagaagtaggtctgttcccccagggagcacatctgagggagaaactgcatgaagttctgcctctggctacctaaggccggagcatcctgccctttccagaaacaccaggtctcacctcaggtcatttggccttcagcactgtcccgccccgcctgtcagtagccactgcagtgggcacagcactgtgcaagtgccaggagagtgcttacacccaaacaaccatcattcaacaaatatttactgcccgtgggttctgggctgagcggcacaggccctgtgccaggtctggagtctggcctggagcgtcagggaggctcaaaggcctgagggcttatgtctcatgggtctcatgggacattgatggggggtgggctggggtgacgcttccctagggagaggggagtgtgggtcaggttactttgtggggtgctggtttggttgtgggagaagttccatttagaatgcctcaggagggaagatcgggaaggcctcgaatgcccgagtgaggggctgaatgctgagtcctaaaggtggtgatgggactggggtctgtggcccaggtagttgtgttctgagcagctcctccctgagttcaggcgttcattcagcgcgtgcatactacgaccagccccccttttgcgtcctcagatatggcaatgcagcagatgataggacagacaaggtctcagctctctgtgcgcgttctggtgggagagatgggagtcacacagccgcatcaggcagtgcaggcagtcacaggcaggagaggaaagctggggaagaaggtggcgggtgatggcggcatggtagtgtgctctgaagggctcttcgagaggtgacattgaagcagatccctgaagcgacctgagggaaggggcctgttgagaacctcaggagagtcccgggcagagggaagagctagaacacaggccaggccctgagccagggccgccatggtgtgtctgcagaagagcagaattcaggaaaggaaagaggaagttggcgcagtggagggggctgcccaggccagatggtggaggaccttggaagaagtccccagtgtggctgtctgggctcctgtggttttattccagggtgatgagaagccagcagaggggtttgggttgtggaggctgttggcaagagtggtgggaaggggctgggaggtaggagaccatacgactgtcaggcctgagacagggcaggggttgggggaaatgtggggaggactccaaggctggagaataagggtttcgtgctgaactcccctccatgcttggaagggaaggggtgcatctgagcttggttttgagatgcagtgagtttgaggggcccccagagcagccccagccccacgacttacctgtggtggggcgtcagggtggttcttaatctccgtacctgtcttccctctgtgaaatggtggaagcacagccgccccgggcacctggtggggatgcagtgagtcttggtggccacacagtaaggcgaagagaggactcagaaccctcccaccccactctcacccccgcctctcccttagttaatctgactccaggcagccttgaaactttctcaccctgtgaagcagtcttcatcacctgcccacttctccagctccgtcctgtctccgctttcctgacttgcagagcatctgccccaatctgctcatcctcccagtaccctcagccatctggctcatggctctaccaaaacagctccacttccggtcacccgtggtgaccccattgccacatccactggcctcctttgctgtctgggctccaagcatctgatgctgcctgtttccctctgttcctttctggaatcttcctttctcctccatcctctctgattctcctgtgatctttgcctttcctaccccactgttaacagtgaaatttccagggctgtcccagttccaagtgagtagatgggggtgccggggaatctgtgttttccatcagctcttcaggtgatttgtcatagtggacaagcttgagaaactgctttggctgcgagtgtttctttttttttgagaagggggtctcactctgtcacccaggctggagtacagtggcacaatcacagctcactgcagccttgacctcccaggctcaagcgatcctcacacctcaggcttctgagtggctgggaccacaggcaggcgtcatcacatggggtaatttttttttatctgtagagtggaggtcttgctatgctgcccaggctcgtcttgaacttctggcctcaggcagtcctccggcctcggctacaggcctgagctgccacacccagtcttgctggtgtttcataaggtccggcccctcccgtcggcctcaggtgtatgacttgtgaggcccagcgatgggctcggaagctcttggtcagtatcccccaaactctgttcccccttgtaggtgttcctcttttttctttgctgcagaagagtgtgtgactcacaaaaagttgaggactgttccttgatgtcctcccaggcttcgcccaccacctggctcctggtaatgcaaggaactgtgtttccatccattcccttcctttcactgcaactccagccccacgttttgaactacctattcgagatttctgtctctggacatccctgtaatgcctcaaactcaactcgcccaaaagagaatgtgccatctcccgtctccaaaggctttcatgcaaccttcttctttgcagagcagcaaaagctacccctgtcacagctgcccaagccagaaactaagaccagagccgctttcaactctgccctcttcttcccttatggccacaaaccccaagtttctcttctgtggtgatttcagatccgcttctctcacttctttttccctccttcccaccacttcttggtactgcaggagcttatcccagagtcacagactcaaatgcctgcaggggcctgagggagggaggtgcacttggcatctcaggaaggggtgtgtggctgggtgtggtggctcccgcccggaatcccagcacttttgggattacattttggccaagacggacggatcacttgagcccaggagtttgagaccatcctaggcaatgtgacaaaaccctgtctctaccaaaaaaattaaaaattagccaggcctggtggtacatgcctgtaacagtcccagctacttgggaacctgtggtgggaagatggcttgagtccgggagacagaggttgcagtgagctgagattaccctccagcctgagcaacagacccagaccttgtgtcagaaaaagataggaaaggttgtggggggcccccagtgatctggggcatgtgtgcgctgcctgaagggtggcccttgcccagtgccttccccttgctgccctgtcagaatctagggccactgttgccagaaactctgagaagctagaaatcgagacttatgtgaaatctgatttttaggtgccagattagattgctttttccgtttcattgatttctactcttaatgttactaattcatgcttctactcacttggttttttgtttgtttgttgttttgttttgagatggaatctcgctctgtcacagtggcgcaatctcagcttactacaacctctgcctccccggttcaagtgattctcctgcctcagtctcccaagtagctgggactacaggtgcccgctgccacacctagctagtttttgtatttttggtagagacggggtttcaccatgttggccaggctggtctcgaactcctggcctcaggttatccacctgcctcagcctcccaaagtgctgggattacaggagtgagccactgcacccggccccttctactcactttggattcaatttgctaggtttcatgctttagcttccctggcacaccccaaccccagctttttaaggtaattctttttttttttttttttccaattttctactaaaatctttattttacaggattaatgtttcacagcagggattgagatgattcttaacctttctctttgcttaacaacatttagagttgccagttcactccagcatcactttagctacatcccactgggatatgttgtttttgttatcattcagtttaaagtgttttccaattttccttgtgatttcttctttgacctttctgttatttggaggcaggttgcttaatttctaaatatttgtgggtttttcagatatctttttgttattgatttttaatttagttctgttatggtcagagaacatactctgtatgatttcagttccttgaaattcgatgagacttacccgacgggcccgaatgtgtcctagcttggcggaagcttctggggcattgacgaggacaggtgtctgctgctgtcaggcagaatgtccccccaggtcagtgaggtcaggctggttgagtgttcaggctttctattctgatttttgttgttgttgtttacttgttccaccaatcaatgagaaagatgtccatgtctctcactatatttgtggatttgtccatttcttccttcagtcctggcaggtttcgcttctgaattttctcttttttttttttttttttttgagacagagtctcgctctgtcacccaagctggtgtgcaatgatgtggtctcggctcactacaacctccacctcttgggttcaagcaattctcgtgcttcagcctcccaagtcgctgggattataggcatgcactgctatgcctggctaatttttgcatttttagtagagccggggtttcgccatgttggccaggctggtctcaaactcctggcctcatgtgatccaccctcccaaagtgctgggattacaggcgtgagccaccccacccagcttctgaattttaagtttcctatggagtaactgaagtgcttctgtggaatgaacgtggccttggtcctaatgggtcttcctgtatttcaaatgtgccatgatggtcttccgaagccacaggctggacagcattaccgcctgctaatgtcagggcctggattcaagggcctgggactctggaggaggaggagatgcggtcctgacctgcgagcagagcacacaaggccttgacaaccgatctttacaaccttttcccacccctgcataccctgaaatggttttcaggccaccatttctgggatcttcccagctgcctgccttagagtctttctctcagaaaccagcccgaatgtttcctggatctctgaggattcatcccacccccattcccatgcagaggccatggctcggcgcctggcgttcccgaggcactttgtaccatcttcagtgatgacacgaatgcaatggggttagtgccacttgcccacagtggtgctgcgagtgcccatggggcgcaccggggctgcttccaccctggaccccagcctggcggagggcctggcacatagtagggcggggagtaggtgtgtaagaagtaagctcgctctggagaggatgtagctgcagccggcgcccagctctcgagaggactgtgggagggcagaggctaaaacgaggccgcctgccgagttcctccacagacccctgggcgaggagcgctctgctggggactgcgccagcggtgcctccaggcctggactctcagctccgctgctgcttttggccagagttcccaaaggcgggtgtggttgtctttggtgggaaggttcagcgcaccgcgatagtaataggggagcaagcactcgctgagcccagtgcagggcctggaccgtgctccatagcaagcactgatcttgggctattggttttggaggaaagagggagcacaaggatggaaggggccagggaagagaggtcacggtgggagaaggagagtccgcatccatcggagggtttgtcactcaggcctgagtgggaggcactggaggcagggagaggccagtcagcagcatgcggccacagcccagagaagccagaggggtttgctggtgggtgggccccagccttttcaagggaacggcaggtctggggagctgccgatctcggggtgtgagggtaacgggcaggctgtggcccacccctccttctcaggctcactggacccctgaccggtttcatcaccattatccaaggctttgaaaagaccccctggccttcctgccacatgtgccctagctatagggcttcgttcccctccacaaatggtgcagacagcatgagccaccctggcagggggctgggggtccgtggggtaggagttgggggtagctgagcgttctttcctgtccccacggtgcctggtgctggggcttggcagccagggttgggacagcctggctttagcaggtcctgagtcaggggtctcaggctccgcagcacacagtccccaggcaggtgtcaggatgggatgtggccagagaaaggcatgtgctctgtctggggatagctgccacccagctgacacagttggcatgagattgtggagttttatggagtaaaatcacaaatctgggttttttaagtaaaaccttctatgagttgccatctctggccttcaacataggatttgggtctttcctgggtgagctggtgctttgtgggccaggccctgggagctgcaagtaccagttgggatctgccattgccctgtggaaggattttaagcaggggtgaaacatggtcagacttggatttagagatgaggaaaaaaaacaaaatcacggtgccagagtctctggggagactggagaatgcagtgcaggggccgcaggagccaaaaaggggcactggtcctgcgaagagtggctctgtccatccctgccttccagtatgtgcccactgtgaccagagctccatttctcaaaagaagccagtgatgccaattaccatgagaaatttccttatttttaactgtcgattaaaatttgtacaagtatggtggggcaggcctgcaaaatgatctccaagtgcctggcctttgatgcccgtcctaaaagcatgtgtggcactggagggcccacgtttctttgttcctcttgagaagctggggtgggggccggctgggctcagggtgcggcccctcacttcccagggctgtggtctcggtggggcctgcactgttcctgggtgtccttgggctgagcctctgccctgtgaggacggccgctcaggcatgatccgtcagcgaagccgtggctgtgactctgttttccgcagtggagcggaggcggagggacaagatcaacaactggatcgtccagctttcgaaaatcattccagactgtaacgcagacaacagcaagacgggagcggtgagcaccccggaccctcagtgtctgcggtggtcccggcccccgacccttgcatgcagaaagtccaacagccatggggctcgggagtcatccctggggtggaggccggtgggcggtgcctgccctaaggctcctggtcccctcgccccccagagtaaaggagggatcctgtccaaggcctgcgattacatccgggagttgcgccagaccaaccagcgcatgcaggagaccttcaaagaggccgagcggctgcagatggacaacgagctcctgaggcagcaggtgggtgcggggcctggagcgggtcagggcccaggagccccagatgcaaggcgctggccctcagctcccttgacctccgtcgtgtccgccagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgccttgtctgcttgtgtgtttgtccatctcaggagtggggagggggcctggggtctgcagagctccacgaggcatggttctgctgttgtgcacatggctgtgcatggtccctgccagctgcaccacccattacccagtggttggttggatggatggaggaattaaggaatgaatgtcccctttgaggccctagacgtgcatgagggtgtggggagctggggtcaaggacatgtcccatgttggagcagaggcaggggtctccgtgtcaacagttcctgaaaacacaaccagcccctggccctgccctgctgggccaaagccctcccctctgcaccagccaatagtggggcctggccttgagcccctcacccccagggagggcagatggccagggcgccaagcttggcccgtcagcctgtcgccttgcaccaaggctctggcgcctgtgctgtgacccctgcccctgctgatgatgaaacctgtcctcagctgagatgcagcgatgcctggtagggctgggggctgctcctgtgtctccccgggtgagcacacccctattcactgggccctgcttcagcctgcagcacccttcaactcccaggagctgggcttgccactctgctcaccttgtggagctccatctgcctttcctccccaattccccccctccctgcactcgtctcttcccacaagagccctgtctccttttcctagctattcccatctgaggccatctttattcatttagtttttagagacagggtttcactctcacccaggctggggtgcagtggcacacaatcacggctcactgcagccttgaccaactacaggtgcgtagcaccacagccaagtttttgtatagatggggtctcgctttgttacccaggctgtgacaagaggagcctcccacgtggtgtggatgaggaggcagatggcagggcctgtgcatttctgtgcttgagtgggccttgaaagtggttcagcaaccaggaagaagtgttcattcctcgacaacaacatccccgggctctggtgacttggctgacactggatggccctggaatgaaaaaggcaaagaggcaaaatgtgcaagggcccatctggaaccaaggtttgttgatcccctgggccgtgtgcaccctgagctgggcctggtagtggaaaggaatgaaggcactgcagtcaggcagcctgggttcatcccccagctagtggtgtcctaaggaaccggctccccaaaaacatccctggcttgtagtgcttgccaatttctgggtgtcaagactcccactgctgctgatttcaggataccagcatgatgccactgaatgcagagtttcgagatgtgcatggtctgctatgttgagccaggtctagcataccgctgtgccctgctgtgttttaggggagatggggaaacctggtgggtaagagcaaaagccctggagtcaggctgtccaggctagaatctcagctctgcctctggctgagcaagcttgggccatgccctgatctctgccttcagtgccttttctgtaaagtgaaggaaatgagtgtccgacggggaggaggttcctaaaagggagcagggtctggggagcccaggcctctggggttgggtgactgagaaggcagcccctgaatacagagcagagctgaaggtggggcagtaagtgctgctgggagaacaggcagcacaggctgagttggtgcagaagtgagtcaacatatgtgccatcgtataaaatgtattcatcggactgtagatgttagctattactattactgctattttatgttttatagacagggtctcactctgtcacccaggctggagtgcagtcacacaatcatagctcactgcaacctcagcctcctgggcttaagcgatctgcctcagcctcccaagtagctgggactacagatgtgtgccaccacgcctggctaaatttgtttaaaattttttttgtaga

SEQ ID NO: 13720 - DNA, 16924 bp, Human
accttggtctgtgcaaagtgcagcagagaggtcagtgcccctggaaacctagcagcaacagaggcaggacaggtgaccagggccagatgttgcaggaaggagtgcagagtttattctgagtgggaagggaaggctttggagggttgtaagcagggggtgacacaagctgtttgacatacatggctcagagctgatgggagcccagtgagcgagtagattcactacaaggacagcatgtggccccacgccacctcttctttggaggtttcttctagcaggctggggatgaccagccgtgtgggtgcggggaggagctctggctgcccaacagctttgagtttcccaggtgacctgccccagtagagaaggacattgccagggcagttatcttatcaggcgcacgctcacctgctcctggagacacgctcaccccataacataccaaggtccccaccattccactggcccagcccctcgctgctgctgcccatggaggtccctacctgagggatgaggagggagtccccaggcctcctggcatctgtcacccaacaccaagatcaagccaagacccttggacacatcctttccccatgttgcaccttggtttccccatctagggtagggacggggaatggttgagagctgtaaagtctgtagctggatatgtgagtccctgtgagcctcagtttccccctctgcacaacaggaatgatagttctgcctgcacagggttttttgcaaagacccgtgaggtcacacgtgcagagcctggcatgtgtgtggtgctgctgcagtgaagtttgggtttttccattggtggtgccatagaagagctaggctctggggtcaagccctggggtcaagcccgggctggaaccctgtccctaattcttagacgttgaaatcttctgcaaagtccctgatgggggctaagaagagaatattgctttacagggctgctgttagatgctaaggaaaccatttgagtgacacacagagcacacccagcccatagtgaatagtcagagttcagtaaacattcagccaccatagagagtgttgtaagcatggcagggcatggtggctcacgcctgtaatcccagcactttgggaggccaaggcgggtggatcacctgaggtcaggagttcgagaccagcctggccaacctggtgaaaccccgtctctactaaaagtacaaaaattagctgggtgtggtggcatgtgcctgtagtcccagctactcaagaggctgaggcaggagaatcacttgaacccgggaggcggaggttgcagcgagctgagattgcaccactgcactccaacctgggtgtcagagtgacactccatctcaaaaaaaaaaagaaaaaaaaaaagagtgtgggagcaccctcctcttccagttgatcaggcacgtgctatttagactgaaagaggacactctgcagccagctgatctggttctcactccattatgtcctagcctgtgatggagccataggagaatgactcaacccctccatgcctcagtttccccatctgtaaagggtcttgtcccctcaaagggttattggaaggttaaataagttagcacatggaagccgtcagcacaatgcccagcgcataatgagcaccttatgtttgctcttcttgttgctgcagcggttcccaggggctccctgatctcagggcaggttgacatggggggatctgggcaggggaggggggggccagcccaggagggaatgcctgaggtgcccaggcctagaggtcaccccaaggagcctgtaatcagctgtggtcgggcggttctgctccaccccaccgccctccctgggtatatcaggactggtccgggcccaggctctgttgggtgggagcacaggcaccgggcaccatggggaaggccgtgagtggggcccaggggtccggggtgcagtggggacaggggttgcagtggaatctgagttctccctccctccatcctgtccattcccaggagaactatgagctctactcggtggagctgggtcctggccctggcggggacatggctgccaagatgagcaagaagaagaaggcgggtggcgggggtggcaagaggaaggagaagctggagaacatgaagaaggagatggagattgtgagctctgactggggaggggcgggagctggagggtaggctgggaaccaggcagtgggcggggagggggccaggagagcccagagcaagcaccctgccccaccccaccacacagaacgaccaccagctgtcagtggcggagctggaacagaaataccagaccagtgccaccaaggtgagctggagactgggagcgtacagaaaggggaggaggagagagggagggagagggagatggaaggagggagatggagagagggagagagagggagagatgaagagaggaagatatggagaaatagagagagggagggaggcagaaaaggaaagagggagggagggagagaggaaaggatggagggaggggaggagagagggagggagatggagagagggagagagagggagagggagagaagggagaaagcattagagagaaagggtgacacacagagacggagagaggagtagctgaaaagagacagcaagacagagaaggcagagacaaataaggagagagcagcaggagagagacacatagaaaggggagcgaggagagagagacaaagggagagatgaaggagggagggagagatggggtgggggcaggaaccaagagacaaagagatgagaaggagcaggacagaccaagctggagaagggaaactgaagcagggggctttccacggggtgtgcatgtggaggaaagcccccaggaccgcctcgccctgcccctctgtcccagggcctctctgcgagcctggctgctgagctgctgctgcgggatgggcccaacgcactgcggccaccacggggcaccccagagtacgtcaagttcgcgaggcagctggccgggggcctgcagtgcctcatgtgggttgccgccgccatctgcctcatcgcctttgccatccaggctagtgagggggacctcaccaccgacgacaatgtgagccatgttgtggggacaggctcaggacatggggacctggggatggaagacactgagcctgggacttgggacaagaggggcagagaaggatggggatagacgaacacgaaaggcagtctcaagacaggggtcatggagggtgaaggacattgggatatggatggggcagacccaaggacacaggacacagggacactggggtgaatcttgggtatggggacataggtgggggcataaagagtatggcaatgtgatacgtaagagatgggatttggaggccgggcgtgtaatcccatgcctgtaatcccagcactttgggaggccgaggcgggcagatcacctgaggtcaggagttcgagaccagcctggccaacatggcaaaaccccatctctactaaaattacaaaaattagccagacatggtggcgggcacctgtaatcccagttacttgggaggctgaggcaggagaatcatttgaacccaggaggtggatgttgcagtgagccaagaccatgccactgcactccagcctgggcgacagagcgagactgcatcttaaaaaaaaaaaaaaaaaaaaaaaaaagagatgggacttggaagcagaggacatgcagtgcagacacaggacagactgaggcacggggaataggagaccctgggactcagacataggacaccagggcagggacccaagcctcaggacacagcacatagagagacacaaaacatgagacatagaagcacagagacagagaggaaatggaggtgcagggcaagggacattggacatatggcagagatgagggcaagggacatggggactcagggacatgtgacatgggacagaggctcgaaaagtcatggccatgggacacaggatgggaactcggagatacacagacatgggagacacgggacacagtgactggggagctagaacatgggggccgtggccacagaggacacagaccatgacgtacaaggtctgcagcacacgcagggacggggatgtgaggatgcagggacaagggggcccaggggacacacagagggtggcagcagattatggaaaacccaggatgtgaaactggagacacggggaatacaggccatggggacaggaggagacatgggacagtggacatggggaatgcaaggcttggggacacaggagaagggaacacgtcagaccaaggcacacagtgatttggggcacaagtcacagatatggggacatggaagattgaggattcagggccagaggatatgaaatatacacagaaacacaagacactgagaagacagagcaggcgagtgtgggacatgagggacatgggagggggctaaaggctacagggaatggtgcatggagcttcctagtaggtggggaaaagcatggggaaaaccaagaaaaccagggcaccagggagcaggtcggtggcctcaggcaggcagcttccggcccctctgaataaccccaccccttccctgtccccagctgtacctggcaatcgctctcattgctgtggttgtcgtcaccggctgctttggctactaccaggaattcaagagcaccaacatcatcgccagctttaagaaccttgtgccacaggtgggttccccagcacccagccactccagatcccagagactccaaactgctcctgtagcctccttccatcaggcccctgtccctcatctgtggcctccatctctccccatgggtcccagctctcctcatcctttacctccccacatgcagcagctcccacccccacccccgtccacctcaactttggtgcccctgccccgcagcaagccactgtcatccgcgatggagacaaattccagatcaacgctgaccaactggtggtgggcgacctggtggagatgaaaggtggggacagagtgcccgccgacatccgcatcctggcggcccagggctgcaaggtggacaactcctcgctgacaggggagtctgagccacagacccgctcacccgagtgcacgcacgagagccctctggagacccgcaacatcgccttcttctccaccatgtgccttgagggtctgtgaagcccccgcctgcctgcccagtaactgctgcctccactggcctctctcctgctatcttctaggacagggggcttcagcctccctgtctctctcctgcatgactgccacctccccgtgactgccacctccccagggcacactgcttctctgtctcccactgtcactaccctctcccaggtcacatcctccactggcagtgactggctgtccttcagctcacacggcagtgcacaccccactgccgccccctatccctgagtcgcgccttggcccccctgcaggcaccgcgcagggcctggtggtgaacacgggcgaccgcaccatcattgggcgcatcgcatcgctggcgtcgggggtggaaaacgagaagacacccatcgctatcgagatcgagcattttgtggacatcatcgcgggcctggccattctcttcggtgccacattttttattgtggccatgtgcattggctacaccttcctgcgggccatggtcttcttcatggccatcgtggtggcctatgtgcctgaggggctgctggccactgtcacagtgagtgggggcaggcggggatgcagggagctgaggggcctgctcaaccatctgttctttcctccacatttcccccatcacctccctgcctgtctatctgtccacttagctcccatccattctcctgccttcccatcatccactcattcagcaagtccttcccgaggcaaccctggggcaagtcctgtgccacacattgagggcgcagagatgacgaggccgggtccttaactggaagaggctgatgtcctgtgcaggcagccagcatgtcaccagaccttccacagtcagcacccagctccagaccagtccccagggaggtgcggggaaggttcctcttctcattttgattgtgtgaagagaattttcagaacctcggctgggacagctcagagaggggcctcgctactgtatctgggcagactggggaaggagtcccaaacaaagcactggctgaacaaaagctggggccaagaaaacacctggtgtttgcagaagcacgttgcacacgcagccccgcggctggggtaaagccttccccgttctttgacgcggggaagaggactggaagccagggtgggtccccagcctgcggtgctcaccccttccccaggtctgcctgtccctgacagccaagcgcctggccagtaagaactgcgtggtcaagaacctggaggcggtggagacattgggctccacttcggtgatctgctcggacaagacagggactctcactcagaaccgcatgactgtgtcccatctgtggtttgacaaccacatccacacagctgacaccacggaagaccagtcaggtgtgggggagggagggcacaggcgccagggcaggatctggtggatggtggagacctgaagagggatagggaggtagggagggctttgtacgaaggcggggcggctcggctccaggtctcaaaggagactcgctaccgggtctagagggaagggtcatccgggggctgggtccctcagggttgggtggaacccaattccacccaggtctggggagggggcccgcgatatgagcctaggaggagggggctcggttctggtccgggagagccgccgtgcgggacccagcctggacgcctggtctgcagggcagacgtttgaccagtcctcggagacgtggcgggcgctgtgccgggtgctcaccctgtgcaaccgcgccgccttcaagtccggccaggatgcagtgcctgtgcccaaggtgagagccagggggcctccagggaatcccgggaggctggtgtagccggcttcgcccctgacaccggtccccgctcccagcgcatcgtgattggagacgcatcggagacggcgctgctcaagttctcggagctgacgctgggcaacgccatgggctaccgggaccgcttcccaaaagtctgcgagatacccttcaactccaccaacaagttccaggtgcgcagccggccccgcccacggcctgggcccgcccacctcgggccccgccccaggccacacccacatcagcgggccacgaggggcttcgctccttgccccttctctccgcagccaaaccccaccccatctcccgctccgcctatggccccgtccaccagaggcaaggccccgcccaccacccagccccgcccacagcttctcctcggcgggactgtccatggggagcacctcgctctccaaatccgcccccagcccaactccgcaccctaattctgttcattccctgcgtccaggactccaaatctgcacctagccccgccttaacgcttaccttctaccaaggacccctccacacaaggcctccatcttccaccttcacccttccccgcagctctcagagcccgcaccgagctctcggccccgcccctctcctcagccccgccccgttccctcgtccacagccccgccccgttcccccgtccacagcctcgcctctcccccccgcccacagctgtccatccatacgctggaggacccgcgggacccgcgacacttgctggtgatgaagggcgcccccgagcgcgtgctggagcgctgcagctccatccttatcaagggccaggagctgccgctggacgagcagtggcgcgaggccttccagaccgcctacctcagcctgggaggcctgggcgaacgcgtgctcggtgagacccctgggcaggggaggagactccaggtgcgaggaggagctagcacagaccctgcccaccactcccggcccagccctgaccgtcctcatccctggctgctggctgatttgtcgcagtccacagcctcacccttgactttccctgtaccagtcctgacccctgtctgtcctcactttctaccttgaccccagtcctcacctggacttttatccgtatcctgacctctaacctctcccaatttttgtcctgacgccttaaacttcgctgcctctaccctagaaagcagatctgtggtccaattctgggccttttacttgctgtgtgacctctggcaagaaatgtcccctctctgagcctcagtttcctcatctgtaagatgagaatgggcctcacagggtggttgtgagggtagattcagataatgtgagtgaaggggtcagcacaaggtcaggcatccataggtgtttggtgcaaggggcctggttattttacccatttcctggccctgctaagaaagggtgtgcccagggctcttccctgacttccccgtttccggtcaggcttctgccagctctacctgaatgagaaggactacccgcctggctatgccttcgacgtagaggccatgaactttccatctagcggcctctgctttgcgggacttgtatccatgattgacccaccccgggccaccgtccctgatgctgtgctcaagtgtcgcaccgcaggcatccgggtatgccactgtggggaggaacaagtggagtgaggacagaggatggcagcaggatttgggttgaagaaccccatgacaaacccacctgaaactggcttgaaccaaaatgcattggtttatgatactgaaaaattctggggaattaagcttcaggtctagccagatccaggagctcagtgtcattaggaattttcctttctccatgtctcagctctgctgttctctttgctggctttatttgcaggcactcccttcacttggggacacacacacccctgctccagcagctcaaacttaactcccacctgcttagccaccccacaaaaagagagtgcctcttttgcagtagcactggattgggtcactcatttatccctgagccagtcactggggctgggggatggaagaccttgattggccaggtctgggcttacttacccaatcttagccagggacctcactgcaactgatggtgtaggggagaggagtggttccccaaacacaaaacaagggtgggaaagccaaggccaggcaggcaatgcccaagcccttcccgtgtctctacggccctgttacatcgggccttgttacctttctaagcttgttcgttagccctctttccttgttcactcctctgcagttatggtgtcctccctgctgttcctccgacagttcgggcctgtcctcacctcagggcctttgcacctgctgttctccctgccaggagcactcttctcccagctttccacgtggctgactctctcacctcttacaggtctctgctcagatatcaccttctcaataagcccttccctgggtacacttaaaatcgagtcaccgtttccttcaccaagcttaatatgtttttttccactttctaacacactatataattcgtttctttattttctgtcaccctcactagaatgtcagctcctcaaggacagggatttttgtctcttttgtctctgctatatcccaggcacgtaggaggtggtcacgcttggtcaagtaaatgaacacgtgtatcagcagatgtctcccagggaggacagggagattgggctgatctgaaggggtcagtgatccactggttccccctacaggtgatcatggtaacgggtgaccaccccatcaccgccaaggccattgcagccagtgtgggcatcatctcggaaggcagcgagacagtggaggacatcgctgcccgcctccgtgtgcccgtagaccaggttaatcgcaagtaagcccccccagacctccccggggttctccccacatctggcacagaccgaggtcccagcgaggtcctcccatctcctccccagggatgcccgtgcctgtgtgatcaatggcatgcagctgaaggacatggacccatcggaactggtcgaggccctgcgcacccaccccgagatggtgtttgcgcgcaccagcccccagcagaagctggtgatcgtggagagctgccagcggctggtgagccctgctgatgagggtgggcaggcgggcagacaggcggggctggtcttggaccggcctctcactgaccacccacccaccacctgcacccactgcctgcagggtgcgattgtggccgtcacgggggatggtgtgaatgactccccagctctgaagaaggcagacatcggagtagccatgggcatcgctggctcagatgctgccaaaaatgcagctgacatgatcctgctggatgacaactttgcctccattgtgacaggcgtggagcagggtccgagccacgccagggggagggcaggcagtgtgggcacaggagggagagggctgtgaggaggctgaggtgcccaccctaccccacaggtcgactgatcttcgacaacctgaagaagtctattgcctacacattgaccaagaacatcccagagctgacaccctacctcatctacatcaccgtcagcgtgcccctgcccctcgggtgcatcaccatcctcttcatcgaactctgcactgacattgtaagtccacagcccagggtacccatccacagggtgcccagagacacttgcctgcagatggacaggagggacagagaccaccacagacactcttgggcacagagtgacagacaagacctgtgtgtgcaatgacagccagtgcaggacacatgggtggcaggcaggtgaacagacctaaatggacatacctacagccatgcacacacaggcggacactcaggtaggcccgggccgacccatgcacacacatgactcagatacagatactcagacagagatggaaacagaacaggtatctggccaaacttgaatcacagacacgtgcccctaaacagacacggacaaataaaccccctcagatagaccccatggcagacagacagaaaagaaccacagatacagtcacgaatgcagccagaggcgcagctgtgttgacaggtatttattcggtaacatttacacagtgctttctctgggccagacacaccatcatttccttaattttgtactcataaccacactatgagatgagttttgttactatcacccgtactttactgatgagctcatcaaggcatagacaggtagagtggattgtcccaggtcactgggcaaataagtggcccggctgtgacttgagcttgagcagtcacaggtcccacagcctgtggtcgtggtcagtatgctctgctgccactctaggcacaagcagatgaaggggcacggcgacactgagagactgaagatacacagagatagggagtgacacagaaatacacaagagcagatacagtcacagagaattacactggagacagggacagagaaacagagtgaggaacagagaaagagagggagggagacagagggagaagataaaagcagatgttcttacgaagatgggcaccaggatgccaacacccaggggccagtggggcccaggctgtccaggctggtgtggctgtgccgtccctgcaggtcctgcctgctaacctcagtcctgttcctgctcacaagtgggggaagggggacccgaagtggaggggacaagggcccagccaaaccctcagtcccagttccttccactcctggccagttcccatctgtgtccctggcatatgaaaaggccgagagtgacatcatgcacctgcgtccacgcaacccaaagcgtgacagattggtcaacgagcccctggctgcctactcctacttccagattggtgggtgcccgtgggccggggagcctggaggtggggggctctgcgctgggctgctcgcctgccccaggccctgccttgggctccggctggttctggacctcagtgtctgcatttggtcctgggtctccgttgtcctccgtgtccctctctgtttgtgacagtctctctggttctgctgtgtccctgctctctctctgaccttgctctccatgaccctgtctctgagttgttgcctatttctgtctttttgggtcctggatgtgtctttttctctctgtccctgcctctgtctctctgtccctgcttctctctctgcctctgtgtctctgtcactgtttctgtgtccctggctctgtgtgtccttgaccttgtgtatctgtgtccctgtctctcttcccgtgtccctgtctgtgtgtccttgacctttgtgtatctgtgtccctgtctctccatgtccctctcttcctgtgtccctgtctctgtgtccatctctgtctccctgtgtccccttgtctctctccaggtgccattcagtcctttgctggcttcactgactacttcacggcaatggcccaggagggctggttcccactgctgtgcgtggggctgcgggcgcagtgggaggaccaccacctacaagatctgcaggacagctacggccaggagtgggtgagccctgccccgccccatcccatccctgggctccctccttcccagggcaacttgccttgtgtgcggcccacttgttcctccacgtgtgactgagttcagccagagcatcccggacccccagactccctgccagttcgggggggcaagggcctttcccaccatctccagctccaaactcctgcttctgatgatcgcaactgcagatgggtgtctctgccctgacactaatgcatcatctcagatgtggaaccaggcccctattctgctattttccctacagcatcactcccacagggtatttgcacatgtggtctattttaatgaaggtttggagcacagtgaggctagatctggccagcagatgtgtttagttcacctgtagagttacatacagacgaggatacttcccttaaacatttactatcatggttaaggtagacactgaagccagactgcctggacttatggtctggtactgcttctcacaagctgtgtaaccctgggcaggttgctttgcctctctgtgcctgttttctcacctgcaaagtggagagaatatcaaagtctacctcagtggttttcagtttgctcccagaccagcagcatcaccatctcctgggaacatgtttgcagtgcaaattctcaggctctatcccagccctctgggagcccttgctgggattctcatgcatgttcaagttccagcaccactgatttacctcctagggttacccagcggattaaatgagctaatgcacgtgcaacactcggcacctggagcagtcagtgatccccacagttagctggtattaggagttgtgttgccaggcatggtggcgcatgcttgtaattccagctacttgggaggctaaggcaggagaatctcctgaacctgggattcggaagttgcagtgagctgagattgcaccactgcactccagcctgggtgacagagcgagattccatctcaaaaaaaaaagtagctgtgttgaagaaatgggctgcatagtggctgccccctttaaatggggcatctgccctcttttcccaaaggcccgcggtgactgcctcacctatttttgccatctgcctggcccctggagtcactggactttgcaaatcccatctgaggatttcaattcccctttcccaggccctttcttttgggtgcctcccccctttcactatgaaagcagtcggcccagcctacagttttcccggccactgtcatccaagctctgctaggctgaggtttctgggccccacgttctggggtcctgcacacctggcagaccctgcctctctccttccccccacccccacactctgatgcaaggcagagagagcatttaggggttcacggccctgggaccctatgcccggtgggctgcagaggctctccgccgggactcaggctggactcaggctgtttccgtttgcccctggcctgcagacattcgggcagcgcctgtaccagcagtacacctgctacaccgtgttcttcatcagcattgaggtgtgccagatcgccgatgtcctcatccgcaagacgcgccgtctctctgccttccagcaaggcttcttcaggtgtccctggctggccctcttcctgccctccaacccctggtcccaactcccatcagatcctgactgtggtttagaacagccggcaaatgccagcgggtgccagtgccagatggtgacatgccaaaaaaacctttctaactggccaataactccccccacggccccctccacatttcactaaaggggtggtgctgagaggcccgggccactccagtgttcagtgtgtagaacacctccctgctgctgctgacatctgacctactttgacccacagtatcctgatttccatcacgtccccaattcctaatggcctgtcccattctgcccacccccaggaataagatcctggtgatcgccatcgtgttccaggtctgcatcggctgcttcctgtgctactgccccggcatgcccaacatcttcaacttcatgcccattcggtgagaggctgtgaggggcaaggacagggagggggctgtagggcacaggcctgggatggccttcaccttgccatgtgccttcaggttccagtggtggctggtccccctgccctacggcatcctcatcttcgtctatgatgagatccggaagcttggagttcgctgttgcccagggagtgagtgtggagactgggagcctgggggcaggggactgaaacgtttgagcagctgcacccacctttgatcctcaacacttggcctctaagcccttgaccctccatagcaaccagcactgacctctgagcccctggccctgcctaagtggcacccccagcactgagtctcctttctccctctctctcccaggctggtgggaccaggaactctactattagagggacgactgccttcaagcatccctgcaactgccacagcaggtgggggcagggctcgtgggaccctctggacagccaccaagatatctgagcaaccaagagtcccagccccaccagtatctgcttctgtagcccacggcaccccaaacttggagggacctgcccactcccctcccccattcccaaggttcgcacctcctggagcagcagcgcctgggcagtcctctgggctggcctcgggaaagccgccacctgtggtggcggtggggctctgacagggagtacagctgaccgcttctggagggtgtttctgttcttaggactccagtccaggctggacggctgcctgagggcccttcgttaaagacacgcttgtgtcctgggcgatggtaataaaaccagctcatgctgactgtgctgtatctggtgccaggcactgtcctcagcgtctctcattagtgcttgtgatctcccacagtcctgtacatgggggctgtttatccagggctgcacctccagtgcctagtacacagcctggcacatagtaggtcctcaataaacctgccttggggaaatgattcctattcctttgcccagggtcatggcatctaaacgcaagctgggccgtggcgataggcaccccctaccacctctgggctttctctgttctcagcacccttctccctcctggaggctcccagacacaagggggcccaagtcatttccacatcaagcatcccccaccccccagcggtgtctcctttctgagcctacctgcttactcctctgtcccggcaatggccagttcctgaacaactcctggaggtcccctcctcacacccctcacctgaaaggttaaccccatccccctacctcccatctctgccgctcctttcccagcccctctgttcacctctcttcctctttcttatgtggctttctctggctagggcctgggcttctccttccttgtgaccacagccccccagtcccccatggcttcagttgtttctgcagtgagacccacctctgtccccagcttcccccagtgttggtgacctacactggcctcttcatcaccccccatgcctgtacccatgcactgacccaatctgatagtcccactgtcccatcagtgtggtcccttctcccttggaaacgtggtgagccctcgggcttacaagccccaaactccagttatcctggaactctttgctcctcccttacctgttagcgccccctgccggtaaataaatacacacagccactgatcaccaacacctgggcttggcttctagtcactctcctaaccccacaaagccctgccctggtccagccctggcctcgtggcctcagctttcccatttcagacaacagccatgcagagcttcctaaagccaaatctgaccctgtccttcctctgcctagagctctccttggttcccaaagcctcctgtgatctgacccctgccagcttctgtagtcttacaagtccccttgaactcattccaaccagttatgttcccttgggaaaaacaggccccctctctgacctcaagaccattacctctgccttgccccaatcactcattctttaggtctcagctcacatgtcctctgctcaggggagcccgcactgcttccacggcaggccaggcggctcctctgggtccccataacccggggttttcccatcataaccccgatcacctgaagcctggctccccacagtccaaccgcccaggcttcaccgtcctctgccaactcaggcccagccactccagtctctctccctgaaccccatgtaagctgggattattccagttggtaattttgcatcctacacttgtctcaatatgtgtgaagagctatgtggggcatggaagtgtgggagaaagtgaccttgtcacaagtccacccagatagactgccccatctacttcctttctacatcaaagtcaaggtgatcaatcacttccagctcccaagagacccatggac

SEQ ID NO: 13721 - DNA, 25633 bp, Human; identical to SEQ ID NO: 12084

SEQ ID NO: 13722 - DNA, 31469 bp, Human
tacttttatgtgtgtatatatatgtatgtgtatatatgtatgtgtgtctatatattgtgtatatatgtatgtgtatatatgtatgtgtatatacatatatgtatgtgtgtctatatattgtgtatatatatgtatgtgtatatatatgtatgtgtgtgtgtgtatatatatacatagagagagagggagagttttgttttgtttgtttctggagacagggtttcactatgttgcccaggctggagagcagtgttatgatctcggctcactgcagcctccatcttcggggttcaagtgattcccttgcctcagcctcccaagtagctgggactactggtgcgtgccaacatgcccaactaatttttgtattagtagagatggagtttctccatgttggccaggctggtctcaaactcctgacttcaagtgatcctcctgcctcggcctcccaaagtactttgattacagatgtgagctcccgcactcacctggccaaattttttattcttttattttttattttttttgagatggagtctcacttcgtcgccaggctggagtgcagtggcacgatctcagctcactgccacctctgcctcccgggttcaagcgattctcttgcctcagcctcccaagtaggtgggactacaggcgtgcaccaccacgcccggctaatttttgtatttttagtagagacggggtttcgccgtgttggccaggctggtctcgatttcttgactttgtgatctgcccgccttggcctcccaaagtatagggattacatgcgtgagccaccaggcccagcctaaaatttattttattatctgttctttaactagaaccttaggtaaggaggtctgggatctgtgtctcttggctaccgtgcctggcacacagttggcgctccatgaatgcacgcacaatgaagggatggccctgcctggaatctgcctggtaggcgtctagactctggggccccgcaggtgagggataggctcccggctctgccttgtgccagccccaccggtcactcccctgctctatgcctcaacctcctcatcagtcaaacagggatgacagtagtaactatacagggtgatgtgagtgtaaaaccagctaatgtgagccaaaacccggctaatttttgtatctttagtagagacagggtttcgccatgttggccaggctggtttcgaactcctgacctcaggcaagctgcccacctctgcagggtggatcacctgaggtcagggcagagtcgctggaaacagtccatgacacctggcctgagctgtttcttaaaaatatatcagaagggccgagcgtggtggtttatgcctgcaatcccagcactttgggaggccgaggcgggtggatcacctgaggtcaggagtttgagaccagcctggccaacgtggtggaaccctttctctactaaaaatccaaagttagcccggcgtggtggtggatgcctgtaatcccagctactcgagaggctgaggcaggagaattgcttgaacctgggaggcagatgttgcagagtcaagatcctgccactgcactccagcctgggcaataagagtgaaactctgtctcaaaaaaaaaaaaaaaaatatatatatatatatatatatatatatatatatatatatatatatatacacatatatatatatacacacacatatatatatgatatatatataatgtatcagcagtagcacgggtctgacggttcctgattggctccgaggagggggacagctccgggtgaagcctgaggagaatccgccccttctccagaaggaggaagaagggccctgctggtcacacaggacccagtctgcggtgggggttttcccgccaccgccccgccctccctggggcccccacctcaccctctcctggcacccttcaccgtcaacctgtcgggccgggtctgagcaggtctggaggtgggcggggagccctggcctccccacctcctcccgtccccaccctgttcccagcactcaagccttgccaccgccgagccgggcttcctgggtgtttcaggcaaggaagtctaggtccctggggggtgacccccaaggaaaaggcagcctccctgcgcacccggttgcccggagccctctccagggccggctgggctgggggttgccctggccagcaggggcccgggggcgatgccacccggtgccgactgaggccaccgcaccatggcccgctcgctgacctggcgctgctgcccctggtgcctgacggaggatgagaaggccgccgcccgggtggaccaggagatcaacaggatcctcttggagcagaagaagcaggaccgcggggagctgaagctgctgcttttgggtgagtccagggtcggtgggcggtgggtggtgggcagtgggcggtggccagccggcaggggtgtcggggcaaggaggcggatcaggctaggtcagacattggcatcgtggagccgtcgcctcctcccagggaatggggagcctggaacccattttccagatgagaaagactgaggttcagagaagccaagttccttgtccaacgtgcgaccagcggccaggtgcccaggcctgtccactgtgtggggcatatacaatagcagacgtggctctaccgggcccctgccgggcaggcccagcacgccctacctgtctgtgtcatggcgagggaatgatgagctcaggtgtgcaacccgttctggccagcccacccgcaagggaggggccggctccagcctctccttcaccaggacgctccctctcgcctttacctccctgccatggctggagagggcttgtctagggctcctttgggggctagaaaggatggattgattggttcattggttcattcattcattattcattcatttaagatttattgggtagctcccaggaacgaggcagccaaacaggggaagatatttctgtcttcctggatctcatttcctgtgaaggagccaagacatttagtctgtaaactcataagcagataaaataattctggcaacaagaattatctaggagaaaacaaaacagggtgatggcttccatgcggaggcttcagatgggggagtcgacgtcagtaacggttcaagattctgaactctggctgggtgcagtggctcaagcctgtgatttcagcactttgggaggcccaggcgggtgggatcacttgaggtcaggagttcaagacacagccaggccaacatggtgaagccccgtctctactaaaataccaaaaatttgccaggcatggtggctcatgcctgtaatcccagcactttgggaggccgaggtgggtggatcacaaggtagggagatcgagaccagcctgaccaacacggtgaaaccccatctctaccaaaataccaaaaattagccagatgtggtggtgcgtgcctgtagtccctgctactcgggaggctgaggcaggggaattgcatgaaaccaggaggtggagactgcagtgagctgagatcatgccactgcactccagactggcgacagagtgagacgccatctcaaacaaataaacaaacaaacaaaaccaaaaattagctgggcatggtggcacacacctataatcccagctactcgggaggctgaggcatgagaatcgcttgaacccaggaggcagaggttgcagtgagctgagatcgggccactgcactccagcctggatgacagagcaagactcattgtcaataaataaataaatataaataaaataaataaataaatcatgcctgtaatcccagcactttgggacgccaaggcgggcagatcacttgaggccaggagttcgagatcagcctggtcaacgtggcgaaaccccgtctctactcaaaatacaaaaaaattagccgggtgtggtggcatgtgcctgtaatcccagctactggggaggctgaggcaggagaatcgcttgaaaccaggaggtggaggctgcagtgagccaggattgcactattgcaccccagcctgggcaacaagaacaaaactccgtctcaaaaaaaaaaaaattctgatctctgaaacctcggggtcttctcattcccgtagcttgtttccccaattacctttccctgattatggccccgttggcctaagcccggggatgctagcctgggagggtcttctgggatccccgagctctgggttgggggctggagaaggtctcaagtcttctggactcgcgtttgtctgccccgggcaaagagcttgatcatcccgtgatggttgctatcgtcctttcctcgttcagtgggaagaggccgcccgagaggaaagagagagaacatcgagtgggatggtggggacccccaggaactgcaccttcactgggggccctttctttcttttttcttttcttatttttatttttatttttttgagacggagtcttgctctgtcacccaggctggggtgcagtggtgcgatctcaactcactgcaacctccgcctcccgggttcaagcaattctcctgtctcagcctcttgagtagctgggattataggcacgcgccaccacgcccagttaattttttttttttttgtatttttagtagagatggggttccaccatgttggccaggctggtctcgaactcctgacctggtgatcaacccgccttggcctcccgaagtgttgggattacaggcgtgagccaccgcgcccagcctctttttttttttttttctttttttttagattgagtcttgctctgtcccccaggttggagtgcagtggtgagatctcagctcactgcaacctccgcctcctgggttcaagtgattctcctgcctcagtctcctgagcagctgggactactggtgcgcactaccacacctggctaatttttgtatttttagtagagatggggtttcaccatgttggccaggctggtctcgaacccctgacctcaggtgatcctaccaccttggcctcccaaagtgtggggattacaggcgtgagccactgcacccagtcaagggccctttcaactctagccttgatccctcttactgaacgagataaaagaatatctcagcagggcatagtggttcattcctgtaatcttagcactttgggaggcctaggtgggaggattgcttgagcttaggagtttcagaccagcctgggcaacttagcaagacccagtctctaaaaaaaataaataaataaaataattagccaggcatggtggtgcgcacctgtagttccaactacttgggatgctgaggtgagaggatcacttgagcctgggaggttgaggctgcagtgagctatgatcatgccactgcactccagcctgggtgacagagcaaagctgactctgtctcaaaaaaaaaaaaaaaaaatgccgggtgcagtggctcatgcctgtaatcccagcactttgggaggccgaggtgggcagatcatgaggtcaggaggttgagaacatcctggctaacacggtgaaaccccatctctactaaaaatataaaaaatcaggtctgggcgcggtggctcatgcctgcaatcacagcactttggggggccgaggagggtggatcacgaggtcaggagatggagaccatcctggctaacgtggtgaaaccccatctctactaaaaatacaaaaattagccaggcgtggtggtgcgcacctgtagtcccagctacttgggagggtgaggcaggagaattgctctaacttggaggcagaggttgcagtgagccaagatcacaccactgaactccagcctaggcaataagagtgaaactccatctcaaaaaaaaaaaatctatctatctatctatctatctatctatctatctatctatctatctatatttgacatattaatgtgtcatattatgtcacattatgacgtatcatatcgatatgtcttattattttaaataaatagggctacttaggctatctacttcttcttgtgtgggttttgatcatttgtgtctttcaaataatttgtccattttgcctgtgttatcaaatttattggcataacatttataacgttcccttgttctcctgctactgtctgtaggatctgcagtgatgtcctctcttttgctcttggtatcgatcatttctgcctttgctcatttttttcttgatctatcaagctaggggtttatcacttttagtgctctttcctcgcatacctcaaggtcatttatccctgacctttgcctggctggccctttcactccatgtaggtctcaacccaagtgtcgcctcctcagagaagtcttccctgactaccctagctataaagacagtcctatcttctccttccccttactctgtttgatttttcttcctggccctcactatttgttcacttgtttattgtttatctctccagctatacagcaagcaacaaaagggtagggaccacatctgtcttcttcatccctgtgtctccagcatctagcacaggtgtacaatgagcctgccatatagtagatgctcaagaaatgcgaatgaatgaatgaatgaatgaatgaatcatttttggggagaacttcccccagacactgtatcatatcttcctggagctgggaaagtcccttccacataccactctgggcactactcagccagcctcaaagcaggaagccccttctactgatggagggcaggggatgtcatccatgtccccaggcactgatgtagcactgtggactgtggtttaaaccacctcatccctggagacaggtctgagggcaacctccagacctctgtcccttcttggaaacaggaattgaatccaaaagctgttttttttttacctggaggtggctgatccttttgaggaagatggcaaaaaggaccagggtgggggtgggtctgtccctgacatgaagcaaccctcatattggggaagggggagagtcagaatgaagccgtgagccgggtatggtggcacatacctgtagtcccagttactcgggaggctaaggcaggaggattgcttgagcccaggagttcaagaccagcctggacaacattgcgagacccagtctctaaacaaaaacaaaaaaagaaaagaaaagaaagtgaacaacaacaaaaacaggaaaataaagctgtgaaagggaccagttatgtccttagcactttaaacattttattttttatttttatttttgagacagagtcttactctatcaccccggttggagtgcagtggtgcgatctcggctcacggcaacctttgcctcctgggttcaagcaatcctcttgcctcagcttcctgagtagctgggactacaagtgtgcaccatcatgcccagctaatttttgtatttttagtagagacggggtttcaccatgttagccaggctggtctcgaactcctgacctcaggtgatccatctgccttggcctccccaaagtgacgagattagagatgtgagccattgtgcccggcctgttcttagcactttgaggcaggcactcctagtttcccccaaaggataaactgaggctcagagaggcagagcgacttgcccaaggtcacacagctgagactcgcacctagaattctggttccaaagtccatgctcctgactgccctgttcgcctgccttgggggacagaaacaccacagaaccccagtgccagatggggaaaatgaggcccaaggaggcagcaggattgattgggggtcagcagctagtttgagccagagcgggactgagaggccgagcctcctgcccctgcggctgcctggcctggctccccacttccccagcagctgcgtttcctgtgagggcctggtgctggactctgtgcacatagctggctccagttgccttgtgatgactggggcttggcacggttaacccagttccttcctggcatctgccggttccacttcctcctgtcctcctccgtgcccaggaggaagcaggaacttcccgtctgggccgcatggcctttgggggtatcctaaaacagatcactccccccatttctatccaggagctgggggatgtctgggggtcggggggcaatggagaggtcccagaatcctttgtggcttcaggacagcaatggattgcaaagagggggttctcacgcagctcttcaggcttcgggtgatgacccatccctgagtcatcaaatctgtgtcgcgggtggcaacaggattatcatttatttcctataacaaagcagaagaggaaaaaaaaatcagtgcatcacaaaataaagccaactgttgcttgccgagacttctgtttgttctctgcacttttggggcaaactaagatctgagagttggaagacaactgggggacaggagcccaaaaggtccagtcctggctgggcgcggtggctcaggcctgtcatcccagcactttgggaggctgaggaggggtggatcacttgaggccaggagttcaagaccagtctggccaacatggtgaaacctcgtctctactaaaaacacaaaaattagccgggtgtggtggtgcacgcctctaatcccagctgcctgggaggctgaggcaggagaattgcttgaacctgggaggtggaggttgcggtgtgctgagatcacaccattgcactccagtctgtgtgacagagccagattctatatcaataaataaaaataaaaacaaaaagtaaaaaaaaggaagaagaagatctgagggttggaaggcaattgggggacaggagctcaaaaagtccagtcatcggcagttgggctcaatgccacaccccaaggagctgtcgagcctcccagactctgtaaaaacatcgctttaacagacatgttaatgacacctaccccagctctactggccgtgtcccattttgttggtgaaggactcacacgaccccaagtttactcccctggggttccacttgctgtgtgacccaaggcaagtcactaaacctctctggtcctccgtgtctcatctgcaaatgggaaaatcatagaatctgtgaggattaactggggatccgtagagtctctgggctcggggttaggaagacggtaagatttaaatcatgctagctgtgatttttattatgattgttataattattcaggcagggtaaaggaacctccaggtataataatttagaaacccataagctcaaggtggctcatgcctgtaatcccagtactttgggaggccaaggcaagtggatcccttgaggccaggagttcgagaccagcctggccaaaatggcaaaaccctgtctctactaaaaatacaaaaattagccggacacggtggtgcacacctgtaatgccagctagtctggaggttgaggcaggagaatcgcttgaaacccatgaggcggaggttgcagtgagccaatatcaagccactgcactctagcctgggtgacagagtgagaccctgtctcaaaaataataataataataaaaaataaaagcccataggctctggactcaaacagaactgagtttgaatcccagtctgccactcaccaggaccattgaaggaattgtgcgacccacagcaattccctcaacggccccgagactgagtttccccacatggaaacagggctaagagttgtccctctcttggccaggcgtagtggctcacgcctgtaatcccagcactttgggaggacgaggcgggtggatcacaaggtcaggagatcgagaccatcctggctaacatggtgaaaccccgtctctactaaaaaaaacaaaaaaaattagctgggcatggtggtgggcgcctgtcgacccagctgcttgggaggctgaggcaggagaatggcgtgaacccgggaggtggagcttacagtgagccgagatcacgacactgcactccagcctgggcgatagagcaagaaagactccctctcaaaaaaaaaaaaaaaaaagagttgtccccctctcgtggtgaggctcaggacagatggtgggactccagctcttagctcaccagggacacccagtcaagggccagcaagctcacaattccctccgctactagccccaaatagccaaagctccaaaaacttgatggtcccccatagtgtctccatgagaaactcaaagaaacgggtgggaggatgtttgtttattgcactgactcccattcctacattccgctgcaggaatattagtgagttgacatgtccccatcctaacatgcaataaattctggaatctgaagctctcacagctctgcatcagagaatttcagattgtggacctgggggatgttgtcgtttgagtagtttgtttatttatttatttatttatattttatttatttttttttgagtcggagtctcgctctgtcacccaggctggagtgcagtggcatgatctcggctcattgcaagctccgcctccccggttcacgccattctcctgcctcagcctcccaagtagctggaactacaggcgcccgccaccatgcccggttaattttttgtatttttagtagagacggggtttcaccgtgttagccaggatggtctcgatctcctgacctcgtgatccgcccgccttggcctcccatagtgctgagattacaggcgtgagccaccgcgcctggccctttatttttattttttttgagacagagtctggctctgtcacccaggttggagtgcaatggcatgatctcggctcactgcagcctccgcctcccaggttcaagcaattctcctgcctcagcctcctgtgtagctgggattacaggtgcgcgccaccatgcccagctaatttttgtatttttagtagagacagggtttttgtatttttagtagagacagggtttcaccatgttggtcaggctggtctcgaactcctgacctggtgatctgcctgcctcagcttcccaaagtgctgggattacaggcatgagccactgcgcccagccctagtttttaattttttttggaaactttttttttttgagacaaggtcttgttctgtcacccaggctggagtgcagtggtgtgatcatggctcactgcagcctcaacctcctgggctcaaatgatcctcctacctcagcttcatgagtagctgtaactaccagtgtgcaccactacgtctgactaaatatatatatatatatatatatatatatatattttttttttttgtagagatggggtctcactatgttgcccagggtggtcttgaactccttggcccaagccacccccctcccttagcttcccaaagcactggatttataggcatgagccgcctacaccatgcccaagcatatacactgttttctgaaccatttttgactaagttgcagacctggtacctttttttatttttttttttttggagacagagcctcactctgtcacccaggctggagtgtagtggcacgatctcagctcactgcaacctctgcctcgagttcaagcaattcttctgcctcagcctcccgaatagctgggattacaggcgcccaccagcatgccccgctaatttttgtatatttagtagagacagagtttcaccgtgttggccaggctggtctcgaactcctgacctcaagtgatctggccacctcagcctcccaaagtgcggagattataggcgtgagccactgtgcccagccgagaaaagcctgtttcttgactttgagccaaatagacatgacccctggagaaactgaggactggagagtcgaggcggccacccccgacctgcccccatggctctccagtgtgcaggtggcacctgctaggtggagttggaggcgttggagacagccctttggggagatgggaggtgacacccccgccccttctccgtgctccggccttctcctctgctcccatttcctctttctgggccccaaccaagccactccttccctttttgctgccgcttgctcgatcaagtcctgcctgcaccgacccctacccccgccctctgcacgccaaccctggaggcagaagcagtcccatcccctctcccatcgctggttggggcccatgctggtgcccccaggagccagacgagatgctgggcaagcctccagcccccacctcccacctggtggatcatacccattttacagatgagaaaattgagacacagagagggggaagggcagccttgggatgtcagagcttagcggggggctgagctggtgtctttgaacctctagtcccaggctcttgaagactccagcatcagtatcccggacccagggccggtttggcaggtgcgcgaactgggctgtcccagagggttccaggctcagaagagcctgaagtttcagcttgcacccagccccagaaaatctgtggctggccctgcaaggaccctgccagattttgtaccatctgtcagcaaggtcaggtcgattctgtctccccagtgtctctcaaatatgtcctctcctctccagctccatgacagccacattggtccagccccacggttgctcacctgaaccaacgcagtccccactgccctggtccgggctcccccagaccaccccccacagcctgtcctccctgcagcagccaccagagggcgcctgtgagcacctgagtcagggccagtccctcctctgcccacagccctccatggctcccaagtccctcagggtcaaagcccaagacttccctgcaacccacaaggcccagcacaacccaccctcccctccttcctctctccccctcctcactctgctccagccacaagggcctcctcactgttcctccaatatgccaggtgcggccctgccccagggcctttgcacgagctgttactgtcacctggtgtgccctctaagattttgacagccaccttccggccttcacaaatcactttcactgagaggccttccttgactgctcacaaatcacttccactgagaggccttccttgactgcgtggctatcgtagtcacctaattactccttgccctatttatcctatgttatttctttcgtaaaagtttctctacctgaaattattgtagcaaataataatacatattagtattgttatgataaataataaaaataggccaggcacggtggctcacgcctgtaatcccagcactttgggaggccgaggcagacggatcacttgagcccaggaatttgagaccagcctggctaacatggtgaaaccacagctgtactaaaaatacaaaaattaactaggcgtggtggcacgcgcctgttaccccagctacttgggaggctgagggaggagaatcacttgaacctgggagccagaggttgcagtgagctgagattgcgccattgcactccagcctgggcaacagagaatctgtctaaaaaaaaagaaaaaaaagaaaaaagaaaaaaacccataagaaccataaccataaaaagtattaaaaacacaaaaactggccaggcgcggtggctcacgcttgtaatcccagcactttgggaggccgaggcgggtggatcacgaggtcaagaccacggtgaaaccccgtctctactaaaaatacaaaaaaattagccgggcgtggtggcgggtgcctgtagtcccagctactcagagaggctgaggcaggagaatggtgtgaacccgggagacggagcttgcagtgagccgaggtcgcgccactgcactccagcctgggtgacagagcaagactccatctcaaaaaaaaaaaaaaaagaagagaaaaagaaaacaaaaacaaacaaaaactttctggccacacaaagataactggatctggccctcaagcagccggagtttgcgacccttaccgtgagcattttataatcaattcatttggccctcagtttgatgcagcaggcatggtctgttgaggtccatgttttgttttttttgtttgtttgttttgtttttttttgagacagaatctcgccctgtcgctcaggctggagtacaatggtgtgatctcagctcactgcaatctctgcctcccaggttcaagcgattctcctgcctcagcctcctgcgtagctgggattacaggcgtgagccaccacacccggctaattttgtatttttaatagagatggggtttcgccatgtttaccaggttggtctctaactcctgacctcaggtgatccgcctgcctcagcctcccaaagtgctgggactacaggcatgagccaccgtgcccagcctgaggttcatgttttacagatggggaaaccaaggcacagagcggcaaagccgctagcctagggtcactgagtgaggtcccggctgcaccggggtttgaacccaggaggcctggcgtggagttgggggtgtctgacgtggggttgggggtgtcgggggtgggagtcccgtggagggctgagcggttctgctgctccatccccaggcccaggcgagagcgggaagagcaccttcatcaagcagatgcggatcatccacggcgccggctactcggaggaggagcgcaagggcttccggcccctggtctaccagaacatcttcgtgtccatgcgggccatgatcgaggccatggagcggctgcagattccattcagcaggcccgagagcaaggtgagccgccagggcaggcaggggcccagggcaggcaggggcccagggcagggttccccagaccccggagcagggccaagttccccagacttcagggcagggcagggcagggcagggcaggcagggaagggtccccagaccctggggcaaggccatgtcctccagacatatgtgcatacatacaagtgcacacacaagtatacacgcataaatgcacacacgcacatgtatgcacacgcacagacatgcacacaaggacacacacgtacatgctcacaaagatacacacgcatgcccacatgcacacacccacacacatacacaaatgaatgcacacacgtgcacacgtgtgcacacacacaaatgcacacaaggatccatgcagatgcccccacacagatgcacacaaataagtgcacacacaaatgtacacactcaaacacgcccatgcacgtgtacacactcacaaacacacacaagaatgcatgcaaattcccacatgcacacacacacatgcacatacacaaacacacacaagcatgcatgcaaattcccacatgcacacacacacatgcacatacacaaacacacaaggatacacacatgcctgcatgcaatccccccatgcacatgcacgcacatgtgtgcacacatacaaatgcacacacaagcacacctatgcacgcacccacaaatgcagccaaggatacatgcgcgtgccccacacacaaatatgcaaacaaatcacacacccagacacacccatgcacatgtgtacatctatacacacacacacacgagcacgcttgtacatgaacaaacacagagaaatgcacacacaacactcagagtccatcacaaaggtctgagcaacgcgagtgcctggggggagctagggctgtttggggaaaagaaggggaaacccagagtctggggggcagctcagggttcacgcgcctctgggggacttctgaggggcagattgcttcagtgctctgtgtcttagtcgcttcatctgtggaaggggggactgtgagtgccgtgcttcctgggagccagctagtgtaaagagcggggctgggtgccatgctccccctgagcctgggctcgcccgagcacatgtgccctctgcagcccctcatgtggtggtctgtgcttttccctctggggatccatgcaagaacagacggaggacaaatcagaagtgtgcgggggggtcgggagctctggggaagaaggagagcagtgggaagagagcgtgtttcagggagggacgtgggggcttgcagagatgcctgcggagggcagccccactcagaaaggctaccctaactgcccccgtcctccctccccagcaccacgctagcctggtcatgagccaggacccctataaagtgaccacgtttgagaagcgctacgctgcggccatgcagtggctgtggagggatgccggcatccgggcctgctatgagcgtcggcgggaattccacctgctcgattcagccgtgtagtgagtctggggtctgcgggggatgggcgcgtggggaggggctgagggcaggggccaggctggctggcttcctgcagcaggagatattgtgggcgcagatgggctgtgaggtggtcctgctccaggatgaggtccttccagggggaccctaattcccgggggaccctgttctgggggtgacccttttcctgggggaactcccttcatggaatgaccttgttcctgggtggaccctgttccttgggactctgttctggcggtgatcttgttcttggaatgaccctattcatagggggactctgttctaggagtgactctgttcctgagggaatccagttccttggggagaccctgttctagggggtatcctgttcctagagtgaccctgtgcctggggttccctgttcctgcgaggaccctgtttcaggggtgaccctgttcctgggggaaccgtattcctagagtgaccctgttcttggggggaaccctgatcctggggggaaccctattcctggagaaccctgttcctggagtgaccctgggccttggagtccctgttcccgtgaggaccctgtttcaggggtgaccctgtttctggggggaccctgttcccgggggtgactctgttcccagggagaccctatttcctgggggatcctgttctggcgttgatccttttcctggagtgaccctgttcctaggggtgatcctgttcctggggggactgtattcctagagtgaccctgttcttggagggaccctgttcctggggggaccttgttcctgggggaaccctattcctagagaaccctgttcccggagtgaccctattcctggcgggaacctgttcctagagtgcccctgttttagaagggacccttttctgggagtgaccctgtttctgaggggaccctattctggggggaccctgttcctggagtgaccctgttcctggggggaccctgttcctaaagtgaccctgttttaggggggactctgttccaggggagaccctgttctgggggtgaccctattcctagtgggatcctgtactaggtgtgatggtggatgtccaaggtggcttgatgtctgggaagactgttcccaggctaccagcattcttggggtagcgccacccctgccatagcagctctcccgggggacaccactcctcgatgaggccattcctcatgtcacgccatccctcgggtcaccctgctctgcgtgtgaagctgcttttccttggggctccattgcctcaggtgggggacgctcctgggccatctgccaactccagggaccccacctccacccagggagctctcctcccccagcagggtccttgctgggcctttcgtagggcctgggaagcaaagggaggctggctgcaaggctgggcctcaggactccttgctctgcagctacctgtcccacctggagcgcatcaccgaggagggctacgtccccacagctcaggacgtgctccgcagccgcatgcccaccactggcatcaacgagtactgcttctccgtgcagaaaaccaacctgcggtgagcgctccacctaggcccagcctagggggcagggaaggcttcctgtaggaagggcaaaggagctggggccctgagggatgagtaggagtttcttaggcccagccttcaaggagctgccaagctaggggaagcaaagctccatgtagacacctccaggcccccaggtagtcaggactgggacctgtaggagcccaggctgaggcatcagagatccaggagggaatatcttcttggaggagggaatattaatggggttttgaaagacgaataggagttcagtagtcctaaccctgaaggggctgctggggaggaggaaatagagactatacagtcaggaccaggtctggggaggcctggtctggggagctcagaggtgatccctgtagtcatcaacactgggggatggactagagtgtgaggctggaagtcaggaaactcagaaaaaggaggagccaggacagcgggcgtggggatggaaaggaagggatgggcaagagttgtttctgatgtggaatgggcaggactggatgagtgtgggaattagaacaggaagtcaaaaatgacacctgagttttttgtcaaggtgatgggggtagacagtggagccggtgggctagaggatgaaaaggtggtgatggagtcctttgggacaggttgagtctgaggggcctagggggactccaccttagctggcagacagaggtgggaatggccagtgcagcaccctaaccctaaccctaacccagcagagcaatggccaatgtcaaaggtcaggaaaggaaaggtcaagaatacagtgagaagaatgactctgggattggcagttagagggtcactggtgaccttagcaagatctgtttccatgggctgatggcggggagctgagcaggggtgcaaagtcatgcccagagacagcgattgtgtttgacctacccctatttggccttcctttccctaaatcccccaaacctattgttttggcctcttcaatagtccttactaggaaggttcataatttatctgttttctgtgggtctcctctacaagatggagagcctcacaaggttaggggctgagtttgattcttctgcttctttagtgaatagctaaaggtcagagtagaagttggtaaatgtgggtggatggttggaaagatggaatgggggcaacccgctcgggtccccttccacgctgtggaagctttgttctttcgctcttcacaataaatcttgctgctgctcactctttgggtccacaccacctttaagagctgtaacacttactgcgaaggtctgcggcttcattcttgaagtcagcgagaccgagaacccacgagaaggaaccagctctgggacacaatagtagtgttagtacccaaggatgacttctatgggagagatacttggtctgggaatctttaaaaaaaaaaaaaaaggaaagatggaagggaatggatgggtggatgaatgggtggatggatagatgaatagatggatggataagttgagggatagatgagtggatggatggagtggcaggatggatgagtggatgaatcaatggatagatggatgagtgggtggatggatgaatggatggatagatggatggattgaaagagggatgagtggatggatggatggatggatggttagatgggtggatgggtgatacatgaatggatgagtgggtggatgagtggatagatggatagatgggtggatgaatgggtggatggatgggtgaatgagtggatggatgaattaatgggtagatgggtggaagggtgatgggtgaatggatgggtgggtggattggtgagtgaaggatggatggatgagtggatagatggatgggtgggtgggatggatgaatggatggatgaatgggtgggtgaatgcatggatggatgggtggatgagtggatggatggatgaatgaatgggtagatgggtggcaggtgatggatgaatgaatgaataaatgggtgaatgggtgagtgaaggatggatggatgagtgggtgaatggatggatgaatggatgagtggatgggggtgtgggtgggtggatgggtagatgggtggacgagtgagtggatagatgggtagatggatgtatgagtagatggataatgggtgaacagatgggtggatggatagatgagtagatgaagcgatggatggatgggtggattgagtaaatgggtggacaggcaggtggatgatggatggatgaatagatgggtagatggatagacggatagatggatggatgagtgaatgaatagatggatgggtggatggatagatggatggatgggtgggatggatggatggatggatggatggatgaatgggtggatggatgggtggatgagtggatggatggatgaatgaatgggtagatgggtggtgggtgatggatggatggatgaatgggtggatggatgggtggatgagtggatggatggatgaatgaatgggtagatgggtggtgggtgacggatgaatggatgaatgggtggatgggtgagtggatgaatggatgagtggatgggtgggagggtgggtggatgggtagatgggtggatgagtgagtggatagatgggtagatggatggatgggtagctgggtaatgggtggacagatgggtggatggatggatggatgagtaaatggagagatggatgggtgggtcggtgggtggatttcgtaaatgggtggacaggtggatggatgatggatggatggatagatgggtagatggatagatggatggatgagtgaatggctggatgggtggatggatgagtgggtgggtggatgggtggatggatgagtgaataaatcgatgaatggggtgggtgggtggataaaagtttaggagtgaaggtagaggctgggaaatcatggggaagtctgggccaaggaagtgatttttaggtgtggcccaggagtgagacgaatgaatggagtgagggctcagaggacactgagacccgagatgagaggtgatgcccacagttcccaactggtcagttgctgatcccactcccgtctcagtctccagagccccctctcgacggctgcttaccctgtctggctctggatgtggggtttgagggactctgaggatgcatgggaggagtgggtctcagggatcaggagacacatccagcagctgcagcctaactgcttcatcatcagtcccggtttcccctcctgtgcaatggggcaagtcccttcttgcttgaggccctgggccgggcccgtccaaagcctctgttctgggacttcctgagtaacggttgcatccccagggaaatgacgcacagatggttatcagcgacccacatttctcagaagagagagaacaggaaggtgggggcagggttcaggcttttgttacggtgcgtggggctgagtcacagatggaggggaggacgtgtgctctgggaacagccctcattcccatctgtgtggccactggacatgcccatggccagccagagcacaggagccccatagcacagatgggaaaactgagttttggagatgtttggcaatttcctccgccgggtcgcccagccagcaccagggcacatctcagatctgtccaacctgctcccctctaatatgggggtagaaagcaggcagcccagcacagtagaagcttgggaaagtccccgctcctccctggatctcaggcttctcatctgtaaaatgggcgtaagactcatccttgcctcgcgggaatgacatggcaaatccacgagaggctagcacctattcttgctgtcgctattatggatcttggcatatcccagacgtgatgggggttgggggtgtcacggagcaggctcctgagctctgaaagggggcacctcggttccctgtaggatcgtggacgtcgggggccagaagtcagagcgtaagaaatggatccattgtttcgagaacgtgatcgccctcatctacctggcctcactgagtgaatacgaccagtgcctggaggagaacaaccaggaggtgcgccaccgcctccctcgccctgcccacttgttggcccagggaccctcacctgagcaggaagctctggtgcagaaagggagggatccctgctcttgaacgggcctgtgtgtgcccagcatggctatgaacttgacccttcagccttttgtggtcagattgcagcaacccaagacacagacctacagcatttgtttggtcaggaccccagacacacacacacacacacacacacacacacacacacacacacacacacatcacacacgcacatgcacacacgcacatacacaatgcatgcacacaaacacgcacagacacgtgcataatacatgcacatacacacgtgcacacacgggacacatgtacacacgcagtgcacatgcacaacacatgcacacgaacacacatgcaccacacacatgcacacttgcatgcactcacgtgcacaatacacgcatatgtacacatgcgcacacacatgaacacacacatgcacacacacagtacacacatgcacacgcacacacaggcacacacacgcacacacaggcacacaggcacacacatgcgtgcacacacacatgcacgcacacgcacaggctggagtgcagtggcgcgatctcggctcactggaaactccgcctcccgggttcacaccattctcctgcctcagcctccggagtaggtgggattacaggcacccgccaccacgctcggctaattttttttttgtattcttagaagagagggggtttcaccatgttagccaggatggtctcaatctcctgacctcgtgatccgcccgcctcggcctcccaaagtgctgggattacaggcgtgagccactgtgcccagccaatagcctcttttaataagtacaccagtcgtctaggatcagggcccaccctactccagtacgacctcatctgggttaattcctcgtgtgatggccctgtttccaaagaaggtcacaaactgaggttctagggggttaggtcttgaacgtatgaattttggggaaatatgatgtaccccataacacaaggcatttgagaccttattgtacttttttttttgagatggagtctcgcttttgtcgcccaggttagagtgcagtggcgcgatctcagctcactgcaacctccgcctcccgggttcaagcgattttcctgcctcagcctcccgagtagctgggtttacaggcacctgccatcatgcccggctaattttttgtatttttagtagaaacggggtttcaccatgttagccaggctggtctccaactcctggcctcaggtgatctgcccgccttggcctcccaaagtgctaggattacagccgtgagctgccgcgcccggccaggtctccctcttcttatgaggacagcagtcacggacttgagggccaccgtattctagtattgcctcaccttaacgacctcttcaaagaccctatctccaggccaggtgcagtggttcatgcctataaccccagcacgctgggaggccaggagttcaagaatctctctccagataaggtcacactctgaagctctggggggacatgaatttcgggaggacacacttccaaccagcacaggcacaaaaccatgtcaggcacacccaggcagctgtccatatggaaacacgggcacacccgcctcagccccagccaggcagataggggtgagcccatgcccctggagccaacagccccgtctccgcgatgggagggtttcctgtcccacctggctggttgaagcactaacctgcttctgcccccaacacagaaccgcatgaaggagagcctcgcattgtttgggactatcctggaactaccctggttcaaaagcacatccgtcatcctctttctcaacaaaaccgacatcctggaggagaaaatccccacctcccacctggctacctatttccccagtttccagggtaagtaattctagaactttctatacccttcaactcccaaaagcagctccgaagagagatgctaatccagactctacttcagcctggagtcaccggaactttcacataggatcagacccgcgttctagactcagctccatccactgcccgacctcattgaatctgttttcccttctgtggaatggaataaaatagcagaggcccttggaactgagtaaagtgaggaattctaaaaacacgtagcatatcacgtacaccttaaacattttatttatttatttatttttgagacagagtcttgctctgtcaccaggctggagtgcagtggcgtgatctcggctcactgcaacctttccctccagagttcaagcgattctcctacctcagcctccctagtagctggaactacaggtgcgcgccaccacgcccagctaatttttgtgtttttagtacgaaaagacgggatttcaccatgttgaccaggatagtctcgatcacttgacctcctgatccacccgcctcagcctcccaaagtgctaggattatagacaggagccaccatgcccggccaaacattttattttatgcttgttggccaacatttggggtttgagccaagatccttcaagcatgggtttgctatgtagaggtcactgttgtaaagcacttctggaaagattgtctactatttccagaatctgcctaggttttaagaatgattctttttcttttctttctttcttctattttttctttttgagacagagtctcactctgtcacccaggctggagtacagtggtgcgatcttggctcatggcaacctccaactccccggttcaagtgattctcctgccttagcctcccaagtagctgtgattacaggcacgtgccaccaagcctggctaatttttagtagtttcctgtcctatttttagtagagatggggtttcaccatgttggtcaggctggtctcgaactgacctcaagtgatccacctacctcagcctcccaaagtgctgggattacgggcgtgagccaccgcatctggccataacgtttctttttctaatctttcatagtgatctcatctatccctaattggatagcaatttctttttctttaatccattttttctttaatttttttttgtttgttttttgagacggagtctcgctctgctgcccaggctggagtgcagtggcgcaatctcagctcactgcaagctctgcctcctgggttcacaccattctgctgcctcagcctcccgagtagctgggattacaggtgcccgccagaacgtctggctagttttttgtatttttggtcgagatggggtttcatcatgttacccaggttggtctcaatctcctgacctcatgatccacctgtctcggcctcccaaagtgctgggattacaggcgtgagccatcgtgcccagtctattttttctttaatttcttttctttttttttttttttttgagatggagttttgctctttttgcccaggctggagtgcaatggcacaatctcggctcaccgcaacctccgcctcccgggttcaagggattctcctgcctcagcctcccgagtagctgggattgcaggcatgagccaccaccccggctaattttgtgtttttagtagagacggggtttctccatgttggtcaggctggacttgaactcccgacctcaggtgatccacccgcctcggcctcaaagtgctgggattacaggcgtgagccaccacacctggcctttctctttaatttttaaagcagagctttgaacaatgtttccaaagcacacagcttagttttgtaatacaatgaccttctttcatgcggcacttgtagctacagatttgcataacgtttcttttaattacatatgaatcaagacacgtacaatgggcaaaaacaggtttgggaacaaactctcagtccatccagagggtgaaagggccacagggcaactacagagaaacaccatctagtgttgggcaccacttagtatattttacaaaggggaggcagagttgtggttaatccagggaccaacgtggggaaggtacatattcactagcactttccccagaacaccactgtgaggataaagtgtggtggcgggtgtcctgcttagctactgccgagtaacaaaccatccccaaacttagtgacttaaactggtcattttcctttgcttatgattttgtgggtcaggaatttgggaaaggttgagctgggtaagttcatctctgatccatgtgacatcagctgggctctatgggattggagataaacttccaagatggcttcttcccccatatgtctggtgccttggtgctcttggcactcttggcctctctctctgtgtctctccctgcctccctctcccatctcatctctctctcctcccctttctcctagtctgtctctccttttccacctcccctgttctctctgtctccatctggggcctcatgatccacagcctcttcacatggtttgagcttactcacaatatggctgcctcagggtagacagacttcagcccaggtggaagctgcttctcatgatagcctcagaaatgtcagacgttactctgccacattctatttgtcaagcacatcactcatatcagcccggattcaaaagaaagagactccatctcttgaaggcagcatgacacatgcatacagggagggaaggaagtgacggcagccatcttggagataacttgccttcatgtcctggggatgccgtaacaaagtaccacaaactgggtggcttaaaacaacaggaaacaacagaagtccaaagttaaggtattggcaaggttggttccttttggaggctctaagggaaaatccattccatgcttctctctcagcttctggtggtggcctacaatccttagcttgtagacatatcactgcaatctctgcctccatgttcacatggctgtcttctcaccatgcctttatgtgtcctctcctgttgttataaggccaccagtcattggatttagggcccatactttggtatgaccactttttttttttttttttttttttgagacaaggtcttgctctgttgcccaggctagagtccagtggtgtgatcacagttcactgcagcctcaacctcctgggcacaggtgatcctcccacctcagcctcttgagttgctgggactacaggcgcacaccaccacacctgggtaatttttgtatatttctgtagagacagggtttcgccatgttgcccaggctgatctggaactcctgggcccaaccacacatctgtcatccacctgccttggccttccaaagtgctaggattacaggcgtgagccctcatgcctggccatgacctaatttaacttaactaattacatctgcaaatatccgatttctaaaagtcatattctgaagttccaggtggacatgaattttgggggacactgttcacctcaatatacaagcaaccatagtagatgagtccttagtacatgcttgacaccaggtccacaatcagtaaacataaactttggtgaagtcaccaggttttgatccctggtcttgtcatgtctcagagcccatgaggccaattttagccaattatacccacaagattcagggtctgggagatagacgtcaagttgttccaggatggtggcctggatagcccctcttccttgccaagcagccctgggaatcagctcatagtttagagaatttgggaacaggataaggtagatatttttttcattcaggtcaaagggaaccacccatgactcatccttgtctcccagcacaagtgactggtgcactctttgctgactcccagccctaccctccactgtgctaaataatatttgtgataataataagaaaccacactttgggaggctgaggcgcgcagatcgctttaggtcaggagtttgagaccagcctggccaacatggcaaagccccatctctgttaaaaatacaaaaattagctgggtgtggtggcgggggcctgtcatcccagttactcgggaggctgaggcaggagaatcgcttgaacccaggaggtggaggttgcagtgagctgagatcatgccacttcactccaacctgggtgacagagtgagactctgtctcaaaataataataataataataatgataataataataaaattgataacagcagctaacacatctaccgcactggtggaagcactctacaaagcttctttaatcttcatgttaaaaccctatgcagggctgggcacagtggctcacgcctgtaatcccagcgctttgggggggtcaaggcgggctgatcatttgaggtcaggagttcgagaccagcctggccaacatggcaaaaccccatctctactaaaaatacaaaaattacctgggcatggtggcaggcgcctgtaatcccagctactgccaagattgcaccattgcactccagcctgggcgacagagcgaggccccatctcaagaaaaaaaaaaaaaagaggactctcttcccctcgtttggccttgatgccgccatcttcacagtcctgggatatttgtctatgcgattccagtcttccaactgcactggctgtaagcgaggccaagagagtgtctctctttaacacagttctgcccaaagtcccagagctgggtctcattggtccatttcaggtcacatgactcgtgtgagacaatctcctgtgttcccattggctgggccggagtcgtgtgaccagctatgactacaaaagatggagtcaacgcacagaaaaatgacaggcgcgatccctgggtcccttcagtgctggttacagggaagagggtctccagaggccccctgggtccaaagagggagggtcctcacccccttcccacactgtttccccaggccctaagcaggatgctgaggcagccaagaggttcatcctggacatgtacacgaggatgtacaccgggtgcgtggacggccccgagggcagcaagaagggcgcacgatcccgacgcctcttcagccactacacatgtgccacagacacacagaacatccgcaaggtcttcaaggacgtgcgggactcggtgctcgcccgctacctggacgagatcaacctgctgtgacccaggccccacctggggcaggcggcaccggcgggcgggtgggaggtgggagtggctgcagggacccctagtgtccctggtctatctctccagcctcggcccacacgcaagggagtcgggggacggacggcccgctgctggccgctctcttctctgcctctcaccaggacagccgccccccagggtactcctgcccttgcttgactcagtttccctcctttgaaagggaaggagcaaaacggccatttgggatgccagggtggatgaaaaggtgaagaaatcaggggattgaggacttgggtgggtgggcatctctcaggagccccatctccgggcgtgtcacctcctgggcagggttctgggaccctctgtgggtgacgcacaccctgggatggggctagtagagccttcaggcgccttcgggcgtggactctggcgcactctagtggacaggagaaggaacgccttccaggaacctgtggactaggggtgcagggacttccctttgcaaggggtaacagaccgctggaaaacactgtcactttcagagctcggtggctcacagcgtgtcctgccccggtttgcggacgagagaaatcgcggcccacaagcatccccccatcccttgcaggctgggggctgggcatgctgcatcttaaccttttgtatttattccctcaccttctgcagggctccgtgcgggctgaaattaaagatttcttagaggctgcgtcgccagcgtcctgtttatcccctctgcattcctttctcggcttacgtgtcccgggggcagtgcttacagtgcggggagcaacgtggagtaggaaggaaaaaagttatacttcttgtctacccacctgtcctggccatggtacccagaactgtggaggctgtgagtcccgcaagccgggacgtggagtccaacctccctcccaggctgggggggacattgaagcagactcctccgtggctactgacctgaaattccagtagcagcccccacccagctttgagaaggcctcttactatcctcagggcagtgttctggggtgcaagccgtagcaccccactttacaggtgaggaaaccggggcgcagagaagtggagtaatttgactaagctcacacacctggaattgacagaggcaggagcctgttcctacgttgaacacatttgtggttttttatttgtttgttttttgagacaatctcacttggttgcccaggctggagtgcagtggtgcgatctcggttcactgcagcctctgcctcctgggttcaagtgattctcatgcctcagcctctgcagtagctgagattacaggcacccgccaccacacctggctactttttttttttttgatggagtcccgctctgtggcccaggctggagtgcagtggcgcaatctcgtctcactgcaacctccacctcccaggttcaagtgattctcctgcctcagcctcctgagtagcttggactacagttgtgtgccatcacacctggccatatttttgtatttttagtagagacagggtttcaccatgttggccaaactggtctcaaactcctgacctcaagtgatccgcctccctcgacctcccaaagtgctgggattacaggcatgagccaccacacctggcctaatttttcttcttataaaaacactagtcacactggatcagggtccagcctgtcatccccatcttaacttgattacatcggcaaagaccgtatttctaaataaggtcccattcacagataccgggggttatgacttcatcatatctttgtaggggagccacatttgaacctataaaaggtattttgtaatacaaaaaggagccgggcgtggtggtgcatgcttgcaatcccagctaattgggaggctgaagcatgagagttgcttgaacccgggaggcggaggttgcggtgagccaagatcctgccactgcactctagcctgagcgacagagtgagaccttgtctcaaataataaataaataaatacataaataaataaataaatataaaagtatgttatagaaaccctctccactgagtttggtctgacattttgctgctggtcagactggggtgatgggtttcagggaggaagacctcagtggtgacagcccttctcaccacatcctatctttctgttttttttttgagacggagtctcactctgtcacccaggctggaagtgcagtggtgtgatctcggctcactgcaagctccgcctcccaggttcacaccattctcctgcctcagcctcccgagtagctgggattacaggcgcccgccaccacgcctggctaattttttgtatttttagtagagacgggctttcaccgtgttagccaggatggtctcaatctcctgaccttgtgatccgcccgcctcggcctcccgaagtgctgggattacaggtgtgagccaccgcgctctgcctcttgttgttgttttgtaagaattttagactcacagaaaagttgcagaagttgtacacagttcccaaatgccctccacccagcttcctcttacctcttacgtaaccctagtacaacccaggaaattcacatcagcgagcgtcctatgaacgaacctgtgtgtagaccttactagaatgtggcgggttctcgctcccgtcctcctttcctggaccaggatccaatcccggatcccacatcgccatgagctgcctccctctcctcattctggggc

SEQ ID NO: 13723 - DNA, 13371 bp, Human
agagagagggatcctttaataaccgccaccaggtcccatccctcctcttcccacggctctccaggattcccacctcactcagagcaaaagcccaagtccagggccaggcgcagtggctcacacctgtaatccctgcactctgggaggtggaggcgggaggatcacctgatgtcaggatttcaagaccagtctggccaatatggtgaaacctgtctctactaaatatacaaaaattagccaggcgtggtgatgcgcacctgtaatcccagctactcaggaggcagaggcaggagaatcacttgaatccgggtggcagaggctgcagtcagccaacatcacatcactgcactccagcctgggcaacagagtgagactccatctcaaaaacaaacaaacagctgatcacggtggctcacgcctgtaatcccagcactttgggaggccgaggcgggcagatcatctgaggtcgggagttcaagaccagcctgaccaacatggagaaaccccgtctctactaaaactccaaaattagcggggcgtggtggcacgtgcctgtaatccagctactcgggaggctgaggcaggaatcacttgaacccaggatgcggtgagctgagattgtgccattgtactccagcctgggcaacaagagcgaaactccatctcaaaaaacaaaccaaccaaccaccaggtcccgtccctcctcctcccacagccttccagggctcctacctcactcagagcaaaatcccaagtcctccccaagacccacaagtccttgctggactggcctgcttcaccagctacagagttagcagggcccagtgcaaaagaaaactcaaaggccccttgttcaaaaatgattaggaatctcaaaatgcagcagtaaatattaacccaagcacaagccctgctgtggggtgggggggccctggacaaaagcacgaagcccccggccctgcctccctccggccttcctgacctccccccgggcactctgctgccaggcacagtcctgccccagggcctttgcacctgttggtcctgcctctgactacctctgtaccccatccccctgttctccctccttcttcaggtcgctttaggggtggaggaagccgtctctgatcctccctcccacctctttaactttgcaccttcctaccctgccattctcccggctggtttttctgcagaactgtccccaccatctgacctgccaggaattcagcttgtgaatttgtctctgtctgtctccaggcaccaccaccagggcagggacccacccccgccccgccccaccccagggccctggagcagcggggcctggcacacagtaggcgttctataaatgtgtcacaagaatggcttccctcaggaaggcggcattaccgctgcctttctgcagaaaaggaaactaaggctcagcaagaaccaccgcccagccagagccaaggtcacagagcacgtccgtggcacgcgtccaggtcgtgccacagcagggccggcggcttcgacgcgggcagccgggtcccttttctttgacagatggggaaaccgaggcccggccggctgccgggtaggagagggtggcgggggccgctgcccggggcgggggcgggccgggcccaaggtcaccgcggcgggcgggccacggggaggcgggccggcgtggggatccgcaggcctccccgggcgcgcgcgtcccccccctcggcggcgcgcacggggcacgggcggcggcaggtggagccgaagcctccgcagcagccgagccgcggccactgccggcgtcgccgccattagacaatagcggtggggccggggagcggggaggcgggcggcggggaggggcggggaggggcgccgggcgcgcaggaagcggggcccggggcgcgccggggccgggcgcgcggggagggggcgcaggaagcgggcgaggccgggcgcgggaggcggcggcggccccgggagctgccgatcggcgccgggacaaaggcgcggccgcccggcgcccccagcagcccgagccggggcgcacagccggggcgcagcccgcgccccccgccgcgattgacatgatgtttccacaaagcaggcattcggtaagcggggcccgtccggccggcgcccccaccccggatccgggccctacgcccccgacccccggctcccggccccgcgccccccaacccccaggcccggtgcctccggcccggcgccccccccaactccccggccctgtcttccctctccagctcccagcccggcgcgacccccctcccctcctgccgccggcccccggacaccccccctccagttcccgatccaccccagcttccgggccccgagcccccccgccgcagctcccggcttggcgccccccccccccaacccgccgggacagtcagggcctcggacggccttggcctcgggtctggggcgctccggaagccccgcgaggcacctctagcccggggatcctttgggggcctgtggtggggggggcgatccgaggcgcacccctcccggaagagcgtgtccccgaggaagggcgctgggaatctggggttgggcccccccggaagatttcgagcaccgagagagagacccctcccccaagaggactttgcagggaggaatcgctgccccccaacttggggagggggctccctagggcgcgtttctacccccctcggatgtgcactccctcccggcgctttggagggcggtagagggcgcaccctgccccccatctagggcgggccttaaaacgcacccccactgcctgggggtggcgggggacggggcggctccgggcgcacccacccgctcggcttcccccgggagaggcggggggcaggaagcgcgggtggggtcgcccagggggccgtaaacacgggcccaggaagtggggcaggagggggggcgccgcagctgcgcggccgctccctcctagccggcccttgaggggggtccagcccacgcctgggcctgacccgggccgccccatccctacagggctcctcgcacctaccccagcaactcaaattcaccacctcggactcctgcgaccgcatcaaagacgaatttcagctactgcaagctcagtaccacaggtgagctgggggactgggggtccctgcgtcccgagaatgtgagtccccccatttcttctgcgcagatggcaaggctgaggcctggagattgggaaaataatatatgctagactctgacctaatcacttgacaaatactgaattcatttattttaaacagccccattttgtagaggagaaaaccgaggcacaaaaatagttaaataatttgcccaaagattcagctgtgtggcttcagagcccctccctcctccccaatacccccaagtcccccattggataaaagaccttccaacaattggagttacggcacggactcgccatccctcaacccccaaaacagaaacattctgcagcctggtcatctctctctttgcccagttttggagaaagggttcccagcacccgtcagattctccaaggtgctgcttctttcagaaatctggcgtttctgaagagcttgccacgctgcggtatctaaggggaaggaactatttagtcctcttacacttaaagaaacttaagcccaggccaggcgtggtggctcatgcctgtaatcccagcactttgggaggccgaggaaggtggatcacttgaggtcaggagttcgagaccagcctggccaacatggtgaaaccccgtctctaccaaaaatacatagttagctgggtgtggtggcgggcgcctgtaatcccagctactcgggtggctgaggcaggaaacttgcttgaacccgtgaggcggaggttgcagtgagcagagatggagccactgctctccagcctgggtaacagggagactctgtctcaaaaaaaaaaaaaaaaaaaaaaaagaaagaaaaaaagaaacttaagcccagagatgttatgatgttatttcctcgggggtgtccatagcattgaggaagtggcaaggctgaggtttgcaccaggtctctctcctggtttaaggatataggttctcgcctgccctgctctggaggggcacgccgggcctgggaatctggagaaagtcaggctatgctcaaacccccgtttggccttggggccctctctaaactgaagcgtgcccaccccagaagtgttcctggaaggatcctggatttcctccaagtagaaaggggaatctcgattttgttgttgctgctgcaaatatcccacctttttgggtactccctgtgtgctcaagaccgttcgtgcctcctcgtgcttcatccttcctgtcgtccgactgtcgtacccattctcaagctgggcaaactgagacactgacagtcgaaggtgctggagtcagctttccatgcaggccccagaagcttttgtgcgggttcctcgatatgaagggttggataccgcctggtgagccccggggctgacctgattccacagggaagggatcagatggcggtcacagtgctgtgtgacctctgctaagccggaagccctctctgagctttggggtctccatccgctgggcctgggcttcctgctgtccaacgagggaccctaccatatcagaggcacacaccggatgttcgaggcgtaacagcccctgggtggccagaccatcctatttttcaagaaaggccagaaatgcaggctttggagtgaaacttcttttttattttattttatttttttgagacggagtcttgctctgtcgccaggctggagtgcagtggcgcgatctcggctcactgcaacctccacctttgggattcaagcgattcttctgtttcagcctcccaagtagctgggattacaggcgtgcaccaccacacccggctaatttttgtattttcggtagagacgggctttcgttatgttggccaggctggtctcaaactcctgacctcaagtgatccacccgccttggcctcccaaaatgctgggattacaggcgtgagccactgcacccagccccggtttttttttgtttttgtttttgtttttaatggtagcaacaaatgcacattttaaaagaaaactagagaaaaattggtggcggccaaagcatccctaacccggcacactcttctccggtggagcaaaatgccaggttcctggggtatcctaagatccatgtgcatttatgggatgcttactgtatgccaggtactgttctagaacttttcttgtctgaattcattgactcttctccaccccaccctgcgaggttgttagtggtacctcacagaggaggaaatgaagcccagagaggtagtggagtttgcctagagtcacacagcagggaagacgaagggctgagctttgaacccagtccgagagggggtggggatggcagaagcaggtaagccacagccaggtccgcagggcccctgtgctgggttggatttaagtaggttaaaggacacctcccccaccaccatcaccagttcttttcctggactgggaggccctcctgcctgctctcttccctccggccatgacgccctcatgggggctttgagaaacgccccacagctcatccttcccgggagggcctgtaggaagctctggtgtcagccacccggactggccaggtggagtgggagaaatggtgtgttttgtcccagctaaagaaaaaaggctgttaggaaggactaagagggagctgaggggtctgcctgggaagtccaggccccccatgaagctagggtccccttgggaagtccagccgggagccgccttgcagccccagaccctctcagcctctttgtacgttctatttgggtctggaaaattttcccctgtggttgagagcttgggctgctgcttggctgtgtgaccttgagccagttcctcaccctctctgggtgtccactgtgtcatctataaaaggagcgtgacaatgacgttgcgggcctcgtcgggaccgtgagaggtgaaggctcgtgagactctcagagctagcgttaccgtgccccctctaacttctgttgttcctataatgttactataatgttgcttatttccccccaaccagatctgcaagggtggtttcatcacccccttcttacagtcaggggccctgatgctctcccctccccgcagcatcacagagagctcaactcttaccaacttccctgcccctcaattcaatgtcctcagcccctatgaaagtttacggcttcattggccaggcacggtgggtggctcatatctgtaaccccaagcactttgggaggccgaggaaggaggattgcttgagcccaggagtttttgagaccagcctgggcaacatagggagacccccgtctcaatttaaaaaaaaaattattgcttgaccctctgagaattggctgatcttgcccttacaggggacttggagcctcagtttcctcccctggataacggagggtggggggctcccgcccagccgccactaaccaccccatctcccccctgtgcctcctcagcctcaagctcgaatgtgacaagttggccagtgagaagtcagagatgcagcgtcactatgtgatggtaacgtcactccgcccccaggtccagtgttgggggcgggcgacagggccctccacatcccctccaccacgggcagctgctccctcaaccccggccacctcccctgggaagcgcgaggatcggggcctgttctccattcagccggcccctgctgggctgagcctgcctcgctagcctggcagatggccgaggcagtggccgaggtgccaaaccgccgggttgcagaccggccctgccaggtcccccggctgtccttggcagcggaggagggaggagagggaggctcaccggctgtgaaagccaacagccaggaactgacgtgggggagcagccgagtccctccccaccgccaaggtcccagcgtccacacgcttaacccctttgggcccgagctcaaagaagaagcctgtgggagggggtctgagccctacccatttcggggggctgaggtgtgacactgcattgctgctgccagaaccacttgctcggttttgtaactgccaggtgacgatttctgcatcaaaaatcccctcccttacccacccttggcctggccctcgagcagcgatgctggggtctcagcccagtacccaaatctcccagactgtgggggaggcagagccagaccctgaccctcccagccagaagaatagggctggggtcagagagagggacctaggacctgcctgaggaagactatatggagaaatggggcacacagctggggtcttgcaggatgagtaggagttcaccagacagagacagagaaactacgtgaaggcctgggaatgaacttggttttcccccaggggtgacagggagccatgggagggtttagagcaggggaggggcagggtgagatctggggcttggggtgggggtagctgctggccccagagccagcaggctttgtttacccctcactgtttatacctaggcaggcaaacttccctggcgtctgggcccacccgcagacaagacatagaaagatacaagattaggagccctggaatgcgtgttctcgcggtgcacatggagtgggggaggagccaggccagggctagggacctaaagtgcccccagtctccatccgcagccccagcggccccctgcccctctccagggcgggctgggatgctgggtgtgggcgtctctccctcctctttccctcccacctgcctctcctttctttcctgccctcagctgtctcttgctgtctcccccctttgtctgtctctgccactcccctatctctttgtctccgtgtccccccatccttccccacccccatctcccgctccccctctctctcccccatacagtactacgagatgtcctacggcttgaacatcgagatgcacaaacaggtacgcccatctcctcctcctcctcctcctcctcctccttccccctcctccccccacctccagccccgccttgggcacccccaggcaggtagcggccggccctcggctgggcaccaagccagcccggttatcctgttacctcctaagccctccccaagctcccgctctcctcccccccgccccgcctctttttcaggcctccctgggagtgtttctcccggtggtggggaggggcagagaccttccccacagcctacggcccccagccctccctacattcgcacaagcgcttactacctgccaggggcctgagtggccgacccccgaggaatgtgcagtctggcctcatcctgcacttacctcactctaagctgcaggcgacagccggtgtccagccccacctttgccactgactggctgccctcgggcccgaacacggctttgctcatcccaccctggccagacctagcccctcttagaagccgcaagtggcagggctgggccgggccccgcgcaggcctcctgtggctagcctgcacctgccacccgcccaggactgaagccggcttcatctgtgtgttccaggctgagatcgtcaaaaggctgaacgggatttgtgcccaggtcctgccctacctctcccaagaggtaagagccagggccttggggaggggttgtgagggggccccgcacttgcccagcccctgtccactgcagccatcttgggtggtgtgctgggcgccccagggcacacgcctcccctctctggacctccctggctctgaacaccagagccggcctgtgcagaagaatccccgggccagagacactccaggggtgcaggcgtgtggggggcgggcctcaccctgctctggaattcccagctggagtgagtcatgtcataggtagaaatgtcagatgggcctaaactgcaccaggaatgtttttttctcatctctcttcctcctttcaccctcttgagacatcctcctccaggccatgcgggctgcacaggaccaaggactagagggtgttaggggattgtgggggaaggggtagcacagggtggtcacacatggacacagccacacagataggcacgagcacatcaacacacgggagatacacagatgcagacacggatacacgtgtgtgcagacagcacagggacacgcatgcaggaatgtgcagctacacgtgggcacacgtgatcctgagcacacattaccacatgcacacacacacccagatgaacctgacgcccagctcctcttctcctttcttgggttctgaggctcaggatgcgaggccgcccctccccagggccatgtaaggcccatctcctgtccctgccaagtttactgtcaaaagtttgtaacttcctcttcaatccctgtgggtatctcaggatcctttgggtgccctgctttgcccagggacaagtcttagcaggacccaatgaaagccctagagaaaagggcacttggagcccttcagaacagaggcttcctggtagccaaggcaaaaagggagattggtagattctagcatctgctggccacagagtcaggtgtttggggagagctcagggaggaactgccctgaatctgagcccattccccagccagccctgccagaattcattgggccctccccagccatggtaggagaagggctcaatttggccagactcagggcacagtcttggagctcctaggatcaggacgtccctgtacagttgggcaggttgtgtactgcacaaacattcacatgtttcacatctttgcaggtggctgtgcacataggataggtcaggatccagggtttctcccgggctcactcaaaagctgtttcctaactacttagcacaaaacccttttaattgttttctgcacttttccatttgtctctgttggccagacgaagagacgagcttggtgaaaggaagcagttggagagagggagggtgctttctgatggggttgaaaaccactgggaggagcagacatgatggcccacttggtagtggggctcctcctggcctcagggccgtccccctctcctctcccaggatcaggaggaatcactgcctctcctctcccccgacccccttccagcaccagcagcaggtcttgggagccattgagagggccaagcaggtcaccgctcccgagctgaactctatcatccgagtatgtatggggacctgggcgggtgggcgggggacaggtgggccccaggcagctaatgttcccctcccccgccctgcagcagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacggggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcggtgctgtgtccctgcctctgtgttgtggctgcccccgggggaggacgggttccttccaatgtgagacatcctcctagaacatcaggagttcctagctgtggcccggtgcggtgtggctcacgcctgtcatcccaacactttgggaggctgaggcaggcagatcacttgaggccaggagttcgagaccagcctggccaacatggtgaaaccctgtctgtactaaaaatacaaaaaagctgggcgtggtggtgggcaactgtgatcccagctacttaggaggctgaggcagaagaatcacttgaattcaaggaggttgcggtgagctgagatcgcaccactgcactccagcctgggcaacaagagcaaaactccatctcaaaaaaaaaaaaaatacaaaaagtagccgggcatggtggcgtgcacctgtaattccagctgcttaggaggctgggacacaagaattgcttgaacccgggaggcagaggttgcagtgagctgagatgatgcctctgcacttcagcctgggcgacagaacaagacgctgtctcaaaaaaaaagagttggtgggtcacgcttctgcatttggcctacactgctctgatgcctagcccagagagggtgagctgaagacttcaggtcacacagcatggcccaggtggttgatgtttagacaggcagttaagggggcttaaaaaggcgaagggatccctaagctagtaagtggggaggctgaggtgggaggattgcctgaggccgggagtgcaaggacaacctgagcaacatagcaagaccccatctcctaaaaaaaaatttttttttaataataaaataagtgagtcagtggcagagctgatttctgcacccgagatctgaagacctaaaggacattctcttcccttagagaaagaggaggccccagtgcccacacaggtacacttcttttcggttctgggtgggttttttttgtttgtttgtttgtttttttgagacagggtctcactctgttgcccaggctagagtgcagtggtgtgatcacagctcactgcagcctcaacttccctgagctaaagtgatcctcccacctcagcctcagcctcctgagctgggacagtgggcatgcaccaccatactcgcctaatcttttgtatatatatgtgtatgtatatatatatatatatatatatatatatatatatatatatataattttttttttttttttttttgtagaaatgaggtttcaccatgttacccaggtctcaaactcctgggctcaagcagtcctcccgcctcagcctcccaaagtgctgggattacaggcgtgagcccccgtgcctggccagtatactcagagagaacactgactcgccccagctgagcctccatcctctaaggaacagccagaagccccccaacccccaccgcctcacccaagctgcaccagccgtggggaagccagaaggaaaggggattgcccccagttttcccatcttggcctcagcccctggctcctctgggacttgggccaagggaacatgttgctgcccacccagcaaatgggagatggccatttctactctggagggacttcacggcaggaggaagtccgagctgaggggagctgacaagggtggagatggacagccgacattggggaaaatgtctcatgtccctgaggagagggctgggagtggaggggacagggctggctgatcacaccagcctcctggcaggtcccaccccatctccactgcagccaaagtgcctctaaaaatgccagttgcaagggatcatcccctgctgacatttacccttgttgaaacctgaacacgcctaggcacaccccttggcaagggtaaattcttcttatttccttttcttttttgagatggagtcttgctctgtcgcccaggctggagtgcagtggcacaatctcggctcggctcactgcaagctctgcctcccgggttcacgccattctcctgcctcagcctcccaagt

SEQ ID NO: 13724 - DNA, 30782 bp, Human
aggaggccagagagggaaaagggttttcagtagtcagcaaggtggtgggaacacacgtttttataaattctggtggccacttccatttcatctgcaaagtaaggataaagatatggctgggtgaggtggctcacatctataatcccagcgctttgggaggccgaggagggcagatcactagaggccaggagtttgagaccagcctggccaacgtggcgaaacccgctctctactaaaaatacaaaattagccaggcatggtggcgcgcctgtaatcccagctacttgggagggtgaggcaggagaatcactagagcctgtgaggcagagggtgcaatgaacctagatcacgcccctgcactccagcctgggcgacagagcaagactccatctcaaaaaaagaagaagaaaaaaaagatatcccttgggtagggttagcttaacgggcttacagcagtgcctggtatcctgtaggcatttcatgaatgcgtacacctggcctggaatggtgcaggcactgcagtaaggcctgattgacacctgatggacagcaggcactccattaatctctggtccgtgcctggcatatagaatgtgtcccattaatgcctgatacacagtaggtgtcccattaacgctttttaatttttttttttgagacagagtctcgctctgtcgcccaggctggagtgcagtggcatgatctcagctcactgcaagttccgtctcccgggttcacgccattctcctgcctcagcctcccgagtagctgggactacaggcgcccgccaccacgcccggctaattttttgtatttttagtagagacggggtttcaccgtgtcagccaggatagtctcgatctcctgacctcgtgatccacccgcctcggcctcccaaagtgctgggattacaggcgtgagccaccgcgcccggccctctttttttttttttttctttggagacggagtttcgttcttgttgcccaggctggagtgcaatggcgtgatctcggctcactgcaacctccgcctcctgggttcaagtgattctcctgcctcagcctcccgagtagctgggattacgggcgtgcaccaccacgccgggctaattttgtagttttagtagagacggcgtttctccctgttggtcaggctggtctcgaactccagacctcaggtgatccgcccgcctcggccttccaaagtgctgggattacaggcgtgagccaccgcgcccgacctccattaacgctttttaatggatgagtgaaggttcctgtcaggcaatgtcagggcgcttcccgggggcagcgactgctccccaggcacctggagacccagagagcgcagcggccgcgtgcgcgcctccgccaccgcgcctgggccgagccgagcgggaccgagcggggccgaacggagccgagcggagccgagcctggccgggccgagtccgccacattcccacaatcccgggcggccccgccccggctcccggctgcgcgtcccccttcccacgtcggcgcaaccaaacccgcgggccccccgccctcgccccgccccgcccctttcgcgcccgccgacgccccgcccaggccgctagtcccgcccccatggtgggcgcgcttggccgccggcccctcccattggccgcaccgtctgcccgtcgcgggctgcgctcccagcctgctaggttgtccggcgctgtcgctcggttgcggcggctgcggttggcggtggctgcggcggcggcgcgggctgagtgcggccgcgcgggagtccgcggctggcgcggcccgagcggggacccggcggctcgccaggcggcggccgaggcggggcgggccggcccggggccgagggccggtggccgaggccggagggccgcggcgggcggcggccgaggcggctccggccagggccgggccgggggccggggggcggcggcgggcaggcggccgcgtcggccggggccgggacgatgactctggagtccatgatggcgtgttgcctgagcgatgaggtgaaggagtccaagcggatcaacgccgagatcgagaagcagctgcggcgggacaagcgcgacgcccggcgcgagctcaagctgctgctgctcggtgagtgcggcccccgggcctgccggctgcgggccctgccctgcctgtgcctgccctgcctgtccgggtcgggccgggaccctccggggtcagccctgcctgtgccgtccgggtcgcgagaccctccggggtcagccctgcctgtgccttccctgcctgtccgggtcgcgggaccctcgagtgtcagccctgcctgtgccttcactgcctgtccgggtcggggcggggccctccgggatcagccctgcctgtgtcgtctgggtcggctcgggaccctctggggtcagccctgcctttgctgtctaggtcggcacctgggaccctccggggtcagctgcgggcccctgatttctttggggtcagcccctgccttaactgttcatgttggcacctgggactctccggtgtcagcctgtgtctgtcctgtctggatcaggcccccgatcactcctaggtcagctcccagcttctgctgtctacattgggcctccaggactcttcaggatttgccctctgttccttctcaagggaccagtccctccctgcacagggaccttctgaccttaccccaccggagtacccacccctcgctaccccttcagggccagacctttgggctgtaacccacagggcacactcacccctcactgctcagggccccgcgttgacccttccctccaggcagagccctgtacactccatgcaggccctgtaccctccatgcaggccctgtacacccccccatccccccgaagactcctccgtgtcccctatccccacattcccttcagggccattctcctgccttcctgttccgggaaaccccgtactcctcttggctggaatgcaccctgtgggaaaaagacagtctttcctctcctcagggttccgctcagctgagggtggggcggttgacacctgagggagcctttgcttgttgtcccaagcagctatctcggcagcctcccccgcccccttccttagagtcctggtgggagccacgctgagtcctcgttgagagcagccccccacctgccggctcctccccaccgtcctggagaaggtttgctggtgaacctccttctccccaaggcacacctgctgcagggagccagtcgggccagctgtaaagtgttgtcactccaaataagggccccttcagtggtttacaaaacagaagctcttgccctgccccgcccctgccctcccgagctcctaggttagctcctgggccgggggcggggcggtggggaaggtcggaaatgcgtgagaggcagcggtgacggaggagggggcgtgctggtggcggtggctcttggggaggaggcaggtcgcatgttgtgtggggaacacgttgcctctcctgccgtgagcctcttagggccctccgtgtcccgggttacagaggtgccttggatgaaacgccttcctgatttttttccccaaacttgtgttttgatttacctaagggttctaaaatgggccatctttccagggggccgcgggtaggcagagccgtggtcctcacgtttggaggaaatgtgcagtgcggcccgcgtggtggcactttgcacagagtggcactggctggcttttgtagtgggtcgtggactttgtttggatggaggggagttaggaattactggtgtcataaagatcttaccagatggccttgccctgtggctctgtgacctccagaacccccgccgccatccctgcatgcacccggtcttctgtgcctgcactttggacttgagattgacacggggttcaaggacgaaggtcaggggctcccgtgtctgccgccttggctgcttggagcaagtctggaagtgatgcggcccttcccgcatcctctgtccagtgcccgcctgtggcccgggggtgtctgctgcaggagcacctgtgtctgcagtcccaccccctcccactctgtgagcctgaaagttgacccctatcagcctgtaagacgggaggttgctgtcaggctcagggccaggcgtggcagataggacagtgaggaagatgtgagctcacgtgcgacccaaggaggactggtgtcagtgccacgcagagagccggggctgtcagggggttgggagggcttcacacccaaggtgttggagccagggacccctttgggaatctgatgcgacagaccctcagaaaacttcccgtccaagcaaccttgcatcccagctggagggccccttgctgggaggactttgaccacctgaggtccaggggctggggcctcagggtgcaggggaggggacctctgtcaggctccctgcctgcttgtgggaactcattccactctcccagtaggccagccccgagcttgcgattgcccccgtttttcagggagcagctagagggtggggccgaggctccccggaaggaaggggctgttgggctgcagcaggtggctatggcgcctgcggcccacggaatgttcagagacctctgggtggaggtcctggcactccgcaggaggcccagccaagctgggtctgcctctccctagaattctttcctcccctgccccttagcagtgggggctccatccctcctcccccatggctcccgtacagcgttgtggagtggatgtcggggagggaggcaggggcctgccaccacacccctgtggcatctggggcccaggagggtctcgtttatgtgggtggtgctggtttcttccaggctctggggcagcagggctccagggccctgccctgactcctgggtttgcaaccaggtggagcatgttctggaagaacgccgcgtctgctcgctctcatccactgcctccctggggctgcacacggcctgtgaggtcggtcagcctggcgaggacattccgtgccccgttttcggggtgggggggaccttacggagccctagagctggacggggctccggctgccgtgccgcctctcccgcggcggctaaaatgtgctgttcacgcctcagatgggcctctccgttacgtacaacaggtctccccggggccctgtgcacattggtccgggttggtctctggggtggggctgccctgggcactgcagggtgctgagcagtgtccgaggcctccacccactccatgccaggagctcccccaagtcgtgataaccacagatgtctctagacagtgcccattgtcccttggggggcacgttgcccccatttgagaccctttactgtgtggtagcgtacaacgtaaaatgctcgtggcaaagctgagggataatgagtgcaaattattttgtcagaagtttccatgagtgcttatagagtatttttctaagcaccgtcaaagccgtgtgtgtgtgaattcactactcagtgtatgcatgaatgtgaatgcatgtattgttttatacccgtggtattccaggtttgtccctatgcacacttctgtcgatgctggtgacagctgtggatgggtacaggagtggcaagcacgtactgcgcacttagtgcacacgctgctcccgcctccgtccgcgccgccgccatcctggggtccgccctgtggcctggagagctcttgcaggccctgccagcagctcttggatctgggttcccattccccaggcccgctgggcttctgcctatcacgggcagccctcggctgttaggtttccgtctcactggtaaactgtggaggggacccccgtatagttctttgtggcaggtttgtggttggaaacgtggggacttccatgggaatgcctgttcccagggcctgaggctgctagcgaggctgagccggagtggctccaggctttctaaataaagcaggatggttagttccggaggcttcctgtccggcctgcgccagcccccacggggcagtgacaaggcccgggatccagcatggggtgcggtggccccacgggaagggccgggcctctgttggcccagtgttgggaggcgtggagcgtggcctctggcgcctggcagggtggctgtgccgtgtcccagaagactctgggagcaggaagcgcccttggatggcctcgtccaaccttgacttcccaagcccgagcccaggccagggagacgtggggacttggtccgggcctgctctcacgtcctttgtgtttacatgtaatcagttatgatgattgtggctgaaagggtctgcttttcccgggcatggtccgggaagctccgttccacagctgtgagctccgtggagcttcctcccgagcctcctgcccggctctgccggtgctgtggtgagagtggaggaagtgctttcctccgagatttaaccacgagaggtttcactttctgagtcttgtggtggagcctgtctctgtctgggacctggaccctgggcagcacggggaggacgccgtggcatcaggaggttggagaggtgtgtggtggagtcggacggatcttagaggggcgctcgcggggcctgctcggccctaccctgtagacagctgggacccagcgccccttctgggtccccagcagggctgtgttctccccactgggcaccccagcttgtgcgtggaggatgggaagccttgtatggcttgcccacctgggtgactgagagcggtggatgcgattaggggcggccaggggctctgggaaggcccacgtgcagggtcattatctggcagaaattaagtcctttcgcagaaccgggatcctaagtgccggtttgctggcgtgcaggtggttgcaggtgcatgtagctcctgccgccaggccctgtgtggagcatcccgcccggggggcctcccaccatgtctgtcatctgtagggcacctggcaggtcttagaattggctgccctggatccagactctcgctgtcatctgggcctggccacatccctcccctgccatcaagatgtctgtggtccagtctcccaccctccatccccactccctgcctctgggtcagaagcctccgatggtctctgctgtgggggttcctggtccagcctggcctcccgcagtctgccgacaggcgctttcaggacagcactggtgggtgggtcttcgggccacctgcagggcctgggagcagtgtggtgtccggatcaggtacgtggcctggggagactcaggttcagagcctacctctgcctcttgtaactgtgggacttcaggtctgtgcctcagtttcctcagggggcggtggggtgaggactcggtggtgatccccatcctgccgcacgtggggacccacggaatgctggctgctgcttccgctgccggtgtggtgatatcttgtcgcgtccacagcacctggcgtgtgtggcacacattgggtgctctgagaaactgctccatgggggatcctgccctgggatctgggatctgggatctgcccacagacaccttgatcaggattccccagcctcggctccgtgggtgttttacactggatcgttctctggggtggagctgtcttgggcactgcagggtactgagcagcgtccctggcctccacccacaccagaccaggagcacccccaagttgtgacaaccacagaagtccccagacatcgcctagtgtccctgggagcaggacccctgacccgtgtgtcttagcagcccccttcccttctcgtcgccatcgtcagctgcgtgtccttggtcccctgcttccctgcccatgtcattgagctgtgcaggtctcagagatgcttggcgagtgaccgtcattggctgactgaaggcagatcacgcagggaagtggagaggagtggcccgacacctccccaatgccctgcaggctggtctggtgcacgccaggggtctctgctggggcaggctcggttgccacctgcctgtgggcctgtgcactgggcagaaggggtctccggggacagtgcgcagctggctctcagaagcttctttctgagtcctgcctgtggcctgggctgccctgggctggccagcacggggcagtgggggcacactctggagggagccaggggcgagtcacttccctctcccggcctcagtttccccatcggtcacgtgggaaggctgtccctccccctgtaggattgtggaaggattaaatgagctgaggccagtgcggcagacagcggggagggagccctcttgtcccctgtggctgcccttcctgctggctgctttgcaccgaaaagctgcggagtaaccctgggcggtggtgctccctggatggcgtccacatggggaccccaaggcctgggaggctccaggagggacggtgctggcccaggtttctgtccctgtctgacctcggagttggtgttctgggtaccgcactgtccggcggcccaggctccgttttctcttctgtcaaactgtgtggtcaccctgatgtttcaggggccctgcagggacggagtggggtggggggctgaagggtgtggtcaaactggagggcgctgtgtctgttgctattgttaaccgtgtccacactgatgggtgctgggccccgccaccgagcgggacttgtgcggcctgcagagatgtggctgttctgttgcctgtcttaatccccagggactgtggggccaggtccacactgtgggatgagtgcagcccccacggctgtggtggggctgggtccacgctgtgggatgaatgcagcccccagggactgtggggccgggtccacgctgtgggatgaatgaagcagccttttctccagccacactggtttgctcggccttagtcccactggatgcggcgagggttgaccggtcaggcccttgctggtggcctgggtagatgtctggagagggggcctgggcctccggactcctgcccttcccccatcagtgatcctatcccacactctttggcgatggtcagtgagctgggcaggggcgggggtctgtccctgtccctcaggtggagatgtccaggccagtgcccacaactgggttagatgggctgcacaaggctggggaccagtctcccaggctgtcggggggcttcagtaatggctgtgggaagacccagcacgtgaggagacgggagcttagaaattttgtatggccaggtgcggtggctcatgcctgtaatccaagtactttgagaggccgagtcaggcagatcactcaagtccaggagttcgagaccagcctgggcaacatgacgagacccctgtctctactaaaaatgcaaaaaattagccagacttggtgatgtgcacctgtagtcccagctacctgggtggctaaggtgggaggatcacttgagtccaggaggcagaggttgcagtgagccgagattgcaccactgcactccagcctgggcgaccgagggagaggttctgtctcaaaaacaaacaaacaaacaaaacaaaacaaacaaaaaaaaaacgtagaaaacatgagtgagtgacaccatccgcttccagtggaggggtggggtcactcccacttgggagccagtctgcacggaagcctcagtgggaacagaacaaggtggcatggcccctgaccggcgaggggcagttagtatctgcacctttgaggcacctggggactctgctgctgtggagatgggattgggttccagtccagaggctgtcctgccatcgctgcccctggctgtcatgccccacctggggtagtgagtttcggggcagctctttcttgagcctcagcagcggggtgagccgggtgcacttcctctctcagggcgcccccttgtcttcttgcctccctgcctgagggtgcgtgctggagcagaagagcacgtcctgggctgcctgccggggataagctgcggagccaggagaccgaagtctcttcaggccctgccattaggggtcgtgtgacttcagggaggcagcttgtcctctccgtgcctcagtttcccctccagtcaatcaggcgctgaggtgctgtctacctcctggggttctgagactgaagcgaagcaggcatgaggccccttgtgaagctggatgaggggcgtccgtcctccgctgcaggagggctgcccctcctcgggcccctgcgtcaggttggtgcctggctctgaccccacacccaccagtacagctcttggtcagggttagatttcctggctgtttccaagagccaagatcacaggcacacgcatgcacacgcgtgggctgccaccacccgccttctcatgggtgctgacaaacggtcatgtgtatcccccaggtggggccctgtggctctggccttgctcccggtgtgtgcactggcctggcctccccgcagcctggtgggggcttcctggcttctcggcccacatctcacagtcttgggcactgtggggctcggctcaggcgtcgtagacgggaagcagcctggaaccctggaagtctgactcccaggtgtcggctcccaggtctcagccctgccactggggtcatgggttacttgaatctttatatactttttatttgttatttatttatttatttatttatttttgagagagagtctcactctgttgcccaggctggagtgcagtggtgcagtcttggctcactgcaacctctgcctcctggttcaagtgattctcctgcctcagcctcccgagaagctgggattacaggcgcatgccaccacacccggctaatttttgtatttttagtggagatgtggtttcactatgttggccaggctggtctccaacttctgacctcaggtgatccgcttgccttggcctcccaaagtgctgggattacaggcgtgagccactgcgcccggccttgaatctttttttttttttttttttttttttttttttgagacaaggtctcacttgtcacccaggctggagtgcagtggtagaatgtttgctcacctctgtctcttgggttcaagcgtttctcctgcctcagcctcctgagtagctgggattacaagcgcccactgccacacccagctaatttttttttttgtaaattttttttttttgagacaagagtcttgctctgtcgcctaggctggagtgcagtggcacgatctcagctcaccacaagctccgcctcctgattcacgccattctcctgcctcagctttcaggcgcctgccaccatgcccggctaattttttgtagttttagtggagacgcggtttcaccgtgttagccaggatggtctcgatctcctgacctcgtgatccgcccaccttggcctcccaaagtgccgggattacaggtgtgagccaccatgcctggccatttttgtaaattttttggtagagacggggtttcaccatgttggctaggctggtcttgaactcctgacctcaaatgatccacctgcctcggcctcaaagtgctgggattacaggcgtgagccaccgcgcccggctttgaatcttgagcatcggatgagcccccagctcctgctgtcagggctgcgccctcttgtggcgcttggagcctccttttcttccgttttcctttcccaccggggaaaaggaagctggggcacggacttcgttcctcctggttggcctctccagatcttggccagcgggtccagtcgggagggtggttttctcctctggaagctggctcagtgggagcagtgggcggactctggcccctcctagtggtggcgtgctgagtgtacctgaggatgtacctcctgcaggctccctagcgtctggggtccactgtggggcggcctgtggcaggcccaccaggaaccatgcttgcacaggcaaagcaccttgcttgtggttgtgtggggggctccctcaggtgtgggagatgtgggccccattctcccaggagccatggctggtgacatgcagtcaggtccatcctgacgggcactggagtgcgggggacccaatggggacatgagggatccagcactgtggaccagggccaggttcatttggttcgctcaggaaacatgtacacagcgccttctgcataggggctagggatgcaggtgggcagggcagccacagcccctgcgctcaggaagctggcgaggcaggctgcagacgggcactgccacacctcactgaggagggaatggcagagccaccctcaaagggcctgtgctgtgggggtgctgggcgcttcctgaacgccgggctcttggatttctgcagtgggggttctccgggcgtttgggaaggggaaggacctgatggaaggggtagtttatatttaactctggtgctgaagcaagggtcgcacacagctgccagtgcccacgacggcctcctgggaggctgagctcaccagctccagacccagtctgaggcaggaacctgggggtctcacagcgggaccggtggtgggtgtggcctcgtggcagggagggagggtgggaggggtgcatgtgaagttgggtttgactcgtcacccgtggagtgcgtgctcccctgccacaggcaggggccaggcagcatctgtcctgcaggaccctcccagctgccctttcatggccggacccctggctggatccctggcttcctgcagtgttctcttttcctaacattttgtcaccgtctcagtcagctcgggctgctgtgacaatactgcaggcacagtggcttgtaaactacccgagtttgtctcatggttctggaggctggacgtccaagatcaaggttctgtggatttggggggttggggggaagggggggttgtgcttcctggtacatagacagcggcgctgtggatttggtgtagggggtggttgtgtttcctggttcatagacagcggtgccttcttgctgtgtcctcatgcggacgggatccctcctggaaccatcagtgccctcatgaaagagccccccaagagctccgtggcggaagaagctgatcccgcctcccaacaccactgtcttaggggtgagaattttaacataggaatttggggggatcacagacattcattgctatgggtgggaccacttggtgcgttgcccttggggtggcggtgtggtcagtggtccattcctgcccagcgccgagcagcggtctgtgcgtggggtctttgcacccgtgcacctgctgaagggtctctggagctttggctttttggcttttacgagtaaagctgccgtggtgcttggtgtgcggtgaggagtggacagaaggctctgtcctggcaggtgccctgcagtggcctgagaccgggagatgagggccggcaaggggctgtggacgagtccagagtgaggcggcatctcggaggggctcacacattgtctcaggaggagtgggctggcatttctttccagtgggcagctgttgaagattttggagccaaaagagcgttccagctcagatgtctttcaggtggagtgtggctgcaggtggggcaggctgggtcagggtggagccatgtgggctgaggcccgagttggggctgtggctttggggccacatggctgccggtcgggtgggagcgagtctctgctgaccagggccctggatgttgagccccagccgcggggtgtgaggtctcaggcaggacccaggcattcagacattgggtccactgtgtgtggacccctgcgtcccagctccaagacgctgtgtgacgggaggcggcagcagctgagttggcgcggggagacagggcgatttgaaaagcaggctgggaccaaagcatcttgaaaacccaaatgtagtcacgttgcctggcttgagtgctgtccagagcctcgcccttggcctctgtacggcagggcttaacagtggccagcacctcagggccaccagaggcccggggccacctgggcctggcttggcttccggtggcccagaactcctgctgggctcctgcctccctctgcaacctctcctggctttggtgggttatgtgggagacacgagtggcttcacccagcgggagtggtgcacatgggttaacatgccagccacccagctgtgtacgggctgcatgtgtgtgtacatgtacatgcatgtgtgcgtgcaccatgcacgtgtgtgctgatgtacatgcatgcatacatgtatgtgtgggtgtgcacgtgtgcattgtgtgcatatatgcacgttaatgcatatgtatgtgtgcatgcctgggtgcataggtgtgagccacctccctcccccatcagtgtatccatattgcctctgcagagctccatgggggtccttggcgagccagggctgtggttgtcatttttgccttccttacaaaacgcaaaacaggccgggcgcggtggctcacgcctgtaatcccagcgctttgggaagctgaggcaggtagatcacctgaggtgaggaatttgacaccagcctaaccaacatggagaaacaccatctctactaaaaatacaaaattagccaggcgtggtggcgcatgcctgtagtcctagctacttgggaggctgaggcaggagaaacacttgggcccgggaggcggagcttgcagtgagccaagattgcgccactgcactccagcctgggcaacagagcaagactccatctgaaaaaacaaaacacaaccccaaacagtagtaccgagccagttctcatctgggcagtgacctgtggcgtttcagactccttctcggccgtcttggtcttcccggcatcctcgctgagagctgaggcttgcttttctgtttcatagttgagatgtttatggcctgagggaccttgtgtcttgggtgcaaagttaccaaggggcggcgccttctgacccgagtgcagggccctcctcgcctcctgcctgcagcatggggcctgtgctggggtgcaggcttgcagtgtgtgctggtctcgtgtcaggtgtggctttcagtgtgtgtgagtgtttgctgtttccaggtgaaacacccttccaaacaaacacggagcagccatcttttgtaatagcattttgttagacatagagtctcatctgggggcagtcttgacccatgggacactggcactgtctggggacatctgtggtggtcacaattcgggggggtgctcctgagatggagtgggtgggggccagggttgctgctgagcacccctcagggcccagggttcagcaccggtcagtagagctgaggccgaggatccctggcctcagattgcatcccctccatgccaccgcccttctcttcagggcgcggtgagggaagggcgtgtgggggtccctctggggagaaggtgttttcaccttcacactcaccctcactcctcctgtcctggaacttgggtgggtttgaccttttgtggatgaggtgagggctgagaggcggattactacctgagacaatcaaaatcaattttctttcttctgaaaaggactcagggtgtttgagaaaagtactggggagaggcagctgccaccggggctccccactcgggatgtgttgggtgttttgcgagaccccccacagggagctcaggtgctgtgggcagttcctgggctttgtcgagggcctcccgaaggcagcactgtggccaccgtgggacacatgcagcctgtctcatctctaggagctgccaggtgaggggtcctgcgacaggcacctgtgcaaagatatctaccatgggcagcaaggaaggttccagaaagtaccggagggagagttgtgttggggcttgggggctttctagagcagaggctgtgagaggaagtgagctgggtcccagcaccaggcagcctttaggcagctgtgattggaacagcactgtgggcagagggcaacagcgtaggacgtgtgtggaagtggggaggtgccggaagattcagagacacagggtggtgaaggcgagcctggagaagtgggctgggggcatgctgggagggggcggtgacgcttgagtctctagggcaccgggggcctgagcaaggttaatacctgagtagagagttgaggcagtctctttttagaaattagaagttaactattgctgtgtaatggggtcaccccaaaacttcgcaacttaaattaacaaaacttatttcagatagtttctgagggttgggaatgtgggagcactttgttgagtgatcctggcttggggtctctcagaagttgtagtcaggataccagccaagcaggggccacatcatttgaaggctggactggagctggaggagccactcacaagttggctccctctagtggctgttggtgggaggcctcagttcctcaccacgtgggcctctccgtgaagctgcttgagggtcctcacagcgtggcggctgcctaccccagagcccctgacccgagactgagggcaaggaggaaggcctgtgccttttgtgaactggccttggagatggcacactgtcacttccatcacattctgtttgctagaagcaggtcactaagtgtagcccatgctcaaggggaggggaattaggttccagtatggaagggatgagcatcagagatttgtggacacactggaaaacccagcattggcatcccagcgtgtgagggtgaagaaaagtggggagacggagtctctgcccaggaggtgaccaggtgagaggcagaggcaggagaggggctggagtgaggacccccatgtcacccagaatgtgtggggggctcatctggaggctggggtggagcgacagctggccacatgggcccccttcccgatagtttttccaggctgacttgctaatccttttcatcctctggggccctgggaccatcagtgtgcccatctctgagatggggtggtagcgtactcgtctctggaagcattgtgggtattagcaaggtcgtggcaggcgtggagacgtaaaggggttcagggatgtgctcagggccacctgtggcaggcacaacggtcctggctgaccccgccacagcaccaagagggagaggggagagcctcgtgggtgcttggtgcgcagggggcagtgtggccgtggccgctgagcaaagctctggggaagggggcgcccagcccttggggtggtctgtgcagagatgccgttggggtgagtccgtctgtcagggcaccgccgccacgtctgtgtgctgtccctctggcgagcattggtcatgaactggcgtgaccgtggtggagctgcacagtcccagctgcggggccggtgccgtgcgacttgatttggcctgagaccgtgtggtctttgacgtaaataccaacaattggcccccaggaaagtgtgtccttgcagaacttctggaaaaggggtggttccagtaagaccctggcttggtggaagatgggaagggcgctttgtaaactctttccgaggagtcaggaggccgtggcgtctggtggagagacggtcagcctcacgtgccttggtttcctgtgctgggtgctgcagcacggcagggtctgggtaagagggggcagcagcacgagagtcaggccccggctgccgcccgccctcacgtgccccgtcccccaggcacgggcgagagcgggaagagcacgttcatcaagcagatgcgcatcatccacggcgccggctactcggaggaggacaagcgcggcttcaccaagctcgtctaccagaacatcttcaccgccatgcaggccatgatccgggccatggagacgctcaagatcctctacaagtacgagcagaacaaggtgagcccgcgggcgcctggggaggggagcgcctgggcagctgtgggcttggtggtgagcatggtggccgcgctgccagggtggggccatgccgggggtcccggccggcccaggctacccctggtcatccatccgttcctgtcatggacatggaaacagcaaccgctgacttcctgggggccaactggagagttgtgatgggcattgcgtggccaagccccacagcctccctcccaagtagctgtgggcgcccacatcctgtgggtggggaagctgaggccctggggaagctgaggccctgtgaggtgagccactcgcccaggtcgccttgggagtaagcagcgtgagctcctggttccggccccttccccaggctgagcagcctaccaggcacctcgtttcggccctgacactcacccatggggctgtacttctcaccttctcacactgtttttttgttttgttttgttttgttttgttttgaaaacagggtctcgctctgtcgcccaggctggagtgcagtggaatggtcaaggctcatcacagcctggaccttctgggctcaggtgatcccaccacagcctcccgggtagctgggactgcaggtgcatcaccacgcctagctaatttttgtattttttgtagagatggaatttcaccatgttgcccaggctggtcttgaactcctgggctcaagcagtcctcccgctttggcctcccaaagtgctgggattacaggtatgagccaccatgcctggcctccgccctggttttttttcttttttttttgataaagtagaggtcatttgatgccctgtttttaaatcacagctttattgagttataattcacattctatgcacttcacttgcttaaagtgtataatttggtggttttcgatatgtttgcatagtcgtgcagccatcaccgctgtcggattccagatttcattttctcaaaggaagccccttccccatcggccgtcactcccaccccctcctccagccccggcacccacacatccccttcctgcctctgtggatcggtctgtcctgaacatttcatagaaatgggattgcacgccatgtggccttttgtgtccggcgtctctcactgagtgtgacgtcctcaaggtgcatccacacagtggcctgtgtcagagcctcgtccctgttcatggctgagtcatgttccagtgcatggagggaccgcgtatttgcccatttatcccctggaggacatttgagtgccttcatgtgtgggctgttgggaacggagctgccgtgaccgtctgtggacgtgtgtttatgtggatgatgtgttcccttccctcagttgcatgctacgcctgggagcagaattgctgggtcccagggtgactctggctttgccctctgagaagcgtccagagagtttgccccagtggccgccctatggggcaggcccagcagccgtgcagccgtggctcctgccagtggcctccctggggcctttcagctgaggggccattgatcccgctttcgtagccctgctttcaggggtagggctcttgcccttagatcttggtttgccacttgccctgtctcccgctgtgatctcttccagctgtggccctctctgagagtccatattcatatttgggcttagatctccatcagcttctgaaacacgcatctgcaaactgcagactgattttgtcgataaagttttattggcacatacccatttctgccatgttgcccatggtgcttcagcagcagcagcagagccgagtgctggagacagtccgtgtggtcgggaaggctgggtgtgctctctggctctctgcagaagcagattgctgctgtctaatctggaagtttccagggagtgggatttttggggtttgtgtctctttttccaagtccccctaggtgtgcttatcccagcccagattgagaggctgggggcagggcaaggggagggctgaagtcggagtccggggcagggagcgttgctcagaggggacaagcaagggctgagtctccactctggggggcctgggagggccccgtggctcccagagcccagggcaaggctcccttctttcccatctgggtcccacccagtatgtcccctccccagtccctcagccaaactgtggctggtcatgtcggcctgtgcgccccggggacggggacacagagcatcaggaggggaaaggatggcccccccacagtgtctgccccaaagggtgttcacatgtgtgtgcaagcacgtgtctgtgcggttggccttcctttgtgacagggcagcaagctggggcctgatgccacccgccgcccagggttccgtgagggggaggcggctcgtgttggggcaccatgtaaactgttgagtgcggcagctcgggggccacacgccgtccttagcaccgggtgtggtatctgctcttgatgatgtttgataagcatttttcggacgaaagagagaagccggcggggcagaaaccgagtctggagctgcacactgcaggcgatgccgctggttgcaacgtcctgtgactgggcttcctgcctcccggtgtgtctggagaattcgaggcagcgagtgctggggctgttggttagttctgtcgtcgtgcttggtcgtgctcggcgctgcactgccctcctgtgggtcctgggtttgaagtgtgtgtgttctacacgtgcttgttccccacaccgtcccctccccacctctaagaagtgaatcgaagcccggcctccccggcaccctgcagaccgcaccgccgggaggctttgcttgtggggccttgttcggaggaaccacaccgccaggcggcctcgcgtttttctgacacgtgttcacacggaactgtcagtggtcctgactgcacagcctgcggaatgccgcccgggccagccgaggcctggaagaggggccgtcacaagctttctggtggatgtgtggccccagcgagctctcgacgtctcccctgcccgccctcgcaggccaatgcgctcctgatccgggaggtggacgtggagaaggtgaccaccttcgagcatcagtacgtcagtgccatcaagaccctgtgggaggacccgggcatccaggaatgctacgaccgcaggcgcgagtaccagctctccgactctgccaagtagtaagtgcggccgcaccgctggcggcctggggacggcagctgcgggccggtgcctgggacccttcgggaaggcctccgcggcgtctgtggtgccccctgcctgctcgccgggggcagggatgcggtgggcccgggccacctggccggatggagggaccagagcagatccctggaggggccacgccttggcaggagccggtggactctggtgtgacactggcctgcttgtatgcctggccctgccgctgccctccctgggtcaggagtgagctcctggccaccctcggtgctggagcccggcctgtggcctgtgggggaaacccagggtctcctaggagggccgtgggatgggaggtagacacaacctgggccgtctcgctcctgcctgggacatcgtccccagaggcacgtctcccactattgactggctgtgaccttgactgatgtcagggttctcccagtctctgggcctgggatagggggtgacttgtgtgctgacaggtggccgggccatggccgcaggtggaggcccccgcgtggcaggctgtgcactgctgccctccatgcttggcaggcagaggccccggccctcccccagcaccgggagagaccctaaggcgacagggacaggcctgtcccccgcccctcctgcccgtcctctgtgtgttccctgcctctgggaggttgtgggagggcccagataaccaagcacttggaacaaaacgccagggcctcctcgcggtgccggaaaggtctgagcaggcacccggcctcttacaacccccaccccaggcagaccactcgaggggcgccccactcaggactgcccagggcgtcaaaaacgggaaactgtcccaacccagagggctgggcaggaaaaggcatgaggggaaccaaggaagccggaatcaagcgtggacttcagtagctgcgctgtgtagacactggctcattgctcgtggtgggtgccgcacccacgtacagggagcagcagggagacgggcacggggatctgctgggacctctgcagcctctgcagctgcgactctcctaatgatgcgcctgtttgtgaagcctcatccctggggccagccaggcctctctcgggaagtcccctgccctgggtcaccgtctccctccttggtggccgtctctggacagctctactacaaaccccccgaaccagctggagtcctcgtcctgggactttctcttgtgctgggtcatttctgtcccctgagaccccagagaggatagaggttgggaggctcgtatcccgaccccagggtctccattggcccgagccctccgggctgcttcagacactgccgtaggtggcgcagtgcgcggtccaccccctcctggtggctttccgtcctcccgctggtttgggtgctgtgtccctgtcctgcccccccacccccggcagccggcctgagcacccaccgctgtgttgcagctacctgaccgacgttgaccgcatcgccaccttgggctacctgcccacccagcaggacgtgctgcgggtccgcgtgcccaccaccggcatcatcgagtaccctttcgacctggagaacatcatcttccggtaccgcccgggccacagcaggcggggagggggcactgagaggctcatttgcccggtgtgccggctcatgcctgcgcacccagtgctttgggaggccaaggcgggaggatcgcctgagtccaggagtttgagaccaccctgggcaacatagccagacctcatatctaaaaaaaattttaaaaattagctgggcgtggttgtgtgcacctgtggtcccagctactcaggaggctgaggcaggaggatcgctcaagcccaggaggttgaggctgaagtgagccatgatggcaccactggactccagcctgggcgacagagggagaccctgtttcgtcttattaaacaaaagaaagcccattggtcttcatcctcagtgtgtgtttgaccaggtcaggggataagatttatctctaagtatgtgtgagccagggccacacagggaaggagctgtgggggtgtggggggcgtggccacatccatccagaccggcagccgaagagacctggcagggaggacatttgacagggcctccaggacgggccgggggcctggttggagccagcatggggctggggtctggagtgctggccggagcagggggtgccgcatggtgcgggaggggtcatagggactgaggctgccaggggagggggctcatggggaccgaggctgtgaggggaggaggggtcatagggaccgaggctgtgaggggaggggggaggtcacggggaccgaggctgtgagtggaggaggggtcatagggactgagtggggaggaggggtcatagggactgaggctgtgaggggaggaggggtcataggggccgaggctgtcagggaagaggggtcatggggaccgaggctgtgaggggaggaggggtcgtggggaccgaggctttgaggggaggaggggtcatagggactgagtggggaggagggctccaggctggggtggaggagctgggtggtgtggggtggattctgttcttcacgggctgcccctgcggatcctgctgggcctccggggctccaggtccactgtggctgggggccggccagcagagccgggttctccctggggaccctcagtgggtcctgtgtctggtaggctgctcagctggctggactctgctgtccctgggaacgtggaccctgcctgcctgtctcctggccccatataacatctccagcgctgaggtcccggctttatgcgtgcctgtcctgggctgctggtgtcgggcgtgagactcccaccgcaggccttattcccgcccagtgctggaggccagaaggctgagatgcaggtgtgggccgggccaggtccttctgaggctgaggggatctgcccaggcctcactcggctcctagtggcggccgcatccttggcatccttggcatccttggcatccttggcttgtggccgggttgcctcatccctgcccccatcctcatgcagcgtcctccccgcctgcgcctttgcctctgttctcttataacctgtccttggccagggccaccctacctctgtgtgacgttatcctaaccagtgacatccgcacagaccctgtttccagatcagagccgtccccgggttctggtgttcgtgcgtgtggggcgctagacggctctgtcctggagggcctcgcggtggctctggttgcgggtgccttctcctgcagtgcaagctcgccctggcactggccctcatgagggaatgacgcctccctgccagggtgtccccacccagctggtgcactgccgaggccattgtgagggttccgggaagtctgtggggttttcctcgagagccctgccttgagacccaccccagggctgggggtgccaccccctgccatctgcctgttctccccacccgtcctcccagctcggcctcccagcgcaggcagggaggatgcggcgtgaagatggaggcagggatggagcaacgtggccacaagccaaggaatgccaagctctgggatggttcccggggacccgagcaggcgctgggccctcagaagctgcggtgtcctctctggacatgggcgatggtgtatattgttacgagaattcaagtttttcttcttttttattcacacggggcccatgaccccaggatacagctgaggcgagccaggcataggccaggttgtggcatgaatgtcccctcacagccccacgctggcctcttaacagcgcaggcctctgtgtcctctgtcagaaatgtcctgtcccctccctgagctgagctcaggctgggtgtgtcaccccctctccaccatcttccaggcccttcccagctccagctgtgcccttttcttttttttgagacggagtcttgctctgtcgcccaggctggagtgcagctgtgcaatctgggctcactgcaagctccgcctcccgggttcacgccattctcctgcctcagcctcccgagtagctgggactatagacgcccgccaccacgcctggctaattttttgtactttttagtagagatgtggtttcaccatgttagccaggatggtctcgacctcctgacctcgtgatccgcctgcctcggcctcccaaagtgctgggattacaggcgtgagccaccgcgcccggcccggctgtgccctctgtgccgggtgcagacccccgtcctgagcctactcctctgccaccattgtttctctgccagccgcctctgtccaccacacgctggcagagggccggccaggtgctgtgggatgcagctggaggccttgaaggccggtgggatcgtcccagtgcgtgaggagaggctcctgctccctcaggtggggacaagacacggggggacccggatcccagccctgccggccgccgcaggcgtgcaggagaggcctcgcgctccagacgggctgtggcctggtgtcggcacacccactgtcctcccgcctggccacagctgctggtgcgggccctcttgtcccttagagtcacctggcacatctgtcatccaccggtgcctgctggactcccccgcagaccagaccaggtggatttcaccactcacatgcccaaagcagccccgctctcctcggcagagttgcagggaccccggccttccctggggcctggggccagggcctgaggggcactctccgcttctgcctttgtattctttcaaggagaccaaagtgccttttctcgttatagaaaacttagaaaagtcacaagtagaaagaggcaaacgtcccgtaaggaacgcacgcccgcagacatcgtctgagctgattttctttctcccgcctgtgcgtggcctgagagtgtgaggttgagctgctcaccacgcggggcagggcgctgcgcctgctcttctgccccaggaggataccggcaactctgccctctgcagccgtcactggagggtccctgcagggagcaactgtggcatcagtgtttactcctgcgagtgacgcttggtgaacatctgtgtccctggcccagtgaggggaaaggcttctgtgctcagggtgacatccagatgccagatgtagggtccctgggcacccatcgcaggttcccgcagcagctggcgcccagaatcctctgggttctcacacccccacactagcgcccgcttccctgggcccagtggtctcaggcccctttgccagtgagggaagggtctgcggtggtcacccctggaggcggtgcggccgctctctgagagcgtccttgcccgttctaagagtgggggctcttcctgctccagccgatgtcagtctggtgtggcaggaggggcttgggtgggagccgtcctgggattgcagattgggccttggggcgccaggtggctgagtcctggcgctgtgtcctttcaggatggtggatgtggggggccagcggtcggagcggaggaagtggatccactgctttgagaacgtgacatccatcatgtttctcgtcgccctcagcgaatacgaccaagtcctggtggagtcggacaacgaggtgggccctgccctgagcaggggcagcgttgggggccgggccttccccacctgccaagcctgggtcccctcacctgggtccccccagctgccccttgggctgtgtgcagtggggagggcccctctgattccctctgccttcgctcccgccagaaccggatggaggagagcaaagccctgttccggaccatcatcacctacccctggttccagaactcctccgtcatcctcttcctcaacaagaaggacctgctggaggacaagatcctgtactcgcacctggtggactacttccccgagttcgatggtgcgccgggctgcggcatggggaggggctcgcgggcagggccttactggggggagggggctgatatgggagaggggctcatacaggccgggagctctaagggagggcgtctgatgggaggtgtcatgtatgggagtggagtctcagggaagggagatctcgtatgaggggggcctgtacgggaatgagttctccgacgcgggtgtctcatacccgtgggagatctgttaatgcagggactccttatacaggaggggtctcgggtgggaggggtctcgggcagggggatctcgggtgggaggagtcttgtacaaggagggcaccatgggagggggagtcttgtattggtgggtcttgtacgggagggagttgtcgtatgggggtgtcctgtataggtgatcccatatgggaggggtctcacaggaagggttcacgcacactgccagcgcagccccgtggggaccttggtggtagtccctgcatcctcctctgtgccctactgcccccaccctcggacccgtccctccctacgtggcccctgccccacggggtgtgtcagggcagctgagcactgagggtcttcacatgcccagccctctctgggcctggggatggcggccaggggagggtgttgtgtgccctcgtctgtgtggtcagtggctgccgttagtgctgtcaccactcagagctgtccctgccaggcacagtgaggccctgggcagctctggcgccctcatttccaccccggatctgtgctcctcccgtgagtctcgggtgtcatcttcgggagggcccctcagggtgccctgcctctggatgtgcagcgagagggaggggtctggcacacggtatagcctcggccgctggctgcaggcgcagggccctgctgtccctgggcaggggagtggcggggggcgctgcacctgctccagccgcacgtggcccctgcccagcagcctgtcctgtgggctcagagagccctggtggggggaggccaagggactggggcatagacccctgtcccaccagtccccagagcagccccttgaacacccccaggggcctttccaccggggcaggcaggagttactgggcgggtcgcctgcattgtccagggtggtggaggggcaggggtggccggtgggaagcagcgcccctgctggagcccctggatgtctctgaggcctggctgcagcaggggcaccgtgggtgggtgggggccactgttcctgctctgtaggctctgtgcccagccctgggggcctctcctctcaccctgggccttcgcagggcagccatgccagaggcctgccctggaaggctgtggctgtggagctgagtggatagaggccggcagagggctgagcagagggagcagcggtgggtgcagagccccaggttggaggcctgggccgtgacagtagtgccctggggctacagtgggattggcaccgcagctcacctggggagggaggggagctgcggcccgtcaggcatgcagtgggctgggggtcgagctgggtgggccgtgggccttactcgctcatcccctgggagtgacaaaggggcccacgagtcccttgccctgggccgggctggggcacagcctcaccctctgccctcccccaggtccccagcgggacgcccaggcggcgcgggagttcatcctgaagatgttcgtggacctgaaccccgacagcgacaagatcatctactcacacttcacgtgtgccaccgacacggagaacatccgcttcgtgttcgcggccgtgaaggacaccatcctgcagctcaacctcaaggagtacaacctggtctgagcgcccaggcccagggagacgggatggagacacggggcaggaccttccttccacggagcctgcggctgccgggcgggtggcgctgccgagtccgggccggggcctctgcccgcgggaggagatttttttttttcatatttttaacaaatggtttttatttcacagttatcaggggatgtacatctctccctccgtacacttcgcgcaccttctcaccttttgtcaacggcaaaggcagcctttttctggccttgacttatggctcgcttttttctaaaaaaaaaaaaaaaagaaagaaagaaaaaaagcaacgaaacataaaacacacaagcgccccgtgcccccagtgactctgggcctcacagagcccccgccagccagcatggggccccgccctgcagccagtcacgcgcccccacaccgcagccccccgtggctgtccttccaaccccacgtgctttttctttctcctgcccgcttcttttcttcatcacaaaaggcgtggagactcggagacggacgtttttccccttttttaagttattgacgcccagcgcgcctcgcctcttcacccatcaacgctgtgctttgcccactggactcctgaagagggggtggggggctccctcggtcgcccaccctgggaagtgcctaaccttttattttattttatttttttgaggaaaaagaacgcctgactcacaggttgaagaaacaccctgggccctctgtcatggccgggttccccgtccctctgcagaggctgggaagggtccccgggctggagccacgggggcttctctgggctgtgcctccggggccaacactggctgcttggggctgcccggggactccagagggctgcacggccaccctgccctggctagagcgcaccccaccggagcccacgtgggctgggcggctggagggatggtcccccggtgacactgggagaaaggccacttggatgggggcgtttctgttttgttccgctttgtgatgtcaccaatttggaaacagcgagggtgggtggggacttttacagaatattctcaggtgtgtacccgagaggcagagagagggacgtggccggcagctctgtgcgtggccttgtcccaagcacttgcgcccgcccccgagcgccgcccccggggagcgggaagccagcactcgcactttggccaggggcgcgtggaaggtggtggcaggcaccggcctgggcagcttccaggcctggctggccacgaccacggcccgagggggagcccgccaggccacgccgcactgagccacagccccggaggccgcctacccggggccccttgaggcactgaggcaccgagactggttctccccgagagactcggaaggtggggaacgaggggactgtgtttggggaggtggctttttcgtctgctgttgactgaacactacagcgccctgtggttccgggcttcgcacagctgtcccagggatggatcgcctgtgctgccttcgcccgccgccacaccgggaccctgcacggctgcttctggcctcgacagatgacaaaagaaacagccccaaaatacgaccactccaaccagcagttcccgcctgcctgcccgccactgtcaggcctgccctggcctcctcgtccgcagggctgtctgctggcttctgggggcagaagagcggggagccccgtggaagggtcaggggagaccaggtcagggcagctacatttctggtgatcagccccatggggagacggggctggcgggataccccccccccggcttccccacaccacttctgtctcacccggaagcgtcctttttttgtgccaggtgtctacctaagagggttggtgccagaagccccccatggcgagtgctggggcccggcggtgccctgggggagcagatggggccacccctggcagggccgctacaaccttttccagcagcggagccctctggggggcctgtgcttgtggcatctctgagggcccagattgcacaaggtgacctggccgtggcctgagggtggagtcgcccagcacgcaggccggggcgctgcggggctaagtattaggccttcccagggagggggcgtgccaagcatcccagagccgggctgggaccgccaaaacgtcgtggcctggatcctctgggtctgagtgcctgatcccctgccccccaaaaaagcagaggtaggtgttgcaggcccagggcaggggtgcctgccccaggagagtcccaggcagtggttctcgtgccagtggcacccaggg

SEQ ID NO: 13725 - DNA, 100468 bp, Human
  misc_feature (1)...(100468): n = A,T,C or G
cccaagatgcatcctgttactatagccattttacagatgaggaaaccgaggttccaagaggggcagtctctgctctctaaacttcaccttccaaaggattctaagctgctgaatgaaggctgcaggcagggtggtctgtacaggggagggagggtggaaggcacggggtctggaagtctaggaggagtgtctgaagtcaactgcaacttttaaatatctgtgaattttagatttcaccctgtatgtgtccctagcgtgttttaataaaataaattgcttcacgttatattggtatgtggatttccagatacacttctcaccatttaattcaaatgctccccacagctgcacagtgggtttaaaatacacagacacacacatttatggaccgttcgtgatgtactaagcactgtttgaataatgtcaccgtcatgcagaggggagcctgtggggggcctagggaacctacgctgcaggaattctgctccctcctagtttacctgtcagaccctgggcaagtggcttccgttctctgggcctcagtttcctctcctgtaatgcctgaggataatgggtgctggtatcttctgcgcccctgggcctggggcacctgccccagcttggtgagagggtatcatttgtccttgggaagctcagagagatgaggtgaaatggccaagctttctaagaatgtgtctttagtgaacatttgacccaaggtcaaggctctgctaaggtcattgtccttatccccagcaatcccacaggatgggcatctttaagccactttataggggagaacccttgggatgggaatgagagacacagcagcctctgagctagcctgggaggatccagggagtgaaccgggggagggttggggccctgtcatcagatgccctgggggctcagacggaggcaggccaggtctctgccctgttacgtctagaaggagaacagaatgtgggctccaggtccagatggcctggctccaagccacacttgccatacctcagtcttgagatctgtgaaaagggcacacccctgaggcaggtggaaattattggatacccagggggaggctgcaagggtttatctggccagctggagatcccgcctggacaccgtcctcctggggtgctggagagacacacaggcgaggccacccctcccctgccccttgggtgctgggtgaagagagcaaattctggagcctcccgtgttagcctgggcccttctggccaaggaagggacagctgcacacaagcccctctagctggggacccgcagcccctgcctggctctggggggagaagggagccagggtgctgtgggaccagctcaccgtgcacccagggtcgtacatctttaaggggaaagaggcgcgctggccggcctctgcgcacgtcacttcttcattccttccctcccccctggctctttcctccaacttcccggccagctcgggggtgatgggggggtggggagggggggccttaaaaatccacccctggcccctcaatgtccagaaacaaccctgtcccccctctccgcttgatccgaattggggtcgccctgcagtcctggggtcctggtctagtgccctggggcattgcgtaaatacgggaggagcgggggggtcctgagacgtcgggggaggctctcctttctcgctcgcgcccttttttccctcgtttctttgaaagttgggtgttgagaagtgggaggttcggggtgggagggggagggtgtcagagggtagagagagagacagagagacagagacgggggagagaggaagagagagacggagggagagagggacagagagcgaggcgggcggcgcgagagagggagagcaggagggaggaggagggagaccgagggaggaggcggcgaggagagcgcgccggccgcggggcgggggggggggttggggggggcgggggggtggtttggaaaaatgactcagtaagttcagcgcgcccgctccggccggccctgcgcctcccgccgcgcccgggatgtattcgtccccgctctgcctcacccaggtacggtcctcgcccggccccccgccggcgcccccgcgccccccgcatcccagccccggagttttgaagcaggaggaggcgggacgaaaaaggcgcgcgtccctcccgccatccctgcccgtgatgccccccgcgccgagggctggggtccggtggggggatgggtcaggctggggtaccccccccacacccttacctaccgcggaccccctacgcgggactcccgcccagcacccccaaccccgactctcgggacctctcccggatgtggggcttggtctgcagatttgcgtcccccccccacacaccgacgcactccgcacccccgccccgacactcggaaaggtcggggtgggggctggcccccctccagcaagggctctgcgggaagccccccgcctgcctctgagaggaatctagggggtcgtgattggaccctgggtctccccagctggagagaaagggacctctcatgtgttttccccgtgtccccccaccaaggttgtgcgggccgccctggccctcggtcgcctttccctcgttattggcccacgtgtgcatggagggggagggggcaggagaagttggaggcccaggagggggaagggtgctccggcggcccggctgggtcccccctcctttgcaagccccccagcaccgtcccggtattttcgctgcatcgattctggattctggattctggattctggagccgccgccgggaggagcgggaggcccggcgctccgggtctggcccgggcactgcggcgctgcggacgccctcgccagcccggcacctgccccgtcccctccccctccccctccccctcccgtagcctctcacccctggccgcactcccagactgccccggggccgagccttgtgcaatggccgagggggtgtgtggggagggggcggctccccccggggactccttccagcccaggctcccggggaccccgaggtctgcaagttccgttttctagaccgctgctttcctccttacgcagtgtgtctttaggctggagaggttctggcctcagtttcccctgaagtgaggtgcggctaaggccggttctagagaggggacagtatggcgggcaaactgtaaagtcccggcacgtggggggtgcgattccagcgagggccaggcccgtcttaagaagcactgtgtggggagtatatgagtccccggcttccgctccagggcatggtgcagtgagggaccccccacgccaggcatgctccttggtagggtctttctcaccggccccctgcagccgacagggaatgtgggagctggtgctgagggggtctgaggtctgtcctacctgtgatcccctgagtgaccttgggtaagtccctgtcccagcctcagtttccctttctgagcagctttggggggggggttcccgaagaaggcatctctttgaagttctccaagaacaactagggttcgagtgggcacgctgtgtgacctcgggcagcctttgaagtctctgggcttgtggggtgactgaggtgtccccgctctgtcctcaccagctggaaggagccatttgggagggctgagcggaggggaggctgttccaggctggggaggttggaaggctgcctgtgcaccctggaattcccccatcagggctggttgggagacatcctggttgctggggtgggttgggggttagtaagaaccccagtccaggctttgcctcagagaattgctaactcggcctcagtttctccaggaacagggcaaggaccagccaggagggctgtctgtggaaaccaaaaaacggagaggctaaaaactaaaaactatccaggggtgctgcgtgcaagagacacagatgagaagacagagacaggcagagagacagaggcagagagctcccaggccagagtggggacagcgagtcccaagtgcagggggctccctcctcccctgcgattctcctctctgccccgccctccaccccagccctgtagtggagctggggaccccctttccagtttgtcttcagcctgaatgtaatccccactgttcccccaaggcccagcctggtctggggtagccagtggggtgggctgggggactcagaaggaccctgagtgccccatgcaggagcctcccacccaagtcctggctgcctgactcagtttcccgaatcacgtcccctccgtttctctcatcttggtctctttttgtctgtctttctctctttctctctgtcttgctctgactctgtgtgtgtgtgtgtgtgtgtgtgtgtgtgtctgtttctccctgtctctccatctctgtctctccccgcctctgtttcactcccagtcactgttggtctctttgtgtctctctttctcatcctctgtctctctgatgtctcagtctctcccactgtctctgtctcttcatgtctatctcaccatccctttctcctctttgtctctgcatgtctctttgatgtgtctctgtctctctgtctctccctccctttgccttctttgtgtgtctgtccgatgtgtctctgtctgtttctctgtctctgtctctctgcccccttcctctctgtctctgtttctctccaatatgtctgtctgtctcttcatctctgtctcaccttccctttctcctctgtctctgcgtgtctccccttgccccctctctccctgtctctctctatctctgcatgtgtctccttactcctctctctctgtctctctctgtctctgggcctccctctcccccttttcccagctaattttacaacctgagcccaaccgaaaatagctcccttttagctgatccgacccggatccttctcgggagccgaggctggcggggggtggggggcatctcggtgccagcccgctctgtgccacccgggcccggcccgccgaggggggagtgggtgctggcggccctggggcattctgggagccccgggccgggctcagcggtgactcaagcgctttttcacttttactcttaagaggaactgtgtggagcccatggctcccataaatcctgccggcgggaaggccggcctccccgcgcctgctctgggcctccctccctgcctccctcccgctggcgccaccgccacgttagttattccgggtttggggccaagtccctcttggccgcagcgtggcggattccccgagccacctccatcccgccaccgggtccctgtctcattcgttcattgtttccttcattccttcgtcccatgccctctcggagcacaatgtgctttgctgccatttctccagcagggtaaccgaggctgggagaggctgtcctcccaccccagacccccgacctttgttggattttctagatcttccttaagcatctcctgggccctggggataggtgggggtgggggaggcagcagggcccaggcccagtgtaggttcttagagggagcttggggggtgcctaccaggagcagggggcctgcagcccctcagtgccgggagaggggctaagagtcagagagggccagggcctgcccgaggtggcacagtggggctggcagagctggggttcaggccattttccatctggcggcttgggcaggtgggcgctctctccccgtgtgccccccacccggggcctggtggcctctgattcactctctacaaggctccaccactctcccgctgtatctccctctgggtctctctgtgcatctctctctgtttctccccctcccctctctgcggcggaggtgcctctgcgcgccagggccaagcgccctgtaaatcaccaaagctgggattctggcagagtcagcgttctcctctctctctctctctctctctgtctccctccctttctccccccatctcgctctctcctcctctctccctctctccttctctgtctccctttccgtctttccctcttcctttctctctctctccccgtctcccttctctccctctctccttctctcttctctctctctttctccctccctacctccctctctgttcctcttctttctctctgtctgtctctctctttctttctccctcccttcctctctctctgttcctcctcttctttctctctctctgtctctctgagctggcctccctccctgtctcacaccaaatggatgggaaatgctgcctgggcctcctgccccggacacggcccgccccccactctcctgcctgtgtccacgccgacctcacctgggtgcccatctgccctgagcacacagcgtgcgggcacccaagtcctgaccagttcacatccatgagcacacgctgggcgcacacgcgtgcacactccctgacacccatacggacgaggacacagctctgcctgcctcggatctgccttgatgggggtcaccaacacacagacctagagtgcccctcacatctgcctgaaaatcttgctcaggaggtgccaaacccaatatagtacctggtatagagaaggtgccaaataactgctatagagtggtgccaaataagtgttgctgtgcttgtgattgttgctaaactaattctcctctttcctgactctggtgggtgacctgcccccacccccggaccgtttcttgccctgaaatgaagtcagcagaaacccccacttcctcagggctgctgcagattcagggaggcagcacaacttttttttttttttttttttgaggtagagtctcgctctgtcgcccaggctggagtgcagcggtgcgatcttggctcactgcagcctccggggaggcaggacatttctgaggtccacagtgcagggcttggtactcagtaggtgcccaataaatacctgttgcatgaatgaatgaatgaatgaatgaatgaatgtttttggttgagaggcgggactttggtcttcccgagcctccatttctccgccaacataaaataaaaaacataatggcactttcctcagagacatcgatgtaccttagtccgacacctggtatacagtaggtgccaaataagtgctgctgtgcttatggttgttgctaaactagtaattgcattgaacaccccagaggcattttccagtttccctcccttccctctgtgtgtatttgcgcagcgtaagcccagctttgggctgggtgacaaggacagtggtgacctggaaaggcccaggctcagacccctctctactgtggcatttctgttagtttttcttttctttcttttttctttctctctccttccttccttccttccttccttccttccttccttccttccttccttccttccttccctccctccctccctccttccttctttccttctctttctctctctctccctctctctccctctctctctctctctctctctctctctctctctctctctctctcggagtcttgcactgtcgcccaggctggagtgcagtggcgtgatctcagctcactgcaacctccgcctcctgggttcacgcgattctcctacctcagcctcccaagtagctggaattacaggcacgtgccaccacgcctggctaacttttgtatttttagtagagacggggtttcaccatgttggccaggctggtctcaaactcctgacctcaggtgatccacctgcctcggcctcccaaagtgctgggattacaggcatgagccaccgtgcccggcctctgttagtcttttctccctgcccagccctgtccagggtctccctgagtttgaccagccctgtgtgggtaccagccttccttacacatgggggtgcatggataaggggggtcccagaggcagaagatgggagcattgcttcagtggtctggatgctggagatgctaacagatcaaagctgtgcccttgtgggaccaacagtctaggccgggtcggggacgggcaggaaacgaggtgaccaggactccttgaggatgtggtgtgcgaccgacctcggggatcaaacaaggggaagggaaccacgtgggactcggagagtgtgcacggtgcagaccaggtgtcactggacgctctggcccgagactgtttgctcaaggggcccaggagtggggggggggggtgccaggaggcccagggaccagtcccagctcagttcctccctgactgtgtgactttggtggaagatttcatgcctcagtctcctcctcgaggtagtgggtgcaatgatagtccccactttcatagtagactttttttttttttgaaacagagtctcgctctgtcgcccagactagagtgcagtagcacaatctgggctcactgcaacctccgcctcccgggttcaagcgattttcccgcctcagcttcccaagtagatgggattgcaggtgtgtgtcaccgcacctggctaattttggtgtttttagtagagatggggtttcaccatgttggccaggctggtcttgaactcctgacctcaggtgatccgcccgcctcggcctcccaaagtgctgggattacaggtgtgagccacctcgcccggcccctatttcgtagtagacgtgatagctcagcaaacgctcagcctgtaagaggcacagcctcgctccctgcctctctcctccacctcctggcccctctggctcagccctcattgtcctcccagaacatcaaggcacagagggaagtaggggacccagggttcattttgctgactcactgccttggcagagagtttgaaccctgtggactcagtttacccaaattcctcactgtggcccacaaggccctgcccagcctgtccttgtcccctcctcaaccctcccctcctctctctttcccccttgctcattctgctccagccacatgggcctcctcgctgttcctctaacacgccaggtgcggtcctgccccagggcctttgcatgacccgtttctccatcagaaagctcctggcctggagtgccatctctcaagactttgttcaggtgtctcctcctgcaagagaccttcctggaccccccccccaagctaaaaaacaccccccaccccagagattctctggtccctcaaactcttaaatttcttcagagcactttgcccaacttgacgttttattacatattttgctgattttaaccatccgtccctgccccagatctggatccaggtgagggccgagcccaggtccctgccaagtccttggcaccctacctgggacccgcatgcagcaggcactcactaaatgtttgctgagcaacagaatgaatcttccctctctgggagccgttcacatgtccacaggctgtgattttctgagccaggggaaggagcggcccaaggttagagcctgacgctggtgccggatgggcctggggttgtccgtgggaccatggacaagtcatccgacccggagaagaaggcattagaactaaggctttgaaggatgcgtaggaatttgggataagtgctaagtaggtaatgagctagattctcatgaaggattgttgagtcacttttacttggaaacttttggtttggaaattggagtttcttgtcctggtttgctggcctggactttcagggtgggaggagcacagggaggtgagtgagggcatcacccagtgcatggcgtggtcgttcagcaaggtcttgggtccagatgtctctcccagctgctgctgctctctttggccaggaagtcccagtgggctaagctggggtttccaggaaagacctagccttgttccccttctccccatcaccttgcaaggaacaaggtcaccaggcaagctcccctgtctccagcaggctgcaatattcctttctgcccattgtacagaatgagagactgaggcttatctgaggtgatctgttccccagccattcagatggtgaaaatagaccttactgtcacccagccaccttctccgacagtgggtgcctcaactctgggcctcaggattggagagggagaggtgatagaactggatggtcctggctagatctgggaaaccctgggttgaggaggaaaggctgcttgaaggaggggacactagagatagggcgttgagggatgtgtaggagtttgggaggattttcagcatctagcttgtcttggttatctcttttgccggttgggcctctgagggcagtaggaggtccctggggaagaggccctggttattgcaggtcatgtgggagaaacagagtgacaaccggccaaccaggccctgcctctcacctggtctgatcccctggggaggacaagggaggatggggcagcaggtccatgacccagttacaagctgtttgtcttcctgcctctgtaactagccggggtcaccactgacgtgggcccccacccctgcccgcctccctggcacctgtccccggaaagggcacagagaaggggaggaacatagagaagggagggacagttagggaggaggaagggaactcagatctacgaggggccagatgagaaaaggaattaagaggagaggggaagtggggagggggaattcagagagagaggggggttggggagagaaggagttggggggacagtgatccctgcccccatcatggatgcctcccctgtcccttccagcagcctcttatcacagccccagtaagcgccagagcttgggtggcagccacggccccagctggacaacattgtccgggcctcctgcccgcctggcatctcctccacaggcaggtcctgcgcctctatgggtcctctctgccgcgtcccactgtgccccccaccacccccactgcccggcttccctggccagaccatctgggctctggtcccagctctgctgaccggctgtgtgaccctggacaaaccactccccatctctgggtctcatccagtcaggggcagggacgagattggacagggcctgggccgggccccctccacctcccctttgccttagcaggttggctggggaagcgggggcagcggaaaagggccctgaggtccggtccccgccgcagctgttacggtgactcacgctttgggggacattggggtgggggagcttcgctggtacaagctgactctggtctcactgggtggggaggctattttcagagcctcagtaataggtgaaatctgatgtcctgcccctccccccgaagcaccccacggccggaggtggcccaaggggacgtggagcacagagcagggagggtgatctggcagcagctgctctgcccatcccggcctggaaatgggaccgagtccagccacatccgctggcacacacagtgggagtccagggtcaacgtctccctaccttcctgagaccccaatcttacagagaacaggctgttctgagaaagggacccgtggccttccagggggtcagggccctgattcttatcctcacaccggccctgagaccctgtgggacctcagccaggtctccgcccctctctgagccttagtttccatgccacagaacacggagcggggcctcaggctgttccctgcttcctggaagattgtctgcaatcaaaatgatcatcgcagcaatcgcgtccatagtaatgaaaataccccagcatcttagaggggccgaggcgggaggatcgcttgagcccaggaattcgagaccagcctgggcaacatagcaagacccccatctctactaaaagtacaaaaattagctgggcatggtggcgcacctggaatcccagctactcgggaggctgagacatgagaatcgcctgaacccaggaggcggaggttgcagtgagctgagatcatgccaccgccctccagcctgggcaacagtgtgagacactgtctcaaaaaaaaaaaaaaaaaaaaaaaaaaaaaaaggaaagaaaatagaaaatatcccagtgccttaggaggccgaggtgggaggatcacttgagcccaggagtttgagaccggccaaggcaacacagtgagtgagactccatctctgcaaaaataaaaattagccagacatggtggtttgcacctgtagtcccagctactcaggaagctgacgtgggagaatcgcttgagtctgggagttcagggcccaagtgacctaagatcgtgccactgcactccagtgagacgcctgtcttttttatttatttatttatttattttgagacggagtctcgctcttgttgcccaggctggagtgcaatggcgcgaccttggctcactgcaacctctgcctcccgggttcaagtgattctcctgccttagcctcccgagtagctgggattacaggcgcctgtcaccatacctggctaattttttgtgtttttagtagagatggggtttcgccatgttggccaggctgatctcaaactcctgacctcagatgatccacccacctcggcctcccaaagtgctgggattacaggcgtgagccaccacaccaggctgagacccccatctcttaaaaaaaaaagtaataaaaatcacagtagccccagcactttgggaggccgaggcaggcggatcacgaggtcaggacattgagaccatcctggctaacacagtgaacccccgtctctactaaaaaaaaaaatacaaaaaattagttgggcatggtggcgggtgcctgtagtcccagctattcaggaggctgaggcaggagaatggcgtgaacccgggaggtagagtttgcagtgagctgagatcgcatcactgcactctagcctgggtgacagagcgagactctgtctcaaaaaaaaaaaaaaaaaaaaaaaatccaatagcaatataagttgtaatgataacaatcatcgcatcattaataacaatgtagtcctttgagagctggggggaggaaaacagctttctgtgctaggaagggatcacccctgtccgaaatgcccagcccagcctggtcaaggcagggagatggaaaggcagttttgcttctctttctcttcttgttccttgtatttattccaccttgaggctgagaaactaggtcccagatgtttttaatttgttttattttattttttatttttttagagacagggtcttactctatcccccaggctggagtgcagtggcacaatcacagctcactgcagcctcgacctctgaggctcaagtgatcctcccacctcagcctcctaagtagctaggactacaggtgtgcgccacagcaactatgcccaactaattatttttgtaatttttagtagagacggggtttcgacatgttggtcaggctgctctcaaacacttgggctcaagtgatctctccacctcggcctcccaagtagctgggactacagacgcgcaccacaaaaattatgcccagctaatttttgtaattttcgtaaagatagggttttgcctgccggccacagtggctcacacctgtaatcccagcactttgggaggcagaggcaggtggaccacctgaggtcaggagttcaagaccagcctggccaacatggtgaaaccccatctctactaaaaatacaaaaattagctgggcatgatagtgtgtggctgtaatagtgtgtgcctgtaatcccagctactcgggaggctgaggcaggagaatctcttgaacctgggaggcggaggttgcagtgagccgagattgtgccactgcactccagcctgggtgacaagagtgaaactctgtctcaaaaaaaaaaaaaaaaaaaaggagatggggtttcgccatgttgcccaggctgggattgaactgggctcaagtgatccacccacctcagcctcccaaagttctgggattacaggcgttagccatagtccccagctgagatcccaaatgctatgcagactcagtttcccttgctggaaaatgggaagaatgggaggggcctccccacacccagacagggagctgggggcctcccactgccccacatttctcttcaaggggctgctgttattttcgtggggaagtcagatgagtgcaggttccagtccacctctgtcccccatggccgggttccccctcaaggcctcagtttcctcatctgtagcatgggtgttgtgactgccctcagacaccaatttgtcatgatttgggagtaggttgaagtcccagctctggcccagtctcagcgccttcccagccctcggattttccatctccagggtgggtctgcagggaacggggtggcccctctccccagttctgaacctttgtggctgagcgtctgcttctctggtctgtttctgtatcagcacagtgggttcatggaaaggggaaaggagggagaggactccacccgggatttctcctccctctgattaatcctggtgcacttgaatctcttatcttttgatgcagaaatccccccacccttccagcagccctcaacctccaggcgggcctagtgtctgcctgtggatctcagccaggcctgtctgtacatatgctctgtaggaacaagctttcgtagtcgttttttgtttttttgttttttgttttcccaagatggagtctcgccctgtcacccaggctggagtacagtggagtgatcttggctcactgcaacctccacctcccaggttcaagcaattctcctgcctcagcctcccaagtagctgggattacagtcatgcgccaccacgcctggctaatttttgtatttttagtagagacagagtttcaccatgttagccaggctggtcttgaactcctgacttcttgatctgcccgcctcggtctcccaaagtgctaggattacaggcatgaaccaccgcgcccagccgggttttttttttttgagacggagtctcactctgtcgcccaggctggaatgtagtggcgagctctcggctcactgcaacctctgcctcctgggttctcctgcctcagcctcctgagtagccgggactacaggcgtgtgccaccatgcccagctaatttttgtatttttagtaaagatggggtttcactatgttggccaggctggtgtcaagctcttgacctcaagcgatccacctgcctcagcctcccaaagtgctgggattacaggcgtgagccactgcgcccagcctcatttttcatttttttttatttctttctttttttttttttttttttttttgagtcaggagtcaggggtctcactacgttgtcacccgggctggagatcaatggcgcaaccttggctcactgcagccttgacctcctgggctcaattgatcttcccacctcagcctcccaagtagttgggactgcaggtatgcatcacctagctaagttttgattttgtagaaacggggcctcgctatgtcatccaggctggtcttgaactcctgggctcaagcagtccacccactgtggcctcccaaagtgctgggattacaggtgtgagccaccatgcttggccgccgaccctagtttttttttgttttgttttgttttttgagatggagtcttgctctgtcgcccaggctggagtgcagtggcgcaatctcggctcactgcaagctccgcctcccgggttcatgccaatctcctgcctcagcctcctgagtagctgggactacaggcgcccgacaccacgcccggctaatttttttgtttttttttcagtagagacggggtttcactgtgttagccaggatggtctcaatctcctgacctcgtgatctgcccgccttggcctcccaaagtgctgggattacaagcgtgagccaccgtgcccagccttgttctttttttttttttttttttttttttgagacagtgtttcactcttggcacccaggctcccaggctggagtgcagtggcacaatctgagctcactgcaacctctgcctcccaggttcaagcgattctcctgtctcagcctcctgagtagctgggattacaggtgtgctccaatatgcctggctacatttttttgtatttttagtagggacggggttttgccatgttggccgggctggtctcaagctcctaacctcaggtgatccacctgcttcggtctcccaaagtgctgggattacaggtgtgagccactgcgcccaggctttttttttttttttttttttttgtgacagtcttgctctgtcgcccaggctggagtgcagtggcaccatcacagctcactgcagcattaaactcctgggctcaaatgatcctcccaccccagcctcccaactagctgggactacagttgcaaaccaccatacctggctaatttttgtttttttgattttgtttgttcatttgttttgtagcgatggggttttaccatatggctcagactggtctcaaacttctgggctcaagcagtcctccctcctcggcctcccgaagcgctgggattacaagtgtgagccattacacccagcccaaccctagctgcaataggcagagaataggtccctgacatctttgttctcccaacctcagttttacccgtctgtacaatgggttgtccatgagcctccacctggcccccttagcttgctccatctgcatgctggggttcaacataggtcctccacggctgggcatggtggctcacacctgtcatcccagcacttggggaggccgagagccgaggcgggcggatcagaggtcaggagatcgagaccatcctggccaacatggtgaaaccccatctttcctaaaaatacaaaaattagctgggcgtggtggtgggcatctgtaatcctagctactcgggaggctgaggcaggagaatcgcttgaacccgggaggtggaggttgcagtgggccgagattgcgccactgcactccagccttagcgttaagagcaagactccgtctcaaaaaaaaaaaaaaaaaaaatgatcctccacaaacttccgccttgatttgtgcctctcacatagtccaagtctgtttgctcatctgggcgatgggttcttgcaggtccctgataaacttctcctgggtcccccgggccttttgcgtgcctccggcggcgtgcacgggtccgcagcgaccccctgcccacctctgcccagcccctcccactctgcgggtctgttcagggcccctccgacctcagccttcggggccgggcagtgggtccgccctctgcgtccctggcgctcctgacctctcgcctctccggcctgcaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgctgggcgagaagcccgaggtcaagcagaagtgggcgtcgcggctgctggccaagctgcgcaaggacatccggcccgagtgccgcgaggacttcgtgctgagcatcaccggcaagaaggcgccgggctgcgtgctctccaaccccgaccagaagggcaagatgcggcgcatcgactgtctccggcaggcggacaaggtgtggcggctggacctggtcatggtcatcctgttcaagggcatcccgctggagagcaccgacggcgagcgcctggtcaaggctgcgcagtgcggtcacccggtcctgtgcgtgcagccgcaccacattggcgtggccgtcaaggagctggacctctacctggcctacttcgtgcgtgagcgaggtgaggtgtggtggcctgagcggagcggccagcggggagggtgtctgatggtggtgacacggggccaggagggcctgagggaggaggccagtgcgtgtgggtatgatgtggtggtctgagaggggaagtgggccttggagagtgcccaatggggcgacacggggcacggagcatctgagggaggaggctggtgggtatagatgtgatgtggtggtctgagaggggaggcgagtctaggagaatatgtaaagtaggtgatatggcacaaggagagtctgagagaggaggccagtgcatatagatgtgatgtggtggtccaggcagggcagcaggcctgggagagcatctgatgggggtgacatggtgcaaggagggtctgagggaggaggctggtgcgtgtagatgtgatgtggtggtccaagcggggaggcgggcctgggagagcgtctgacgccgggtgacacggggcaaggagggtctgagggaagaagccagcatgtgtagatgtgatgtggtggtctgaggggggaggcaggcctaggagagcgtctaatgcaagtgatatggtgcaaggagcgtctgagggaggaggccagtgcatgcagggcccagggtggctgctgatgggatgtggaggtcagatggaggaggcaggcctagcagaggtctcaagtgagagatggtacaaggaggtttttttgacagaggaggcaggtgggctgtggcgctccaatggtagaggcaggatctcaccctcacgtctgagggaggaggcaggaaggcccttgaggtctcagggggatgagaatgtcctagatggtcttgggcacaacggacggccttgctgggagcaggggtgaggagaggagagggacaggccatcccagccctccgagggagagagccaagagagtcctggcaccgctttctgtgaatgcttgttggttgattgactctcagaccatgccagcagaggcctgatgagcctggccctgccagaggggtgtttgccggtggtcaaatgcctgatgttgagaccagctagctctgtggggttgaggaaatccaaggcggcttcccagaggaggaggtgcagctgagctcagctctgcaggatggccaggccacagtgaacaaggagatgccccagggggcctggcaggagcgtggagatgagaggcctgatgcctgtgcctctggtcccggtgctaagagcagggttggtcctgcagcttcttggctgcgtggccctcttggacttcagtttctcttgcctgccaaatggtggagatgatcagtctgtagctggatggggctatgggaggttccagaagatcatgcgtgtagccacgtgcgaggtgtcagctgcatcccaagacctgagtgggtgcacagcacacccctgccatgcccatccaggccgtgtctggagcacgcgtgaacccccacacacccaggggctgccagagcatgtgggatgggtgtacgccagacgcagacccacacaggtcaccagcccagccccagcccaggcagcactctatagaaacaggcagttgcacagcctgagagggaggggcatttgcccgaacaggaggaccctggggccagactgcccatgctccagacacagcccttcttttccccagctgtatggacacatcccttttctgtgcctcagtttcctccttggtgcaatgggagtaacagccatgccaccttctagagctggtgcaagggtgagacagggtcacgggctcccaggctctagggtgtgtggaaagacagcagggcagagttacccagtgtttttttttttttttttttcctggagacagggtctcgctctgtcacccacgctggagtgcagtggtgcaatctcggctcactgtagcctcgacctcccaggctcaagcaatcctcctgcctcaccctcccaagtagctgggactataggcgcacaccaccacacccagctaatattttatatatatatatatttttttgtagagacagggtcttgctatgttgcccaggttggcctcaaactcctgggctcaagccatcctcccaccttggcctcccaaagtgttagaagtacagcaggcaagagccactgcaccacaccagttacccagtcttttttttttttctttctttttttggagatggagtttcgccctgttccccgggctggagtccagtgacgcaatctcggctcactgcaatctccacctcccaggttcaagcgattctcctgcctttgcctccccagtagctgggcttacaggtgactgccaccacgcctggctaatttttgtatttttagtagagacggggtttcaccatgttggccaggctggtcttgaactcctgaactcaaacgatccactggcctcagcctccccaagtgcggggattacaggcgtgagccaccgcgcccggcagttacccagtcttgatcttgattctttgaccttgaccttagcatctttctcctcccccacccccactgatgagcaacaaacctgctggggttggctgtgagggggcactggggacggtgggggcagagaggtgggccgggtgactgcctgttgggagcaggggccaccgtggggacggaggttctcatcgtcacacagggccagacctctctgccaccacacatcttcctcgcccggggccccgcccccacctcctccgtgctgagctgatacaattttgaagcgagcttttctgctgcagtcagcacaacctctgggcgcctccccacccccaccctgcccctcccgcctctgctcagcaggcaggcctgtgccccaggtcaggttggcctctctgagtgaaggctgcaccctcccttgcccccagcctgcccccttcatccccaagggaatccctgcttcaattggccccagcaggccacaccctcccccaattggccccagcagggcacacccccccccaaccctcccacctgcccactgcgggtgctccagctcctcatgggggtaagagctgggcctggactccaaccccagctcagctgcccactggctgggtgatgtggggccagtcactcaccctctctgtgcttcatttccttgtctataaactggggggctcaaaactggttgccttgtgggaaatgtcaagtgcccagggtgagagctcagtaaaccacccacaaggcatcgtgaagaccaggcactaggcagggggctagggcccttggtggttatcgttactaacattatcctcttcgggattggtttgtttgtttgttattattggtttgggttttttgggggtttttttggttgttgttgtttttttttttttttttgagacagactcttgctctgtctcccaggctggagtgcaatgacgcaatcttggctcactgcaacctctgcctcccgggttcaagcaattctcctgcctcagtctcccgagtagctgggactacacatgcccaccaccacacccggctaatttttgtatttttaatacggacggggttttgcatgttggccaggctggtctccagctcctaacttcaggtgatccacccgcctcggcctcccaaagtgctgggattacaggcgtgagccactgcaactggccttgttttttgttttttgcagagatggggtatcactatgttgcccaggctactctcgaactcctgggctcaagtgatcctcccgccttggcctcccaaagtgccaggattacaggcgtgaccccctgcgcccggcccatcctcctcattctgattataatctcccactgccagacctttccttatgcattccctggacatagaatgtctttcccatatggaaaaccccaactccggctgggtgtggtggctcatgcctgtaatcccagcactttgggaggccaaggcaggtgactctcctgagctcaggcattcgagaccagcctgggcaaaatggcaaaaccccatctctaccaaatatacaaaaaattagccacctgcctggctgaaaattctttcccattctcacagctgccctgtgaggcaaggatcattgctgtatgccttttttttttttttttttttttttttgagatagggtctcactctgtcacccaggctggagtgcagtggcgcgatcttggcttactgcaacctctacttcctgggttcaagcgattctcatgcctcagcctcccgagtagctgagattacaggcgagcgccaccacacctggccaatttttgtatttttagtagagacgggctttcaccatgttggccagggtggtctggaactcatggcctcaagtgatccgccctcctcggcctcccaaagtgctgggatgacaggcgtgagccaccgcgcccggcctgttgtacgcattttacagaggaggaaacagaggctcagaggagggatttgacctgccgtggtcacacagccgagactgggccaggtgggatttggacccacaagcagcttctgcctctgccctgtccttgacacctgcctcatcctccattattgtcagaaggggatgggcggaagttgtggtgcgtgagggggcagtctgctggcacggtgtggtcaccttctggcagggttgtgtgagggccccacaggctgaggtcttatgtagggtccccaggctgtggctggcctccaggcctcagcgctgatcccagtggttgtcaccctgacagcaggaagactggccaccggcttccttttccgaaccgagagtccccttggctgtggagcgtcctggcccagccagagtgcagtgtctggctttcatcagccctgctgggcagctgaggccctgggatagagggagagggagggacgggcatcaggcatagggccttggctggcctcttggaggggtgcagggtggatggcggtggaggggcacctgccatggggctgaaaggagccaccacttgcaacgtcacaagtgagagaggaggccgggcacagtggctcatacctgcaatcccagcacttcgggaggccgaggcaggcggatcacctgaggtcaggagtttgaggccagcctggccaacatggtgaaaccccatctctactaaaaatacaaaaattagccgggcgtggtggcgggcgtctgtagtaccagctactcgggaggctgaggcaggagaatcgctggaacccgggaggttgcagtgagccaagatcgcgacactgcactccagcctgagcgacagagtgagactctgtctcaaaaaataaaaattaaaattaataagaagagggtgtcagggaactgcaggaaaataaagcagggagggacatggaggggggctgggggccactctggatggggagggcttctctgaggaggcgtctttgaggtgaggcttgaagggggtgagggagtctggagaggctgggtggagggagcagtgagggggttatagccagtgcgaaggcctggagcccaggagcagcacatggagctggctgggatgttcagggggtagtgagtggcgagggccgtcctgtggccttccagtgagggtgaccagccgggggtggggcgggagagggtgacccgggtgctctccgacctgccacgtgctggggaaggagcctgcaggaaccagggcccagagagggaagctgtctgcccgcccagggcctaaacccagccaggcctccccgccccctctggcagcccaagaaatctgaggcgcgggcgggcaccgtgccagggctgggcgggggaggggctgccaggcccgcccgtcccagcagctgccagcccgccccgagccgccagcccagatggtgcccatctgctgacgccgccatgggccagcctcctgttcccgccttgcgtcgtgccaagctcctgcagtccagcgccgggaatggcgcggtgggcagagcccggcccgggaagctcatagcacgccagagaggctgccccgggtgccctggagagggtggcaggagaaacatgggagggggagttccccagcgcttcctggatggaattggggagcaaggaccccaacagcgataatgatggcggcaaacacacatggcgtgccctctgtgtgccaggctccgaggccaccgctcaccctaactggtttaattctctcccccatccaagcaggaagggactttggccttctctcgtgttctagtggaggaagcagagacccagaggtttggacaagagtcacttgtccaaggtcacaaagctcctcaggggcagagccggaatgagaatccagaacccctttgaaaaagggattgaggccaggcgaggtggctcctgcctgtaatcccaacactttgggaggctgaggcaggaggatcacttgaggccaggagttcgagaccagcctgggcaacatagcacgaccatgcccccccccaacaaaatttttaaaaatgagccaggtgtggtggtgtgtacctgtagtcccagctactcgggaggctgaggcaggaggatggcttgagcccaggagttggaggttgcagtgagctgtgatcccaccactgcactccagcctgggtgacaaggcaagaccttatctctaaaaaccgtttttttttaaggggtgattgaggccaggtgtggtggctcacacatgtaatcccagctacacaggaggctgaggcaggagagtcgcttgaacctaggaggcggaggttgcagcgagctgagctcatgccactgcactccagcctgggcgacagagtgagaccctgtctccaataaaagggaggtggtattgaaaccccttaaacctcttttcaaaaacaaactaaaagtgccctttgaggttatctagtggaagccacaccctctgagtcatacagatcatacagtgcaggccgtgcacactcagggagtaaatgaatgaatgaatgaatgaatgaggtgaaccctatggaaggggaccaagcctggggccagggtgtccataaagctcaccctgagcttgatggcaggagaaagggtctcaacctgggagtgagggacctgggtcagccacagtgctgccctggcttgctgtgtggctttgagaaaagtcctgccctctctggtctggggttgaggggagtggagggtgggaaggggcggccttgtgggccacagacaggagcaaggcgggtcttcactgaaagcctcccgtcctcttctgcctttattgatcttcatcccggttgtgggtgctgcactggggagacaggccatgagctcgggtgacggtgcctgtttatttgtatggtggacagaatttgtgttcctgtgtgctccaggcagtgtggggcgcattcttctctttgagccttagtttttgcctctgtagaatggggagaatcagagctgtgcccattgcattaaagattggagtcagtggtctctgagaagcatacaggaggcactcaataaatgctcacttccggccgggcgcagtggctcacacctgtaatcccagcactctgggaggcccaggcgggtggatcacctgaggtcgggagttcgagaccagcctgaccaacatggagaaaccccatctctactaaaaataccaaaaattagccaggcgtggtggtgcatgcctgtaatcccagctagtcaggaggctaaggcaggagaattgcttgagcccgggagaaggaggttgcggtgaaccgagattgcgccattgcgctccagcctgggcaacaagagtgaaactctgtcccaaaaacaaaacaaacaaacaaaaagaatgctcatttcctccctggattctctccccaaccccaggagggaaggagggaggtcccagtgccgccgtgaaaccctacacctccttttcccaacccagtgagccagtgggggcaccgtgacccaggagtggctgtcaccagaagctggaccaagtcaccctttccaggtgtctggacagcagaggggtgaggggttcctggcagcagcagcctgttatcccccagggctgggcagccaggtgtgccagccgtctgtctgtgcagagaaggtggctgccgggcgtgagtcgcagacgccagctgatggtgtatttatagcaacggcaggagtccgcggggcatacgtcagtggtaaagagggacgggcaggtgggggtccagctcccacagcagacaagagcccaccaggactggccagggagctgaacagagtgtcagggagaatgaggggcatgttgtgcagccgggaggcccaggatcacacccctctgctctggaactgcgtgatgtttgacaagtgacattgcagctgtgggcctcagtttcctcccccatcaaatggggatgataataatcctgcccacctaatagggctgcataggatccaattagtgcatgaaaagcatgaggacagggcctggtatacagtaagcactcaaaagtgatttgttgcctaaaaaagggagggaatcccaacatgggccacaatgtggatgcatcttgaggatgtcacactcagtaaaataagccagacacagaaggacaaatcctgtgtgattccactcctaggaggtccatagagtcgccagattcacagagacagaaagtaggatggggggtgccaggggctggggagggggctggggagagaatgtttcatggggacggggtttcagtttgggaagatgagaaggttctggagaggatggtggtaatggttgtacaaccctatgaatacgcttaatgctgggttaatgccactgaacttagaaatggttaaaagagaggcaggaggattgcttaaggccaggagttcgagaccagcctgggcaacacagcgagacctcatctgtacaaaaaatttaaaaattatctgggtgtggttgcacgcacttgtgttcccatctactcaggaggctgaggcaggaggatcgcttgagcccaggagtttgaggctgcaatgagctatgatcacaccactgcactccagcctgggcgacagagcaagacttgtctcaaaaccagaaccacccccaccaaaaaatggtaaatttatgttatctagattttaccacaatctaaaaatgtagttctggttgtgaataatgataataacaagtaataatattatatctatggccggctgtggtggcttacgcctgtaatctcagcactttgggaggctgaggcgggaagatgacttgaggtcaagaattcgagaccagcccagccaacatggtaaaaccctgtctctaataaaaatacaaaaattagccagtcgtaggccaggcgcggtggctcacacctgtaatcccagcactttgggaggccgaggcaggcagaccacttgaggtcaagagtttgagaccagcctggccaatatggcaaaaccccgtctctactaaaaatacaaaaattagccaggcatggtggcgcgtgcctgtaatcccagctacttgggaggctgaggcaggagaatcacttgaacccgggaggcggaggttgcggtgagctgagattgcaccactgccctccagcctgggcaacagagtgagactccgtttcaaaaaaaaatgttatatatgtaacaatgtaataattagtaatatgtcatatataatcatggaacaataaataagaaaaatagtgtctgcggtgacagcacagtagttattattgtcgttatcatgatcgtcatcactgtggttctcgtccagctctgccctgcagacagctgtgtaaccctgggtgagtttcttgccagctctgtgctttactgcctcatctgtgaattgagcatagggggtgcctagcaatttaaatgagataatagctcttttttttttttttttttttttgagatggagtcttgctctgtctcccaggcaggagtgcagtggtgtgatcgtggctcactgcaacctccacctcccgggttcaagtgattctcctgcctcaacctcccgaatagctgggattacaagctcatgtcaccacacccggctaattgtggtatttttagtagagcgggggtttcactatgttggccaggctggtctcgaacttctgacctcaggtgatctacctgccttggcctcccaaagtgctgggactacaggcgtgagccaccgcacccggcctaaatgagataatatctatgaaaaaactaaccctttgcatgtgatgagtgctgggaactggtaggctctttgaggagtaggtcctcccaccaccccgcagacgcccctacccagcagaatgctggtttctgcatgaatgcatttgtgtggggactcccgagacagcccctgagggagccctcattcacccgggtggggcccggccctcccagagccagtgggagggggaggcgccttgttgcacctgtgatgccccccgttatggctgggctgcagttgtcaccctggccctgtgcctgggaagccaaggggaggctgagggcagctagggacagctctgtgcccacggccccctccagccagctgccaggccagccccctccctccagctgggcgagggcaggaagtcacagatggtcagggttggtgaggggtgaagcagagggcatttggggacaccggatgtctcgtccagatggggaaactgaggcccggagaggggcgaggcattgccccgagttgcccaggaagggccttggctcttgtcccttctaagtcccatctttatttttattttttattttttggagacggagttttgccctgtcgcccaggctggagtacagtggcgcgatctcggctcgctgcaacctccgcctcctgagttcaagcaattctcccgcctcagcctcccgagtagctgggattacaggtgcccgccaccacacccagctaatttttgtatttttagtagagatggagttttaccatgttggccaggctgacctcgtgatccacccacctcggcctcccgaattgctgggattacaggtgtgagccaccgcgcccagactaagtcccatctttaggtccgcttggctgttccacggccacctggaggggaggtagggccagcaaggagggaccctagggtctcagggcagaagatctgccggaggagagggagaagggggttctgaggggaggaagacgcgagaatctcaacgctgaagtggtttctagattctccagggcatgagtcctgaaatccccaaggcctgagttctagaatttcttccactggggccctgaccacacaggtgattctagaattctcctaggtgagttccagacccaggggtccaggagaaatagaatgttggctgggcgtggtggctcacacctgtaatcccagcactttgggagaccgaggagggcagatcacttgaggtcaggatttcaagaccagcctgaccaacatgatgaaacccggtctctactaaaaatacaaaaatgagccgggcgtggtggcgcgaacctgtaatcccagctactctcaggaggctgagacaggagaatcgcttaaacccaggaggcagaggctacagtgagctgggatcgtgccactgcactccagcctgggcaacagagtgagactctgtctcaaaaaaaaaaaaaaaaaaaaagagttccaaccacacatataatttaacatttttctggtcctcacacttaagaatgtaaatttaagtatactggggaaattaattttaacattattttaagtaatgttaattttttttttccttgagacagagtctctctctgtcgcccaggctggagtgcagcggtgcaatctcggctcactgcaacctccacctcctgggttcaagcagttctcctgcctcagcctcccgagtagctgcctcagcttcccgagtagtaacattaaaatgtttaattttaacattactttatttaacccagggcatctggaatgatactattgcaatccataaacaacaggaaaaattattggtctattggtcgggtgcagtggctcacgcctggaatcccagccctttgggaggctgaggtgggaggatcacttgaggtcaggagtttgagaccagcctggccaacatactaagaccttgtctctacaaaaaaattaaaaaattagccaggcgtggtggcgtgaacctgcggtcccagctactcaggaggctgaggtgggaagatcgcttgagcccaggaatgtggggctccagcgagctgtgattgtgtcactgcattccagcctgggtgacagagcaagacttcaactcaaaaaaaaagttatcgaggtattttatgatcttttccccaccccccccccccccccgcttacactaagtctgaaatttggacagaccacatttcaagcactggatgtcacacgtggccaggggctgctgtattgggcaggccgtgctaagacatctgagttccagagcaggggttcccgacccccgggccacagacgggttccgtgcctgggaggaacctggccactcagcaggagttgagcttagggcaagtgaccattctcacctgagctccacctcccgtcagatcagcgggcggctctgggtgcccctacgagcatgaaccccatggtgaactgaacataggagggatccaggttgcgtgctccttaggagaatctgactaatgtctaatgtctagtttcatcccagaaccatctccccactcaccccgtccctggaaaaattgtcttccatgaaatcggtccctggggccaagaaggttggaggctgctgttccagagaattcggaagcagatctccagtctcccaagttgggttctcgaaaacgtgagggcaggttctagaccttccaaactggttgcttgaaaatccaaggaggctgggcgcggtggctcacacctgtcatcccagcactttgggaagccgagacgggcggatctcccgaggtcaggagttcgagaccagcctggccaacgtggtgaaaccccatctctactaaaaatacaaaaatcagccaggtgtggtggtgcacacctgtaatcccagctactggggaggctgaggcaggagaatcacttcaatccgggaggcagaggctgcagtcagcagagatcgcaccactgtactccagcctgggcaacagagtgagaatctaactcttttgcccagactggagttcagtggtgcaatcacagctcactgcagccttcaactcccaggttcaagtgatcctcccaccttagcctcctaagtcgctggggctgggattacaggcgcataccaccatggttgattttttttttttttttttagtagagatgaggtctcactatgttgcccaggctggagtgctgtggtggactcatagctcactgcagcctcaatctctcaggctcaagggatcctcctgcttcagcctcccaggtagctggcagtataggcgtgcaccactacgcctggctgattttttatttttatttatttatttatttactttttgagacggagtcttgctttgtcacccaggctggagtgcagtggcgcaatcttggctcactgcaacctccacctcccgggttcaagcgattctcctgcctcagcctcccgagtacctgggattacaggcgcgtgccaccacaccggctaatttttgtatttttagtagagatgggatttctccatgttggccaggctggtcttgaactcctgacctcgggtcccaaagtgctgggatgacaggcatgaactaccatgcccggccttatttttatttttcgtagacaggaggtctcactatgtggcccatgctgggatttcaggctctttgagctttcttccatattggttagggctggagcaggactccactgtggcgggaggtatttgggcgcaaggagagcagttgtgaggactggtggtgacccccagttactgtctgttgtgctttggatgctgggcacgggaagcctggctgtaagtgtgtgtttccgggccgggcgcggcggctcacgcctataatcccagcactttgggaggctgaggtatgcggatcacgaggtgaggagatccagaccatcctggctaacgtggtgaaaccccgtctctactaaaaatatgaaaatattagccaggcgtggtggtgggcgcctgtagtcccagctactcgggaggctgagagaggagaatggtgtggacctgggaggcggagcttgcagtgagctgagatcgtgccactgcactccagccggggcaacagagtgagactccgtctcaaaaaaaaaaaaaaaaaaaagtgtgtgtttccaagaggctgttatggggcctcgggcacaccctcactgggtctggatcccagcctgtctaccaccaggcgtcccttctggtgaacagagctatgtgagaacttccaacagggacaccacggccgctcgtagcccagagcttgcagagctttgttcaaaggcaatggcccagggccgagcacggcggctcacacctgtaatcccagcacttgcagaggccaaggtgggtggatcacctgagatcaggagttcgagaccagtctggccaacatggcaaaaccctatctctactaaacctacaaaaattagctgggtgtggtggcacatgcttgtagtctcagctactcgggaggctgaggcaggagaatcgcttgaacccaggaggcagaggttgcggtgagctgagatcgcgccattgcactccagcctggtgacagagtgagactccatctcaaacaaacaaacaaacaaaaaagcagtggccatcatgatcggttgtgtcatctagtgggaggcaggggtgtgtctgcatgcgtgtctggggtgcattgtggggggattgcaggcgtattgagggcttaccaagtgcctggctcatctgagccctcaggaaaccacattgttggcagctacctcaccgtctcacaaccacccgctgaggttggaatgatcattaacagcatttaacagatggggaaactgaggcctagagaggcaaagtcactggcctaaggtcacatagctaaggagcacagtcaggatttaaatccaagcctgggagatcccaggacccacagtgggcaccacataaaggggctgtttggggtatggcagggactgccctggaacgttccggatcctgcctttgggcctacagggctttggtgccggtgagcaggccgcaggttcagctggctcaaggagcagcttcggggctgcagccaggctgggggctgggcaggtctcaaacccctggacctggggaatcagggaggtgtgagctgcatctgaggtcgggtgtctctgtgactctgtctctgtctctctacctctgattctccccaagctgccttgtctcagtccctgtctattcccaccccacctcgctctctctcccggccttgcgagtctcctcccagccccccatcccacccagtgggctgcccggaggtggcggcaacggggcagctgaatgggcctcttgttcctggccacacccgccccttggggtcaccctgggacatgcccaggcagcgtggctaccttaaagggccagtgctcagaaagaatgtgagcgggggaggctgcgtccactcccaaatcccacaccctccccaaggtggaccactcatgtgtctgacgggggtggggagctgtgtacctacacaccctcgtggcttgggggaggcctgtctggagcaggagatgtgatagggtttgggtttgaccttggataaatcccttcatctctctgtgcctcagtttccccatctagatcagggggctccttggtgccacccctgtgggttgctgggcagatggcatattatccaggattttgcacacagttgacactcttccggcgcccactgtgcattgatagagcacctgctgtttcagcccagcattcatccgccgtgcagacttggcaattccttcttcaccttgctccgtgcctcagtttccccaaatgcagaatgaggcgatggctgtcttagcttcacagagagctacgcaaggattgagtcggttcgtggaattagagggtattagggagaagggcctgaaacactgccaagtgtcacctccactggcgcacttattgagcgccagctgcataccaggccttgctgaggaagcctcactgcagaggttgcagtgagctgagagggaaaggccacccagcctggatctcactctggtgtcatcgcctcctccctctgctcagggttgtgcagcttcaggctgctcccctgccctctctgggcctcagtttcaccttcagagcaacgggaacagccccatcctttcacacactggaaaccatcaccttcttctgcctgggagggggttgtgctgtctctgggaatcccaggcatcccccaggcaggagtcaacccagaggccctcggacccgggctgtaccctgtgacagctccgggtggctacgacgctcccgtgctccaggccagccccacagacagcccgggacaggttgctgccggatggacaagcctgtgcctcgctgccttatgtaaccagtttatgcaagggcagccggcccgcttacataaggggaggccgggccagcgcccagctggggagggggaggctcttaaagggaccggcgtcccccgcggctccctccacgggcactggtgcgaattcataggcgagctgcggactccaccctcagcaaggccgccattaatgtcgttatgattatttttgtggatgttgtttatcatcactatattctttccccagggcgggggttcagctgagcggaggaccacgcccagtgcttgggcagaggcttgggctgtgacgctggctctgggtgtcacctggttaagtccctgtctctgagcctcagcctccccttctgcacagtggggcaatgcaggaagacgtgaggtcctggagggtcctggccctgctgcctgttcactgtgtggcctcaggcaggtggcatcccctctctgggcctcagtttccccatctataaaatagcgcctgctctgtggggttgctgagggagagtcaataagacatattaagagtttacatgcccgccaggcatggtggctcacacctgtaatcccagcgctttgagaggctgagacgggaggatcacttgaggccaggagttcaagaccagcctgggcaacatagtgagatgcccatctctacaaaaaataaaacttagccaggcatggtgatgtgtgcctgtagccccagccactcgagaggtcgcggcaggaggattgctcaagtctgggaggttgaggctgcagtgagctgtgattgggccactgcactccagcctgggtgacagagcaacaccctgtctcaaaaaataaaaataggccaggcatggtggctcatgcctataatcccagcactttgggaagccgaggaagacagatcacttgagatcaagagttccagaccagcctggccaacaaggggaaaccccgtctctactaaaaatacaaaaattagctgggcgtgtggtgggagcctgtaatcccagctactggggaggctgaggcagaagaatcacttgaacctgggaggcggagattgtagtgagccgagatcgtgccactgcactctagcctgggtgacagagcaagactccatctcaaaaaataaataagtaaataaaaataaaaataggctgggcacagtgactcacacctctaatcccagccctttgggaggctgaggcgggaggatcgcttgagcccaggagtttgagaccagcctgggcaacatagcaaatctctgtctcaaaaatttttgaaaacaaaagagtttaggacagcacggagcacagacactgtcagcactcatccagtggaaccactttgcagccaataaatatttagtaagctcctactgtatgccaggcactgctccaggcgctgggatactgcagtgaacaggacagataaaaattcggccctggccaggcacggtggctcacacctgtaatcccagcactttgggaggctgaggtgggcggatcatgaggtcaggagatcgagaccatcctggctaacatggtgaaaccccgtctctactaaaaatacaaaaaaaattagccaggcgtgatggcaggtgcctgttgtcccagatcctcaggaggctgaggcaggagaatggtgtgaacctgggaggcggagcttgcagtgagccgagatcacgccactgcactccagcctgggtgacagagtgagactctgtctcagaaaaaaaaaaattctgccctcgtggaactcacagtttggttcaggcgatgggcaaagaacaagaaataaatgtcagtttaggcttagtgcggtggctcacgcctgtcatcccagcactgtggggggccgaggcgggcagatcacctgaggtcaggagttcaagaccagcctggccaacatggtgaaaccccgttcctactaaaaatacaaaacattagccaggcatagcggtatgcgcctgtaatccagccactggcaggggctgaggcaggagaatcgcttgaacccggaaggcggaggttgcagtgagccgagattgtaccactacactccagctggggccacagagcgagactccgtctcaaaaaataataataataaaaataaaaagaaataaatgtcagtttagcgataaggactatcaagaaaaataaagaaggccaaaggaaaagaggctgatgggctgtgctggggaggtccctgaaaggctgtctgaggacctgacatttgagctgagacctgagaagtgaggaggaaccagttatatgaagaactgggggaaggcgttccaggcagagggcacagcccgtgcaaaggccctgcggcaggacacacctggcactttggaggaacagtgaggaggcctgtgtggctgcagcagagtgaggagaggaagagaaggaggaggggagggcagtttgtgcaaggcctggtgggcagtaggaaggacttgggctttgaccccaaggcaggtgggagccatagagggctatgggcagaggagggaccagccctgactcaggtgctcacaggcaccctctgcctgctgcagggaggacagactgtggggggtgagggcaggagctggggaccagggcagagtggaccgccctggtgcaagcaggcggtagcagggacagaggcagaggagggggcagaatccaggtcaactccgacggtgtgaggattcagttgctcacctgggtcgtttataccttatctgaggctggcccttgctctccttgccccgtctcctgcctgcaagccgcacctgcctgggcacatgcagggaagggagcggcgcagcactgggcacgcctgggagctctcctgcaatcaggactttgttagcgggcaagctgggatatgggtcctggtgcccgggaggcccgtggggctctgggctcctgccagggtcccagccctaacccaggtacgccacccacatggcagggttattctctttttttttttcttttttttagacagagtctcgctctgtcacccaggctggagtgcagtggtgcgatctcagctcactacaacctctgcctcacaggtttaagagattctcctgcctcagcctcctgagtagctgggactacaagtgtgcaccacctcacccagctaatttttgtgtttttagtagagacggagttgcaccatgttggccaggctggtctcaaactcctgaactcaattgatccaaccgcctcgacctcccaaagttctaggattacaggtgtgaaccaccgtacccagcctattctcatttattttctttcttatttttttttcttttttttgagacgaagtctcactctgtcacccaggctgaagtgcagtggcacgatctcagctgactgcaacctccgcctccagggttcaagcaattctcctgcctcagcctcccaagtagctgggactacaggcatgtgccactatagccagctaatttttgtatttttagtagagatggggctttgtcatgttgacgaccaggcaagtctcgaatgcctgacctcaggtgatccacccagcctcagcctcccacagtgctgggattacaggctggagccactgcgcccagacggtccttccttttcatgcctcctccttccactcccccatgtaccatgtctccttgtctctctttttctctctgctcatccctccctctcaactttctttctacaaatatttattgagcacctagtctgtatcaggccttattctagccactgagggcacaacagagatctagacagacaaagcctctgccctcaaggaggtgacattccactggggagatgagcaaacacccgtgcagtcactaagcaactaagcaaatccataggcaatcactaacttcctctgaaggaaagaaaacagaaggctgagattgagggtggccagaggctgcttgaggtgaaggggctcagcgtagacctctctgagaagggagcatttgagctgagaccaggagagatctcaagagagagcaagcagttagctgtttagacagagggaacagaatgtgcaaaggccctgaggcaggactgggccaggtgcattggaggaacagcgaggaggcccctgtggctggagcagagtgagtgagggggagagagggaagaggggagggcagaaagcggacaggacaggttgtgcagggcctgtggtcctagtcctccactttgactactcccccaaatctcttaatgttcctcacattcctttccctgacaagcatttattttgcacctgctgtataccagatcctatcaggagaatcccaaatattcatgcaacaagttcatattgggtgcctactgtgtgccaggctctgctggaataatcacactcatttggctgcaggcatttattgagtgccagctgtgtaaaagcatttatcgagcaccacctgtgtagcaggctctggggagagaggccacatgaaagcttgggaaggagaaagtttccttctaccccctttcaggtttgtgccctctggtttccagccccctcccacattcaaggcaacatttaaacctctgggttcaagttccgttgtccaactgcgtggccgtgagatctggggcaagccccttcctctctcggatcttccgtttccccctttgtaaagcagaacactccacaatctgatgtgtttacaacttgacatctactttttgcagcaagggaaactgaggcacagagcagggcggagatgtgtctacctctccctccccaagcaagactggcatggagtctattctcctgaccccacgccaaagccagggcgtttggtattttgttttttcttggaggcccagagaggggcagggcttgcctgaagccacacagcaccgggcaggcctcggaattgcggagagccctcccctgggcgcctgcccgggctcccgcgccttcctcctgcctcctttggctgggccgccagccttgcctcccgtcctccggactccccgcgggctgcccagttggagacgcgccccaagaaatatcagaaggaaggggaagccgggaggggcctccgcctcctcccgccaccccccgccgcgcccggctgcccccacccggtgcccgacattggcagagagtgtcctcgggcgcttccgactggccctgcctgcttcgtgtggccactgatcccttccggagcctctccatggggacgcccgtgtgtgcgctcagccagtggcacatgtggctcccggggctcccttctccacccccccagcccctggcctgcccctttccccccatcccttcccgaacctctccatggggacgcgtgcgtgtgcgttcagcccgtgggcacatgtggctcccagggctccccccgaggcctgcccttctcccccccacgtcacagccgccgagtcaggcctgccaggaaggtgttgggggtgggggtgtggggaggcctcagcttggctgctggagaagccaagaatttgctccaaatgtaaacagcgagttattttcagtccactcccccccaccccgggtggcgttgacacatttgacattggcgggaccgggagggggtgggggtgagggtgtgcgtgcgggtatttttaaccttgctcctcacatccctggagtggctggtgccgagtggcagataatggggagggggcgcggaggcgtggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgcgccgcccagacctacaaaatggccgccaaggccggagaaacatctggaacaggggaagggagaggcgagaaaatggccgccagagggatgatgtcatgggcggcgtggcctcccagagcgtccccagcacggggcgagtccctacgcgcaggcctccgagcaggggccctgtggcctccagggacctccagacccgctgcccaggccggacacccacaaagagtgacaccggggtccccaggggtccccagaggcgggcccgagacctgggggagggcgaggccagcactgggcctccagtcccaacagcccgatgctggggacggttccggggcggtggtggccgctgacctgacccgcaggacaccgaggcgtccaccagcgcccgggagggcccggagccaggccatggagccggcgggggccgggtggaaagaaaaaagaaacttttctttgaaagtgattccgaagcaggttggctccggcccaggcggcccggcggcaggggagagggagatggaaagtatgggccagacttaaggaacgcaggaaggacgaggccggggaggcccgggatggaggccagcgtcctggaggtcaccccgtccacgcctctgcctctcgggcccccccaggtcacatccagattttcctccctgtccctggggcgggcggggagtgcggagaacatctatgggcttgtgttttttcctcttttgatttgtccagacaggcgatggacaagggctgggcaggggttttaggtcatctgcactgccaggatgtggaggctcagagagggagagtgcttttagtgaggtcacacagcactggcaaaactgacagctgcttccctccttagagcatcttggggaggaggaagttctctatggaggatcagggtccgtactggaattcctttctatttttatttaatttaatttatttatttatttatttatttttgagatggagtttcactcttgttgcctaggctggagtgcaatggcacgatctcggctcactgcaacctccacctcctgagttcaagcgattctcctgtctcagcctcttgagtaactgggattacaggtgcctgccactacacccagctaatttttttgtatttttagtagagacaggggtctcaccatgttggccaggctggtctcgaactcctgacctcaggtgatctgcctgccttggcctcccaaagtgctgggattatacgtgtgagccaccgcgcccggcccctttttctttttctttcttcctttctttttttgaaacagagtcctcctgctctgtcacccaggctggagtgcagtgacttgatcatggcttactgtagcctcaaccttctgggctcaagcaatcctctcacttcagcctcctgagtagctgggaccacaggcatgtaccaccatgcccagctaaatttgggttttgtttgtttgtttgagacagagtctcactctgttgcccaggctggagtgcaatggcacgattttggctcactgcaacctccacctcccaggttcaagcgattctcctgcctcagccttccaagtagctgggattacaggcacccgccacgatgccctgctaattttttgtgtttttagtagagatggggttttgccatgttgcccaggctggtctcgaacttctgacctcaagtgatccgcctgccttggcctcccatagtgctgggattacaggcatgagccaccgtgccctgcctatttttttttttttgtagaaatagggtctcactatgttgctcaagctggtctcgaacttctgacctcaagtgatcctcttgccttggcttcccaaagtgttgggattacagcgtgagccactgtgtccagccaatgtctgtgtgtttttcactgctctgtccccagtacctaggacagggcatggtacacagtaggcgctcaagacgtgtgttggataaaagcatcacagttttctcctgaggctggggttggcacagatgctggcacaggaagggggcagaggctcaggaaatgcaaagtaggttgcaacgtaactggacacacacgggaaccctgtggtcacatttttcaggagggatgtgaggaggcgaaaactcaaacttccctcacttcaagtgcagattctgtgccgggagctgtggacgataaaccacatttgaacagaagcctgaataaagcgagagagtgagccaggcaggcatttgcagggacggtgttccaagcagtgtgcacagcccgtgcaaaggccctgaggcaggaccgtgcctggtgcattggtggaacagccaggaggcctgtgtggctggagcagagtgagcgagggggagagagggacgaggggaggaggggagggagggggcagaggcaggctgtgcagggccttgagcgccatggggagatggggagaacttggacttttagatatttggttttctgttttttgttttttgtttttgaggtggagtctcgctctgtcgcccaggctggagtgcagtggtgcgatctcggctcactgcaagctctgcctcccgggttcacgccattctcctgcctcagcctcccgagtagctgggactacaggcgcccgccaccacgcccggctatagttttgtatttttagtagagacggggtttcactgtgttagccaggatggtctcgatctcctgacctcgtgatccacccgcctcggcctcccaaagtgctgggattacaggcgtgagccaccgcgcccggcccaattgtttggttttgtttttgctttgttgttgttgtttttgagatggagtctcgctctgtcacccaggctggagtcactggtgcaatcttggttcaccgtgccctctgcctcccgggttcgagcaattctcctgcctcagcctcctgagcatctgggattacaggcatgcaccaccacgcctggctaatttttgtgtttttagcagagacgaggtttccgccatgttggtcaggctgagctggaactcctgaccttgtgatctgctcgccttggcctcccaaagtgctgggattacagacgtgagccaccgcgcccgggtgaactttcacatatttgtagacccagacacagtccagggtgctggggactagaacaaacgtttgcagaaagggctggggagggtgttccagagaaggagatgtcagagctgggctgcaaagtatggctggaggtttcctaggagggagaggggcagggaagacggcacagcaggagctcagaggactcaggcccaggtcactcgtatattccattgccttccaggacagagaaagttgaaccttcgccgggtaatgtttaaaaatggccggtgacacccagtagctgggaattccagggcctggctttggttctctctttagctggctgaggttgggaggcggacgtggcagccggcagagccagcaacatttggaagccggctaacgttggaaaatcaaccaggcgagctcacggtggcggccgatgctggaaacctgggctccgtgaggtccagcagatgccctgctggggcccaagtggacattctaggccttctgacagcccgccgggtttttaaataagtgtgattatggtttcagcaagtcctgtccttcctacagccaaaagatcaattcaatatggccactccgtgcaatgctgggccacccctgctgggccagggtgttgtgttgaagccaagattcccaacacctgagagtccagaagtttctttaaaaattgctttaactgtggtgagacacacatcacacactttttttttcttgagacagggtttcactctgtcacccaggctggagtgcagtggcactgtcatagctcatcgcagcctcaaactcccaggctcaagcaatcctcgcacctcagcctcctgagcatctgggaccacacatgcagcacgcaccaccacacccagctaatttttattttattttattttatttttgagacggagtctcactctgtcgcgccaactcggctcactacaacctccgcctcctgggttcaagcagttctcctgcctcagcctcccgagtagctgggactataggcgaccgccaccacacctggctaatttttgtatttttagtagagacaaggtttcaccatgttgaccaggttggtctcgaactcctgaccttgtgatcccaaagtgctgggattataggcgtgagccaccgcccctggctgacacccggctaatttttaaaaatattttgtagagatggggtcttgctatgtggtccaggctggtctcgaactccttgcctcaagtgatcctcccacttcagcctcccaaagtgctggaattacaggtgtgagccactgtgcccggcccagagacttttgaaagtctaaaatggattgtatcatagctcacatcactcctcttcccactgcaggataaaacccaggcctctcactgcaacacacaaggccccgaatggtcccgctcccctctccgttcgttcctctttctcttgcccaccacgctgcagcctggggtctgtctctgcctttcacacatccaacttcattcctgccccgtggaccttgcccttgtcaccgaacctttgtggaacgctttcaccccagctctccacatggctgggctccttctcccgctggagagccaccgtcacatcctcagagaggttctgcctgagtcctccctccaacgccgcccccaaagccattctgccttcggccagtttcattgcctccgtagaacctagaaccgtgtgaaatgatctgaggcttcctccgtgcactggttctgcccgtctccctccccacttccttctctgccatccccccaaggcctggcgagtagtaggtggtcagtaaacacctgttccgtgagtgccgggtgtgcgttgacctcccagtcaccaacggcggaagcttcagccagcggacgcagggagttgtcccttgcaaagggggtgggtgctcccgggcgggaagggtggggccagagcccacggcgatgcctttgtcatgagctaggatggactgaatttgggctcacagccacggacaggagagaacagtgtgtccgccccgtcagtgccatccagcgtgcgtggctgttgtgcatcatttgtttgcttgagcaaaggctacagggtccagtgacattcttggcagtccatgacacctcacagacctgggaagtcaagagacctggctcccggccagatgagggtatcatttgaaatacaatttgctggccggctgcggtggctcgcacctgtgtttcccctactttgggagacagaggtgggaggattgcttgagcccaggagtttgagtccagcctgggcaatatagcgagactgcgtctctacttttttttttcctgagacggagtctcgctcctttgcccaggctggagtgcagtggttcgatctcggctcactgcaagctccgcctcccgggttcacgccattctcctgcctcagcctcccgagtagctgggactacaggcgcctgccaccacgcccggctttttttttgtatttttaatagagacggggttttaccgtgttagctaggagaacaacaatttgctttccagaaccagagcctctcaacactagcatgtgtgtggtcatccatgctaaatggtgctgaaagaggcatttgtgtctctctgagaaggagctatttgaggaaagtcctgaatgaggggagagaatgagccatgtagatagctgagggaacagtgttccaggcagaggcgcagcccgtgcaaaggccctgaggcaggaccatgcctggtgtgttggaggaacagcgaggaggcccccgtggctagagcagagtgaggaaggggagacaggaaggaggggagggcagggaggggactgatcgggccatgcagggccttgtgggccacgggaagaaggtgggcttttccccgcaaagaaggtgggagctatggagggctgcgggcagaggaggggtaatgttcatttaactcctggagtttgacaaaatgctatcatcaaaacagactttatcacagaacctctagctatccccgtcccctccgtaagctcctctgagcatagcaacagaacgggaaggtaaggcagcgattggaaacgcccgcgttacagatgagcggagagccgctggaggttggaggctccgacagaggaggtgactggtccagagccacatggccaggttgtgctggggctggaactccatcgaacgcaggtttcagggtgcagcccttgtttccataagataccccaaaatcagacaagcctgggacttgccacctcttctttaaaaaccccagtgctgtttttgtttttgttttttttgagatagggtctccctctgttgcccaggctggagtgcagtggctcaatcatagctcacccactgcagcctcgacctcctgggctcaagcagtcctcctgcctcagcctcttgagtagctgatactacaggtgtgcatcaccacagccaggtaacttttttttttaaagtagagatggggtggggtatcctgtgttgcccaggcttgtctcaaactcctgagctcaagtaatcctccctccttgaccttccaaagtgcaggaattataggtgtgagccaccatgcccagccctccagtgcttttttttttttttttttgagacggagtcttgctctgttgcccaggctagagtgcagtggcacgatctcggttcactgcaacctctgtctcccgggttcaagcaattctccttcctcagcctaccgagtagctgggactacaggcacacaccaccatgcccggctaatttttgtatttttagtagagaccaggtttcaccgtgtcggtcaggctggtctcgaactcctgacctccagtgatctgccctccttggcctctggggattacaggtgtgagccaccactcccggccctccagtgcattttaaaggctctgaaaagtcctacgttgtcctgaaaactcctcagtgatgctgaacctttttgacctgtgaaccccaggtttgggtaaagtctgctcacatccggcggcacacccataggaaacccccagcccggctgtgaggagtgtgaactttgattcaccaggtccttggcccagctttagtttctcccgtgtccgtgtttgcttgtgcaatcatgaatatatattgaccagcaccaggtgccacattgaacagtttgtccgcgccgtcagtgccatccggcatgcacggctgttgtacatcatgtctttgcactggactgagctcagctgcagaaagcagcacatttcagagggtgtctaccgggccaggagaaaacacacaaaccgccaacattttaaagcttgtaatcgacatcgtatacaactggaaaagatgttcatttatatgttttgtttttgttttcttaagacagggtctcagtctgtcacccaggctggaatgcagtggtgcgatcatagctcactgcagcctggagctcctgggctcagacgatccacccacctcagcccccagagtagctgggactgcaggcacaggccaccacgctgggctaatttttatatttttgtagagatggggtcttgctctgttgcccaggctggagtgcagtggtgtgatcttagctcactgcagactcaaactcctggattcaagccatccccacctcagcctcccaagtagctgcgactacaggatgtgccaccatgcccagctaatttatttttatttttatttttgctagagagagtgtctccttatgttgaccaggctggtcttgaattcctgacctcaagcaatcctcctgccaaggcaatcctctcaaaatgcagggattacaggtgtgagccactgtgcccagcctgttcatacgttttaaagagaggtgcagacaaaactgggttggtgcatccacatccctctctgtgtgatgctgggtaatttgcttaccctctctgggtatcctggagattgtcagccccagccaaggatggttaaaaggcattaaacaatacctaggacagagcctgacatctggagctcattaaaccatccgtacatgcagatgtcgttataattattatcaatgctattctgtcactccacaccctgactcccacctcagtggccccaggtgggggtgctctgaaatttctctggcctggctgagcgggaggggccggggttctgctggaataaagaacagaggaggaagccttgaaggatttgttctgtcccagctgtccccagtatcacagttagccacacggatggcagaagggacctttgacagtggacacaggggctggaagggcccagcctggggctcactgcaatctccgccttccagattcaaatgatcctcctacctcagccttccgagtagctgggattacaggtgtgtgccaccacacccggctaatttttgtatttttagtagagatggggtttcaccgtgttagccaggctggtcttgaactcccgacctcaggtgatctactcacctcagcctcccaaagtgctggaattacaggcatgagtcaccgtgcctggccttggggctttatctgactggctagagaatgggattcaaacaccaggaatcatcccaaaccgccaatgagaaggagccctggagtgaggggaaccgagacccctcctaaaaggatttacagggtgtcacagaatcaaaattacagcaaaggctcaactgtgagatgccagggtggctgatcattgattctagacccatcactaccagctggtgttctgtgagtttgaagccattgctgtctagctttgtgcctcagtttccccagctggcgattaccgtcccccatatggggacggtaatcacgtgtctgctgcagaggagttacaaagatttgtgaggcaatggaggcaacatttgcagccgaacctagtcaaaggaattactcactgcgcattaatttgttgttttttgagatggagtctcgctctgtctcccaggctggagtacaatggcgcgatcttggctcactgcagccatcccccgggttcaagcaattctcccgtctcagcctccggagtagctgggattacaggcacgcaccaccacgccaggctagtttttgtatttttagtagagacagggtttcgctatgttggccaggctggtctcaaactccaggcctcaggtgatcctcccacctcagcctcccaacctccctagcatttcaacgacctgaagtgaccctcttgatttatttgctgacttgttcatttcctgtcacgttcccattagaacatcagtgcctcgagaggagggattcttgtctgtctctgtcgccgctgtgtcccttgggcgtctggcatccgggtggctctctgcaatctgtttgctgagtgatcaaaggaaagaactaatggcaacatagtgcagctccaatgtacagatgaagaaatccaggctcagagatgtggaagtacttgcccagggccacacagccggaagcccgccaactcttttagtaaagggccagtgacactgtaaacattttaggcttttaggcaggtcacatgcagtctctgttgcctattttttcttttgtttacgaccctttaaaaatggaaaagacaggccgggcgcggtggctcacgattgtaatcccagcactttgggagtccgaggcggacggatcacgaggtcaagagttcgagaccagcctgaccaacatggcaaaaccctgtctctactaaaaatacaaaaattagctgggcgtggtggcacgtgcctgtagtcccagctactctggaggctgaggcaggagaatcacttgaacccgggaggtggaggttgcagtgagccgagatcacgtcaccgcactccagtctgggagacggggcgagactgcatctaaaataaaataaaataaaataaaataaaataaaataaaataaaataaggaaaagaccatacttagctgactgtgcaagaataggcaaccccttctagtttgctcatctaatgtcagaacccacgaactgattccaaaaccctccacagagaatctaaaatgctgcaaaccccgactctgtgatgctggggatctaaagtgcttagtttgtttttttgtttttttgttttttgtttttttgtttttgtgttttttgagacagaggctcgctctgtggcccaggctggagtgcaatggcatgatctcggctcactgtaacctctgcctcctgggttcaagcgattctcctgcctcaacctcccaagtagctgggattacaggtgcctgccgccacacccggctaatttttgtatttttggtagagacggggtttctccatgttggccaggctggtctggaaatgctgatctcatgtgatccaaccgcctcaggctcccaaagtgctaggattacaggtgtgagccaccgtgccctgccaagtgcttggttctttagtctggagtgcagtggtacgatctcggctcactgcagcctccacctgccaggttcaaacaattctcctgcctcagcctcctgagtagctaggactatgggtgcatgccagcacacccagctaattttttttttttggtacttttagtagagatggggtttcaccatattgtccaggctggtcccaaacccctgacctcaagtaatcctcctgcctcggcctcccagagtgctaggattacaggtgtgagctctaccgtgcccggccaagtgcttggttctttctcgactcaatcctattttgttctacacaggtcaggtctgcctccactcccccaaccccatgccccatttcacccattggcctctgaagcccagagatgggcaggggtttgtctgagaccacacagcaagaggggcagcagaggaggacgggaacccagatctgcttccctcccaggctacacccctgtagccccccaacccctgcaaacttgttatttaagcctcctcattacaggggtttggagccgaggaagccctgctgccttttagtaaatgctctccctagacagcaatctttgatggaggctctgggagaagttgttcagtgatgtgcatttgtcgagcacctactgtatacctggtgccagtatagggttgggtggaagggtcttgtccactcaacacccctttttctgccctattattgccttccctggccaggcgaggtgactgacacctgtaatcccagcactttggatggctgaggcaggaggagcgcttcagccctggagtttgagttcagcctggccaacatagtgagacctcatctctacaaaaaaatgtttgttaaaaattagccagatgtagggccacaagcctgtagccccggctacttgggaaaagaaggcaagagaatcacttgagcccaggaggtcgagcctgcagtgagctatgatgacaccactgtcctccatcccgggccacagagtgaggccctgtctcaaaaaaaaaaaaaaaatcaagaccatgattgcccccccataaagagcccttttaaacattttttccctaatcactctcctgtgaaattttaatagcataggtatattttatatacctatatatattaaaaatgtacctgtgccatcaaatatatataatatatattatacataggtatataaagtataactatatgtcatatagataggtatataaaatgtacctatatggcctgtaggtatataaaatatgccatataggtatataaaatatacttacgccattaaatatatatttaatatacaaatatatttgtttttttctatactgtaacaacatatgtctgtacattattattattattattattatttttgagacagagtttcactcttgttgcccaggctagaatgcaatggcgtgatctcggctcactgcaacctccgcctcccgggttcaagaagcaattttcctgcgtcagcctcctgagtagctgggattacaggcatgtgccaccgtgcccggctaattttgtatttttagtagagacggggtttctccatgttggtcaggctgctctcgaactcctgacctcaggtgatccaccgcctcggcctcccaaagcactgggattacaggcgtgagccaccgtgcccatcctacatttttttaaaaacacaaaattctggccagacatggtggctcacgcctgtaatcccagtgctttttttttttttttgagatggagtctcgctccgtcgcccaggctggagtgcagtggcgcgatctcggctcactgcaagctccgcctgccgggttcacgccattctcctgcctcagcctccggagcagctgggactacaggcgcccgccaccaggcccagctaattttttttgtatttttagtagagatggggtttcaccatgttagccaggatggtctcgatctcctgacctcgtgatccgcccgccttggcctcccaaagtgctgggattacaggcgtgtgccaccacgcctggcctaatcccagtgcttttggaggcctaggcaggagggtcacttgagcccaggagttagagaccggcctgggcaatatagtgagacccccatctcaaagcagaacaacagcagaacttctgagctagacagacaactttgctttgaatctgacaccagctttgggaaatacgctgtgcgcactgggccttggttgaccaaccttacaaattgagcagatttaatcagatggggtcaggaagtgctaattcagcacagtaaaaactcagcagatggaagctgcccactggggtctggggaatcttggggctgtggaagttagccagccttcgacattatgcactttgtacacatctgctcagaccgaaagaaggtccattttaaggctgggtgtgtactaagtaggtggaggaggaggaattatctgtgcctctttttcttttctttttttttttttttttttgagatggagtctcgctctgtcgcccaggctggagtgcagtggcgcaatctcggctcactgcaacctctgcctcccgggttcacgccattctcctgcctcagcctcccgagtagctgggactacaggcgcccgtcaccacgcccggctaattttttttttttttttgtatttttttttagtagagatggggtttcaccatgttagccaggatggtctcgatctcctgacctcatgatccgcccgcctcggcctgtcagagtgctgggattacaggcgtgatccaccgtgcccggccacctctgtttcttttcttccagtttttcatggaagcagccagggccacacagtgcactagaatattcctcgctgatggcagaatattctgtgctgtccaacttggtcaccaccagccacgtgtggctctttggtgcttgaaatgtgatttgttcaactgagcaacttaaaatttaattttcttttctttttttttttttttttgagacatagtctcgctctgtcacccaagctggagtgcggtggctccatcataactcactgcaacctccacctcccaggcttaagcagtcctcccacctcagctccccgagtagctggaactacaggcatgccactacacccagctaacttttgtattttttgtagagacggggtctcgccatggtgcccagtctggtctggaactcctgggctcaagtgatcctcctgccttggctttccaaagtaccgagattataggcatgtgccaccacgccccgcctaattttatttcagcgtagctaacttaaatgtaaaaagtcatatgtggctgtgacccttgtactgatggctgtagaacgtgaggagttttcaggagccaaatgatggaagaatggtcagcaggtggttgagaactattcccaggttttagagatgatttaagatgagacggctggccgggcgtggtggctcacacctgtaatcccagcactttgggaggccgaggcaggaggatcacttgacgtcaggaattcaagaccggcctggctaacatggcaaaatcctgtctctactaaaaatgcaaaaattagccaggtgtggtggcaggagcctgtagtcccagctactcaggaggctgaggcagaagatttggttgaaaccaagagacggaagttgcagtgagccgagattgtgccactgcactccagcctgggcaacacggcaagattccatctaaataaataaatacataaatacataagatgaggcagccaaataaaaaggaaggagattctgaccaggctactcacatgggtgaaccttaaggacattaagctcaattgagaaaagccggacacagaaggacaaatactgcgagtccactcctaggaggtccctagagtcgtcagattcatagagacagaaagtaggttggcggggtcagggggtgtcggaggctggggaggggacggggagtgagtgtttcatggggacagagtttcagtttgggaagagtaggaagttctggagaggatggtggcgatggctgcatggccattggaatgtatttaatgtccctaaagctgtgcatggaaagttggttcaaatggtaaatattatgcgtattttaccacaataagaaattaaattaaaaattaaaatgagatggcatagatttatagcatattatttttaaaactaaactaattttgaccaggcatggtggtgctcaaccatggttccaattactcgacagtctgaggtggggggattgctggagcccaggaggtccaggctgcagtgagccatgattgtgccactgcactgcagcctgggtgacagagcaagaccctgtctcaaaaacaaaattaggccgagcacagtggctcacacctgtaatcccagcactttgggaggctgaggcacgcggatcacttgaggtcagaagtttgagaccagcctggccaacttggtgaaaccccatctctactaaaaatacaaaaattagctgggctaattaaaattagattagaaaattagattacaggtggcacacacctgtaatctcagctacttaggaggctcaggcaggagaatcacttgaacccgggaggcagaggctgcagcgagctgagatcgcaccattgcactccagcctgggcgacacagcgatactctgttccaaaaaaaaaaaaaaatttaatttaattaaaaaacacataaattcctaggactataggaaaagaagaaaacttccttaacccaagaaagggaactacaaaaccccacagctaaccccgtacttagtggtgagaggctggatgttttctcctgagatcaggaacaagacaaggacaccactttccccatttctattgaacattgtactggaagttctgccagaccaataaggcaagaaaagaggctggacgtggtagctcacacctgtaatcccagcactttgagagaccaaagagagtggatcgcttgagcccaggagttccagaccagctagggcagcatcgcgaaaacccgtatctacaaataatacaaaaattagccagatgtggtggcgtgtacctggggccccagctacttgggaagctcagataggaggatggcttgagctcaggagttcaagactgcagtgagccgtgattgtgccaccttactccagcctaggtgacagagcaagatcctgtctcaaaaacgaagaagagaaagagatcagcctggctatcatggtgaaaccctatctctactaaaaatacaacaaaaattagctgggcgtgtgggcgtggtggcacgtgcctgtaatcccagctacttgggaggctgggaattgcttgagcccgggaggcggagattgcaatgagctggatcgtgccaccgcactccagtcctggcaacaagagaacaagagcgagattccatctcaaaaaaataaataaataaataaataaataaataaaagatacaaaataacaccatcaaagacagtaccaatagcgatattaatcaaatagcaatagtagtgaagctgccctctgcctggtgaagcactcactatggcagccatggttctgggagttttattaataattcattcatcacctttttttttttgagatggagtcactctgtcgcccagactagagtgcaattggcccgatctgggctcactgcaaaatccgcctcccgagttcaagagattctcctgcctcagcctcccaagtagctgggattacaggtgcccaccaccacgcccagctaatttttgtatttttagtggagacggggtttcaccatgtggggcagaatggtcttgaactcctgaccttaggtgatccacccgcgttggcctcccatagtgctgggaatacaggcgtgagccaccgcacccagccaatgtttcattcattaccatcttgtccctcataaacagcttccaagagggggtgctatagttgtgtccatttcacagatgagaagagtgaggcgcggatgcatccgaggccccgctccctggctgcccgattcgcaagctcatgctgggagccaccgtggggcctgacacttagtaggtgcccaagaaacattctcccttcccagggaaacacccggatgccagctgggcactgcggcctgctgagacgccagctgggcactgcagcctgctgagtctgtgtgggctctggttccggaagagggtcctgtgcccacggcctggcgcccggacggccggctgcccaggctgggtccttcccaacgtcatggccaccggtgcccagccttgagacagtccaaagggaactggccagctccgaggggccgctggcagccccagcctgggatcagctgcagggcttggggccgagctgggcacactcccctcggctgctgtccggcccagatggccacggccggggcagcctagctggaggaagggcttctctcgtctgctcctctgtttcctgacgaggaaactgaggcaccgggccctgctcctgtgctgttcatggcatccttggtcttggcaatcagtgggtgctggacacacggtgtgtgcatagccattagcacggcgccaggctaactccagaggctccgtgcgctaggaaatatcattgctttgatcattcccacagcaaccctgagagtggtctccatttatttttttaaaacaaggtcttgctctgtcactcaggctggagtgcagtggcatgatcacagctcactgcacccttgacctcccaggctcaagtgatcctcctgagtagctgggactacaggtgcctgctaccatgcctggctaatttttttttcttttttgttgagatggagttttgctcttgttgcccaggctggagtgcaataatggcgcgatcttggctcaccgcaacctccgcctccggggttcgagcgattctcctgcctcagcctcccgagtagctgggattacaggcatgcaccaccatgcccggctaattttgtatttttggtagagatggggtttcaccatgttgatcaggctggtctcaaactcctgagctcaaagtgatctgcccgcctcggcctcccaaagtgctgggattacaggagtgagccactgcacctggactgtttttttgtattttttgtaaaaacggggtctcactatgttgccctggctagtctcgaactcctggcctcaagcgatcctcccgcttcggcctcccaaagtgctgagattacaggcgtgagccactgtgccactgcccctggcttaatcatcatctcattttgcggatgaagaaactcaggccttgaaaggaaagtgaggccgggcgcggtggctcacgcctgtaatcccagcactttgggaggccgaggcgggcggatcaccaggtcaggagatcgagaccatcctggctaacacggtgaaaccccgtctctattaaaaattcaaaaaattagccaggcgtggtggcgggtgcctgtagtcccagctactcaggagactgaggcaggagaatggcgtgaacccaggagacggagcttgcagtgagccgagatcatgccactgcactccagcctgggcgacagagcgagactccgtctcaaaaaaaaaaggaaagtgaccttctcaggagcacaaagacccggggggtcttggagacagtacttggctcaggtgtctgatcccagcacaaaactgtagataaaataaccctggtgaaaaagcccatcacagggcctgggagggagaacattgctcgtggttctgacccgcagctttccttgtttatgaaatggatacagccaggcatggtggctcacgcttggcatcccagcactttgggaggccgaggcgggcggatcacctgaggtcaggagttcgagaccagcctgaccaacatggtgaaactccgtctctactaaaaatacaaaaattagccaggcgtgatgacgcgcgcctgtaatctcagctactctggaggctgaagcgggagaatcacttgaacccgagaggtggaggttacagcaagccgcgatcgcaccactgcattccagcctgggagacagagtgagaccctgtctcaaaaaaataaaaataaataaataaaatagaagaaagtaataatggggcggactctcgtgattgaggtctccaaatgccctcaagtgcttcaggagtatcctctcctcactgcctcccagctctgctaaggcctgggcagtgtttgtgcccacgtggaagatgagaaacaggctcaggacagttaggcgacttgcctgaggtcacacagcgatcgcgtcctggccttggggtctggcgggtgggcaggaggggcgtgattctcttcctgcggctttcgacgttggttgctgccaccttcgtctttgacctgggtgatccatgggtggggctggggaggggcgtctgcctggctgggcttgtccacctgccccccaacttcagccctccgtggaggggtcagggctccagagggggcggatgtgactcgtcctgcatccaggctgccagagccgataacgctgagctcagcgtctgtctgcctgcgcgtctgccaaggaacctaattatttttagataagatggaggggcgggcgccggggcagagggagcacccaagctgggcgggcagtggggtcgtcgccatcagagagaccacccctcagcctcctctctctggggtccctgaacggcaacccaggactaacagccgggtccctgggactacaggggcagaggctgaggctaagggacgtgacgtctccaggactcacctctctggtcctcagtttccccatctgtaaaacggacatagtgatagacctcctgcatagggctaaggcggggctgaatgactgaacctcattttattttatttattttgttttatttattttattttatttattttgagatggagccttgctcttgtcgcccagactggagtgcagaggcatgatctccacttgctgcaacctctgcctcccgggttcaagcgattctcctgactcagcctcctgagtagctgggattccaggagcgtgccaccatgcccggctaatttttatatttttagtagagacggggttttgccatgttagccaggctggtcttcaactcctgacctcaagtgattttcctgccttggcctcccaaagtgctgggattacaggtgtgagccaccgtgcctggccgttttgttttatttttttgttgttgcttaatttcattttctgagatggggacttgctatgttgctcaggctggcctccaactccagtcgcccagactggactgcagtggtgcaatcctggctcactgcaacctccgcctccgaggctaaagcgattctcctctctcagtctcccaagtagctgggattacaggtgcgcatcaccacacctggctagtttttgtacttttagtagagatggggtttcaccatgttggccagtctggtctcaaactcctgaccctgacctcaggtgatctgcctcccttggcctcccaaagtgctaggattacaggcgtgagccaccgtgcccggcctgaacttcattttacagatgaggctcagagaaggcaagcgacttgctcagggtcgcacagcaagaaagcggcacagctgggatttgaacatcagtctgttaagattccaggtgtctaacttcttacccacgactgagccggccctgcagaagcggagggcttacccaacatacgggtacactggcgctcacagggcctagctggtgtctgcagggtgcctggccagatgtctgtgaccctctagggcagcagccaagggaagggcccaaagagagaccccagggcctgggtgtgttttggggccactgtttgtctccatagcactggcccagcccaggactggggccaccagcatcgacacttcatctgctcctggggtggggtctctgtgatgccaccagtgtttcttccctctctttgcagatgcagagcaaagcggcagtccccggacagggatgggctctgaccaggaggacagcaagcccatcacgctgggtgagtctgggggcagcgtggcggtgaagggcggagggcgcagccctgtcctcgtcttttatttgggaatcatttgcttggcaccactcgttttacagatgagcagactgaggctcggagaggttaaggggcctgtccaggggctaccagggagctgggttggaacccacgactctgagctcccagcttctgggctctgaggtgctcaccccatgggagaccccggagggttctacagtcccatgggacgtttgagggtttttgtttgttttgttttgttttcattcatttatttattttgagatggagtctcgctctgtcatccaggctggagtgcagtggcacaatctcagctcactgcaagctccgcttcccgggttcaagtgattctcctgcctcagtctcccaagtagctgggattacaggtacctgccaccacacccggctaatttttgtatttttagtagagacggggtttcaccatgttggccaggtcggtcttgaactcctgacctcaggtgatccgcctacctcggcctcccaaagtgctgggattacaggcatgagccaccgtgcccggcctgtttgtttgtcttagaaacggtctcacgctgctgcccaggctggagtgcagtgacaccatcctagctcactgcagcctggaccagctaggctcaagcgatcctcctgccttagcctctcaagtagctgggactacaggtgtgcaccaccatgcctggcttttttttttttttttttttttttttttttttgagatggagtatcactctgtcgcccaggctagagtgcagtggcgcgatctcggctcactgcatcctccatctcctgggttcaagcaactctcctgcctcagcctcctgagtagctgggattacaggtgtgtgccaccacggctggctaatttttgtatttttagtagagatggggtttcaccatgttggccaggctggtctcaaactcctgacctcgtgatccacccacctcggcctcccgaagtactgggattacaggcatgagccaccgcgcctggcttttttttttaattttttaaatatttttgtagagacagagtctcactatgttgctcagactggtctcaaactcctgagctcaagtgaacctcctgtcttggcttcccaaagcgctgggatcataggtgtgagccaccacacccagccctcatggggcgtctaatagatgggtaggacagtgtaattctatgttgtagggataggaagtgggaaaattaacctcacttagaccagagcagtcacttccatcctagcccccagctcctgcccttggcccccaccatttgtccttctcactatggccagaggacacctgtgagcccccaagtcagggcccgtccctcctctgcgcacagccatccacggctcccacctctcttggggtaaaagcccaggtcctccctgtggcccacaaggccctgcacaacctgtcccatccctgccctgtcctcccctcctccctctctccccgtcgtccactcccagccacacagacctcctcgccgttcctccagtgcaccagacccagtcctgcctcagggccgctgcacattctgttacctctgtctaaacagccaactaactgctcgcttgttctctccagatctcccctggtctcagctcaaatgcccccttctcagagaggtctaccctaaaccccttcagcataagcagcctctggctaccctcaatctttttttttttttttttttgagacagagtcaggctctgtcgcccaggctagagtgcaatggcgcaatctcggctcactgccatccccgcctcctaggttcacgccattctcctgcctcagcctcccgagtagctgggactacaggcgcccaccaccacacccgggtaattttttgtacttttagtagagatggggtttcaccgtggtagccaggatggtctcgatctcctgaccctgtgatgcacccgcctcggcctcccaaagtgctgggattacaggcatgagccaccgcgcccagcctggctaccctcagtctcagccctctgttttctttccttcagaggaagttagtgattgcctatggatttgcttagttgtttagtgactgcacgggtgtctgctcatctccccagtggaatgtcacctcctccagggcagaggctttgtctgtctacatctctgttgtgccctcagggcttagaatggggcctgatgcagagtgggtgctcaataaatacttgtagaaagaaaagaaggagagagggagggatgaagcagagagaagaagacaagagaggatatatggggagaggaaggaggagagatgaaaaagaaggaaggggccaagtgcggtggctcacgcctgtaatcccagcactttgggaggccaaggcaggtggatcacctgaggtcaggagttcgagaccagcctgaccaacatggtgaaaccgtctctactaaaaatacaaaaattagtcgggcatgttggcacacacctataatcccagctagtcgggaggctgaggcaggagaatcgcttgaacccaggaggcagaggttgtggtgagccgagattgtgcaccctgggcgacacagcgagactctgtcaaaaaaaaaaaaaaaaaagaagaagaagaaagaaggaaagaaagaaagaaaagaaagagagagagaaaaagaagggccgggtgcgggggcttacgcctgtaatcccagcactttgggggactgaggtgggtggatcacctgaggtcaggagtttgagactagcctgatcaacatggagaaaccctgtctctactgaatatacaaaaattagccaggcgtggaggcacatgcctgtaatcccagctacccgagaggctgaggcaggagaattgcttgaacccgggagacagaggttgcagtgagctgagatcgcgccattgcactctagcctgggcaacaagagtaaaaactccgtctcaaaaaaaaaaaaaagaaaagaaaagaaaaagaaggaaggggccagggcgcagtggcttacacctgtaatcccagtactttgggaggccgagtcaggtggatgacctgaggtcaggagttcaagaccagcctggccaacatggcgaaaccccatctgtactaggaggacacgggaggctgacgcaggagaattgcttgaacccaggaggaggcggaggttgcagtgagccgagatcacgccactgcactccagcctgggggatagagtgagactgtctcaaaaaaaaaaaaggaaaggaaaagaaggaaggaagagaaagcgagtgggtgaggcgtccttcttggaaggaccggaacaggcatgcacagggaggctggaaggttctcggaggttcacaggcctgaggccactcctcactggcccccggtgactcctccgtctgtgacccgggtcctccgcggcctcctgtgatccccagacgcctctctccaagccagatgttggagggaggtgggggcagcggcgcttggcctggtcccctggggagcttgggcgtctggtagaggaaatcacgtcctcccagctcgccagggagtcccccagagatggagctgagcaggcgctgcacaaacaggaaaccccggtcgggggaggcggagggggcgtgctgacaccagctggccagctgggtcagcaggaaacggctctggccacttctcctggacactcgggggccaccgctctgtcctcttcagaatgcgtggccctgaacctcccagcgcggggcagggttggttcattgccttcactcagcaaatgactgtaacagggggccgggtgcggtggctcacgcctgcaatcccagcactttgggaggctgaagcgggaggatcgcttgagcccaggagttcaagaccagcctgggtaatatagcaagaccctatctctacccaaaaaaaaaatatacacacacacacacacacacacacacacacacacacactagccccaggagttcaagaccagcctgggtaatatagcaagaccctatctctaccccaaaaaaaaaaaaaaaaatatatacacacacacacacacacacacacacacacacacacacacactagccaaacacggaggtgcatgcctgtaatcccagctacttgggaggctgaggtgggaggatcgcctgagcccaggagtttgagaccagcctgggtaacatagcaagaccctatctctacaaaaagtaataataataatacaaaaattagccaagggtggtgatgcgtgcctgtagtcccagctacttgggaggctgaggcaggagcatcacttcagcccaggagttcgaggctgcagtgagctatgattgcaccgctgcactcgagcctgggcaacagagcaaaattctgtctctaaaaaagaaagattgtaacagggggactggcgggggtttgggtctgcagaactggacacagccctgagctccctgcagtccgtgctgccccctgggggccgggagaggaactgctcccaccgccacccaaaagccaagagcctgtcccacctccaaacctaccaggctccctggctctttccactccaaccctgctggcctgcaacttgccaagtgcatttctacccggaggcctttgcacgggctgttcccagtgccgggaacatcgtggccctcagggaggtgatgaaacatcatccccatcggagaagccaacagtcacggggcggttgccaggcgctgttctcggagctttgcagattttaacaagttccttcctcttatccagtctcatcttgaggtctgtaaaatgccaccatctcggtcaggctttctctgagccctgggtgtaaaatagcctccctccccaccctagctagttccccaccagccgcctgccttaccacaggctgatgcacctcgcatttgacttaatgagcttttaatttgtagtaaaatgtgcatgatgtacaatgcatcattttagccatttttaagtgtccaagtcaaagtgcactaagtacattcacctctatctaattccagaacctttctttttttttttttttacccccaggctggagtgcagtggcgcaatctcggctcactgcaacctccaccttcctggttcaagcaattctcatggctcagcctcccaagtagctgggatcataggcacatgccaccacacccggctaattttttgtattttcagtagagatggagtttcaccatgttggccaggctggtctcgaactcttgaccttaagtgattctcttgcctcagccttccaaagtgctgggattacagatgtgagccgccgagcctggcctaattccagaacatttcatcccccctaaaagaaaccccatccccatcagccaccactccctgtctcctctcccagccctggtgcccacgcatccccttcttgtctctgtggcttggcctgtcctggacatttcagtgaaatggctcatgcctgtaatcccagcactttgggaggccaaggtgggtggatcatgtggtcaggagttcgagaccagccggaccaagatggtgaaaccccgtctctattaaaaatccaaaatttagacaggcactgtggcaggtacttgtaatcccagctacttgggaggctgagacaggagaatcgcttgaacctgggaggcataggttgcagtgagccaagattgcgccactgcactccagcctgggcgacagagtgagactccgtctcaaaaaaaaaaaaaaagaaaagaaaaagaaagaaagaaatggcatcacacactgtgtggccttttgtctctggtgtccctcactgaatgatgtcctcaaggtgcatccatgttgtagcctgtgtcagagcctcgttcttttatttttatttatttactggttttgagatgaagtctcactctgatgcccaggctggagtgcaatgtcgcgatctcggcctgtagctgggactacaggtgcccgccaccatgcccggctaatttttgtatttttagtagagatggggtttcaccatgttggccaggctggtcttgaacccctgagctcaggtgatccacctgcctcagcctcccaaagtgctgggattacaggtgtgagctaccactactgcgcccagcccaaggcctcattctttttcttttccttcttcttttttttttttttttttttttttttgagacagggtcttgctctgtccccgaggctggagtgcagtggtgcaatcatagctcactgcagcctcaacctccagggctcgagctatcctcccgcctcggcctcccaagtagctgggactacaggtgtgcaccaccacgcccagctaatttttgtactttttgtagggatggggtttcgccatgttgcccagtcccgtctcaaactctggggctcaagtgatccacctgcctcagcttcccaaagtgctgggactataggcacaagccaccatacccagctaattttcgtattttttgtagacacagggtttcgccatgttgcccgggctgatctcaaactcctgagctcacgagatccacccacctcagcttcccaaagtgccgggattacaggcatgagccaccacgcccggcatccttttcacggctgagtcctattccagtgtgtggctagaccacgctgtgtttatctcttcatcttttgaagggacatttgggtggctttccagtttgagctgtggtgaacagtgctgctaggaacattcgtggacttttgctgacctattaatcttggctgctgtctgtcgctcacactggactttgagtctcacaggggcaactgcttcagcctgtatcatctcctgctgtgccggggcccagctcagaatcagacactgtggatgcttagtaaacgcctgttgagtccatgaatccctcctacaagggcgtccgagggcaggacagggctgtccccaagctgtctgaggttggccaaggctcccgacctctcggggacaacttcgatttccaaatctgtgaaatgggtccaaaccactccagtcgagaggacagtctcccttcctttaatattaggtaggagcaatgctggggacactgagggttttaactgcggcttgtgggcctcccattcaaccccccattttaactgacccattgctgggtgccaagctctggtctaggcacgaaggacactgcagggtcggggcagacagacatccctgcccacacggacctcccagtctgaaggggagaagaacaagaagccagagtatctcgaagggtgacagtgtgtaaagcaagccagctgcccctcccaggcagttggatacagatctcacgacaaccccgatgatgggattgatggtttcacttttgcaattagggaaacttggaggctgagagagggaaagtgacctgccccagatcacacaccgaggcaggtgatggagccgatgtgagcccaggcctccgctttccgctcttttttttttttttttttgagatggagtcttgctctgttgcccaggctggatggagtgcagtggcgcaatctcggctcactgcaagctccacctctcgggttcacaccattctcctgcctcagcctcccaggtagctgggactacaggcgcctgccaccacgcccggctaatttttgtatttttaggagacagggtttcactgtgttagccaggatggtctccatctcctgacctgtgatcctcccgcctcggcctcccaaagtgctgggattacagacgtgagccaccgcacccggctccactcgttttttaagagagggtgtcgccctgtttcccaggctggagtgcagtggcacaacaatggttcattgcggcctccacctcccaggctcaagtgatcctccagcctcagcctcctgagtagctgggactacaggcacggaccacaacacctggctaattttaacactttttgtagagatggggtctcgctgtgttccccaggctggtcttgaagtcctgagctcaagcgttcctcctgcctcggcctcccacagtgctgggattacaggcatgagccactgcgcccggcctgctgttcacttgaatgcagcattccacagcatgggggaacccggatgaaggctgtgtgaaggcccacactggacaaggaccccccacggggccttccccatcagactggagctgtcattcccccacagcacaggatggacagggggaacgtccaggctcgggccagcccccaggagtccaggcagccctggagtgtggggaagggaaacaggcccagctcagcctactgaccccgctgtcttcctgttccagacacgaccgacttccaggagagctttgtcacctccggcgtgttcagcgtcactgagctcatccaagtgtcccggagtgagtgttcccgtcagccctgagctgggtcttggagaggggagggggccgcagggaggaaggagcccacccccctcaccctactccttgtcctttccagacaacccctgtgtcactaagccaaggttcctagaaagggaggtggccaggcccttcccagagcccaaggtcagggctccctcccacctctccaggaaacagaatctaaatgctggatggcaactaaggaaacttctgccccagcatccctcctcctccctggggcctccactgtcctgtcccaggagaccccaaaggaccccgcccctcctgtccccttgctttctctgctgacctgctggggacccagcacattccgtcacacactgtctgaatcccaccccagcgagtcctgggcgctgtccttctttagccctgactgacaccttccctgtccagatcagcagagcctggcctccagctttggctacacctctgcctcacagtgtgctcttggcctctccccatggccttggtcctctgatccatagaataaaactggtttcagccaccctaggaaccgggccaatatgggaagggggtccccctttggactgcacccagtggctttccctacctctctaaagcaaaccgcagcactgggcactgcttcctgcctcactctcctctgtcaccctctgcagcacccgtggtgactggaacaggacccaacttctccctgggggagctgcaggggcacctggcatacgacctgaacccagccagcactggcctcagaagaacgctgcccagcacctcctccagtgggtaagtacccaggtccccacctctgggcatttcatgaccccattcatcaacccatcccctctggcccgagctgactcattcctctccctggaatacctcttttcacgattcacctggcctgagaaactcctactcatctcatccttcaaaacccagccagccccacgtgcctcttcccctagccctgacagcccaccgtgggctcccccagcctcaagtcctgccggctcagccagcccttaggaccctccccacccagaagaatgcagacacaggttgttgctgagatatgctttgtgacctcgagcaggtcacactgtgtgtgccccagtttccccatccataaaatgggatcatacccctaacaggcagttctgaggactacaggtggccaggagattagccaggctgcctgggttttggtctccaccatgctagcttggtgtccgacctgtgttgagaccctccctgcctctggcccgggtgtcccatccaagcaatggacaggttggaacaggcgttcgtagggaacgggctgaacgcccgcggctcccgcgatgtctcgcgatactacctccctcgcccccgctcacttaaggaccggaagtagcaaagcccgccgtcgcgccccccgccccgcgtctccctggtaaccagcctctccccttccctcgcccataaggagcaagcggcacaaatcgggctcgatggaggaagacgtggacacgagccctggcggcgattactacacttcgcccagctcgcccacgagtagcagccgcaactggacggaggacatggaaggaggtagggctggtggcgggggcggagccggccttccggtctgagtcaccgcggcgggaactacgtcttccggcagccactgcgcgggcgccgcggggcaggaagccggcctggagccgcggggcctcctgggaattgtagtcgtcccgagctgcgcttggctggaagtacggtccgggttcgcgttctcggatctctttggttccgctgcggcgaaggagggcagagactgtcccctgcctgactctcctgccctccggccgtgaatgccacatctctgtggggtccccgagctgcaggatggactcagtagtgactctgatcaacagggcgcctcttcctgggatctgtcatagaatccctcgtctgtagggaccctgtttgtcctcttcccctctagaaggtcctgagatgccggatcccttctcattggggtccttcttgaggttacttttttttttaaccaggttcccatctccatgggatcttctggttctgcaggagactcgtctcctttctgtagggtctccattcccatggcgtcgttttctaggaagattttatcctcttgcttttctgtcttcagaagggtcctctctggggtgtctttctttctttctttctttctttcttttttttgagatggagtttcgctcttgttgcccaggctggagtgcaatggcgcgatctccgctcactgcagcctccacctccctggttcaagcaattgtcctacctcagcctcccaagtaactgggattacaggcatgcaccaccatgcccggctaattttttctatttttagtacagacggggtttcaccatgttggtcaggctggtctcaaactcccgacctcaggtgattcgcccgcctcggcctcccaaagttctgggattacaggcgtgagccaccacgcccggcctctgtttttgtttgtttgtttgtttgtttgtttttgaaacggagtctcggtctgctgcccaggctggagtgccggggtgcaatcttggctcactgcagcctcgacctcccaggttcaagtgatcctcctgcctcagcctcccaagtatcggactgcaggtgcatactgccatgcgccgttaatttttttttttttttttttttttttttggtagagatggggtctcactatgttgcctaagctggtcttgaactcctgagttcaagtgtgatctttcctcctgcctcgtcctcccaaagtgctgggattccaggtgtgagccaccatgccgggcccctcttatttttttttaatttttgttttttgagatggagtcttgctctgtcacccaggctggagtgcagtggcgagatcttggctcactgcaacccttcctcctgagttcaagcaattctcctgcctcagcctcccaagtagctgggattacaggcacccaccaccacacccggctaatctttatatttttagtagagacagtgtttcaccatgttggccagtctggtctcaaactcctgacctcaggtgatccacccacctcggcctcccaaagtgctgggatgacaggtgtgagccactgctcccggccacctgtaggatttttagaagcagtataacattaggattaagaggtcagattcaggcattggagagacctgggttcagatcccagccctgcccgtgtctagctctgtgtgctgtgtaacctggggcacatcacttaacttctctaagcctcagtttcttcatctccacaatgggggtgatgtgaataatgttctttgggagctacaggaggaggaagggtaggatgtgcgtgaagcaaccgtctggcccatgcgacatacccgggaaacgggaggtcactgtcatccacgtctttataacattcctgtctctgaccaggctcggtggctcacgcctgtaatcccagcactttgggaggccgaggcaggcggatcacgaggtcaggagatcgagaccatcccggctaacacagtgaaaccccgtctctactaaaaatacaaaaaaaatagccgggcgtggcggcgggtgcctgtagtcccagctactcaggaggctgaggcaggagaatggcatgaacccgggaggcggagcttgcagtgagctgagatggcgccactgcactccagcctgggtgacagagcgagactccgtctcaaaaaaaaaaaaaaattcctgtctctttccggcactcggacgcatctagttgtgacatttcaggtgccaaggcccctcccttccacagtgtgggctcccagagcaggaacattcctaaagggtctccatccctcaggggacctgtctcagtatttatgaggttctttttttgtttgtttgttgtttttgttttgagatggagtcttgcttgttttgagagatcacgccagtgcacgccagcctgggcaacagaacgagactatgtctcaaaaaaaaaaaaagaaaaaaaaagtcacttctgtttcgttttttttgttttttgttttttgttttttttttgagacggagtttcgctcttatcacccaggctggagtgcagtggtgcaatctcggctccacctcctgggttcaagtgattctcctgcctcagcctcccgagtagctgggactacaggcgggcaccaccacaaccagctaatttttgtatttttagtagagacggtttttactatgttggccaggctggtcttgaactcctgacctcaagtgatccgccaacctcaagtgatccgcccatctcagcctcccaaagtgctggcattacaggtgtgagccaccgcacccagccgtgacttctcattaactctgtaattgatgaggctgtcagaatgtaaactgcacgctaattaaagtgaaagaccacctttgcgatgagccaaagcaaccctgagaggaaaaattgtagctttaagtctatttattaggagaggagaaaggtggaaaataaagaatctagctttcaacagagaaaactcaaaaagaaaacattttaagctctggagctcagtctgacttttctgcccggctgctcactggcaaccccttccactggggaaggaggtggtagcaatggcggggacaaagaggaagcccccaccagcttctgctctgtgattgggaatcgcagagctagcagggaatgtcagaggaggtctgtgctcctgcagcttccacttgattacctcaggggatggcaaactcactccctcctgagggtttctttttttttttttttttttctttttgagacagagtctcgctctgtcgcccaggctggagtgcagtggcgccatctcagctcactgcaagctccgcttcccgggttcacgccattctcctgcctcagcctcccgagtagctgggactacaggcacccactaccacgcccggctaattttttctattttcagtagagacggggtttcaccgtgttagccaggatggtctcgatctcctgacctcgtgatccgcccatctcggcctcccaaagtgctgggattacaggcgtgagccaccgcacccggcctcctcctgagggtttcatcctcagtgtaaagccctcctgtgtgctggccctacctgaggccctggggacacagagatgatccaacccactcttgtccctaccttccaggggctaacagcctagtgagggagatgggtttttatccaggtgactacagcccagaggaggaggcacagaagacagtcagggggaacaagaggaccctgatagaacttggaagaaaagggaggacctccccgaggaggagaatcaggctgacagagcagtgaggagctcgggcaactggcttctctgcttctccagctgtgtgacatttggcaggttccttaacctctctgcccctcaatttcctctgctatacgatcaggttgctggccgggtgcagtggcttacaactgtaatcctagcaatatggcaagaccccatctctacttaaaaaaaaaaaaaaaatagcatcacatagtggtgtacacctgtagtcccagctccttgggaggctgaggtgagaggattgcttaagacgggaggtcaaagctgccctgagctatgatcataccactgcactccatccggggcaacagagaaagaccctgtctcaaaaaaaaaaaaaaaaaaaaaaaaaaaaaaaaaaaaaaaaaaggctcacctgtaatcccagcactttgggaggccgaggcaggcggatcacctgaggtcaggagttcgagaccagcctggccaacagggtgaaaccccatcattactaaaaacacaaaattagccgggtgtggtggtgggcacctgtaatcccagctactcgggaggctgaggcaggagaatcacttgaacctgggaggcggagggtgcagtgagccgagattgtgccattacactccagcctgggcaacaagagcgaaactccatctcaaaaaactctgccttgatatcccagtgaagagaaaacactggaagaatttttttttttttttttttgtcagagtcttgctctgtcgcccaggctggagtgcagtggtgtgatctcggctcactgcaagctccgcctcccgggttcatgccattctcctgcctcagcctcccgaatagctgggactacaggcacccaccaccatgcccggctaattttttgtatttttagtagagacggggtttcaccgtgttagccaggatggtctcgatctcctgacttcgtgatctgcccgcctcggcctcccaaagtgctgggattacaggcgtgagccaccgcgcccggccaaacactggaagaattttaacacccgtggcccagggctggactttacgtaaagcacgcacctggggcgtgagagccgggtttattattaattcgcggctaagctacaaccgggatgatttaagtggatttatccgcagggaagatgatgggagggcattcccagcagggagaatcgtggtttgaggagttgcactgtggatgtttggggccagaccatcctctggggcggggctgtcttgggcactgttgggtgctgtgcagagttcatggcctccacccactccgtgtcaggagcaccccccagtggtgacaaccgtaaatgtccccagacctggccaaatgtctcttgcgggcagaatctcccctataatatagccagaggcatatgcaaagcacctaaacggagtggggagaaggtgcgtgacccctggtctgggccactcttttttttttttttgagacggaatctctctctgtcgctcgcccaggctggggtgcaatgcgcgatcttgactcactgcaagctctgcctcccaggttcaagcgattctcgtgcctcagcctcccgaatagctaggattacaggtgcccgccaccacggctggctaatttttgtatttttagcggaggcgggttttcaccatgttggccagtctggtctggaactcctgacctcaggagttccaccacacccggctaattttgtgtttttagtaatgatggggtttcaccctgttggccaggctgctctcgaactcctgacctcaggtgatccacccgcctcggcctcccaaagtgctgggattacaggcgtgagccactgcgcctggccttttttgttttgttttgttttgtttttcccaaatagtgacttgctctgtcgcccaggatggagtgcagtggtgcgatcagcgcccactgggctcatgccatcctccttcctcagcctcccaagtagctgggactatgggcacttgccaacacacctggctattttttgtactttttgtagagacagagttccctgtgttgcccaggctggtcttaaactcctgggctcatcctcctgcctctgcttcccacagtgttgggatggcaggtgtgagccaccacacccggctggccgctttttctctatgtcccttcccaacattttagtcccagacagccctgcggaggtgcctggcaggcacctcattttgcagagggaaaccctgaggctcaaagaggtgacatcacctgctccaggtcaccccagcggcaagcgggtgcacagggacacggaaccacgtggccgttcccagcggccccactcagggtacctcgctctctttgttttatggggcatctgtgatgtcctaagccgggttatttcccctcccggcaacactctgtgagatcagggctgcccctggccatcagttgacaagtggggaaactgaggcccaaaggtcccacagcaaagaaggggcagagccccgagcttatgcccagtgcttcctgggcctctccccatcgctgtggcctgcatcggtaaacatttcgcagcctctgaagtcccaagggggacgcctcagaacaggcctggcccctgggctggagcagggttcctgaggttcccagtggggcccagctgtaacctcattggtggaccgaggcaagggccagaggggcccaagggaagggccagaggggccgggggcacaggaagggccggaggggctgggggcacggggagggccaggcttattgttgcagcctgcaaggctgtcccaagccgggtgcctccgcagagggaggacacaaaacaggaacccaggcaggcagggtctctcccgaaggtgcccttggcccctggccaccaccctgggatgctcctcctcctcctcggcatcctccccccacccttccctgccctttccagcttcctgtctagacagcccccaattagccactcattaagggggttaagctgattagagcagctctcccttcctctggcggactcggggccttttctcccgggcagtgctcagccagtccccaaccctgaggctcacagaggcctggggggatcatgccagcccgatgccaggcaagacccccaccccacacctccaggccccacattccagcctctaggctttgcccgcttggggcctgggccaggccctttctcctggccgcctccacccgaggcctccctgcttacgcggctgcgtggggtggagggaaggtgccttggagcagcccccactgtgctttgtttttgctgcttgtgtagctcccccttgaaggcgacaaaggtcccgtccacaggcggttattacacagggcggggcaggcagcccccatccattcctctcctctgtcaccccaggcttcccatcccttttttttttttttttttttgagtcagaatctcactctgttgcccaggctggagtgcagtggcatgatctcggctcactgcagcctctgccttccagattcaagcaattcttctgcttcagcctcgcaaatagctgggactgggactacaggcgcctgccaccatgaccagctaatttgtgtatttttagtagagatggagtttcaccatgttggccaggctggtctcaaactcctgacctcaagtgatccgcccgcctcggcctcccacagtgctaggatgacaggtgtgagccaccgagcccagcccgcccatccctttttttaaccccagggtggaggctagtgcaacgtggcctggggagggacagagttgggttccaactccacctccacccccccttggctctatggccttaggcgagtgacgtcccccatcaggcctcagcctccacatctgtgaaatgggcgcagctcctgtaagctctgcacggggcagctgtgaggaccacattaagagaggaggctagtgccttcacagaaggtcctcacccagggcgatgctgccccacccccagggacactggccggtgtctagggacatctgtggttgtcacaactgggagagctcttgacatggagtgggtcgaggccagggatgctgcttagcaccctgcagtgcccaggacagcccctccccagggaacgagccagccccaatgtctacagtgctgaggctgagaaacctgtattaattatgtagaaaaaaattgaggctgagtgtggtggctcacacctgtaatcccagcactttgggaggccaaggctggaggatcgcttgagcctagtagtttgataacatagggaaaccctgtctctacaaaaaaataccaaattagctgcatgtggtggcgtgtgcctgtagtcccagctactcgagaggctgaggttgggaggatcgcttgagcccaggaggtcaaggctgcagtaagctatgattgcaccactgcactccagtctgggcaacagagtgagaccctatctcaaaaaaaaaaaaagaaaaagaaaaaagtctgccccctgctcacaacggattaaactcctagtgtggcagacggtgtgtaaaccagggggacccccagctcctgggactcacctcctctctccctccccactcaaggtgtggatttcaatgtgtgcagcctcctgggacctctgcagggcagaggatcatgggacgcagaggatcatgggacgcagagtctcttgggggtccatggaatcctctaagacagaggattttacctatgggtgatcctgaccccagaggacactgggtgacatctggggacctgtgtggttgtcacgactgcagggtggtcctggcatggattgggtccagggacaccgcttagcaccctgcagtgctcaggatggccccaccctagagaatgatccggtcccaaatgtccacagggcccagaggagaccttggtgcactgtcaacgccccgtggtcactgctgtcctcatcagattcatgccctgcatcggggcctctgtccactccacacactctgtgtagggcccctcctgaccccggaccctagagacccagccagagtgggccttggccccctgggggagccggcatttcagtgggagatgggcttgtttgttgagcaaacaaatggctgctccgacggggtgatgagggccttttgtcaaatacaaagaggaggtcagatgggcgtgtgtgacaaatggctgctccgacggggtgatgagggccttttgtcaaatagaggaggtcagatgggcgtgtgtgacaaatggctgctccgtcggggtgatgagggccttttgtcaaatacagagaggaggtcagatgggcgtgtgtgttaaacagacaggaagaagctctgatgggggagccctcgggcctgcgtcctcctcacagtcaatattctcagatggggcattcaggatgccgggaggggcgtatggatgtgttccctgagaggaaagatggccactgagatgggcgggggacgcacatgcccgctggctgaacagggaggtcccacaggggtcccaggcatgcctgctgaacagacagaggatgcttggaggcggggtgcagagtcagtgtccgtagagcctgccgggagcatgccggcttattctttctcgcggtgcctgagctgcgctcccccctccttcctgccctgccctggctgccgctggccccatctcaggaagctctagcggtgcctgcagggatgtggcggccgggggtggagtctgagccagactatttccatccaggacaagcggttctaggaaatcctcctaaatgagcgtctgacaaccctaacctcgttcccgccgtggccctgcgcttgcagggagctgccagcccctgcacacacacacacacgcttgcacacacgcatgcatgctcatacatatatgcacgcacgtgcacaggcgtgcacacatgtatgcatgcatgcttgcagacctgtacgtgtgcgtgcaagcacacatacatagacatgaacatgcatgtgcaggcatacacatacatgcatatattcacgtgcacacgcatgtgcgcattcacacacatagacacgtgcacaggcatacacatacacagatatgaacgtgcatgtacaggcatacatatgcaggcgtgcacacgtccacatatgctcacatgcgtacacacacatgcacagacatgcacacatgcatgcagctgtgcacatgcgtgcaggcatacacacatacatgcacgcacacacatgcatgtattcacatgcacacacacacgtgcacaggcatacacatgcacacacacgtgccgacaagaccagcctggcctccccggctccaggccaccctcattcctgccacatcctcctgccctggaaaagcccgggcctggctgctggggcccagcttggtcacagacttcatggcatcccactgggcagtggggcctctctgggtggctcagcctcgatgtccgaggcctcaggagtgttcccccttgagtgttcacaggctgggcatgagtggaggtgtcatccttcctgccccccatgtgggtgtcctgggtgcccgcctcctccagagccgggtgttcccgggtccctgggaactgctgacctgcttctggggtgtgtcccagtgacaccttcactcctcacagcatggtgtgtgcagggccatggggacagctggttccataaccacaaaagcagatgaagagctgcatgtccccccacagctgggtcctggatctgggctccccctgggctgcagccatcagagaggacggaagttccctgagtggtaaccccgttcagggaaggatgcagcgatgctgggaggatggaggaggtggggacaggactggggagggcctgtaccacacagatgcctgcaggtgcctatggaaccaccagcaggagacccaagacacggtgacatcctcaccgtttctcatcagggcatcacccggggacagcaggtcacatctggggacatccgtggttgtccccactgaggggcgctcttggcacggagtgggtggaggccaggggtgctgctcagcgccctgcagtgcccaggacagctccctacagagaccgatctggcccccacatcagcagtgctgagactgagaaatcctgcgtgaattatttggaaaatattgagttatgtcactgctcacaccagacaccagaagaagctcctgacagggcagacggtagaaaccagggggaccccagctcctgggattcacctcctctctccctcctcactccgtgtggatttcagtgtgtgcagcctcctgggaccacagcagggcagaggatcatgggacatagtctcgtggagggtccatgggatcccctaacccagagggtctcacccacacgtgattcttgcccagggtacttttggtgatgtctggggacatctgtggttgttacaaccgggggtgctcctggcatgaagtgggtggtggccagggactctgctcagcaccctgcagtgcccaggagggccccaccccagagaatgatccagccccagtgtccacagtgcctgtctgagagaccctggaggtaaggaactccaagggccaggtcgaagggaagctaaactcatcaccctgtttggatggtctcagtagatatgttttaccttaaaagaaatgtaaaaatcctttctaaaaattcggctccccagggcacgcctccctgagattccatttccagggatagggtagggcccaggacactgcatttctcaggcaagatgtgatccttagccctcacttgaaaaagcttctctggggccaggcactgtggctcacgcctgtaatcccagcactttgagagaccaaggcaagaggatcccttgagcccaggagtttgagaccagcctgggcaacatagcaagaccccatctctaaaaaaaaaattgcctggacatgatggtgcatgcctgtggtcccacctacctgggaggctgaggtgggaggatcacttaagcccaggaggttgaggctgcagtgagccatgatcgtgcctctgcactctagcctgggtgacaaataactcggctgggtgcagtggctcacgcctataatcccagcactttgggaggccgaggtgggtggatcacctgaggccaggagtttgagaccagcctggccaacatggtgaaaccccatctctactaaaaatacaaaaatgacccgggcgtggtggtgggcgcctgtaatcccagctactcgggaggctgaggcagtagaatcgcttgaacctgggaggcggaggttgcagcgagccgagatcacgccattgcactccagccagggcgacagagggagactctatctcaaaaaaaaaaaaaaaaaaaagacacagccccagaaggccaggcatttcggctccagagctgggactccaccccagcctcctggaaatacccaaaatggccctctttggggctctgtgttcccacttcattttgaagacagggtgaaagtgtcaaggggcaccgtgtcatctccccactcaccccaaatagcagcagcagcggctcctgcagtagctaacattcttccagctgggtggctgacgttccctcggaaagcagggctgaaggcatcctcagagaatgccccgatgcccagggatctgggacggccatgggcttcacctgcacaggcacccctggcccaatcctcacagctgccactcccacactgctcccgatggaaattccagagctttacagaatcccctgttttatgaaaaggggtagacgtggcagctcaccccaggtcgcacagcctcatggccagccggggtttgaaccctggaccacctgcttcccccacacccaggggctttccagggggtgcctggagggggagggaagccgatgtttggtgggtgagcctccctgagtccatccgttttttgtttgtttgtttacttgcttgtttgtttttgagacagtttcacagtttcattcttgttgcctgggctggagtgcaatggcgtgatctcggcccactgcaacctctgccgcctgggttcaagcgattctcctgcctcagcctcccaagtagctgggattacaggcgtgagcccctgcacccgactatccatctgttttttgtgtttgtgatggagtcttgctctgtagccctggctggagtgtagtggcgtgatctcagctcactgcaacctctgcctcctgggttcaagcgattctcctgcctcagcctcccaagtagctgggattacaggcacccgccaccacacccacctaatttttgtatttttagtggagacagggtttcaccatgttggccaggctggtcttgaactcctggcctcaagtgatctgcccacctcagcctcccaaagcactgggattacaggcatgagccactgtgcctggcctctgtttcttcattcattgattcactgaggaaggtgtgaggggctgagctgctgagttgggggctgtgggggcttttgtcccaggcagcctgggaggtagtgaggcccctgtctgcagagtgatgccagcaagtcactgcagaggggggatgcacctcatttcagccccagggaggctccgttccttcctcccgcgtggacgagggaaggcagagctgagctggggcttgtctgtgcgcccttagccagtcagggtctaactggacttcggatctgactgtctctgccctccctgccaccttctctagggctcgggtgactcccaggtgatggggcagccctgagccttcccatttctctggaaggagagtaggcaagggccaggagcgaggcccaggggcacgtgttgatacccagctctccatcccccggctgtgccgccctggctagccccttctctgctctgagccttcgtttactcctctgtgtaatgggctcacagcctctccccctcaggattctggggtaagaggaggcggggtgatgaggcttcctatcccttcggaggctggctttggggaaggtccagggctcatggggtgtgaccagcctgtgactctctcgtcccatcccctccacaggcatctcgtccccggtgaagaagacagagatggacaagtcaccattcaacagcccgtccccccaggactctccccgcctctccagcttcacccagcaccaccggcccgtcatcgccgtgcacagcggtaagcgccacgggcccctggcggggaggggcggcgggccctcctatcaggcctctcacagccggggaagtcccactggatgtctgaccatgagtcctattgctgtagccttctaggtgggcaaaaaaccatagaggtgccgtagtggagagcgcccagggccttgttccagcccggctgagaggttggactcagtccctttgggcctcagtttcccccctgtataacaaaaggctgcaacctaacttcacctcactcccctcacccccgtctcaatctaatccccccattccaaccccagacactgatggacaggcaggatcagaagctgccaatgaggccaggcacagtggctcacacctgtaatcccggcactttgggaggctgaggcgggtggatcatctgaggtcaggagtttgagaccagcctggccaacatggtgaaaccccatctctactaaaaatacaaaaattagccaggcgtggtggcacgcacctgtagtcccagctactggggaggctgaggcaggagaattgcttgaacccgggaggtagaagttgcagtgagcagagatcacaccactgcactccagcctgggcaacagagtaagattccatctcaaaaaaaaaaaaaaaagctaggcttggtggctcatgcctgtaattctagcactttgagaggccgaggcaggcagatcacaaggtcaggagttcaagaccagcctggccaacatggtgaaaccccttgtctactaaaaatacaaaaattagccgagtgtggtggtatgcgcctgtagtcccagctacttgggaggctgaggcaggagaatcgcttgaacccaggaggcagaggttgcggtgaggcgagttcacgccattgcactccaacctgggcgacagagcaagaccctgtctccaaaaaaaggctaagtgcaagtggctcacgcctgtaatcccagcactttgggatttcaaggcgggcggattacgaggtcaggagattgagaccatcctggctaacatggtgaaaccccgtctctactaaaaatacaaaaaattatccgggcgtggtggcaggcgcctgtagtcccagctacttgggaggctgaggcaggagaatggcgtgaacccgggaggcggagcttgcagtgagccaagatcgtgccagtgcactccagcctgggtgacagagcgagactccatctcaaaaaaaaaaaaagagacatctccatctcggccaggcacagtggttcacacctgtaatcccagcactttgggaggccgaggcaggcggatcacctgaggtcaggagttcaagaccagcctggacaacatggtgaaatctcgtttctactaaaatacaaaaattagctcggtgtggtgatgcatgcctgtgatcccagctactcaggaggctgaggcacaagaatttcttgaacccgggaggcggaggctgcagtgagccaagattgtgccattgcactccagcctgggcaacagagcaagactccatctcaaaaaaaaacaaaacagaacaaacaaaaaatcaccttccatggttgccattgggattaaggggggtgaattgtaggaagcctcaaatattgcttaccaccccatgttctagtgatcaactatttagttctttacacagtcatgcacacagagaggcagtcccaaatcaaagcagccatttgggccaggggtcagcaaacgctggccccctggttgcctgttcttacgaataaagttttattggcaaacagccacgaccacgtctttgtatatgtcctgtggcagctctcaccctgtcttggcagggctgagtaattacagcagagaccacgtggccaaaagccaaaaatatttactatctggccagaggctgtggagatgagggagtgactgctataaatagtgaaaatactaaaaatcactgaactgtttagaaagaggaaaaggcaggcaccacaatagaatatgactcagccatgaaaacgcacgaggctctgacgcaggccaccttgaggacgtcatgctcagtaagagaagccagacaaaaaggccacacagcatgtgatctcatttctatgaaatgtccaggacagggccagccacagaggcaggaaggggatgtatgggtgctggggctgggggaggaggtgaggagtgacggctgatggagacggaatttctttatgtgctggaattaggccgggcacagtggctcatgcctgcaatcccagcactttgggaggctgaggtgggtggattgcttgagtccaggagtttgagaccagcttgggcaacatgatgaaaccccatctctactaaaaatacaaaaaattaaccaggcgtggtggcacacgccggcagtccgtgctactcaggccgaggcaggaggatcacctgaggtcaggaggtcaaggctgtagtgagccatgatcatgcccctgcactccagcctgggtgacaaagcgagattctatctcttaaaaaaaaaaaaaaaagatcactattcagccatttgcagaaagagcttgccaaccctagatttatagtgtagactgtggggccagatgggctgggttcaaattcccggtctgccatctgatgccgtgtggccccaggcaggtgacacatcccctgaaggccaccctgtcatcctctgtttaaaaaaaaaaaaaaaaaagacggggccaggtgcagtggctcacgcctgcaatcccagctctttgggaggccaaagtgggcggatcacctgaggtcaggagttcaagaccagcctggccaacatggcgaaaccccatctctactaaaaatacaaaagttagccaggcatggcggcgtgcacttgtaatcccagctactcgggaggctgaggcagaattgcttgaacccaggaggtggaggttgcagtgagctgaggtcataccactgcactccagcctgggtgactgtctcaaaaaaaaaaaaaaaaaaaaaagaccaggctcagtgggttacacctgtaatccccgcactttgggaggcctaggagggaggatcgcttgagcccaggagttcgagacctgcctgggcaacatagcaagacccccacctctacaaaactaaaaaattaaattaaaacacaaggataatatcacagccccagtggggttgccgtgggagtcggggaatttgggtgtcaatgtggtcagtgctgctgggtttttttggtggttattgttactaaacgcactgagatgccggcaggaatgacacccacagacacacagtcacacggtcacagagcagaccggctggagcccccaagtaacccccgcttcccactgtctccgcagggatcgcccggagcccacacccgtcctccgctctgcatttccctacgacgtccatcctaccccagacggcctccacctacttcccccacacggccatccgctacccacctcatctcaacccccaggacccgctcaaagatcttgtctcgctggcctgcgacccagccagccagcaacctggaccggtgagttgggcggggcgcgttcgggcctctcctggcggctccaggtgacctcccgggggccacgtgctcacacgaaggcacaacctctgcttaaaagggtcttgaggacttggctctgaagtcccctcctctgtcgtgctgggaggcagctggattgggtcagaattgagatgctttcggatgtcagggtttcgggcgcatcatgtcgcaccctgtggggtctgggtagcacccgtaggtcccagcaactgcgtgagtcgtactcatgttaacacaaggcagggagggactgggcatagcggctcatgcctgtgatcccagcgctttcggaggccaaggcgggaggattgcataagcccagagttcaagaccaacctgggcagcatagcgtgacccagtttctacaaaaaaaatacttaaaaatgagccacgcatggtggcgggcgcctgtagtcccagctactcaggaggctgaggtgggaggatcgcttgaacctgggaggtcgaggctgctgtgagctgtgattgtgccactgcaccccagcctgggtgacagaacgagaccctgtctcaaaaagaaaaaaaaggttggggggcggggggcaggaagacattgattacaaaaaaaccaccaaactcagttcgagcaagacagcgtttgccagactccacaggaagctttggatgttcagagcttttcggactttggaaccacgggccaggccgtggatgatggtggatgatggcgtgctcgcagtgaattaggaaaaacgcggagaacctgctgttaggaggcggtggcactgtttggaaggaaatcagtcgagttggcgtgcagggggtttacagaggagatgcagtgagcgtggccccagtagtgccgggctttgagtgacaccagcaagcgggtgtccccaggcccctccacctccggccgtcctcagacccaccaaacccgccatggtcacacccgcgccctggccccccagcctgccaccccgtccgggccgtgcacagagccgggggcggccggcgccagcagcccgaggtagagggggagcccaccccttaaccacgtgtctctctgttcccccagttaaatggaagtggtcagctcaaaatgcccagccactgcctttctgctcagatgctggcacctccgcccccggggctgccacggctggcgctcccccctgccaccaaacccgccaccacctccgagggaggagccacgtcgccgacctcgccttgtaagcacgcgggaagcggtgccctggtggggcggatgtccgcaggggggcctgtcccctccccagccccactgccaggtcagaggtcaggcccgaccctgcagggcctggcgagtttggtgggtctccggaaaacagcccagtggccacgtggttgggcccatgtagggctgaggcagccttaggggctggccggaccaagcctcgggccagggtgagagtccagggtctgtccccttcgccgagtcacctgggggaccccggtgcccgccgtgggccgtcagaaaccctccctggtatgtcaggcagctgacagtggacacggatctcacagtggcggcccgagggccagactcgacccccagactggtcttttgtttgtggagaaagagaatcggttgttatcattttaaaatcaggacgttttacataaacatttccagagttctggcttcttggggagaaaggagctacaccaggcccagttcctttgggtgacctgggctggaccacacctttagatgggactctcttcgcctgtccacctgacctggaagcccctgggttggcggctgctgcaccttctagatttttctgctctctggatgtggttctgggtggctgctggatggcccctcggtcctggcatccctgtcctgaggtccaccccattcgtccgcagtggctctacccccagactctccccacgacccccatgcaggcttgggtgggtcacccaccctcacagggcgccagacatctctgaacccagagacctctccccatggactccatctgcccctcacccccctttttgagcatctctgtccctcactctccaaatgagaccccccaccccacccaagcagttggtggccacggttccttctaggtgccctcagctcctcttctccctgccccggcgttcctgtccccgtccccactgcgtgccagaacccaggctgcctgcccataaaaaccggcttctgatcactggctggaggagatcagccccaaatccaccctgggctggaatcccacctctgcagctctctcactgtgtgacctcaggcaggtgtcttcccctctctgagcctcagttttctcagctgcaaagtgggtttgccttggtgcccaattcacagggcagtgggggacaagccggtgacatgggtcagggaggcagagaggacattccatgtggcgcctgatgctgcgtggtgtcaggcagctgtggtcattcttgccggctgtccctgcctgctcatctgtgaaatgggagcgttgactgcataggatccagtcagggctcagtgggatcatgcccagagcctggtattcagtagacacttaataaatgcaggatactgcgtgggatccactcagggctcgatgggattatgcccagagcctggcatacagtagacacttaatagatgcaggatactgtgtaggatccactcagggctcggtgggattatgcccagtgcctggcatacagtagacacttaatagatgcaggatactgcgtaggatccactcagggctcggtgggattatgcccagagcctggcatacagtagacacttaataggtgcaggatactgtgtaggatccactcagggctcagtgggattatgcccagagcctggtatacaatagacacttaatagatgcaggatactgcttaggatccactcagggctcgatgagattatgcccagagcctggtttacagtagacacttaatagatgcaggatgctgcttaggatccactcagggctcggtgggattatgcccagagcctggtatacagtagacacttaatagatgcaggatgctgcttagtatccactcagggctcaacgggattatgcccagtgcctggcatacagtacacacttaataaatgcaggataggcatggattccacccccctttccctgcaccggggctcttaactgcaaatctactcctacttctccccataagcctcgctgcctccagctccccccaaccccagccaggacaacttggggaccctgcctgttgcagcttcttctccccctacctgggtcccggcctgtctgaggcccccatccctgctgtagccccaggccgtgagttactcacacgccgacaaaatataatcgctgaggctgaaatataaatacgcacatctgtatgtatgcacacacccagccctccctctgccctctccgggaggaagattaataaataaaacgccctcaataattcatgcaccccgcgcggaggcagccctcagtggcaggaccgggcgggcgctgcccaccctgaataattcacgggcggttttgtgaattacagagccatcctgccttccctctcagcagacaccccgcccacctgggcgatctcagccgtgacccccgggcccctcgagtcaggatccccgcctcccaaggaccttgggcctttcaggggggcccggttcaactgggggtagggcggcaggctcggaggccccaggcactgggtgcagaggcccggctgtgtgacgcctggcggtggccaccctctctggggccagggccgccccggctcccacaacccctcgctaacgggctctcggtctctctcctccctgcagcctactctccgcccgacacgtcccctgcaaaccgttcctttgtgggattaggaccaagggatcctgcgggcatttatcaggcacaggtaggggccgagaggccggctggtggggtgggaggggcagggcagaggggccggcccggggggctcagggcgaagagggcctgctgggtcccacgccacacccccggcacaggggcgccagcctcccacaccccacctgggcctcgagcccccacctggcctctccctgaggccaaatttccctccaccttggtcctggggggatggggtgtggccccagactcagcctgtggggtccccaggagcgtctctggagaccatcgtggtacagctatgggaccagtgtcattaccacctgcttcccatggtatagatgggaaaactgaggcccagagagacaagggggtctgcccagggtcacacagtgcatcaccctccctcctccagcctccatcccccatccacgccgaggcctagagggaccgcggggtggccgggggaaactgaggcagcccatggcggggcgtggggcctcccaggacagcatccaagcccccaccccaggcttcagcccacatctaagccagtgtgaggagtcagggcggagaggcttcgtcagcaggacagacaggatggggcaggggccagcgttcatgttcacgttgatgttcatagtcacgtacatgttcagacggctgcagctgagtgagcatggccggggtcccaccacccctagaaggcaggcaggcaggcaggaggttgacagaggaggctcagagaggggaagtcaattgcctgaggctgcacagtagtctagggagtgggggcgtgggagggcagccttagccccaggcccaggtgtccctcaccccccacccccataaggggctctgtgtaggccaggagtgtgtgagcgcgtcttcgggttatgggtaagcagctggacctttgagcctctgctctctccccggtttgtgttggggagagggttggaggatgtaggagtggctgccacaggcccgggaggtccagactcagagagaaacgagctctgggctacccagcggccacggaactgcagagcgtggagatgtatggggtccccaggggccgtgttcaaatcttccagccactgagggaggtttcctgctgcagagcccacgggcaagggtcacggggcctccccgggaccctgcggggctgtcctggctgagcggatgggggcggggaagggacatggcattccccctccctccctgtgctgggtgcccaggatgcctgtaagcggcccctccctctcttcccaggctccgcaaaaccagccggaggaggaagcagggatggaggctgcttctcctgagttcagaggagatccatgtgctatgggtggagggaatcctgggtcaggggccagggctccagcccagtgctggctcacccactctgaacctctgtctcttcctctggccttgggcacccgcaccaagagcctttgaagggcactgggggacagaaagggcactgaaaggttcaggcttccccacaccccgtaaatattaagtaccctgccttgcacccatagagccccggagagggagtaacttggtcagggtcccccagcgagcagacgtccaggactcctcgctttgggatttgggccccctatggccaacctctcccccgcctggtgctgatggagcccggcattacctctgccacccccaccccacatcgctccctgcccctgcgggaggctgggaacgtcttaagtggttcagaaaccaaagctaataaaagctgcggtgggaggaggcccagcccgcttaacccttccccagcctctgccttggaccaaactctctgaccaggccctcccgccagggcccgggacccttctctcagactgtgctggctccagccccaccccacccaagcctgggagggaagggaaactgaggcaggcaagggtggcacctttctcagcatccctatcttgactggctggactcctctggggacccagaaagggtgggaccagggctggcagaatggggtgtgggggggcactggcaaggggctcagcataggcaatggtgtgggtcgggggagggggagctggctggaatgtgagagatctccggtggcaggggccagacagatgatgcgggctttgctctggggtagtggggagccatagaagggtttagagggagggagtggacacccaccaggcctgggagtcagaactttctggagcacagaaaggaggtgacacattgtcaagaggctctcaggggagcatgggttagggggaaggcgaggtccccaaactgggcatccagggagcacaggtctggggaggaccccattgctgctgccctgactggactaagagcacctgggttgaggccgggcgccgccacctccctgcagaccccggagagagggagggaagaagcagtgagatcccgctctcccctctcccagctcccgctcaaagggccctgagcttggaggcctctcatttccgattctggccagtcagcacttctgcctccgcctcctctattcctggcggattcgcttccctctgccccctcctcccccaaagcctgggtgggcgcgcctttccctctgcctctccggctcccgacaccccccagtccatggactctccccccatcaatatccctccccgtgatctatgctaattgatctcgccctggtcagttacccacccatcgccccatgtccgtccctatcaatccccccactgtgaggctgggtggctctgacgccctggcccctcccctctgtgatgtccttcacgcccctacatttctcctgcacgggaacccacgtaagcagctgggtaaaccgagggtggggggcaaggcgggcattgagccacatgccgggagccacacaggcggctgcagccaggccagcaggataccagagcccaaacctcccccttcacacctactgcctcagtctcccctcagctgagtgggaggatgtggagttgagggtgcccccaccccacccccgccccattgctggggccacagccaggcaggaaggggaggggagggaagggaggagggaggaagggctgaggggaggctggtccaccacggggagggtcacgcccagagtctgtcggttgccaacagaaaccagacatgaggtaatggccaagatgaacttgaacttggctggaggtggggcgctgggaaccactgtggcgccagttccatgggctggcccagtggctgcctggttggaggggctctgttgaatgatttgctgcagcggtggggggcggccccacctctaacctcagttggggagtggaggggtctccccagttccagaggcacagccctcccctcacagtccaccctggatgctccatctggggttggagtttgcgtttccagggcaggggtctggacagcagcttctctgcagagactgaggccggagctgtccccaaatgacgtgaccttgggtacagccccatgcagaactcccctcccttagcctcggtctcccgcctctgggaggttgagagtcatcctcagcccccctgtgcttagtgagcttctgtggagcaagagggggccatccgggggacctgtgacaggatgggccctggacgcccaggacagtgctcagaagatgccaaggggattcctgagaggcaggcgagggggttggccctgggcaggagcagaaatgagagccagagccagacaggcctgagttcaagttccacctctgccgcttccatgctggtgacctcgggcaagttccttgacttctctgggcctcactttcttcacacaaaacagcggtggagggagacctaccccctccttcacggggataccggggacatcattaaagaggagaatttttttttgtttttttttggtttttttggtttttgttttgagacggagtcttatgctgcccaggctggagtgcaatggcacgatcttggctgactacaacctccgccccctggattcagacgattctgctgcctcagcctcccgagtagctgggattacaggcacgtgccaccacgcctggctaatttttgtatttttagtagagacagggtttcaccatgttggccaggctggtctcgaacccctgacctcaggtgatccacccaccttggtctcccaaagtactgggattacaggcatgagccaccgagcccagcctcttgtttactttttaaaaacattctcaaggccatgtgcagtggctcatgcctataatcccagcactttgggaggccaaagcaaacgaataagctgaggtcaggagtttgagaccagcctggccaacatggagaaaccccgtttctaccaaaaatacaaaaattagctgggtgtgatggcgcatgcgtgtaatcctagctactcgggaggctgaggcaagaaaatcacttgaacccgggaggcagaggttgcagtgagccaagatcgtgccactgcactccagcctggtgacaagagcgtgacgctgtctcaaaaaatcaacaaaaaacctctttataaagtgaacaaggcagctgatgtggtggctcatgtctgtaatcctagcactttgggaggaaggagttcaaggccagcctggtctacatggcgaaaccccacctctacaaaaaaaaaaaaaaaactagtcagatgtggtggaacatacctgtggtcccagctactcgggaggctgaggtgggaggatcacttgagcccaggagatggaggctgcagtgagctatgatggcaccactgcactccagcctgggcaacggagcaagaccctgtctcaaaataaaataataaattggctggccacagtggctcacgcctgtaatcccagcactttgggaggccaaggtgggcggatcacttgaggccaggaattcaagaccagcccggccaacatggcgaaacccggtctctactaagaatacaaaaattagctgggtgtggtggggcgggcctgtaatcccagctacttgggaggctaaggcacaaggatcacttgaacccaggaagcggaggttgtagagagccaagatcacaccactgcattccagcctgggcaacagagcaagactctgtctcataaataaataataaatagagaagaaaataatttttaaaatataaaataaaggccaggcagagtggctcacgcctgtaatcccagcactttgggaggccgaggcgggcggatcacgaggtcaagagagtgagaccatcctggccaacatggtgaaaccctgtctctactaaaaatataaaaattagctgagtgtggtggcatgcgcctgtaatcccagctactcgggaggctgaggcaggagaatcacttgaacctgggaggcagaggttgcaatgagccgagatcatgccactgcactccagcctggcaacagagcgagactctgtctcaataaataaataaataatataatataataaagtaagattgagttccagactgggagtgctggctcacacctgtaattccagcactttgggaggccgaggaaggtggatcacttgaggtcaggcgtttgagaccagcctggccaacatggtgaaaccccatctctactaaaaatacaaaaattatccaggtgtggcggtggacgcctgtaatcccagctactcgggaggctgaggtaggagaattgcttgaacccaggaggcagaggttgtagtgagccaatatcacgccattgcactccagcctgggcaacaagagcgaaactccatctcaaaaaataaaataataaataaaatataaaatacagttccagataaatggatcttttgtgtgtggtgtgtaagtatatccccaatgttgcgtgggctagacttatactaaaagaattctgtgttaaccagaactccagtttcactgggcatcctgtactgtgtctggaagcctccctcagagacaaagtcacttgccatgggtcacccagcaggttgttagagcctgggatggggaaactgaggtcacagggttgcaggaggtggggggtgagcgtgggaagaggtaaaccatgtctgcagcagagtctgacccctcgacttctctccctttttctctctccctctttctgtcgccactgggccactcagtcctggtatctgggatagcaaaggtcttcttccctcgccccttctccatcgtcccaggaatcccagggggcagcacagccggcccccggcccacgttttcggtggaaaattagagtgaacaagaacacccctgccgactcccagcccggccaaaaagacaaaacacatagacgcacacactcaggaggaaaagaaaaaacaaaggcagaagaagaagaagaagaaataaaaacccacccaagcaagaagacaaaaggtaaagacgcaacgtttccaactctcgggacgccaaggccgcaggactggagggccaggccccgccacccccacgggagacccgggacagggcgtcttcctaagttattcatctcctctccgcctgctgctcgggaaggacagacgccggccgcccgcccgcgccccggaggccctggctctgtccggagaccaggtgagcacagcctggagcctgtgcccagggccgacaggcgcgacacccagcaaggccacctctccccgggcccccgcgcctctgccggacacggaccggcccctcagcccccaccgaggacgcagccactggggggaaagggagacacagcggaccccggccgggcagcggagaccgcagaggcgggcagggtggggcaggcgagtggtgtcgcgggggtgcgtggcgcttgcgagccctggccaggggaggaagtgaggcccaggcacctgctgcccctcgagggggccctgcctgccgcggggcctccccacaagcccctcccaaagcgccggccgactcgctgtctcgctggggactctttcagccctcgcgcccgcccgtttgggaggagaagtctctatgcaattggccccggcccctccaccccccacccccggcataggaggcccccccacctcgcccggctcacacccccaaagggagggacccacattgcacacactgtaagaaatgcactttccgaggaaggggatgggggagcccggacacccagagctccccgagttgggggtgcccgtctggagcgcccccgtcagcccctggcggtgggaggtgagagcgagtggtttaagtgcctgattaccaccacccgcccccccctttgtccagctgggacacggaatggccgcgggcctcctccccctcccctccagcctctccaccagcccctccagtcaaccctcatcgccgtgcccccccagagctagagagatggggcccctgcgtggcccgaggggcagagctgggcgtcacttcgcaagcgtcctgccctgccggggcgcgggggtgggctctggggaagccggtgcgccccccacgcctccgctgccagtgccttacattctggagcgacccccctccctggtgcctcccagcgaagggggaccgccgtttgcactttcatcgcctaccccgacgcggggcccagctgcgggacgtgcatcacggctgggcccccagaggagagaggaggccgacgccagcggtccccgctcggaacggggagggttttcggggggttcggcgtcgcaccttggggccccccgcagccgtgtagggggcctcccatctgctaagcgtttttccgttgagccgctccaaaaacactaagctggggacgccaggtgcccccccaccccggctccctggccctatccacacctccacccccaccccaggatcgccatctttaggggaggcctgggagggggtgttaggtgttttagggccaccgagctcaaacacaaggacccctccccggcccacccagcccagccccaactgacctccatgcctagggaaaaactccccccaccactgccccctcccccgacccaggccaaagccagggcaggtctccgggtctcacctgctcctagcctcacccccctgcccccgaaaaccagactctcctcccaaactagcctcaggagcttggcgaacccgctcgctcctaaagagaaagacccaggaccctcccccatcacccccaagagaggttcgccatcctctggcctcgagcccttggtccctccgtccgtctgtcctcggggcccgctcccccggtggcccttggggatcaaagcgtgggccgctctccgggagggcgggcgggggagggggtggtcgggttgtgccattggggtgtccggaagcttctcagccagggtgggggtcgtggagtgggggagggaggccagcc

SEQ ID NO: 13726 - DNA, 23383 bp, Human
ggttggaacccgcggggcggaccaatcgcggctcggccacagcctcgcccgctgattggtccctccaggccccgcccccgctcgccccgcccctctcgctggggcgcctcggagccgcgtgccctccgccccggggtgcccattgcgcagagcgtggcctggagacccgcgagccggggaaggtcgccgtggagtcccgaccagaggccggggttggggtcggtgcagaccgagggctggtttccttgactgtgggagaaacgccgggagccggagtaagtagggctccgggcggggcgaaaggaaaagttgggtccctagagtgaagaccgagttctttctgtccgtctacactgagcgtactcggggaatgagttagagccagtctcttcctcccctccccccttctcatccctcactgttgccactcaagtcaaaagcacacattgattacaaatattaggtctggaaagggcagctgcaacagctgaagcgtgttcactctgggggcttgagagcgcagaaggctcgggaaagaggtgacaatgacaacaaaattgacgcggacgctccagtcaaaggcatctcccctttatccgatgactcaccctcttaggaagtcggcccgagaggcaaatctcaaaataccttgacatgaaacattttgtttttctgatcaatttaacgcgcacgtttccccacatcgatgcgctctcccaaacaccctgcattggatcctaataatgatccatgcgtgcctattttttaaaagtctgaaaaagaaaattctgcccatcgaaatgaacttcatgaatggggcaggctggctgcaccgggacggaatcgtccacccgacccgaatgaattggcaggagccgcggccacatttaaagggccagagcgcgcgttccctcccgtccgcccccaagccccgcgggcctcgcccaccctgcccgccgcccctccgccggcggccgccctctgcggcgcccctttccggtcagtggaggggcgggaggaggggcgggggtgcgcggggcggggggagaagtcctggagcgggtttgggttgcagtttccttgtgccggggatcctgtcccctactcgccagcgccaggctcctcccccccggcgcggatgacactagaacctccttaagttgcgtcgcgccacagctgtctgcgaacactgagctgcctggcgccgtcttgatactttcagaaagaatgcattccctgtaaaaaaaaaaaaaaaatactgagagagggagagagagagagaagaagagagagagacggagggagagcgagacagagcgagcaacgcaatctgaccgagcaggtcgtacgccgccgcctcctcctcctctctgctcttcgctacccaggttggtactggtgactttttttttttttaagtttgattttttgcccccaaccacttgggaggacctaaatcaattttaaaaactcaactctcctcttttggaggttttctaggggctgagaggacggtcccgggaccggtgtccccgagggagggacttgccctccaagtcgtaacagtcagccctgggacttgccctccaagttgctcagccagccccggctcccgcgagccgggctgcagggacgtccccgagagccctgcgggctccgcggccgtgtccccgcgctcccgtgcgggtctcgggtgcgctgggcgggcgggcggcgcgaggggaggttgtgccactccagcaactcaggggctcatccaggtctcccattctctcccttgcaggtgacccgaggagggactccgcctccgagcggctgaggaccccggtgcagaggagcctggctcgcagaattgcagagtcgtcgcccctttttacaacctggtcccgttttattctgccgtacccagtttttggatttttgtcttccccttcttctctttgctaaacgacccctccaagataatttttaaaaaaccttctcctttgctcacctttgcttcccagccttcccatccccccaccgaaagcaaatcattcaacgacccccgaccctccgacggcaggagccccccgacctcccaggcggaccgccctccctccccgcgcgcgggttccgggcccggcgagagggcgcgagcacagccgaggccatggaggtgacggcggaccagccgcgctgggtgagccaccaccaccccgccgtgctcaacgggcagcacccggacacgcaccacccgggcctcagccactcctacatggacgcggcgcagtacccgctgccggaggaggtggatgtgctttttaacatcgacggtcaaggcaaccacgtcccgccctactacggaaactcggtcagggccacggtgcagaggtaccctccgacccaccacggtgagtgcgcccggggtgccggggctcccgccggccgcttcagccgtcccggctcggggaggtcgggagggacctgagggcggggagaggtcaagcgaaagcccccatctgccgttcctggttcatttacaaaaaaattggggcccggaaatgggcgaggaaggcctctggctcgtcgcgagagtgtgttttgaaagagtcgcagcaggcgcctctcccggctggtggccctggggcctggcgctcacctggcgggcgccaggccgcagccctccgtctctgcgcggctgcaggttttggggtggggggtctcgggatgtccccaagcgcggggtgccctggctctgcctccgcgggtccgggctctctgggcccggtagccggcgccggacaagcacggctggaacccggctcttccaaaaaacctggcgttccctgttacccgctagctctttctaggcgggtgggcggggtggagggggccctctgccagcgtccctcaattcgcacattttcagaaaggccccagagacctatttattcacacccttctccttgaccttttcccagagctagtgcctttggtttttagacaggtctcttacctcctggcttcaggaatggaattctgatgctgaaggggtttgggggggaagacccctgtcttaagtttgagggatctgagatttcccagattcccggctgcacagaattttcttgcgtctttgctttcaagtcgcctccttgcctgcaactcttgccttactctgtctctgggtactgccctccattagcctcccacctaagatgtaggatacacccccgtttaaataaaggcaattccagtaccacctctttccccctttcacctggagaagttcaggagagttctgaaatgtaaaaaaagaagaccaggcctgtgtagtttgaggaaaaaagatcgaacactttccagctctaagtttgttcctaaagaagaaacaggggtaaaacatcgggcagaaaaagtgtggggctttctgagtccagccagaccgaattctgccctgattcccctactcagagcctgccttgacacggatgacatagcccctccggcagcaggcgtcctctaccctgctgtcgccaggttttaaacaatcgtttctgcggatggggcgccctttgcccacgttctgtgcggatcagcagttaggtggaaatgcggtagaggcagacttaatattatttactatactacttcctgcataatatgaatcttgacccttggtgttcagagaactctctttccctctccactcccctccccttcctctctcttaagattttagtttcagtattgttcttaatggttgaatcgaatgtcaaatgctgaggcaggtactggctttaaagatcaagaagtgtgtggatttgcacttgctttttaaatgtacccctcagagtgtatgagttacagctaccttaagattgtgcgttttaaatgaaggctaatcagactctgtgtctgagtcatctttcatttaaaatatacacatcaactggaattttgtgtcttaggggctcaggtgaaaattcacccatggcactggtgggatcatagctttattgagggtgcatggggcttacgttatctccttctcctttaggatttgggagggtgagaaaagcagagaaaatggccatcccagggtccagccttgggaactttctccaacagcccgagcaatgaaaacgtccctgcaaatcccattttaggccttttgcgggcagcctggccgtttctgagcaagcactgggttaggtttccggaaactaaccctgaaagtctcctgacttctgtcccaaggcctctccttcctgtatttggtgctgggagctgggcctgactccagggtcgttttctggtgtggagcagttgtgtggccgggctccatccttcaggcctcctcactcacagccggctctcttatcaggctggctgggattaagtccgagtcagggaactcagggccattgaaggaaacccataaatcaagtcaggttctagagagagaccttggggaatgtgatttaggcggtgtatctggagaggccaaataagcaaaggggcccttctccccctctgcagcaacctctcgggtgtcagccacaggcccttcattctgctacatttgatgggacatccctgtgggagagatgggtgaaggattctgtccccagcctgacccccaggtgtgccaggcaggtactccggggaccgccgggaattgagagtgggcctgagcccgggcttttgctgaaaaggaggccgatgcgaggtagagattccccaggtgtccctgacggcctcccagggccacactcaccctccttctctctcctgccctttccccgttgccccacagggagccaggtgtgccgcccgcctctgcttcatggatccctaccctggctggacggcggcaaagccctgggcagccaccacaccgcctccccctggaatctcagccccttctccaagacgtccatccaccacggctccccggggcccctctccgtctaccccccggcctcgtcctcctccttgtcggggggccacgccagcccgcacctcttcaccttcccgcccaccccgccgaaggacgtctccccggacccatcgctgtccaccccaggctcggccggctcggcccggcaggacgagaaagagtgcctcaagtaccaggtgcccctgcccgacagcatgaagctggagtcgtcccactcccgtggcagcatgaccgccctgggtggagcctcctcgtcgacccaccaccccatcaccacctacccgccctacgtgcccgagtacagctccggactcttcccccccagcagcctgctgggcggctcccccaccggcttcggatgcaagtccaggcccaaggcccggtccagcacaggtaggagccagctcttccctggagccttttctcctccctcctccccttttcctcaatccagggccgcacccagagggacccctcaggggagccggggtgtcccaaagcctgctgagatgccattcttcccattcttcctgccgggaaggcactgcatgtcctcccatcctagctcacgcctggcctcggaagcagaggggaagtgggatctgatttaaaaccccccaatgagctgggataggaaaaaagacaaacaaaaacaaagtcatgccctcttctgcctgtcgcaggacttctggattgggctggtaacctttagtcagtttccaagaccaaatggaaggccgagggaataattcttgagtgtttcatgctaaaacgaaacctcctcaagcctaaacaaacacaggtccctctatgacccctttggcctctgtcattctgactgttcctctcgctcagctcaaaggggaccacgcagtgaggacagtcctttattagacgtgtagacacaaagtgtgtgtgcatgagcctggccaaagctgcacgcatattctctgcgtggaaaagggggctctcagctgaactgggagaaagcggtggctttgcattggggaagcagagttgaatgaaaatcaaatgtcgcctggcccagttagttacctgcagcgtctcctagagctctcagtgcagtcaggggcaggaaaccgtattaggacatattgcttggctgagctgcagccagaggaggtagaaaggaacggaaaagtgctccaggtgtgtatctcagcttcctgtgctctgttcctttccaaaatgcaaacgctgcctagcagcacgctgcatttttattcagttggtgtcattacttgcatgaagaaaaaccccacacaaaatactttggctttaaaaataaatcgatctatcaccaattccatttctaaacaaagtaattgagtcaaaagagagctagggattctctgatattgatttaactgtattattagacagggtttggtgaagattttgatgtctccttaggcgtgtccatttcagagtgggcatctcttctctgatcggctccaggtatcttgcctccgctgtctctctacagatcctatatagaaagcaatcgtgaaaatcacttgtcttttagggatgagatgagcagccttgaaaccgagctcccaaagctccggtttgaaaaacttcagagggagtactctgggagcccagtgaccatgagatcagttttcagggtttttttccagggtgacattcactccgactgcctgagcaggactgtctctatttagttgatatgttttagctaatccaattattttcagactgctgcacgcgacagttgcattgtttatcctgagccaggaactttaatagagtccggatgcggttaggctgacagaagaacccagacctgcatgttcagtacatgaaagtaggcaggagggagagggaggcaggctagctggtggagtcaaaaagaaagcaagaggccgggagagctggaggcacaaagtggccacggtgcctggcaggggctgggcttgggggtggagggaaggattaagaagtggggtgcagcttgactcagaaacacaggctggggagctgaatcgaaagagagcagacctatgcattttgaggttgtgatgggatttcttttctttttcttttttttttaaagttctcttttctggtaaggctatgaggttggggagagctcgtggtatctgaggccggcgtagtggtttgtgcggggggaggggacagagtgacttttccaagatactctggtttctttaccctcatttccgtgtttgatttctccccctcttgtgcacactttctgccttaagtttagtcttttctttcctctcatttctttccataagactctgaacatggaggggagaaagagagggccgtggtttccctaagccagagctaggaataccgatacaccgattttggtttttttggcgaggaggagaggaggccatttcaatttggcctttttacttcctccttcttaattcctttctcacagtcgtgaaaaccaagaacagcacacctggcaggggcggcgagcgagctgggacttttgggagtgtggaggggaagtttcgagaagcccctccttttgcagggggtggaggtggtgggaattcttcaggaggggattctcttggttttagtggttgctctctctctctctctctctcttttttttccccctttaacctcttctttgcaaatgcatttgctgaaggaggacacagagaagagagagtttttggggttgtcgctggaaacggttgaagtcgtggttagggcacctattgctgtcttaacgcctgggctttcggggctgggacgaagcttttgcaaacaaaagacagagtctttgtgtccagggccgcttcttagctcccctgccacctttccagttgggcatctccctccactgtcgtctgatcgagctcctgccctgctccctaccccctcccacagcctggtttaagggtttcaggccaaggcggagcaagaggcatttgccagcagctgttgaatgtcaagaggcctcgccgctctgtggttcttgtcacctaagagagaggtgtctgcctgagcagctcacaacaggcaggggtgaggagaggggaggaaagaaggcaggagagagtcagggcctccattaggaaaactggctgtttgctgaagtcacagaccagaggcagcaaggaaaaaagaagaagaaaagcccataggaggcaatggcaaccttgccgagtgaatcaagacagaaaattaccctagtgtgcagaaccttgttgaagaggtaaccgttgctagctttcaaggtgtttctgaaaaggaagctatcaccctccccaccaccctgcaaatgagaggaaatcagactgatcatgtcaggctgggaggtcccccagcaccagggtgcccaggagccgggtggcaaccacgctccccgcctccaaccacagcggcctctcctcacactgccctctgcccagtgcccaagtaggggaggagcccgagggggtcccctgtctgggcagggtggggagtgggcctgcagtcctagctgggacagggccagtgctgccccagaaggggctgacccagcagctaccagggacacaaaaaggcaggcctgcggcctggcctgggctgcagccggttactcgcccactcacccttcactctttccttccagcctcccccacatccagtctgccacatccctcaggcttttgaccccaactgaaaggtgtctgggtgtgattcaggcctgagcctttttcaagaactgagaagagccgttgggtacttaggaaggcgcctttggcatgcactgcagcgtgtttgtgtttaatctcaggggttctggggcacagcaaaggctctctggggaccctaggctaagaatcttttggaatgtggagcaaaaaaaaaacctctcttacatcctcatttttttttttttttaaaaaaacaaagtagacaaaaactagtgggcaccatccctgactttcaagggtgcaagaccctcttccatttgcaaaagtctttaactttcctgaagaacttacccctggagagtatcacaggcccccaagtgtgaacccccctagttccctcctacttgatctggggctttccaaaggcccaataggtcccatatctgccaaggcagatttttcctccttttaggggaatcaaaattctcaagcaccctactgggttctcttcttctaccccagtggtccgggcaggttggaggtcattaattactctcttaaaacaaaacagtcttcagagctcatttttcttccctacctaccctccggggtcctcctctgggcctcccctctctgggggaccaacttgagttaagcctcctgttcctgcaaggaaggggagtcctggctttctctgggcacccagagaactgggcgctagagacccgtgtgtccctgggtcccccaaaaccaaggagattctcctagaaagcatctttctcttcctcttgcaaagttgaaatcagttagccaactcccccatgtcttgaaatggtaatttaagggattcttccaaggagctttctgggtgggtctgggtcgctttccagcctgggctgagggagtgaatgctgctcagacttcctaccggcctggctggtttttcgtttattttgtttgtttgtgtttttgggaaaagagaaactgtaggcaggccttggttactgagcagccaccccgctttgttaacttgcctcttctcctgatcttcctctgatcggcttcactctgtcctcccaaaccttcccttttcctttttccctccctccccctcttccaggttccctgcctaaagtttgcatttcccccttgcaccccctggctggggtcatactttaacttcagtctccgtaacagcggctggaaagctatggaaacccctgctgggtcctaatcgcttcctttccagccagggacatttgcagtttgattggaagtaaaatctaaaaccctagctagtgaaatcaatcagccgattgatcaatctatgcatctatttattatctgttcacctatctagccattgatgaatccttcctttcccccatcctaatcttcattatttaatcaatctctatagacagacccatgatgataatgggtcacctttgtcttcctttttttcctttgagggaaatgaatggaatgtttgccttttgccaccatccagggctcaggattttctcagggaagtatttgtagctggaatctgcattcctccttggtcctgcccgatcttctccatcaagtcgggcaagccaagaacagggttctgttgcaacgatgcatctgccccttctgcgggcgcctccgtgtgtgtcgggggaacggtcatgccaggacagcattccccagctcaactttggagcatcttggaaagaggtgggggtggacacgctccccaaaagaggagggagaaggaaaaaagttctccattttacgtttctcccccagttccaaatgctgtcagctttcctgcgtgttttccttccctaagtggcttatctgtgcttttgtttccagaaggcagggagtgtgtgaactgtggggcaacctcgaccccactgtggcggcgagatggcacgggacactacctgtgcaacgcctgcgggctctatcacaaaatgaacggacagaaccggcccctcattaagcccaagcgaaggctggtaagttctcgggaagggatggattccatgctgaccattctgggtttctcatttcctctcttccggaaggacagctttctgcaggaaattgacaggatagcctccaatcgtgtcagctggcttgggacagtttttttttttttcctttttctttctttcttttcttcttcttctttttttttttttttttcaaatttgatacacagaacagctcttttcccctctttttccccatccatgtttcttaagtcgcttgtgaacattttaaggagactgaattcttggttatcaaatctgcagtgtattcctgaatagaataatggtatgaacaggaccagagcagctggtttaagtgcattgatgagcaccgtttgacagatagagacatttagtatgaggatggaatgttccagaaaccatccagaatgggttcctgaagttgtggcgtgtggcttcccaggaaggattacagactcagtgcaatggatggatttgttatgctaatgcttcaaaatggttggagctgattaaatgaatttcagaggcttcaccagcaaccagtgagcctaatgccactttcctcctttcttggtctcagcctttgagaactttccacaggcaattcctatgggaaacgtcgtgtgagtcctctcatacctggcatttggtcttcttttctctttgaactactaccagtaaggtgatagttttttctctcctctctcattattcttttaaaaactttttaagcatgagggatccttgagaaaacctggctctgtcaagcatttataaggaagacttataggggacattcatttgcaagctcctctttggaagtttgaatagtgaatgtatgtgacagacaaataacaactctagccacagctaagagatcaaaatgctttatgtggtgctgacattcaccaagtcgagatgggaggaggggaatttccccacgcagattaatggataaattagcatccatcaatttctaaggaaggaaaaagaacacctctgtattctttttaaagaatactttgccctccccatcagattgtagtgcaactcaacacctttcacatcctattttgaagaaggaaaaactttctttttttttttttttttttttttttgagacagagtctcactctgtcacccaggctggagtgcagtggcacgatctcggctcactgcaacctccacctcccgggttcaagcaattctcctgtctcagcctcctgaatagctgggagtagggacacccgcccccacacccggcaaatttttgtattttcagtagagacagggtttcgcctttttggccaggctggtctcaaactcctgacctcaggtgatccaccgcctcggcctcccagagtgctgggattacaggcatgagccaccgctcccggccaaagaaggaaaactttctagggatggaaatgtccacatgactttaatctttgacaatcctggatatcgaggctttattctttctgatctttgcccccttctccaactttctcaaccttcccccacctctcctccagcagtttgggttttttttttttttttttttttttcctttctctcatgtgcaaagctgacttcctaggaaaaagctgccggatatctgagcactggagataactcataaacaacaactcagcttccccaacctaaacaccaagatgtttgaacgtatcagaacaagaagtgtttgaaaaaaaaaaaaaaaaaaggctagaggtgttagtgcagaatgaatatgatcacaccacaaaagaatgttttgaatcactcaaaaacctggccttagtaaaaaaaaaaaaaaaaaaagagagagagagagagaggaaaaaaaaacaacaaacaaaaaccttcttgttaaaatgtgtcttggtaccattatagttgttttttttgttttttctgttttttttctaataaaagtaaagaaggaaaaagagggattaaaagtctcaaggcatgggctgattggtgagcaaaagtttatttgacattttcttgggtcttcttcctctgtctggtcagattgcagaggaggatcgtaattccattttatgcaattttatctccactcacctttcataggaaatctctagaactctgagtaataattgctttgaattttagagttcaatgactgtcacattttcatctgtcttttctttcttaatcatctgtctttggtggtttgatgtttttagttctatagaattcataagctacagggaggtagaacacaggacacattcggatttctttttctttctttctttctttcttttttttttttagccctgagatgtatttgacttctgaacacctagaaccctttgttttcttctttcctgtattccctgaccctttattccagttccagcttgctatttttgtttgatacatttgcagattcactgaagaccacccagcccatatatagctagctcttctgtgagatgcgtatttaaccctgaaaaaactaatgcaagaaataggagagatgaccgaagggaagactcatagattcttttccccctggcattgccaggattttcatacatctcaccactagtgagaggctgagctgcttgctttaatatactgtacctcctgctagtgacccaaacagtgtggctttgagagaccctaagttcccataaagtttgtagtactggaagcatcttcctttgcttttatttagattgctgtcaatagactgcaaaagattacatgctgtaccttgtcatctggagctctgactttaccagttggcattatatgcttgtactctgtacattcagaattgctgggctaggaaacccaggtgcctgagtgatattaatctgctatatctgagtagctcttctaaaaaaaaaaaacactataggaagataataatcacatataatttaattgtcaaaatcattaagcactggttttacgtagtactttctcccaaaaagtacacaaatgaaacagttgtttaagcattaaattaccatatttcataaaggcagtcgggcagaggcatatggggttagatcagcactcatggacaatgtgaattacattcaagatggacagcaaaagactcccatcttctcccttatgataggccagggcagtttttagtttccagttccttagaacacagaaaagaaagaatttttttaaaaaggtcatatatactctgttatttacatcccacagaagcatatctgtgaaacaatttagcaactttgaaagaaaaagggtcactcaggttaattcaaaattgtcactgggttctccatatctggcagcttcgggtgttggcttcaactttttgcttgataaaatattgatataaaactgtaccagaatcccaggccgggtgcggtggctcactcctgtaatcccagcactttgggaggccaaggcgggtagatcatgaggtcaggagatagagaccatcctggctaacacaggtgaaaccccgtctctactaaaaatacaaaaaattagctggggcggtggcgggcgcctgtagtcccagctacttgggaggctgaggcaggagaatggtgtgaacccaggaggcggagcttgcagtgagccgagatcgcgccactgcactccagcctgggcgacagagcgagactccgtctcagaaacaaaagaaaacataacaaaacaaaaaacaaaaaacaaaactgtaccaggatccctatagttcttgttctgtgttcttataaccataccagaattttcttcatcacagacagagactaaactctttcttctcttacctttcctttgataatatttttgatccaggaatggggataattttgcagttaaaattttctttttatgatggaaggtgaggaggagagagaggtttatattagaagtgacccaactccattttcttccaatggtttttttcagttttatttttttaaagcgtgaacagagaatagtcacctgatcaatttaaatatgtcaaaaagtgaaagaaaaatctctcttttaaaggaaatgagggcagtaacacaaccaaggaatcaaaattcaggttgaggctgacctttgacctgcaactatgctactccatgaacagcaagtaggaaatggctgatttcatgaaggtggactggcatcagaggaggcgagggatccagggttcctgatgagtggcaacattccttggtcttttgagtttgtttgattggtgaatcaaatttaggtgacagccagctaaagagagtgagggtggctgtcttgtgaatgggaagtgaccaagcttgaaagcacagactgtggtggctcacgcctgtaataccggcactttgggaggccgaggcaggtggatcacttgaggtcaggagttcaagaccagcctggccaacatagtaaaaccctgtctctactaaaaatagaaaaattagccgggcatggtggcaggtgcttataaatcccagctactcgggagtgtgaggcaggagaattgcttcaagccgtgaggtggaggttgcagtgagctgagatcgcaccactgcactccagcctgggtgacagagcgagactccatctcaaaacgagaaaaaaagaaagtgcaggctgtataaatttaggaggtcttgttgacctaggatgtcctacttggcgcttcctcaggtgtgtcacccatgtgtatgtgccacacacttgcacagacattctttgcagaatttgctgttgtgttggcacactgttctctttataactcagcatttctttatttgcgatccagagtgtttttggtgcttggctttgcgcctcctttgctgtgaatgcatcctgatggctggagcctgtttgaggatggatattcttgggagttgtgtttgaaaacaacctcttgtggccctggacttggtgaaaaaggcaactgaaagcccagttccaaaatgaggctggctaattcaaaattgccacccataaaaattaaccctctggtgtactttgtgggttgagggtaggaggctaagactgccagggaggaggccccggcttcctgctcctaccggggagcagcaggtgaaactctgaccacgttactgcaatcctgacatgctccagtggagtggcgacatttttcttctcgaggcagcttttggggatctgtattactttcatgtggaccacttgctagttttgatttcaatgataatttcttccttcctttttttttttttcaagcctgtcttcatagtgatgacaacacatttaacatttgttttgattttaccctctcctctctccccactctcagtctgcagccaggagagcagggacgtcctgtgcgaactgtcagaccaccacaaccacactctggaggaggaatgccaatggggaccctgtctgcaatgcctgtgggctctactacaagcttcacaatgtaagtggactgggatcagcaagaacagggctcgcttcctgatggtgaccagcaaacagcgtcaccaccaccctctccaagtgaatcgctcaccatgggggcagatgacaggttccaaataattgatgcaataggacctagcttggaaaactactttgtctagcatagccgtgctgaggccgagggggctcacagcctggcagccacacaacccccttggtatgcattggacactccacataccatgcagcaatccgatgtgctgagtgggcctgtgtggtttataaggaaaaaaaaaaaatcttccttttggaaaacaaaaaaagccaccggtcctattttgttgtttccttacattttaaactctttgcagaaagagagaatgaaagagaaaggtaaatagaattgtaatgtgtggcagggggtctggaaactaagaggacccatttggttactgagaggtaaaaagtcttggctaaatctgtgctacaaatttgaaatggatcctctgtataaaagacatggaaaaaaatgtctgacagatttcgtctgatgtctttgtccgaaccaactttcacgtgcagagagctagctcctgaggaaggtggctggcctgggggatgttaccataccagggaaaataaactgtcattttctccttttatatcatgttagcagagcggtaattgccagtcacctgaatttagttgtgtcatttctgatctttccatttggggtcctctcattttgtaatatatcttaatcttaaaaaatttttttttcagttttttttttttcctgaaatcattctggctcagaggccatgattctagtgaggcttcaagtttacattaactctaaagacaaaaatggttattttggtctttctctgtgttgctctctctctccttcctttttagctctttctgattctcctaaattctcttggccaacctgactttggcaaagtccggggctgaacagggaggagacagggacttttgcttgcggcggttctggcaatgaactcatcttactcaggaatacctgggaattggggaggaagcttttctggttggattttttgagtcataaagaacttctcagggtgaccccagcaccctgcttctttttcacttcttgggagcaagttgctgtgattccgaggagccctgtacgctcattccctgcctgtgccaactctctcgctgtggccctggtgcagtgaatgaaactagagtcttactacgatcccttattctcccttaggtcctgggactgtggtctatatacatttatcagcaattcaatccaagttctattttcactttggggaatttgcttgctgactacagtagagatagagattcgtgattaaaatctggaaggcttgggcttataagctattaggttattagcattagggtttattagctatccagtcatcagcactgcctatgaaattatttttgggctgtaatttatggatttcaaagaactttcatgttacttgattacatttgagcctgagatagtcccatgatgtagacagggcagaaattatttttatttcagttttacttgagggagttatgactcagaaaagcaagtcgcttgcacaaggtaacgtggctgagaaagtataagagtcagggcccatttcagagtcaggaggctttcctgggaagttggcagtgtcagaactaagaggagaaccaggggaaagggaatgctctctttttttagagtataacaaaattgtaacaaattgtgtgtgtgtatatttcatccctatattcgtggaagtataggaattataggagattaactagctatatgtttttttgaatagttagctgggatgagatatgatctcacttgtgtctgatcacatatatatatatttctgaagaacatgaatttctcaaatcaaagtaaagctgaggaatcctctccatggctcacttctacctcctcaatcttaatgagcttggtcttcatggctgggctccagtgaatgggagacagaaacttcctcatcctcaagagtggtttttctgtcttctctggtttaccaggaatttgtaaaaggaggcgattgatgtgtattgaacaataagagataataatctattaacattgtcatcacgttgcgttttgctctgcccttccagacatctctacatggatgccataagctctttcttcttatctaggtgttgagataactgcctacctcggtatcagcatctctcagtggtgttgtgactggttatctggggttgtgtggctactggtgtaactagatattatatttagatacctggctatgtatagctagatatcggcatcagagctgtgtatctggacattatcttggtgaagatttgatgtgggagtagattcctgtcatctctgtaggctgcatctttatcttgatgataactttgaagaaggaacctggagatgttcctctggcagtgacctttctgggctctcctgccatcggtcacgttgccttcctgggcttggggaaaataaggtctcagctccagtgtggggctttgtttccttctccaggtgacctctcccagctcagcttcgggaagctgggtgttggctgctctcagcaggttggccatttgaattcttcctttcttagctgtgattttctggctttgggaacagacaggtaaaacccagagccaagggttctccacccttgagaactgtggcggaaggcgatgctttcagcccgggaagtcaggaatggccaggacactgacattcactccttgagtctgtttgccaccctcccctgggaacatggccagatgtggagtttgctcttccgggcagatgtctgctgttggggttaatctgcttctgcctccctgtggggagtaacttctgtttactttgtaaagtttcctttcttgattctgggcccccaaagcaaatgtatttttaaaggcaaatgaggtttattaagaagagagaaatggtagatgtctccgagactgaagtctcttgatcttgagagtagggtctggtctctgtctctttactctagcacattcttggtctttccttttcaagatgagtgcccttttgtgctttgcaccccataggtggttattaaatacatgttgattggttggttggctgtttgtctggttagaagtagagagtcagagctaggtggaaatagcacttgcaaccattgcagctgctgttggaatgacacaggcaagagatcacttttgggccaggcgcggtggctcatgcctgcaattccagcactttgggaggccgaggtgggcagatcacaatgtcgggagttcgagaccagcctgcccaatatggtgaaaccccgtctctactaaaaatacaaaaattagccaggtgtggtggcaggcgcctctagtcccagctactcaggaggctgaggcaggagaattgcttgaacccgggaggcagaggttgcagtgagccgagatcgcgccactgcactccagcctgggcgacagcgggagacttcgtctcaaaaaaaaaaaaaaaaaaaaaaaaagatcacctttaagaaaggcatggtttcataaaatacaacccggctacatataaattctagcggaagattttatggcacctcttaaaggccaggtagaagagaggcaaccgaaagttactcagtagaacagtacagtcctcatttcttcaaggcagacagccttaaccacctagaggctgatggcctggggagtacttttcaagttctgaagcagatttgtcaaagtagccaaaatggcatttccctcctgaagattcttcactacctcgattcttatgaaatagtctaaggaagttctaaagaaataagacaagtgaattctattttcgttaccagagaaatacaatcgtactagacggggctgtaatctggtaactgtatgtattttagttcttcagtccctgggaaggagacaggagaaggtgggagggaggaaggggccagctgaaatggaaacagatccctgatccggggcggtcagtggaacccttcttggtgtgcgagagcctgtgcatttcagaggcagcaaaaaagtaaaaaaaaaaaaaaaaaattgatctttgtttagattaacagacccctgactatgaagaaggaaggcatccagaccagaaaccgaaaaatgtctagcaaatccaaaaagtgcaaaaaagtgcatgactcactggaggacttccccaagaacagctcgtttaacccggccgccctctccagacacatgtcctccctgagccacatctcgcccttcagccactccagccacatgctgaccacgcccacgccgatgcacccgccatccagcctgtcctttggaccacaccacccctccagcatggtcaccgccatgggttagagccctgctcgatgctcacagggcccccagcgagagtccctgcagtccctttcgacttgcatttttgcaggagcagtatcatgaagcctaaacgcgatggatatatgtttttgaaggcagaaagcaaaattatgtttgccactttgcaaaggagctcactgtggtgtctgtgttccaaccactgaatctggaccccatctgtgaataagccattctgactcatatcccctatttaacagggtctctagtgctgtgaaaaaaaaaaatgctgaacattgcatataacttatattgtaagaaatactgtacaatgactttattgcatctgggtagctgtaaggcatgaaggatgccaagaagtttaaggaatatgggagaaatagtgtggaaattaagaagaaactaggtctgatattcaaatggacaaactgccagttttgtttcctttcactggccacagttgtttgatgcattaaaagaaaataaaaaaaagaaaaaagagaaaagaaaaaaaaagaaaaaagttgtaggcgaatcatttgttcaaagctgttggcctctgcaaaggaaataccagttctgggcaatcagtgttaccgttcaccagttgccattgagggtttcagagagcctttttctaggcctacatgctttgtgaacaagtccctgtaattgttgtttgtatgtataattcaaagcaccaaaataagaaaagatgtagatttatttcatcatattatacagaccgaactgttgtataaatttatttactgctagtcttaagaactgctttctttcgtttgtttgtttcaatattttccttctctctcaatttttggttgaataaactagattacattcagttggcctaaggtggttgtgctcggagggtttcttgtttcttttccattttgtttttggatgatatttattaaatagcttctaagagtccggcggcatctgtcttgtccctattcctgcagcctgtgctgagggtagcagtgtatgagctaccagcgtgcatgtcagcgaccctggcccgacaggccacgtcctgcaatcggcccggctgcctcttcgccctgtcgtgttctgtgttagtgatcactgcctttaatacagtctgttggaataatattataagcataataataaagtgaaaatattttaaaactacaaaatgacatcgtatccacgtggtggccgagctcttctagaatctggtagctctagctaatttcagagaaaggagttaaaagaaacaacttaacaaccagacatgttaagttattcactaggaaccgatgctaaccccagagagtcaacgtctattttggggggagctgggaatatttggagttctacatgcgacctggaggaatttatcctggggccggggtgacatctggggtcccctagtgagtggcagtgtgtcttcctgctctcctcctgccctcgaaggaggactgggaagatttccacgctgagattcccaggcgcaaactgcagctgatgcgttcctcgaggttctctttgagatggaaacgagccggctgctcgtgttcatttctgttttgcttttctactgttgaatgaataccaccacagtgaagggattattggaatgttttcgaaacacaaaataaccattttgtaacttctgctgtatagttttcttttcctgtggatggagtgtgtaactacagcacacatttaaatgaaatctctgttaatcgcctctgcactatcttagcaaatattttaaacctaaagctaaatgttgaaataaaggtgtagagcattactgagatgcaaatggagctctctctggctcctaattaatgacctacaactcgactgttgtttccaattacttttgaaacactgaaggaaagaatcactgctggctgtggtaaacttgggaggttttgtcatatagttccaatgtcttaaagtttgccaccgctttgcttcatgaacagatttgagttaatgccctttcaccttaagaacagggagttcaaattcttgacattcttagggctggacaaggggcgggggacacgtggaaaaatcccaaactcagtatctcagctacgttttgtttaaggtacacttcatcccattccttcttcaaagaaatgtcatttcattgttgtgggcattgattgaaccttctaagatgtttctagcagatgatgcaacagctgtaaaatataaatatatatataataacagtgattcagatcctttttctttttttcttttttgagacagagtctggttctgtcgcccaggctggagtgcagtggcgcaatctcggctccctgcaacctctgcctcctgggttcaagcgattctcctgcctcagcctcccaagtagctgggactacaggcgcccaccaccacgcccagctaatttttgtatttttagtaaacatagggtttcaccatgttggccaggctggtgtcgacttcctgacctcaaatgatccacccacctcagcctcccaaagtgctgggattaggggcgtgagccaccgcgcccggccgattcagtttcttctttggaatattatcatatattttaatggccagaatggtttggttcttttttcttttttcaaaaatataagacacagtagaggagcaatactaaagcgggtttaatctagaaaagtagaacaagatcgcagacctaaaatatggctaaaaaatttttgagtcgattgtattcctaatttccaatctgtttcacctcacttttgaagttgttgtattagcacatctataggagaatatggggtttttttttttttttttggaaaatatctgaggatttgggttatttctttaaaacatttaaaaagcca

SEQ ID NO: 13727 - DNA, 49931 bp, Human
  misc_feature (1)...(49931): n = A,T,C or G
agaaaacaagcgtccctttgcctgacacttggggcagttcgatatagagagatttttaggttgactctgaaagtcaagacctccagaccgcatggtagaaggtgtaaggcagaagacaatctcagctggggaaattcctggtctttaagccagcaacatgaaggactggaagagcatgatgtgctctgtaaacccgcagcactgcatttcctagctcggccccacaatatgcccccacagcaccctccagttcggcattagtttcttcctaatgtccactctgcccgaagtgacaagcgggggcatgtggagactcagctccaggttcctggacgggctcagccacccccagaaagctaatgaatgctcaaccagggcttccagatgcccaggggacagagcaggagatgccggggaatggggctttccttgcagttcaggagggccctgccccaggcccagaagtagaagggaaagcggctgttttggcggtaaacagtaatgtggggagtgctgcagagaaaggcagtcttggggtttcaagctggagagcagtcagctacactcaggacctctggccatccctgccttcacctgctgtttggcctgatcgtctaacttctctgattctccactacccactccttattacgtttttgagacttgtcaaagttttatattagggctaactgggacgcatacaaatctggtaacttcgccagggcgggaagttaggaaggagcagagctggctgcaggtgtctggtcctgaccactcctctatgccacccttgaggagcttgctgactttctcatgacgttctcccattccaggagctgcaagtgcgttatcctggctggagcacggtgtcaatcacggcagactaaggccagcggtgatggcttgaatgccaggctgggggctgggatttttcctgaggatttcacaggacagaggttggcttggaaagaccaaggtgggactgaggaacattccccctacccccaacctcggtgggctgttgcaagcctggaggccagagaagacgggcctgggatgccgcgggggcaggggcaggcagtgaaggagatggctgccttcggtagagctggtcgctgaggcagaagaggagggcgtggggcgtggggcgtgaggtggccggcgccccggctggccaatggccgggctgcggcccctccgcggggcggggtgggcctggtgggcgggcggggctcggggcgggggcggagagggagcctggtgggcgggcggggcgcgtcttgcgggctccctgagggctggagcgggtggggtcgcgtcttttcgggtgtaggggagctgcgttttcaggggcctcggtttcctcccgtctccggacgggtgcgggaaagaggggcaccaggggcgggcggcggggcggaacggggcgggnnnnnnnnnnnnnnnnnnnncaagcctgaaggccagataagacgggcctaggatgccgcggagacagggacagtcagtgaagcagatgtctgcttacggtagagctggtagctgagccagaacagaagggcggggggcgtggggcgtcaggtgtcaggcgccccggctggacaatgaccgggatgaggcccctctgcggggcggggtgggcatggtgggcgggcggggctcggggcgggggcggagagggagcctggtgggcgggcggggcgcgtcttgcgggctccctcgggtaccggcgctgccgcaccccgccgcgctcccgcacccgcggcccgcccaccgcgccgctcccgcatctgcacccgcagcccggcggcctcccggcgggagcgagcagatccagtccggcccgcagcgcaactcggtccagtcggggtgggtgaggggcggcggcgggggaggggacgactctgctgagctcagcctctcttggtggatgtggggcggggcgctcgagtaggacccgacgccaaggggagggggctgacctgtgcttggtccaccccaggtaggggctgagagaggcttgaggtggaagtgggggtcgggcactctgacctggtcgaggaggggctagggtttgaaccggggacagagtctaggtgagctggggcttgggagctattagcgtagaggatccgggttcggttcctctggcgagggctccagcatcacaggtgaggagcagagctcagcttgtgctcgaggatgggggtgcggggtcctggggcgatcggggctcgggctggagcgggtggggtcgcgtcttttcgggtgtaggggagctgcgttttcaggggcctcggtttcctcccgtctccgggcgggtgcgggaaagaggggcgccaggggcgggcggcggggcggaacggggcggggcggcgggcccagcgaggggggtggtccgcgcgcctctgatcgcgttccgggacacacaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagaggtgggtgcgccctggcggcgcggggctctgagaagcgccagactgggggcagcgaagtctgggaaggcatggaagagcgctggccagggacctcgggtcccgcgcagggcctgggaagggccgacagcagatgcggagtgacctggaggcagcgcacggtgatccctactcccgcctcgttttgcctccttgccaaaaagtctggatctgagcctgtccaccgagaggctctgcactggaccctccctaggtagctggggccaccacctgcctgcagttggcgtcaggcatgccgttggccttccctattgtcagcagaggtttgcagggcccctggtattccagcactgtggtttcacagaaacccgggacaagctccaggcatcgccaagttctagcttgtccgttatgctttgagcttgttaggatgccatgcagggacaaagaggcaaagagccctgagctttgctggcagtctgtctgggctgtcttgcttctcacgcaatgtgggggcagagagggaagatggaaatcctaaatctcagcactgtatgagtggcggatgaggatgtgagaggcaataccccctccacccaacggtgcttcgcagttgtcctgggctcaggtcctcctctgccactcagtagcagggtgacattgggcaaatcacttaatatcctgcacctcagtttcctgtgaaaactaaatgtcatatgtgtgggcacctggcaaataataggtgcgcagtatttagcaactattatcagataccacgtaccttagcaaagctttgcctagcttctgccctccatcacctccaggtctaaacactgtgggtggcatcttgttctgtcctctgtgatggtcacccacgcatgcccagggctacctgggcaggagatgtcactggcccagccctctctgtccaggtgcggggagctgtccctggtgcctggggtgggtagacgagggcgctgttgggcccaatctgtctgtagcctgtgtctatagagaggagccagccgtcctagtgaaggaggcagcaggaaaccaatgtccaggctggttggcccctggtctggcttcacatccctgctgtctccagcttggtatcccccttgggcaaagccttaactgctggcccttgtctccagggggaagttgctttctccccgcagccctttgtagtttggggctatttcccctcccactccacaacagttagcctgtggagtttgcagtgaaggggacactggcttgggaggcagtgaaatgggcagctgtccttgaatatccactggacaggcccagatcccaagacccatgatctttctgtttcctgtgattgcaaaacaatcatgacatggagcaattaaagggtgaagggattcagataggccccaatgtctcttaactctgaagcttcaaattaagtggagtttgcgatgcctctggttctagggcaggccatctgctttccttatccaggttctaggactttccctcctgcacacagattcccggtaagactgactaagtcacctctatgtttttgtgcccaccactgttcagaaagtctgcagcgtggtcctctgacgttagcttctgctgagggaggagagagagcagcaagggcctcttcagtctcttcttgagcagagcagtgtggggccctgcaggacctagtgacggggtcttctccatgggcgttatccagactggattttgccaagaccccagctttcctccctctagatgtggctctgtgtaggttggggggttgaagtttgccaccagaggagatgtgggctgtcacttctaccccactctttcccagaggtgtcctcgctggcagtgggtacaggatgagagaggttgaacaccatggcaggagaagaggcagtggggactgatcttccctcatccagtccctgctctgccacttactggcagtggcgttccgagtctgaagtggagaaatgtccacctcttagggtaaggtgagaattaaatgagatgctgcaagtaaagcaaatcagtgagttgggcagctgtccctgaatatccactggtcaggtcaagagcccaagatccatgatctttgtttcctgtgattgtgaaactatcatgacatggaacaattaaagggtgaagggagtcatataggccccaatgtctcttaattctgcagcttcacattaaattgagcttgtgatgcctgtggttctagggcaggccatccgctgactgcctaaaatggggttaagtaaaacacgtgtaatacaggtagcttcattgtgaggtggctgtaaggatgacatgatggttggttgtaaataagtaacaggtatcattatcatcatattactagtagcagtatgaatgataacaaaacaccaccagtgtctgatagattctcaatagaatctatcttttaaaatatcttaaaccattaaaaattaatcttaaaatactaaaagtatcttttagatatcttcaaaaatagaatacaatagattgtttatagactgtggttattagtattaactttttatggagactgccagaatgccccttaaatctcatagacacaggataattggtatttagtcattgttcaggggaaaaatcaaaaaggacctgggccagatgcattatttgtttacatagttgcatcatgaatctcctttcaagtaacttcctggcattttcaatgttccagctgaatcaagctgttgaagtttcttaaggggaaggacaaagcagctctacttgtacggtcattattggaagaagcatatcttcaaatggcttcaatctgggatattcctactttcctgtgttactattctgtatgctaccaatcaatgtattctgaagatataaccactctgtttctcctcccctcatggccagctctgtaactcactcattttagaatgttcttactgcctcacctatttctagtataagtgccatttttaatagcattcacattcctcctctacgaaacagctccttttgcttcagacttaagtttctcttgctagtggcaataatagttgcggttgaaatttccattgtaaactatacttttagttcatggtgccatttaagaaccgttagctcattctgttgaaataaccagtggctgagctggggggaaaagttttataaaaagactatctgctcagcccagagcaaattctaggtttggcaacttgtcaattatttgaaagccaaactgatcccgatgggaattttaaaaacactaaaacattctcttcttctgggtgggtcctctccagcaccttcagtcttctcttcccagctgcgtttttttctatcactaaccagagtggtaactgagggcaaggtctcttgcttttaagaaaagtcattttcttgcccattctgtcttctatctcagccccatttcttctcccctttgttggcaagctcttcaaacacatgatatcaacgtttgctcttcctgcttctagctacccattcccttcagaactctggcaaaacaaactggcttcttttgaaactgccttcttaaagggcaacgggataaaaacagctgtgtatttcatctttgctgtgtggcagatagtgtatttcatgccttaattcttatatctactgcatggtccttaattcttatatctactcaacaaagtaggacatccctattttacaaatgagcaagctgaggtttagtgggatttggtatcttgcctaaagtcatacagctactttgtggcagagccaggacttgaacccaccttgtctgactccagaatcctggtactttccactgtgttcctctccgaggatgctgcaggcaatgacttgactcatccagtggccatctctcagtggcttgatccttctagacttacttagagtctttcccacctagaaggtccctacccagaagtagctcccatctcctagacctaattctagccagtttcctgactcccctctctttctgatctactctttatattatttcccgctagccttctggaacttgctgtagttccctattgcctggaacggagattcttaactggggatcagagggaggggagggaaatcctcagaataagctgagaagctcagtattatcagggtctcatctctagaaatcccaattcagcgggtccatgaagggatccagatatttcaattttttaaacttttggacctgactctataatcacagcttccccataaggttgctgtcaatattcaaggcatctggtgcaacgattcagacatagtcaatgccccaaacgtgggggctattcttagaattattattgttatgaagccagtgatcaagtttcaaacatctcagcagccatctcagaatccagcacagaatccggccactgactaagtccttgttgagcctttctgcctaccaggttttattcacactttgagtttagtgtttttgtgttgcattgagacatgaggattctttcctcttatcctcctcagctcagcaaacctggtggttaaagcaggggctcatctagtacttaaggggatagaggacagtgatttttttaaataggaaaatactttttgagcattctttttttaaaaaaaaaaataaaaatagcccatagtcaaaaatagcagtgttggaaaattgccaactatcaggtagaacttctctttatgtctctcatttgaaattcctagagagagtatctgattggctcaattagtctatgatgtggcctccctttgggtcccatcagctgtgaacaggtcacattgtcaactgcccactcatcagggccaggacagggtgataaatctggaaggggaagttgggtgcagatatgaggtcactgacatatctggtatagatgttatggaggatcatgagcctggaggatttgaggacagcggccacagaaacctgacaccagagaagaacatatgtctaagaaaaccagaaggggtgtggaccccgggaactggttaactgaccctctacaagggtccctctgcaaggatttcctacaagggtacccaagaggcagggtggggaaggagacacagctgtggccctacctacagggagtaagtttaggttccctccatcccctgcccctaccaccaccaacaacaggtcctgccacaaggacttaagagcaaatagtgcatttgggatgtgctcccagaaaacactagcaggaagtgggaaagtgtgatgaaagaaaagaaagacaatcaacggtatgcctgcaagcaggttactgctgcgggcatctagggctccatcccactggaggccttagagggagactacgtagattctacatgctttagaattgtctagcgaagggagaagctagactgtttacctccatagcctgactttcattgctaggatgttaactccctagcacttggggcctctgcagactgagcatactttggtgaccagagaatgcccttagagagagacagagttggttgttggcatgtatgggaactggatacaggtgacctccagattaggccaccaggagatgggcagggcatcaacagcgtttacacagggagcaagactatctagtggaaacatgttcaaatcccagctccaccctttcctgggactctggggaatttatctagtcttcctgagcctcagtttccctatttgtaatatgaggacattaacacccacctcccagagagattgtgaaatttcagtgctgtaatatatgtaaaacgtttagtataatatcttatcatagtgagtactcaattaatagcacctatcatcatcatcattctttgtaattgcagaagaggaaaagagattttttttttctaatagactcccatttgtaacaagagaaaataattttgctcattaaattcatcgatttaatagatggaggcagaagaagctgctgctaaagcatcatcagaagtgaacctggcaaacttacctcccagctatcacaatgagaccaacacagacacgaaggttggaaataataccatccatgtgcaccgagaaattcacaaggtaagtcatggccagcacttcctcctttctatagcgtccagtcccatcagagaactaaggtttttttgtttttgttttttcatatgtgatatacaagcccaaactacaattgagaatcataaaatacggattgaaaaccagaaggagtaatgttactgttgaaagtggagagacaatgtatcaggatcctaaactgcttttgcatttaagcaatatatttaaccctaggcttcctgccagtccagttgcaaaggaatgtccagggattatcatttgaaaaaaagaaagcaaatggatgtctaaaaagaccctttcctagcattgaatttgtggaattgatctatctcataggtttttatgtatgtctcagtagggattgaactagagaccacattatggtgaattgaccctcacttttttttaggaggaatgtaaatatgatataccccatttccaaaagagaaaccctctattgctacaaaattaaacattcatttgctggttgtgcgttcaaaattctctggcagatttttccccaaactaccacctgtctgagtgcctcttggtctaacatcatgcatgaagaacaaccaggttcattcccattctgacctgatgaagaaagctctgcgaatctcaaggaacatagcactagcttgcccctggtgtgcaatgtctctgacatgatttggcaggactctgagagcaaactgcctaagactgtgtgctgtgcagatattcagggtcgttgtgagcatcccgttgtgaatatcaaggagcctgccccctcagctcatctcaactcctgtatgcaagggcacagcggcttcacaaaagagcctcacttttattcaagtgcgcaggtaattacttggttgaaacaatagtgtttctgtgccacagagcacaggggatcaatttttatgtgccgttgccttgactataaagtagcttttgtgtggcacttctcccactgcatcgtaatgggctcagttagatggatcagctacagagtgtatgagctccaggtaaatgaatgagtttaccagcagaacataatcctttggcattgctcatctgcgactgaagaatgttttcaaagtgattattttattcttgtcaaaaccaatatcaagtcaccctttctgacaataattaaccaacaggtttggttgcttcttaaagttgcttcttgtaaatgtcagaatacctgagtgtgagtcctaccagtcactagtgtgatttttgaaaaattacttaaatgtcctgattctcactaactgcatttatgaaataaggatatcaacatctacattacagtactgtgcaggtcaaatgacctaaagtatatgaaagttcattgtaaactgtaaaatgcaatgcaaaaaccactgttcttattattactgttattataataaagttatgttattaacacagtgcagtagttctcaactgggcttcatagaacaccaatcttcggccaggcgtgatggctcaggcctgtaatcccagcactttgggaggctaaggtgggaggatcacttgaggttaggagttcgagaccagcctggccaacatggtgaaaccccacttctaataaaaatacaaaaaaaaaaaaattagccttagccaggcatggtgtcacgtgcctgtaatcccagcgacttgggaaactgaggtaggagaatcacttgaacctggaagcagaggttgcagtgagctgagatcatgccactgcattccagcctgggtgacagagtgagactgtcaaaaaaaagaaaaaaaaaaaaggccaggcacggtggcttatgcctatattcccagcactttgggaggccaaggcgggcggatcacctgagatcaggagctcgagaccagcctggccaacatggcgaaaccccgtctctactaaaactacaaaaattagctgggcatggtggcacgcacctgtagtcccagctactcagggaggctgaggcaggagaatcacttgaacctgggaggcggaggttgcagtgagccgagatcatcgcaactgtactccagcctgggcgacagagcaagactctgtgtcaaaagacaaacaaacaaacaaacaaacaaacaaacaaaaaacactagtcttatgcaatgcttcatagaagaaaagctcagtagtagtgaaacatatttggaaaacttatattcttcttctggagatttaagaaaaatacaaattgttataataaaggttctaataagtcatgcaacccatacatacaggcttgtagaattttttaaaatatgacattggttaattctataaaaagctggcataagggaagagatcatttcatttggggagaggaattatttaggtaaaaatgtaaaagcatgatccttaccttctcagaactagaatttgattcccttctgcaaattagtacaagagtttccactttgtcctggctgcagattcctgtgatattagagctggcagagaccttaaagatgatgtagaagtgagaaaattttgaatcagagaaaatatattatttgttccaggtgacatactggatggttactggtgactgagacagagctcaaagaacacacatctcctagctcctgagccagcatcttttcttttctttctttctgtttgtttgtttgtttgtttgtttttgagatggagtctcactctatcgcccaggctggagtagtgcagtggcacgatttcggctcactgcaacctctgcagcccaggttcaagcaattctcctgcctcagcctcccgagtagctgggattatcggcacttgccactgcggctaaattttgtatttttagtagagatggggtttcatcatcttggccaggtgaccaaacatcttttctgtccttcatcaccaaatcagacattagacgtgacctttcatggggcaggaagagcctgggttctatgttagacttagctttgagatgcctgcacctggttacagaatcagaggcagacaacagatacaggaatattggaacaagtctctcattatacttaagcactttcttgatgaaatgaagccattcactagaatcaggtagggctgctagagctaaaacctgcttgcttttcatgaaagatgttcaactagacacccggacttgtaatttgtcaagaataaagttgacattgagtttcaagtgatgagccccaagaaagatagaaacagctgacatctttgagcgttttgctgggtgtcgggcactgtgcggagtgatttctccggatcccctcatttcctcctcatagcaaccctatgaggctgactctgttaacatttcttatcactgtgcccaggggaagccgtccatctcacagctgctgggggaactcagaaagaaagcggggtgggcatttcgactcctatactggatgctcctgcttcagaaaatggaaaacaaaacacaaaaacaacttgtggaatttgtccagaattccttctattttactttcattgtacctgttttactgtagataaccaacaaccagactggacaaatggtcttttcagagacagttatcacatctgtgggagacgaagaaggcagaaggagccacgtaagttgtcatttcccctgtacttgcaccccgacacactcactttcattttcattcagtttgccaacggtgactcagatgcagaccatgggcaggagggagtggagtctcctgactcatttctaccgagattcctcaattcctacatttctgaccagacagatgtagtccagtaataggttacgcctccatgcacttggcatcagaaacaacagataaattaaattgagtggtcatttgcatggcccatctcagctttgaaaggggtacaagcaagtaccagacatgttgactgggactttggtgacagacctggtatatcaggtggtgaaatccccagagcctctgggatggctaccccttttgtaatcccacctctggtcaggcagtttgagaacaagaacaccttatgtggagcccaatggcctaaagggaaaaaggctgtccgtccatttcagggctaggctctggtcccctgtgattgcttctgttagttgcctgttgcttagtccagaggcagaatggatttcacagaattatagagtcataaatttggaaggggtgtgatttcacagaaagaaaacctgggcacaggtcgggggatgacctggttggagtcactggtctcctaactcccagaccagaggtggctcaactgcacttcatcttcccaaagatgtgctggcttcggatgcacacgcctgctgaggagtggccagtagggaaagtgtgccttttttatgaagaccgcaggaagccagcccccctgtatccagatggcttctgcatcctcagccttcccagggcactgaggattttccccacgtcttttggtctgatggctggaagggaaccagtgtacggatgacagttaggaaggtggtgttgtcttggttagtagctgatggattttttcccttgtttttggcacagtgctcaaatgtcgggagctggccgacttttacagcaggctgggggtccagttggctgtgtgcaatggtagtgacccaccattcaagggagcctgggggtggggggaggaactgtgcagtgaagtggaaagggcactggctgtggagtctagaagccccactttgtcacctaccagctagggcacctcagtttccccatcttcaagtgaggtaacaatgtccatcatctctcccagccctggcagcacagaagcctctgaaacgaagacaaggttaactaaggcagggatggaagagaggccagcttccaaaggtgggaagagacagaagaaagcgaaacaaaaaccagccagccataggatatgatcatggtcctagagggaagtggtttagagtgttccagatctcaggctgtgtttggggtttgatgaaggattgaggcctgagcagagttgtagaatgaaaagggcaggggaagcagaactcacagggttgtgaattaggaaaaaagcctttgttctcaagtcaaaaaaaaaacttaatctatcattgcacagtggtacagccgtgctctggggagggcagcagccgtgcctgtgagcacatctgcacctgctggaggaccaggatacatgaggctgccacatgtgcatcccatgctgccccctccaccctttcaacgaggcagctgtgtccagttggtgccttttagtcaggggaattgagactctgagagtgggatggggaagagacaagatcttgaacatgccaacggcatgcttgggcagaaactggttgcctgcacttttgtgctgtgcgtcacttttcccaagcatgcatggccttgtgtgcccctgtgtactcttcttcagatctcatctgggaggcccagaatctccacacctgcccatgcagtctcctgtggccattgtgtgatggaggacacaccttggcccccttgtgcagggcagaatccgaacccccatatatgacagtcctgagaatgcaggtggttgaggggagcggtagatctaagtaccccacgtgctggaggcttgccaaggttgtcttgatgcctgctcagaccctcgggatatgagcatattgggtttctatattagactaaattcccgtttgattaactagaagggagaccgggggcatctgatgcttgactggccagtgtctggacgatcccacagggctttggagaacagattggagacttttcaagccacctgtgagagggatgtcatatggcagagaatgtggcatgtgtgcctcactacagagctgcactcattgtcgcagtggcttgcccagagtcagggaagtgagatctagtttcccatgtccacagaattctttcattcaaccaccttcctattcctgggcacagttgacctagggcttcagcatcgtctttacagagacacggagctctttttctgaatagaaagcgataaagactagtttactatcaagggaatgcaggggactgtgctttgtcaccactgtctcattctatcattttgcaatttaatgatttttacggttggctctgaaatgcattacacactgcagaaactttctctcagagggaagagggagatttgccatggcaaaggacaaatcatatgctgtgtaaaccttaaaatactatacacaggagctaaattttcaggctttaaaatttccagatgaattcaattaaaagtaatcaccacacaccctatactttcctttcttcaaatgctggaatgtgtattaatatgtatggtaacccaaggaggctcacagaaagttacagagagtaacactatatgcctgtctagaaattgcacgcagtatgtgcaaggccctggtctgtttttacactcaaatgtgaaaggggaaaaggacaccgcagcttgttattgcacctgagcacatcggctgatggggatgtggtctgacgtctttgttgtgaggcttttgtgctgcacttgccgcctgccccacttcacaggtcagtggcagacgcactgatgctgtgctgcttttgtgctgggggtgaggaggaaagcagcatgtagaagctagagcatgggcaagccattgtgcattaataggacacttttatttatggaactgtgtccccacataggaaaagtctggcccaattagccaaggcacccttttgatggcacacatcctctttaaaatccaactcgcagctacaaggcttagcatgtcctgcatgtgttgtctttccggtttcacattagaatttgatgttaaaaagtgagctggtttgtatctaggtgaacacacctagtttgaagctgtaagttcaatcatgtacaagcaactccaagatactggccaagacttctggaaggctgggtacagtggcccacacctgtagtcccagcactttggagggctgaggtgggaggatcacttgaagacaggagttcaagaccaaccggggtaagaaattgagacccctctacaaaaaataaaaaataaaaaaaattagccgggcctggtggcacatgcctgtggttccagccactcaggaggctgaggcaggaggatcgcttgagcccaggcggtcgaggctgcagtgagctatgattgcatcactgcactccagcctgggtgacaggaataccctgtctctagaaacaaacaaacaacagacttctgaggccacaggtggatggattttcctgccaaaagcacccagcttgtagagatttgagtgacccagtgacttccttgttccagtgctggtggtggctttttgactgggacagcagactgaggacagtgatcatggagttcccgacaagtgtgagaccgcatgttgtgaggatactttgcctgttaaatgtattggagcctggggagaatggggtgttaagccgtgaccgtcttttcccatggagcagtgagcacccatcacctccaagcccagagagaccaagcgagaaagtgggagaggaaagtgtatcgaacaagcgctttctccctcaggtctcaagttcttccctgaccccaacttgttcatacactctcgagtggggtgctggctttgttttctccctgcgccctggtttttgatgctggactcaatccatttaatggagtgtcagaaggtaacatgatgaggaatcgctgggggcttatgattttaacagaagtgcaccaggggagggtgcggcacctctagagggactcaatcagttcccagaggatctgcctcctggggagacctgcaaggtccagggaggctagggtggtggctgagtcccaggaaatgcagcccttcccttctgtccattttgaggcagaatgaagaagtttgaagaaggtgagatgcagacctcggttcgagccctgcattgccttttacaagctctgccctttgtgactcggtttcttcagctatcaaatggggctaataatccccctttcacaagactgagtgagaatctagtgtggcaaggtttataaaggctctttgtgtgaggttcattattactgaagagtaattaaaactgggttctaatttgctggttcccagcaactttacagaaaaaagaatggcatgagactggggggagatgcgaaaggtctccacaggcacaggcgtctttcctctgacatttgtagcctcgggctgctttcattctgcagcagcctgcctcgctctctgagtgatgtgctctgccaggagctctgtgttcctggccacaaggctgactcatcccgctgttgttcctaaccgtgcctgtcctatatgtctaggttgaggattggggatacagacaaagggaaggataggtcaaaatgaacgaccaggggactaggcgatggttgggtactgataagttccaagttggggccccaagttggcaaggggtgatactggtttctgcagaaagaaacagacttattgtcctaaggttgatagcaaaggcttgtgtgaatgttcagttccatagtctgacaaccacacagagtttgggtacatttgtgtttcgagatttatattttgcgttgacttcgtgatttatgtctaaatataaggcccacttgcattattcagtaggaaaagatatataagaaaaattgaagagctctgtatcattctgagaaatgggtaaataattcccaaataaataaagttgatgtgggtgagcaatttttacggggtaggcatttctttttgtgctgctacctggtatattaagttgtactctcctcaacctcaatatcttccaagaaagaattcattaaatagaagcgattccacatctaaaatcaaaatactttggagttaatactgtggagatggtataaaaggttgtcttcaatcaaacattaagtgaaaaaaaattgcagaacagtatatataatatttaaagtatataaaatatacatatatggtatatgaaatctcttagttttagaaaaaagtacgcataaaaaatcctggtaagacatatattaaatcattagtagatctttccagaggattttaagcttgcagagaccctttatagatttctttattttcaaaagagtttgtgaatttacaattttggtctaaacatctctatgtttttgaatggttttgcaaatactttcagtgcaaatgctagaaattaaattgctaagtcaaagggtatgcatatctaaaattttgagagatactgacaaattttcctctaggaaggctacacccattttatttttagcatcaacttctgaggctgtgtttcaccagccctcacctacagtgggtgttaacagtgcgtgatcatatgataggcaaagaaaaaagatatcttcgttttgtttatatttctttgattattagatcaaagaaatataaagatcatttgcattgctataaaggagtacacaagcctgggtaatttacaaagaaaagaggtttatttggcttacagttctgcaggctatacgagcatggcaccttgtttatatttctttgattattagatcaaagaaatataaacaagggggatggctgtttgagaactgtaaattttatcaaatgtagagtctgcaaatttatcttatcccttcttttctttgtcagggagaaaggtcagttttgcattccaggccatgcccaagagcaaataccaagagcaaataccatctattccagtgtgaggtgattagggaggtgggaagtcctagcaggaacatttgagtgctcaatgtctatgtgaggcggctgatgggctgaatcacagagggtgggtggtggggacatgcaggctactgcctccacccctgcgaatacagacaaggtttagatgactgctgatagaagcagcacttcagagggggtggttaacagctcgggcacaggcagatccagttcaaatggcaattctattgcttattagctgtgtgcctttggttaagttcctgaactgctctaagccttagttttcccatatgtaaaatgggcttaataacagtaccttccatatagtattgtcatgaagataaaataaaataacccaggtcaaaatattatacaatacctggaacataaagagtaagaagtcagtaaatagcaggcatttgttatgatttgattattttggtagcccaatccttggctatcaaaattatcagtattaattcattcatttatttgcacattccttgagtacctgctacgtttttggcagagaagtgtaaaagacagtctctaacatcggagaagcatccaggctatagtggacaaaaaaaataaacaagtcattacaatatggatgcataattttgaaaggcaaaggttgcacagggcattgtgggggcatggtgcaggggaaaaccaggtagccatggaagacttgcttgggagacagttctctacgggtctctgtttctgctcattttataagcaaaggcacttctcagtccatttgcattgctataaagtagtacacaagcctgggtaatttacaaagaaaggtttatttggcttgccgttctgcgggctgtacgagcatggcaccagtgtctgcacctggtgacggcttcggaaagccctcactcatggcagaagatgaaggtgcacaggcatcacattgtgagaggaagtgaggggagggaggagagagacagagagagagagaggagaggtgccaggcttttttctgtttttttgtttttgtagagacagtgtctcactatattgcccaagctggttttgaactcctggccccaggagatcctcccacctcggcctcccaaagtgctgggactataggcatgagccactatgtccagcctctttttaacaatcagaacacatgggaactaatagagcgagaacagcagcaagccactcataagggatctgcccccatgacccagctaccttctgctaggtcccacctccaacactagagatcaaatttcaacatgagatttaaagaggacaaatatccaaactatatctgacactaattgatctcttgttccaggccatcttttctaggcggtggccttgaaaaacagagctagctctccctccttggcagagggcaggtttgcttgcagtccattatcaaaggtttgggttctctgagcttgagatcccttaggtgtgatgtaaacccaatgcatgtgcagcatccgtctggacccctccatggggcagtgtggaacctgcaggcaaggagaactgatacagacaagaggcttatgctgtttccgtgttgctgaaataaagtcctttgtctctgacccagaagtctcatgtcttctgctagcagccatgaaaccgtggcaggaacatgtatcatcttgcaagtagaatagaatcttagacccttcacacttcttgacaggctccctggaagaggtggcagttgagctgtattttgaatgttgtctaggaattctcagttgtggggaaaaagggtattcgttgaacaagtatttcttgttcaaagtcaaggaggcatgtggaaataagaatatgttggaggaacgctaaacaatttagaatgccagagctggagatgtgcgtgggggagcagcaagtaaagctgggggagaggcagggatgagatcaggcaggcctttgagagccatgccaaggagttaggaatacatgctgagttaggaacatatcctgcatctgcagtgctttaccatgtcctgtactgtatactgtaatgagacttcatgcaatccctagaggaaagagccaggaagatgtggtttggaagacagacattcgtggcgatggagctttgcttaatcctgctgaagctgaaggcttgagcccctttgggctgcaaagcctgtaccctgcaaaaagcctggcttctggccttgaaatctggaaaccgttacttagaaatggagcactttgcttttgcttggtgccagtagacaggacagataagtgacagtaattgaacttgaactctcattaggttgatggtgtcggctgcagaacaagctgatttctgtggtctctgagtagcctgggcatgtcaggggcccaacagctcctccatgcaggtgtgtggctgtccactgctctcaggacctggggattcttccagacaagcctggataactttcaccatagggtctttgtatcctggctgccaaatttgtggccctgtccttctttacctgttggcatcattccaaaaaactcattgagtccattttgttttgtttttaaaataacatcaagggctacaacatgtcccagtattcccttatttagtcaggcgctgtgccaggcatctgacttgcattccttcacacgatccacatgacaatgatacaaggcagacacccagttgaccccattttacagatgaagtaactgaggctcagagaaaattataaaacagaacttgtaggtggctgagccagtactaaaaaagagaaataaaatgaagcacttaggtcttgtggattccaaaacttccaagactcatgttcttaatgcaacatacaaaaaattgtgataaaatgtatgtaatataaaatatcatcttaacaatgttgacacatataattcagcagggttaattatactggagaaaagaattctccagaattcttctcatcttgcaaatcagagatgctatacccattaaacaatgcccccctcctgcaatcccctggcaacctccattcttctttctgtctgtatgattctgaccactcaaggtacctcatatgagtggaatcatactgtatttgtatttttgtgactggtgaatttctcttagtgtaatgtcctcagggttcatccatgctgtagcaggtatcagagtctcattcctttttaaggctgaatgataatacatggtttgtgtatatacatagatatattcatatattcataccatgttttgtttctccattcatttgtcaatgcacccttgggttgcttccaccttttggctattgtgaataatgctgctatgaacacaggtatgcaaatatctctttgatattctttcatatcaaatgctttcacttcttttggatatatacccagaagtggaattgctagatcataaggtcattctattttgaatgttctgaggaaacaccatactgttttccatagtggctgcgccattttgcattcccaccagcagggcacaaggtagaagtttttttttcaacctttcagtcttcatgactgtaggcactagaggacataagtgcccaatgtaagctgaaggactgtctcaaaattcctggcccctgctgtccttggataaggcagtgcgttccccagctctgtttccagcggttgcctctgcagtgtggcagccatagtctcagggagtgtttttaaagcttaactgatgccactgacctgagtttctcacccctcaccctggtctgtagccaacatgctgaaaactttccctaggcctgggcgtatgcaggctcaggctgcatcttggagattgtggggatccagagatgtgatttccttgaccattcaggaattaacacccactccacaccctcctttatgagccccacccttacccctccatggtgtcctcaaagactccccagaggcatgaggggcctcccacttccctgtaaaggggctccagactcccaagaggtcctatgggggactcaggcctccaaggaggttttgtggtgatgatggttgtttatcaattcccacctgtggtagcgagggcttcccgggaggtaggccaggggacagtgccaacagaggccccagtcacaccgtctcctcttccagggtcagagcccggagcagtggaagggaagtgggtcaggatgggaagcggggaatgcagaaggacatgtttaatgctcccagggaattcacagtcatgcccccgaatctaataaatgagctggtctctccaatcaggcaggaaacctctactcttggtcacatccccagcagactatgggaaaaatgacggatggagattgagtcatctaaatgtttgttcagatctcattgctctgtctactgtcagtttcatttttcacctccacctcctggaagagaaagaataaacaagatatttgggtacgttttaggggagcatagtggtagaatttggaatccaaactgctgcaagttgaaatccctgcttctggggaaacttccctcatggctctgagcattggttgctgctctgtgaaaagaggatttaatgactgcccgaggagggtattttacaagtaggaggccatgtctggagaatggtgtttaatagatgctgaataagtgtaaattctcctttctgacctaatttcctggaccccttgtggcaggaagcagtagtttactgaatttgagtgtgatgaatcagtaaatatgtttattttgttgtaaggttgctgttgctttgaaagagtaactgagaaggcttctgaaagatgatggtggctaaggtgctagaccaaacagatgaaaaagctatttgtgtaaagacaggcctcatgccaaagataaagtaaaacagtatatcactgagtcacacaattataaatggtagaattcacagggtcccctgaactcctctgaaccaggaaggaacacatgtggcccatccactgccataccccacctccgggcacatggcagacattgctaatcaattgcagagttgtttccttatgagcccagatagcctcagcacttgaggcagcacagcacttccaagcagcaactgacagttgggaaaggactatccttgaaacctgtgttccacccctgcttcagaccaaacctcctgttttacagatgagaaatcagagatgggagggatgtagttttctccaaatcatgcagccatcagatctggaaacttatttccagttcagttcagtttttagtgcatggtggacatggaatttcctttttcaggaagcagggtcttggtgcccttgtttttatcatatctcaaaaaattaataattgagaggatgggccacctaatgctgagaaagatggtgaagaccagctgggaaagggtgttctcaggcccagggaaaaaatttagaagttcataaaggattgtctgaagactgaactctggggaggcagggatttcacctgttgtgtgccacctccgtatccctgtgtctgtgctggacatggataggggttgagtagttgaatacatacttagtagatgaaagctgtgtgacctagttgcaaattggggaatagaaacggaagtaaaattccttgaaggtaagattctgtaaagagctgtaagtatgtaaatgagtctgatttgtttaaaaaatgaacctctgtttttcttgcctttgttcattcatctacattgttggacacctactgtttgctgggctgtatacccagtgttttacgtgttttctaattcttaaaacactatgaagtagatataatattattttatagatgagggcactggagtttaaagaagttaaattccgcaagtcatggcagacggtaaaatggtagaactggaatatgaacccagttgtaaattttggccatttcaattaaaagatatatttctgataaagtcatggtggtttgcagccataatgttgagttgttttgatccccagccttccattcccgggttacagcttgtgtcattaacatcaagagtcattgagcccctcccccttccaaaggcctcagatggaaaaccaacatcacaaaaggacaactgtatggttttcctctcccagggatggcagagctccttgggctcaggggagaagatatcagtggaagatggttaggaaactgtggaatctcacacctactttcttttgttctcaccactgatggggtgtcagacttgctgctgctgaaaaggaacattctaaaccagtagaggggcattttaagtgggtggcatgctcccgtgtctgaagaggttggccattgacacatttcagtgatgcgatgtggaaaatacagccacagggaaaacagcctgaattttccatagtctcataattcagggcctcccagaaaggaggcaggaacaaaagagtagtggctaggatagaaaaacaccctggcttgaagatggcggaggggcctgccctccaggccaggggtccccgggtggctggggtgggcagaggccagcagattccatccttctcatgcctggcaagcagaacttaggctcagccccacgagcaggagattcctagtagcctttgctttttccattgtttccagggtcctccctttttgattaaatctatggggacctccttccccagaaagaacatacatcctgtagcagaaagttcaaatcaaaggccagaagtcatactcagtgcttgccttgtgcagagctgctctcctctccccgcatccccatggttttgctgggatttggaaggtgagaggaaggaaagagaacaaatattcattaagcacatacacagatgctgtgtgaccatttcatatgagctactttccttcactcttaccaaacccacctacaacacagtgtactagccctgagttaaagataaggagtgaaaagctcagagtgacttgccaaggtcacccagctagtcagtggcagagttgggatttacaattatttccaaataagtctgtcttactccaaagcctagactccttctagtgcactgaacactgccttgcaaaatgatcagatggtgggaaggtcactaatagtaatggaatgtctggtacatgccatgaaatgtggtcatacttatcacccttaatctttctgacaacataactggttaggttttatcatgcccattttacagatgaggaaactgcaacccaatgaagttaaatgacttacccaggcttgcccagcaagaactgaggaagagagcttggggagctcactgtcgggggagcgggtcattttagagccttttgtctgagtcttggcttggagagccggggcaaccctggtggtgtggccgggctccttggtgctggagcacaaaggaatctcctagccccagccggaagcaccaagaccattatgaggatgggcggctccagggtttctggggcaggaaacttgggtgtgcccagaccaccttccctagaccatctgcacatggcctcctccttggagctggagttccacgtttcttgccatcccacaaaagtgaagcaaaatttgacgtggcctcttgtgagcaaaatgaggtcaaagcatatgtttttccaccactgaaacattaaagtttttcccaggctcattagcataaacgattcaacttgaaaagttaaaaaattctgggagacccctttccgtcctcactgtggaagaactttgtgggtagtgttgggggcaaaagaaagaataattcctcagggcagggaagagactggaaggcaggagattggacgctccttagaggctcagcagggaatcccaggcgccgtgccccacccagcagccctgccagggggctggggaagtgactttttttctgcccaggggaaaacaaactggtttctgttttgttctgctttagattttcttcactttttctttttttttttttttttaaaggaaattgagcaaattctttgaattgaatttataaagagggcaatggattagggacactgaagcagtggttgttcagcttgggcatacagcagaattattttcttaatctggatacaactcatgggaaaagtaatgcgtttttattttcacttacttttaaattaaattgagcacttcctttaatctgaaatgtggacaacaaaccacaatatttgcagtacttcgtaccaatagcaatcacaaatatttttattttctcttactgttgttatacatatcttaaaatagcatttatgctcagcacttagagatgaagagagttgtcagagttgccgataggtcttgctatccagtgtgttcataagaagcccataaaatactgtctctcaaaatattttgataactcgacttcaacacaaccatttttctttgtaatcctgtatgtttacctttattcatctaactctgttatactgagaacaggagaacaggcttcatctaggtgttaaaggggtccctagtacaaaaaaagttaagaccccttattttaaaaaggccagtgtccacactgggacctcctagtcactcctcgtcacagagacagacatggcctagtgggcagcagggaggctgtagaaggatctgtctgttgccttcattggagtgacatccccaccattgtagataagacttaaccttgaggttcctcgaatcatgccagcttccccattcaggtggtttgaatcctaaagactatgaagagccattttgaagaaactgaaggttgagaagattctgattaccagcattgttgtataggcattgggtcgggggttggtctggaaaatgctgggcctgggctctgtctcagatgtaggagtgcccagctcatcctggggcgtctcccagatggaccatttgacagcagtgtagcccagataggggcctgcactgactcctgctgcccacaactgcagccaaggctgatcttcggtggagaaggcctctgtcctgtggctgcagcttggcagcctgaactgctgcgtgaagcatcctctgactcccttctccctctgcagcctgtcttacccatggcatagctggaggatgcagacatgacatccagtggagacttgtgatatgtcaggagtgattacaggtcacagcccctggaaccttgttcttcttgagagatttcacctgccccaccgaaggctccagccctaagcctttgggatggacagagaaaatacaaaatatgatgcagtttttgtcacctcccagttctctcaagtccatgtgcctagggactgtgtctcagaagcactgtctcctgaggaaccagctcttgcataggtgctatctccaagtgctgagagtgtggagggacttggcacatttattactttcttcccaaggcaaaggaaaaccaaatttaagagactgagctaggccaagtcagctcactgactcatctaaaaagggcaaacaagaaaccagttgagtcaatctggagaaactctatccatccccaaggacggggtagtgtcctgaatgtgatcaaaatgaggctgggcagtgaggacactatcagagcctgcttggctttttgtaattactgaaaaacagaagcatgcgcttccaccctgtccctgaatcctgcccaattcctagccctcatcccctgcatcattccttcccttgcatgaatgaaggaatagcacaaccaatcccgtgaacagtcctaggcttatctgggtgcaggtaaatcatgagattcactctaaacttaatcccattaattgccgtgtttgagagaaaggggatttcattagggcctccagaggagttttctgagggaagagatacaagctctggccaccccaggaggccctgtatggaccctgctcaccatggttgtggcgggacatcgtcctcacttgtggcccgaggactggctgtgctctccctggcccatgggagcgggaaggcccagaactctgtggccacggccgggcgctgctaccctccacggctgaacactattagcctggggcagatgtcagctctgagaggtccgccaattctggtgtgtcccaaaaagtggctgagactggagactaggagatgcaggatatggatgaagcatgagccagagtgctatttgcaccctgaagccagaaaaggaggaaaagatgatggagatttgtggaggtagctgagtgtctggagaggctggggtagagcaggtaccacccttcagacagcgccacggggaagctggtgggacatgtttctgccaacttgccaactcctaggagacctgacgtgtcacccagaccctttacccagcagggcctgtcatctcccctaggagggcttgttatgattccccagacctctctcctccagtgtttctttcaggaggactgtccccacgcccctgacacatggtgattagggagcccccgtgactccgactaccctggagcgcccacagcactccccagaggcagctccagatgtctgctgttcattgcccagaacgcttattttttaaaagaggccctcaccatggacttccagcatcaccgggggcaatgctgggaatgggggtggtgctttcctcagagaccaaccaggaccatggggagcacctgcagcagctgatccagagaccaggacatccacaaggacagatatcttatgaaaagtcctcaggttcataggaatgctaactctgctgggggtgggggagctgcctagccatggatgataatataaacctgtttggcctggagagcaaccaagaaggcccaggggtcctagccaaggccaggcagggtcaaagtagagatggaaaagttgctgacatcagtcatggggctataaagtggaggcatagagagaaggctaaggcagagggatatgagacaggccttttttctctagacggctgtgtgtgattgctgagggcacaaaccccaccatgattatgcttctggttagccttgctgcaggggagcagccccacccccagccccgtaagcattggtgatacctgccaagctctgagatcatcaccttcaaagtgcccagcaggaaggctggcaaggcagagggtgagtttggatgcaccgtgttctgggcatctgttacccaaacttagcagtataaaacaaccgtttattatgttcctggattctgtgggttaggaacttggacaggtaccatggggatggtttgtctctgctccgtaatgcctgagacctctgacttgaagccagggtactcaatgaccagcgctggagccatctagaggctcttttcacccaagctcctggctgttgcctggaaccctaggcagtgctgttggcctccccatgtagcctggacttcctcacaatatggtggcttggttcaaagggcaggcacctgacaagggaaagagccaaatggaagctatgttgcctcttagaacccagctgtgaagttatgcagcattacttcctccacagttagttcattagaagtgagtcattagagccaagtgctctgctaggatgaggacggtatgattgagggctgggcatgctgccttccagccccctgctattttctgtttctggaagcagtcccttggtcgaagaagctgtgagtgctctgggtggagaagaggccagtgatttcagtgcaggtcttgggggctttagggactgaggcatttccctccttgggttgcctggaaacaccagtgaccaaccagccatgggtcgcctggacaggaccacccctcagagagaaaagccaactgtgggcacttacagccctcccatctgaatcttgcctttcccagtatgagtcttggcatgtcttataaccacctgttggtccttgaaccctgaactattcctctcttcatcactccagccctgagtacccaactggggtgggtactcaggactggggagcacccaggagagaggcgctagttgcccagtgggagagtctgggaaggcttccttgaggaggagacatctgtgctgctccctaaagattaattgacagataagggaggtaagggcattctaaaagcatgggccaaaaatctgggtcctagggaggtcagaaaaatcaggctggaaaacaggttgggagctgaccaataagagctctgtataccatgcagtttggactccaggtcatggttgctggagtaggtggagacagtcagttgtgaggtagaatgtgctcagggtgacagtcttacaggaactcatgaccttggtcagtctgtgagagtccagaacccgtaagccctgcagattcagagaccggacctgctcagcaatcttgctaactaaattctgacctcactaatgtgtaaaccaaaagcacaggctattaatttgcagggttgaggaacatctctttccatgtggggacccccatccgggatgctccctatgtggtgtcagggtcctggggggcaagtttggttttctgtaggttgctgggtgagtgagaattagagccgagggagcttgagattgttgaagggaagtcatgggttcccgggtgcctggtgtagtcagagcagagagctgccacggagctccaggcctccctctccccgggtcactgggacacaccttttgttcactccctctctccttgtcacattcttttatgatgtcagaatcacagatgcgggctgactgttcccagggcctggaaggcaggctgtctcctccgattatgtgttgactgaatttgtgcaaccctcagccttctccagggcccctcggctggagcagctttctgaacaattatgatcagggacgtgcataatcaagtttgtgttttaggcagataactggagctgcagaaaggagtctggtggagagggaggcaggctggtggctggacgctggcctccttgctgccacattgtgcataggatgaggtatgacttggtgggagcatctgtgagggtagcaaaggcccttctctgcctgtgaggaaaccccaggacagtgagccccaaaccaccagagtccctcctcaccaacttcctggccttagcaggagctgggcaggaatagagacttctcaggagggtagagttaggagtgaagccagcttcctttctctctggcactcatctcctgggatccacatccggattcagttcctgagaacctggtgagaacttggctacccgcctgtgaccggaagcatttctcccggagtcacatgggggacttcacactgacctgggctggctctcctgctctgcatccagacgctgtaggtcccgcggggtttgcagcctggagtttggagcagctgaaaggcctgtgggccctgagcagatacagcagcagctgtcagggggctgctcctgccaaggcttccccgcccagcctccatttcctgacacaagggtaggacagttggagctccctgcgggttgggaaacaaaggccaaggcccctgaatggatgggaaaagtcaggctggggagagtctgaggttctcgctgttgtgattcatgcctttccttgcgtcggtgaacctgttccccacctctgtagctgctcttgttaccgtgggatactcagcctggccatctttttggatcccggaccccatctgctgcctgacctagcaggagagccagctgctgcttcacatcccagctccagcactcactagctgtgtgactttggcaagttactcagcctttctgtgcctccatttcctcatctgtaaaatagaaaggaatagtaacagccctctctcagtggagtgttttggagatcatgtgagttaatgcttaggatgcaggacagctctgggaataatatctaggaagcaatataaatatcggccattatggctatgattgtttcatgacaacccctgttatcatacacaatccagaggcttttctccaagtacagaagctgcacctgagcatggttgctcacacctataatcccatcactttgggaggccaaggtgggaggatcacttgaagccaggaattcaaggccagcttgggcaacatatagagagaccccatctctacaaaaaaaagttaaaaacaaaaccaaacaaaacgataaaaaaaagaagaaagaagaaagaagaagaagaagaggaagaaaaagaagaagtggaggaaggagaggaagaagaagaggaagaggaagaagaagaggaagaggaagaagaagaggaagaggaagaagaagaagaaaagctgcacatgctcacaaagcccctgaagcacaggccagaatctggggtcgtgagtgggtacggggaggaagggcagtgcttcccagcctcctccctggagtggggtcaggagcaggcaccctgatgtccttgttggcttatcttcatggatgtctttgaggccacctctctttctgtggccaccagcccttccttctcaaccttctcctgctcaaggccaaccccactttctctcttccaagaaatgcacctgttgaatcttcacattgatcggattggcacataaaatacaagacaccctatagaatctaaaataatttttggtatgagtgtgtcccatgtaataattgaggcatactgtatgaaaatattattcattgtttatctgagattcaactatggctgggcatcctataattttatttgctaaatctgacaaataaaattcagctaaattatttgctaaatttggctaaatctcctttaatctgtccaataacctcatgaggttccccactttgaggcccctaaacaaagaggtcccatgcaagtggaataaggagccatggaggaggcagcgggtctgggagacctggaagtgctgctggacttgtcagtgcatttgggcctgaaatgcccatcagcctcctgatcttctgcatatggagtgctaactgtggactcggtgtgtctggggaatagaccccggccaggctcagtggctccacccacacagcgtgcctttggataggtggtcggggctgtggagaccctaagtccccggagaagtgttggggggagtgggtagagagggctctcccaacggctgccaacccaggtgggatgacaggcacttggatgagtagagacaagctgcttcctttggagttaaatatgcgtctaacttctccagaggaaatgccactcaggctgaaagaatgttgggaggctctgtgtgtggagggctggctctcggtggcctggcagcaggacaagattcctggaggaaggaacaagcttttccagggaccgacaaagagagaaggctcccagaggtgctctggaggtgggagctgtctgtatatattggaaggagaagagggaggataggaggagagagagaactccaggactctttcctgattaaggaaggcatgacaggcactaaagggttaggagcagtgttctccataccctggggtgccaagctctgctcgggggtgcattttcctctttcctgggcagtgtgacttgggggaagaaaattggtgggagcagccccaggcgagccaggcctttgcagacattggcactttagaataataatagctggcactgatgggctcctggctcctgcctgggtttttccacagggcagtctctgcagcgggtcaggctagagcccctcagtgaggtttggggcccccaccccctgagctggctgagagtttccagtgtagcatccaggaaagactggaggcgccctgctgcgttccagacaaatgtgcatcttacaggctcctgcgactggcctggttttaaggtcaaaaaaggactctcaggaatggggaaaacctgacttgggaatcctgtaggataaaagggaagcttcctgctgctcttcctcagggcactgttgctaatcctccagtcaccttgtgccagggccagccttgtggaccctgccctcctgcagcaggcacagctggcagtgctccacctccctgagagttccagagttccctcctgcctcacactgccacctcctgccccctggctggggccccgacccagcccaaccactcccagagagagctccacagagcactgggttgcagttgagcagaacttggcttgagtgtagctctgccacttctgattttggcaagtgacttcattgtactgtctcagtttcctcatctgtcaaatggggcttctcttgcttactgtggaagacaggatagtgtgaggacgagctgaggtgatggatgctcaggggtctagcccccaggggtgatcgaattgtgtctgtttttccttgttccgtgcagcctccttgtccttgttggtagttggcccatcctgggccctctcttggttccattgcaactgtcctccttcttcttgtcttcccctccagagcagagggctctaggatgaagcaggaagttgtgctgttggtaatgggaagggcactggctcaagcctgatgttctgggccttttcagtagaaatgtattcattaacaaacaagacccattggcccacacttaagctcaggagaggccatcctttgagctcctgccgtgagttaagcactgcaaatagagatccacgctaggggtagagtgggtggaggccactaagcactgttgcatctgttatctcctttaatctgtccagtaacttcatgaggttccccactttacagataagacccagagagactcagtaattaggccaagatcacctagcttgtaagtgaacgtgtattagaacccaggtgtgggcgcaaaagcctgtctcagccctacatggccccagatgcacttgtgccatatggtcttgacttgtgacccagcattatggcaagtgcagcgacagagcctgtagaggggagtgtgggggcccagtggggaatggggaactgtgcctggactctcccagtgttggcactgcaagtcctgcatcccaggatacccctagccctgggtgaaccaggaccttggccacttcacccacactgctgactctttaccagaggaccacctctgctcaggagggtgcctgggccaagctgcctccccacccgtgggttctgggaacagccccacatccaggagaggattatttgtttatctcacaaattataccatctgttcatcctgggagcactcagggcctggcatgaccacaccacccccagggtgccaggaaatggtaatccacagataacatgccccacccaaaccttcagtgactagaatgtgtacggggctggagtgccagagcctggctcagccaagagacgctgttctggtccctgtggctccacatcctttggaatgtaccagcacctccccactgaccacccctctgtcaccttctagcaataagatgctgaaggcttaggaacagagctgactgtgcgtggaagatccgaaacagaggagattggggctgctggcttgtatcgggggaaggtgcatgtattagtttgctagggctgccatcacaaagtaccccaaacaggacgacttaacaggaatctattctgtcacggttctggaggctggaagtctgaaatcaagatgtcaacaggattgtttccttctgagagctgtgagggaaggatgtgtgctcttatgaatgtgtgtgtaaatctgagcttttcttccatcaacaccattaggctctaaggctctatgaccagtggttcatctactggtcagttcgttctttctgttattcttttttttttcaagatggggtccactgtctgactcaggttggagtgcagtggtgcgatcttggctcactgcaacctctgcctcccaggctcaagcgatcctcccacctcagcctcccaagtggctggaatcacaggtgcatgtcaccatgcccagctaactttctgttattcttttagtgaatggcagctgcgagtcaagcacatgctgggggaattagagtcagagactgctccagaactcatgttgaaattcaatttccattttaacagtattaagaggtgagacctttaaggggtatttagatcctgagggctccacagtcataaatggattaatgccattattgtgggagttggtttcttataaaagggcaagtttggtccccttttctcttgccctttcttgtggccctttcactttctgccaggggatgatgtagcaagaaggccctcaccagatgctggctcctcaatcttggacttgccagcctgcagaaccatgagccaataaatttctgttcattataaattacccagtctcaggtattctgctatagcagcaaaaatggactaagatggtgactgacctcaaagggtggctgtgaggatccgagaggcatactatacttaaagcctgaaggatgtgcaggcaactggttggcgctttctaaacttcactcttgtcctctcctcctgcacagtgtgcagagctctgaggacaagtgcatcctattggtggaggtcctgggcctccattctgcatgcagttgaccctcacttcttgccctgaagatgttctctccagagccatgggcttgagaggagcttggggaaggccctggccctggaggcatccatccccagcagcctcttcctttgggcctccggtgaacaagaatgtctgggattcctgagaagtgtgggaaatccaagtgcccagccagtatgaggaatgagatgcagcatcagaagggtcccaaagaagcggtgcctctgcgggccccacacagactctgggaaagcctccagggactcattgttgtcctctccctcctccaagttttgacttctgctcactcagagcctctctcctctgatcaactctaaactggaaaatcaaagactctgaatggctcctttgccattttccactatttcatgatagtgtcaaagcaccggggctgcttccagcctgacattcctgccaaatctatgctgtgttcccggtcagccctcgctcccgccagcttctgagctttctaaatatagttccctcctcgggacaacaaagaagccatcctctgaatgactgcattccccatggccagcttctgggctgtttgtcagattcccccagcaggatgggagggaggagtgggggcaaacaggagtggccaggactggagaggagctgctgaagtccatgcagcagggtgctgtcttccagccatatgacatttgggcccagacgctcagtggctatggccttgaccgtgagttcctgccttctgtctctggggatgcatggggcccagagccctgtcccgggcaggtgctactaagttgtgactgaagaagaggagagagaaatggtgatctccccagcaggaaatgaaaagtgtctgtcagctccagtccagtcaagctgggtgacctctgggcagattctatccttaagtctcagtttccacatctatgaagtagggataaggactatgtcaaggagactagagagaaattgtgccaggtggcgggcactagtggtcctatctggccagggctctgtgcctgcatgtgatggattgcaggcatagcctttgaagtgctttttgatgtgcctttcacttcaggatggagtccctcttctggtcccagggctaagaggtagatagaggccctgcaaggtactcattccttactaaaacaagaccccaagcccagagcccctgccttccctcccaggcctcttatttctgatctcagcttctcagccatccagagcccagttgggtgctgaggcccctttaaaaagcccagagcccccgccttccctcccaggcctcttatttctgatttcagcttctcagccatccagagcccagttgggtgctgaggcccctttaacaccttggctcaaatgtggacagaacccttgagcacagctaagagcaattagaattatggaaaagaaaaaaacctggatttctcagctcagggcctgtctgtgcttggagggcactgacacatgtcctctccacccacccactcagttctactaagggtagagggcctgacctcttcctcaggtctaacaaacactgggaaaggtgaggccagcccctactgctagcggtcttcaggagagactcaatacaaacagctttactggatggagagcctggcctttgtacaacaaaaggtcactctgccccaggacttgcctggggtggacatacaggccacttcccacctgtttgacaccctcaggatgtagataagtcaggactagatgtttgatccccgagtgctgaccaggacagagatgtcaagctttggtggatgccttaaggccctgttgatttagaccttcctttctgctcacagactggccccctggcaggggtgcaccatagcgggatcaggcattggatgtgtggaggagcagatgcatagctatctgttgctatggccaccgttcaccaagcatgaactctgtacaacagccctgcaaaacagctcctgccttcatctttgtttttaatagaggtagagtcagcagcccaaggtttcacagctgttaagtggcaaaactaggattcagtttgtgcaccttggagtccggaagtctctagtatgaccacaattcttaaagagtgtgttcctgctgggaatggcagttgcacatccaactagacaagctggtgggctcgattataacaaaagcctcaagctttcttgaggggagtcatgtggaactaacctaccagcactccttgctgataccccaaaggaaaccagtagctttggtatatttaggtttttcaaaggtttttggcaaagttccatgccaaaattttttttccgtacctagaaaaacaattaagtttgaagggaatatgctttgtcatgcataggagcctgtttagggaaaggaagatattcctaaggatgaaaatgcacccgtcttgatggataattgtaaacagcagggtcttataggaattgatgctagaagaatcttagctcatatttttaattaaagatctgggagaggaaatgtatagtgaaaatcgcaagtctacgaaggcctttcgggggaatgagaagccaaattaatggaatgtatgttttttgctctagttctcaaaccattgctaatgatctgcattttgttggcctgtttgccacagtaagatgcaagtgctttcacccactcaacacatatttattgtgcgcccatgatgttccagccacagtactgggcacaggcatgagtgtggtattattctgctttacagaagggctttacaaaagcttatggtttcaaaatttccctgcttttgtttatggttctaacccttgcttgttttagaaatcattatgcaaagaacaactgcattctttttaatgtctgcatggagggatttttctgtgaaatgactgtacaataatcagttccctctggttggacatttttgttatttctggattataaataatataacgatatagccttaaacacacttgttctcagatatttacatatatggacaagtgtttctgagggtagtcaccaggaagggaaatgattgggtcaaaggacatatacatttaactatttgatagatgctgatggattgcctgcaaaaaaaaaaaaaaaaaatcttcaattttaattaccccaaagcatttggcaatgcctatttcctgaaactaacattgaatattttattagtttcctattgatgctgtaacaaattaccacacatttactggattaaaacaacacaaatttactgttttccagttctggaggtcagaagtccaacacaagtcccactgggctaaaagcaaagagtgggcagggctgcattcctctctggaggctctaagagagattctgctccttggcccctggccccccttccatctacaaagccagggatggccaatggagtgtctgtgacacctggcatgatatcactctgacactgtctcttcctctattcccttttccatttttaaagtcccttgtgattccgtcaggtaggtgctcctggataatccagagtgcgctccctaccttcaggtcagctgattagcaacctgcattccctctgcctctaatttccccttcctatgtaatataacatacccacaggttccggggaataggatgtgaacatctttgggggtgctgttattccacccaccatggagacattcaacctttctaatttcttccattctaagtgaaaaaaatggtgttatgctcttttaagttgcatttcttgattgatttcattggtgaggttgaacgcctttctatttgaagaggcaaatttctgttattctaagttgtccgttcataccctttgtctcctttgccactgggttgctctttctctctctctttttccaattgaattacgaatttcttaagggcagaggcctcctcacattcacctttgtgtccccagtccctcaaaatatggctggttcagagaagggattctgtgcctgttggcccttcctttctcccaaatgtcgtccctcccactccattttcttgccattctgctttggaaagaacgtcgggaggcttccggctgagcagcctgagttgtgtctgtgcacaagagcgtgtgctgggctgagacaaagcgcgtctgtgatttgttcccagccctgttgggacttctctggccgctggggctctggctcagactcagtcccttcacttgggcggccgttcaccctactcggagcctcggttttcttatccgtaaaaacagcgatggtatcatgcctgacatttaaggggtgctgggaaagtaactgaaacaaaagcatcaatgcttggcaagggagcaccctggttgctgggccgccagcacttgcagtgttgatcagagcagcagagcccctggaaggggactggaggcagctgccggaggtccaggcctgcccggccaggctcttccaggtggggctccacacctgcattcaggatggggaggatgctctgggtcagaggggagagccggtccttcccttcctcaagacccttccagaaggtctgctgggccccagaataccaggcctcaggagggtccttctcaccactggctgctacatgtggagccctgaacccccttggctcaagggctggtggtggaaagagaccctccaccctgaactagtcacattatcttggagggacctctctgcctccatttcccggctggcaatatagagaaggcagtccctacctgcctcctgctgggaggagtcactgaacaagatcagggccgtcaagcctgatacctcaaaagggcgatcaatggccattcctgtcatcatgttccctcctcccctgccctccttcccctgctgtaaagctgccggttcgtaggcctgagcctgacagcaggtccaggagctgaagcagccctgcttctgccagtgaccggcgaccatggcaggtcacagtgccctcggccatggctccctgttctgtgactcaggccttggggtggacagattcccctcactccttctctccctgtttctccagccaggcagagctggcagccatgaggagacagcacctgggctgggagggctggagtccagccaccctcctctaattcatttccaagctggcagctgcctttccctcttgcagggaccctagacccaggaccctgagggcgctctctgtgggcagggctgtggctttctggcagggtccctagcgatgccccctctgctgcctcccagtcttcacagtcagcagagcccttggggcctgtcttccagcctttcctgtgcagtcgggcgggcctggacctcattagcactttttattaaatccatatgttctgtgtggaagaccagccctgagtccctgtgctcccgccctgggtgtgggtgggggagaactgtgcacagatggcgattgtgtgaatttggtgtgggatcctccaggctctgggctgccaagcctcctaggcatggagatgctgaagggcagtgcagccaggcagggatcaggagcgactagagtctggaggcctttcctgaccctgctgagcctgtggggtcaagaatggggaatggaagcgggcctggcccttcctgggcactgtgggcctgctgctctgctctccattgacacatctgctccctgtgcccttccccaggagtgcatcatcgacgaggactgtgggcccagcatgtactgccagtttgccagcttccagtacacctgccagccatgccggggccagaggatggtgagtatgccagggcctctggggctgtggcaccagggtctcgggcacctgggggagaaagccaggggccccagcgttctcagctgggcttcccagaagagcctcaccatgatggggaggacccaagagggctccccagagggctgactcctggaggacaaggaactcattccagtttgggatgacaggaagccatctgcagacccagggccactcccatccaccccatgtcctctggtcatgttgtttgtgtcattgatggtagagaaggggagggacggccaggcaccgtggctacacctgtaatcccagcactttggggagaccaaggcagaaggatctattgaggccgggagttcgagaaggggagggaagggagaggaggtgtccctacacctgttgcttcccctggggatgacccatcctaatagacaaacagagacattccggcagcccccaggcagggagagcggcagctgctctccttctggacctgcaccccacccaccagatctttctccaatctgccaataagagagggcagagggacagggcaagaagaggccagggcactgccccagtgcaggttagattgggaaatgtggagccagggcaaaggagactcttcacccaacaggcattttggacgaagccacatggactcacagacttttcatagtcatttttccttattcagacaataacacagcatgctaataagcttggaaagtcaagcagttcttattaccttacccgactgtctgtggtgaggccactgctgttgcacctcccagccaaccccactcggtaccgtcactgggcacagccgtggggacctcactttgctctctaactgccatgccctgtgtggctgcaggaccctggcacccacaggccatcctcatcttgggctggcttgggccttagtttaatcggctcatcattgggccttgcctctttgggcctggacctagggacctaaggaaaaagggaacagcacaagtctgtggggaccacaaagaccccctgctgttctttgcaaaatcttaagctgtggagaaagactcagatccatgagtcctcccggtgccatttttccagcgttctgacccccatgtctcgccagccaagctcccacctctgtcccactgactttcactgaaatctcagcctggtctgcctgtctctacaatgggaggatgcaggttggcctatctgtggtatcttcaggctgggctctcagcaggcccccagtccctaagccgctggctctaggctctttccacctgtctgcagctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggtgagtggcctcccctcagatgcaggaaaaaccctgtcccaagctccaccacactggacctcctggagccacgtccatgccaaccacatggtttcgcgtcccacctcttggataggctcccaaatgctcatcagtgtgtgctgcactcccacagcctctgcccggagtgggaagaccacctcttttttttcccgtgttgatgctcagaaaagttaaatgacttcaggatgcaaaagcccagtctggaatggggtgggactagcagccccctccctcccaccactccttatttcccaggttcctttacctgtgaatcacccgcttccactcccatcttccgtcctgcctctcccaggtgaggtctgctcaggctctctccgcccccactagggttttgaaaaattctcatttgccgcctccccagctctgcatccccagcccactagtcctccctgtacctgccgcctccgtgatcttcctaaagggctgctttttgggtgttgctcccctgggacctgcagcagctcctgttgtctcccacgatgttcagactccttaggctgtcttgtgaggcctcatgcagctccaacttacttgccctccttttctctccactacttcttggcctatttgggaatttcaccggccctgacattttccactgagctcaaccccaggcctttgctggtgctgtccctgtgcctgaatgcctttgcctccctcttaatttctccagactttctggccctcaaaatccagcagaagcccacctcttccaggcagtcctccctgcttcagccctaccaatcattccctcctgagcccaggctgctattcttgtttcctgtcattccgtatcttcaaaactagcctgcactttggggttgagggtgggaggtgggaggttatgctccatttctttgcccctccctttggagcccttctaccctacacggggcacacaggggtgactctgggctggttccaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacaggtgaggccccctaaccctcactctcagggagccaagggctgaggaggtgccatccagcaggggcgtaggagcaggagcaggttttccctgggggaggtgtagattccctttaggattggtttgagaggtcgttgggtcatgcagatggaagggtccaatcagcagtcggttctaggggtctggagcccaggctgcccaggaggcacagatctggggctcatctagctggtggctgaagcttcatgagtggatggtccatggagaggacatggagggagaaaagcctgggctccctccccagacctgtcacaatgacagataagcagagaaaaaggagctggcagagaggccacggggaggccaggagtggccaccaaggtggagggtgcagcccacactgtctgaggctgctgagactccatgaggcatgaggctcaagcctggccagcttctcagggcacatctccctgtcctccccgcagcctctactcagtcttctctcccaacagaatccagggctgctgggcagacaggcagaactcccattccccacggctctgtgcagtggctcacacctgtaatcccagagctttgggaggccaatgcaggaggattgcttgaggccaagagttcaagaccagcctgggcaacatagggagatcccgtctctaccaaacacattaattttttttaaaaaaaggaattcttcctccctattcccacagaggtccatggctccctgcatgtggctagactacaccccagagtcaggctgactcctgcctggaggcccgaatgggccacagtctttgaggggctgtggtgctgctacatagcactcaggtcctgcccctgggctgcggggcctgagagtcacaggaggtcaggcctgcgctggaggaggggaagctgccccccaccagcacattctcccaaagtgagcctccctcagccatcattttaagatagatgttgacgggaagtgaagtgtctctgttgaagagacaggagaggagggggcatgaaggtgaggctgggagccccacagagtcagggcgccttagctttcggcctgggcaggctcccacgtttagagcctggctttgtcccatctctccccagccacagcctggtgtatgtgtgcaagccgaccttcgtggggagccgtgaccaagatggggagatcctgctgcccagagaggtccccgatgagtatgaagttggcagcttcatggaggaggtgcgccaggagctggaggacctggagaggagcctgactgaagagatggcgctgggggagcctgcggctgccgccgctgcactgctgggaggggaagagatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgctcttctgtagttcttggatttcttttcccttttgactttgaataaatgtaaaatcctttcagccagaaaaagtaaaatagaaacaacctgtattaaaaatcttccatagaagcaaatttgccacccaactgaagcacacctctttcagcatcaaaatattttagaaatcttaactatttttggatgggaatttgtcttaaagagtgtaaatgcttcacggccttctgaaaggacaaatggaatatgtatgactctttttttaggggagccttctttaatcaaatgcagttctgggccataagacagtaagatcctcaaggaccataatattagagctactatattgaagtcagctgcgtggcaagtgccagattaggcagtctacctatattcattcatttaatcttcactgaactccatgagcattttcttcatttcacagatgaacaaatggaggtgcaaagagattgacagagtagaagtcagacaaaaacagcatctagtacagtatgtccaggttatagtgattattttaagatcaaatagggagctgttttctattcaatgtcagaaaccatcaggaccaccctacattctggttactcaacagatatctactgagagcctcctcagaatcaggtgctgtggtacgctttggggtgccaagctgacccagatagggtccctaccttgaaggcatcccagtctaatgagggagacacagccagagcaagcaatgacaaaacaaagacagtcaacccgatgtgggaacagaggtgttacggaagcctcagtggagcacttggggagagctggcatgggaactggctcttgaagatgataggagtttatcaggaagccagagggcacaggaaagggctttctgggccatgggcagagggagggaggcacaagggtcaggtgccatgtaggggaaactgcaagtcatttgcagtggctggaaggcaaggaaagcttgaggaagcatttagagaagaggctaaaaattatgtcatccaaaaaatgattgaaaacattgtggtaaatgagataaaactaggtcccccatagttgtatatgtagatatagtaggctgctccattttgtcatgatagccacaaacttgtaagaacacgagaggctttgcaaaatacttagctgaagccagcatctgagtagcatctgagtgtctcctttactcagtcctgagtgaaatgtgggaggggctgggtggaggtggtgcttgaataccttgctgctgctctctcccaaagccagagttcctgccaagccatggcagatgccgtcaggtaaactgctcaacagctgttctcagtccctccagcagctagggctggccccatgacccaggaaatgtaaggggagggctcccagagtttctggaattttttcccaattgacaaaaggagagtggcaaacaagaatggagctcctgccctccatccacttcccctgcctttgagtatggtgctcaggaagcgacatttggctctggggcagccatctggtgatcatgtgatcaacagggctgcattcctctggaggctctggggagagtccatttccttgctgttttttagcctctataggtcactggcattccttggctcatgggccccttcatcttcaaatcctgcaatgacagttctgtccttctcaggtgccagctctctggctttctacaggtgggaaaggttctccacttctggggacccatgtgatcaaattgcgcccacctagataatccagaataatcttcccacgtcaaggtccttaaccttaattgcatctgcaaaatctcttttgccctgtcaggtaaataatcacaatcttcccacgtcaaggtccttaaccttaattgcatctgcaaaatctcttttgccctgtcaggtaaataatcacaggatacagggtttaggatgtggccctaccacagaaagagtctttgagtccttgacattgaggaggaaaccaatcctg

SEQ ID NO: 13728 - DNA, 49931 bp, Human; identical to SEQ ID NO: 13727
  misc_feature (1)...(49931): n = A,T,C or G

SEQ ID NO: 13729 - DNA, 49931 bp, Human; identical to SEQ ID NO: 13727
  misc_feature (1)...(49931): n = A,T,C or G

SEQ ID NO: 13730 - DNA, 163181 bp, Human
  misc_feature (1)...(163181): n = A,T,C or G
tagaagaaacgtattttagtgaattaatttggaggttcaaggtttaaatgccattctctaaaaatctctaattgtgcacaatacagatgttatttttccatccttacattttacatatccattatgaaattccagtaataagacgatggtaacattatcaatttgggttaacaattatttagcaaattcgtcttgccaagtcatttttacccttcaccagaagaaatatatgtattagtatctcaagaatagttgacattgctagcatattgcgatttggttcctggtgttggcaatctttggtatttctagtcctgagtgctaacctaccacgcaacagaacctcaacccccgttctaggatacttgggcaaatatatatttattagtcatatatttatatatttttaacgatattgtcatgtctttcctcttgaaattatcttgaaattctatcttcctgagggctggttaaagaaaaggcgccactgaaccacccaagattgaacaattcacacacacacacacacacacacacacacacacacacgaaggtgtagcttgaagcgcctgctttcagtctttcccagtctttccaagcatctctcaggctgaaagcaagcggaagtgattgagaaatccctccagggactggtgcctcccacagggatctacaactttacactccatccccccttcccctcccatctctaaaccccctggtagtgaggggcgccagagtccccgccccttcttgctgccaaaatttgttcttaaccttttttggggcaggggacctacagaatgctatggaccctccatgaatggtgacagaggttggtggaaagcacagcttaaatattttgcgaaattttcaagagaccacgtattagaaacacactccgacctgcaggattaagaaccccatttctaaaactcttgacttggggtgattaaatcgagagcggagctcaggtgccaaatctcttcccgaatgaaaaagtgtaggaagggaaggcgctccggcgctgggccactttcacttgtaagaaaccaaaagaaggggactggtggcaagagatggggacggaagagaaaggaaaggaaaaggagaaatgtgagaaacagacagggacacggtggggcggggagaagacagacatcacaggggaaaatggggagaagggacagagtccgagaggcacagcagcagagagacaagggggaggaggaaaaagagactcggaagggaggagagagaggagaggagaggaaaaagacgagaggggaagtggctgcacgcgcgccaggaaagggagagaactttccctgctttccctccccggggcagggaatctcagaaaaccccacttcagcgaggtggcggggaccaggaacagctgccccggcgctggtgacgcctctggcctccgcctcttgcagccggcagggcctccggctgcgagtcccgcacgggccggccgaggaggggacatggtctggaaggaggcggtccccattcgtctcgctttctcctcccctctcctcctcttagaggcgtgcaccgggggcatttgagaggctgtggacccgcggcccccccgcctccgcccccccagccccccattcaagaagccgctcagctatcccggccagcacagggcgcccggcgcgcctcggagcgcaagttcctcgccttctcctgcccgctcgctgggcattatgcggccaagcagccgagccccagtcctcctcctcctcctgctcctccggctcctcctgcggcccgagcggctcagctctcggcaggcggcggcgttgctcagccgagcgcagacgggaccctcgcagcgagacctcagcgactcctaaagtcaaaagttggcggcgggcgccgggctccgcgcgctctccacggccgctgcctcgcgtcgccgccgcagccaaggagggcaggagggaggggggtgggggcagcggagggaggggtgggaaagcaccatgcagtttgtatcctgggccacactgctaacgctcctggtgcgggacctggccgagatggggagcccagacgccgcggcggccgtgcgcaaggacaggctgcacccgaggcaaggtaaccaggctccggcccccgggaccccgccggccccgacgccgcctcccggtcctcgctcctgggcaggggcaccccgcagcggaggcttctctccttttcctagaaagaattatctcccgctttgcagcctctcccttctttgggtcatccccaaccaattgctagggagggacactatggaaacgaatttaggcaacccccccctaccttgctgttgccagatatatccccatccccactcccacgccgcaaactaaagtaacttagtaattgggggcaccagatagcgtcatgttttattttattcaggttatttatcaatatctgaaatcatatatattttgacttgttaattgtctggctcggaatagtgtatcctcagcacctagcacaggtcctgttactggcacatagtaggtgctcagcaaatatttgtccactgattaagggtgaagggattgactcgaatgggctggaaaataaggtcagaacaaagtccccaccttcgttttaaattaaagcttaaggaaaaatgaattattggttcatatacctctgcttctctccgcagtgaaattattagagaccctgagcgaatacgaaatcgtgtctcccatccgagtgaacgctctcggagaaccctttcccacgaacgtccacttcaaaagaacgcgacggagcattaactctgccactgacccctggcctgccttcgcctcctcctcttcctcctctacctcctcccaggcgcattaccgcctctctgccttcggccagcagtttctatttaatctcaccgccaatgccggatttatcgctccactgttcactgtcaccctcctcgggacgcccggggtgaatcagaccaagttttattccgaagaggaagcggaactcaagcactgtttctacaaaggctatgtcaataccaactccgagcacacggccgtcatcagcctctgctcaggaatggtaagtgggcgcgcgccacctcctctccccttccgcctcctcgcccgcttctagaagacttaattgtcctctaagcctagagaccctcactgtggcgaggctccgctcctctccggcgttaaatatcagctagaaactcgtatggtttgggtagctagctctgtgcgtgcgagtacactggcgtggagcgcacacacccgcccccaggggcttctggatgtttcagagctttctggagtttggactcggttcagcggcgcgttgcccaacgctgcgaggcggcctggaagtcagtttccaaactcggagaaagttactggagttgcggttccctgcagcaaacttggccacccgggagcggagccgctgagcgcagggcggaccagactccttattggtgcgccttgcatcggggatgtggggctgaggatcccctgcccaaggcactgggagttccttcagtgtgtgttgtggagggcggtgcgtaatctagagtccccgctttctctcagggcctttattcacgcgccaggaaccctgaggctgaactggattgacagggagcaggtcccgtcccaggaacggaagggtgggccgagggctctgggggcgggggagaaggcggagcctaccccggacgctttgaattggggtggaaccgagagtgggggtgcagcgcagtccaactctgcaccctactggcggggtggccgggagaaacgggatagtgggagacagcctggagaggctgtccggacgtgatttcggttcctctggggtttctactactcacgggttccagggagtggagagagggagcctgcggcgcacgtttccctagggactgaggcagggcggggaggccgccttcttgcgctgccaaatagcatttagcagggaatccacgttggttccccgactctctgtcgacccccgcatgtgccctccagtggatcttacaaggcatctgccccccacttctccacgacatttgaggagtcgctgcggtacggttctggcccgagcaagggtggtccttgactttcccaagcgacgtgcgtttctgccacgcgcgtgtgacgcagaaactttcccgggtcagtctctcccagcgcacggcgctgtaagcgcaatggggtcgtaggcactgtgcccggtgatgcctttattcttcccgaagcacccacagcccctccctcccttttctaagcggggccttggatactcacccccagacactgggctgctccatcagtgcgctgtcgttcgtgggtcttaaagttcccaagcacatccttccttctctgcctttcaatggaaggatcgggtggagagcgtggcaagcctgaagactgggagggggtagttctagcctgctgggattcaaggaaagggataaacccctttagcccccagcaaagcgcccggagccgtggctcccgaaatgcgctgtcgagattgtttgggggtgggcggagacggcagcttggcgaagtgggagggggtgctgcagtgagtcatcgctgccccaggacctagggcaagagctctggaatccttctggtccttgaaaggttaaggctcgggtaggcagaagccagccgtctgagcccagagcctggagtgcccctagattccaagatagtaacccccaattccaggaccgtagggataggactgcgtgtgtacgtcaagtttgtaaacagcctttactcctcctctctccccgcctccacacccgctgaagcctagtggccccagcagttgtataaatattttactgcgcaggaccttcattttcattggcagttttaggtggtagtgcgcacgtggtttctttgggaactgaggactagggcttcagaaacgactacctggactgtgataacctcatttatattgcgtttaattcgcagtctgcctcttttggggaaaagggccctcatacatcttaaagatatgcgttctggttcttcgtatcttcagccattaatctagctccaaaacccctgcccctttgtcttccttctggaagttatctcctcccaagacttccccttaccacttctgcagcagtggcatcaagatgttgctagttctccgcctaggagtcttccaggaaatcttgaagagtctaccagagtctaccagattttggagtgggctgtgccatcctgccacccctagtcagttgtcagtttttctgaatttcatctgagatgggtcgcccgcctctcctgaacatctctaccctaaatctatcccgcttcacttttctccccctctctccttaggactgatgtctaagaaatattacactgggcttcttctccagtctttctcctcgatcgctaactccatttggcatttaagactatttacagtgcactcactcacatccacatgtccagtctcagctcccaatctttcctccacaaatcctgcatttcaggccatgggttttacactgctttctctgcaccccaccctcaatcctagtcttcattgcctttgtgccttggaatttacttggtcttctcactcatcttcacatgctcaaatcctacccttctttggaggtgtatataatttatatctcttctttcccagaagaccttttcatagttccccatgttgatgtcatctctccccctcccccttcatagacacttctgagagtctctcttatgatgcttagtacgttctcccttgtatcaaggttcttggtacacatgttctatccttttctccttggcaacagggtcagcatcaactcatttttctcctatattggagctttgtatgttgtatatacttagcatatatgtttgaataaatagtcaccttaaccaagaaaagataactcttaggcccacctttgtgaatcaacagtacaattaattttggcatcacattgatatgatttattgagctcttactattaatgtctgcctggcactactgtaagtagtttacatatgtattatctcatccaaatcctccaagaacccaatcctcagaacaacacattttactgacaaaaaaaaatctgagactttgagagctggagacttgctcaagatctcacagctcgtaagtggcagcgctgggatttcaaccgggtctttctgatccatgtgcttaaccatagaccagagactgatcctgttctcctgaagagaacctcagggttcttttataaaaaggcacgagactaaagtcaggttagactcaatgctgtgcagctgcttctgtaccattgaaggggaatttgggcccaatcacttcctccttctgtgtcttggtttccccatttaccaatcaaaggtggcaaatcgtcaccagctgagctccctggctctttcccaggactcatgtctctgataggcttcacatgttgtgatatgctctctgatttgtgctcagagaacaccagagttgtgtattgaacacaggcagagaataaatttattaaatcactgcttctctggcaactagctactctgtctcttagtctgaccacacctgagctgcccttttcttaaaccaggggctcatgaatcatgtggagagcttttaaaacaaaaaacaaaaacattctagatccatccctagaaattctgaatctgtgagtagggggtaatgccctaaatctaatttaaaaacaaaaacaaaaaaccttcccaggcaattttgaagctagctgttttggggagccaacgtcttagcctagtgctgctcatactttatcatgcgtaagaataccctgggagctcattaacatttcaattcttgggccctacccctagagattttgattcaatagatcagatttggggtggagcacaattatttgaatttctaataagctcctggatgatgctgatgcggatgcagctgctgatgttcagggagtcatttctcctgtgtcaatggaaggatgcaaggcatcagattttttttccagcacgggaaatgagaaagcggaggagaagagtggagcttgatttctcctcttaaacaccactcagcaacttggcatggggaatttttcagtgttcttgtaatttttagtttgggtggttcaatcttgaggtatcatttatcatttgtaaaaacttgggtatgtggggtgaaaaggagcaaaaatgacttgcaaggtgcttagaatgattagtaagagcaaattttatcctaatggttagaggctaacactggcaacaccaaaaaccgttcacgagttctaagcctttgcaaggtgtcaggcattttgctaagcacttaattatcattatcttatttaatctgcacagtaactctttacattaagtatctttatccccagctgacgaacaaggaagcttaaacagagtggttaaggaacttgcccaaggtgaatgggtaggtgctggtgctgaaattggaacctagggcaatctggcttcaaagccttgcaggacatcactcccctattttgcaaaggaaagggttggtgagaggatcatgtgccagcgttacaggtggtaccaccttgaatgcattgtggccaacatatgcttcttgaatttgaatcaatgggaagacttcaataggccagcttttcctgctggagtgcatacttgtccctaagtttctaggctctctaagtttccaagactctttcgacagcctgcaggaatgattggaacttgagctctaaggaagtatttcttagagacagatttggatagcaggtacaatcaactgaagtcaaatcaagaataagttactgatatgacactttgggaggctgagccaggcaacatattgagcctgggcaacatattgagacccccatctctacaaaaagtaaaaaacttagctgggcatgatggcatgcacctataatcccagctactcaggaggctgaggtggggggtttgcttgagcccaggagttcaaggctgggtgagagagcaagaccctatctctaaaataataagaatagtaaataataaataatttttagaaaatatactgatatgacagagagtggaaataaaccacttctccgcatatgttgcagcattttcagttgaaacaaccctcctgaaaaagagattgggtaaaatgacaccatctctacttgaaaatgttcttttggtttttttcctcccaatgactgagttacgttaaatcaacctcccatctctcttcatttgcagctgggcacattccggtctcatgatggggattattttattgaaccactacagtctatggatgaacaagaagatgaagaggaacaaaacaaaccccacatcatttataggcgcagcgccccccagagagagccctcaacaggaaggcatgcatgtgacacctcaggtatttgcttcttgcttaagcggagagcccagctctttgagatgggtaaattgctatactacagagatgtagctctctttcagtctacaaagtgcaaccatatgcattattgtttattcagtcctcaaatgatgtagggatacataccccactgtacagatgtggagactaaggagaggtttagtaccttgtctaaggtgcacagctaagaagttataaagtcaggatttgaactcaaagcagtgactccatgccctctatgggaagagccaccttttctgttgaagttgctgatttttaggcttaaccttgagtaatattcaggtcatgatagtagcaccctcagtcaccaaatgcatgtatttttttttggcatcttctgttcatttgggtgttttttgtttgtttcaccatgtagggttacagaaatgtcttataaatggaagccacgaaaacatatatgtgtttgttgaatgtttcctagaaacttcaggtttgctcatgttctgtgacttaaggaactgtagcaaggtacctgtacgttatgctgtgaggtaccaatcaaccagtcaaatcctatgtgcccactgctagtctccttccatcctggccagattctttgaggttttgcgctgacatgtttggccattgtcaaggatatgtcattctgggcaccctggaaagcttctgtctgtgtttcttcatctgcagtcttgtagcaacacttcactgcctcagaagcctggttactttctgcctgatgataggttatcctatgaaataattcctcaatttggtcctgcgtcttaggatgttcgtgaaaatacttaaaaaaaaattcttggacttccctgtctctaaaactttatctttctttctattctttatttttaaaattgcttctccaaattaaatagcatctcagggtctttctggtatctccaaacaaggcctaaattcaagaccaccagggagtttcctcaaatgctccccagaggatcacttacttcatcttatacctgtaccaggttgttcactgggatagcatgtggtgtcctattctctcctggaattattatttctaaagtgaatcctttaataaaagataacattgactatttataacctacaagtagccaaatttaagggtgtaacattgtaggtcttttggctttatcccatccagttctgtgttcttaccaccataacaagatggaatataactaaagcattctgtcagactctaaagagccaagggatatgaggagtagaggggcaagtatacttagatacatcaaaaacaatagtttcagcagcaggtatacagtcaagactgccagccaccagcaagtttaatggacaggacatttatcacagttttgaccgtgctagtaagaccattgacctaaacttcttgacttcccaaatctgtattagcaagtacacattttagacatgtgtataaatgtaaacataacatgaaatgtatacataacatacagaaatgaaatctgcagttcccctccttccatcttattagtatatattcagaagacactgaaatatttttttcactgatgaatttattgaccaatgacacttcatgatattcttctcccctaaagcggctacaggtcaacattttaaaaaatgactatttattattgttttattctgtacatgcattatgcaaagcactgtacatgtaccaccttgcttaatccttatcacaaacctatgaggtagttaccattcctaactctgttgtataatacctggaaaaggagctgagatttacagagatgaagtagtttgcccaagatctcacagctagtccacaatgatgacccatgtttctctgtcttattccgtgacccattttctctgtgcaggagtctgtgtggaaaagagagagggggcagaaagagaaagtcttaattagtactgtgattcaaaaaaatcttcaaggttcattttaaaatattaattatgcaagttaatggacatttgatttcctgggctggaggaaatgtcattgtcaaatcctgttaaaaacacaaagaagagtgaatcttaaaaatgtcaggctcgaagacaatgaagatgccttagttaaaaaaaataaaataaaagtctattttggttccagtcgttattaaggttggggcctttaattaccaccttccaaatcacaatgccagtacttttagttttcctcctagtgtttgcttgctcctgaccaatatggcatgccgttccttcatcccttgtaatgaaccaggagcccagcagttttgatcagctcttccaaaggttgctgctgggctgtgccactctggtctctctcttccagctacttctgcaccccttctttgaattcagatgcagcttctcagaacagtttagaatatggcacgattcaccagcaggtatcagaggaatggaccaacaggtcaaggacacctctggaaccaggtagcctttgcacagggagtgaaagtaggttgaggtgggagtagtccctcttgccagagagaaaaggggctgcctagcaatagcaatccactcagattcagtggttcatcttccctcccaacccccaatcaagagcagtggttggtaaccaaaagtgacctttagaagtactctgggagcctcatacaaatgcagattctttaaaacaaaacaaaacaaaactaacccctctcccaggcaaatgtgatgaagcaagaatcagtggttttaatagtgctccaagtgattcagatgtttagctaaatttgagagtcactgctaaagttgggtttaaggcagtagtcattatctgtcacttgctgttggcattgctgtggacttgactttctacatcagtgctttccatgtctcctcttctcataggatgataggatactggaactggaggagtccttagcagtcttgtctaggccaacaatctaattctgtgcagataaggaaactgaagttgcaggatgttaagatgcttcctcccaggagtgatatcctatatattcaacaccaacccatccgaaccttccctagccttgggagagaggtctcctgctgagctcagtgtaaccctttagttaccagatcatgggagtaggagcagggcaagacacaatgactgtgacactttcacacgcagatggaatatgtcttggtcatttctgaatcttgaggtatgcctaattttcaaaaaaggattctgagataacttatgttaaaaagggaagcatagaaggagtctactgcaatgaaaactttatgggtttagaaaggagtctacagttccgtttcttcattcatgcgtgcatttattcagttagccatcaagtctttattgagcaacttctctgtgccaggaggagaaaaccaggaactgtccatattcctggttagttgtatgacttcaagcacactttagaatataaagtgaggataacatgtacctttcaagattgaagttagggctaaatgagtatgaaataatgaaagctcccaggacagtgtttatttagcatgtggtagacaatcacagaatggtaggtgttttttaaggttcatgaaaatagaaaacaaaacaccacaatgaggaaaggaaaactccaaatactaaaattcaaaggtaatagcccagtgcttctgggtaatcatgaagggtttaggggacttgcccaaggtcaccctgccagctagtagcaaggctgagggtgctttctgtccccttgtttcctctgtacccaatgcaacatttaaatattttctttcttgcaagtttctcttggcccagtggctgcccttcctgattgtctctgttttgtcatcactggttatgtctatgtgtatacatttgggccatttgagtgtctctgcatttatttgtcttttcatcctatttgtgagttctttagggttcacgatgggaagtggggtgtcttctctccctatggcatgcccttgtgactgcagtgtcctttacatactgggtcctcagtaaaattcactgtgctcactgcctgctagccccacacaccaggggcacaagcaaaaggcctatgggagccctttggagagtggcttgcttttataagccacttcctgcggatccttcccattgcttgtttccagatgagatcccaagttctgtttcacggacactctctatttgaccctgaattttgcacaagaggatttagtggttcttatcagtgcttcctggtaggtggctgagagaaaggcagggaagaaggctgttttgtttgcctgggcctggaaggcaagtgtttttctctaactcaaacttctccctcaccttcccatctcagcaaggccaggtaatttttgtttcttaaggcatttaagaactgtctactctgtgacccatcaatgctgtgcctaaggaaataatcagacaattgtgtaaaggtgtttatgaacgagatccagtacagtgttgtttattatagcaaaagactggaaacagcctaagtgacctttgggaggaagatagatcaatacattatggggcaggcatataatggattcctatgcagctgttaaaaatgatggcctgaatttatgttaccaaacacagaatatatattcagtgaacaagcaggtgataaactaatatgtttggtaggatattattttttttttaatgataaactctatttgggtacatgtgtgtaaacagaatatctgaagtaaaggcatgaaaatattaacagtgattatttatggttactaggaacataggcagtctttacttttgaacttttatattcttctattttgtgactcatttgcatgtttctttgatagtttcataatcagaaaatacagataaaatgaaacagggatagtggcatggatttattttgctagacctattgaacttgtcactggagaccaatagccaagccacattttggtctcttaggatcttaggaccttagaagtggagattatcggtcctttattttcttggaatgaggcagtctcaataaccagacagataaaaatcctgccttgtgtctacttctttgggacatctgtggctggttaaagttgaatctctcattcaacccagctaaattgccttgtgcctgttggactgaccctggtattattaagatttaatctccattaggcactggggactctgtttatcactcccattagaaggtaccatcacttcctgattgggatttccaggctgcagttataaaggctggaaaacataagatgataattaaagccatcatctgttaggctcttatgtgcatatgggatcactatgctacacactttacacacattatcatatgtaatacattggtcagcattgtagggtaggtattattacccctattttacagttgagaaaattagctcaaagaggttgagaaacttgtccaaaatgtcacacagccaggaagaagagagtctgagccttaacccaatctatttccaatgtgctatactatgggccaaattgcatagaaaacacaaatggaaactgctatatagaaactccttttttggtttatttggttttttgagacagaatctcactctgttgcccaggctgaagtgcagtggcgcgatcatagcttaccatagccttcaattccagggctcatgggatccttacacctcagcctcccaagtagccaaaactaaagacatatgccaccacacatggctaattaaacaacaaaaactgtagagacagaatctccctgggattacaggactgagccatcatgcctggcctacaaacccctttttaacttcatttttggagcatcttctttgactaccatctaatttccattccctagatgatactaataagagttgacatttgctgagtgtgtattatgtggtagcctctgttccaggcactttacaactttacatggattacatatttcaattcttaccgcaaactccattttgcagattggaaaactgagacacagagaagtctgtaatgttgacttgcctgaggttataaagctcatcaacataccattttcttcagcccttatgtcctggtctagttaggggatattttttggcctcggtattgatttgactgcattcatatatgaattatttttgctggcaggaatttttaaatgcctgtctggaatttgatttgatttgaggaaggctgcttggtgcctgaaattcccaccaagactctaatgactcacagaggccttgtgtctgtctccagcaggcctctgatggagtgtatgcttgttacacattaacctcttggatcccattaataatttagcatagattagctgattagattagctgcccttcgagtggtacccaaatggagtgagagacggagctggggagcagacccctgagggggctttcggtaaaacattctggggcagcctatgggttccaggcagtgacggaagctttggctgacttcagaatcctgcctgggccccaagcaagtcagtggttggtggctaattagtgacttatgctaggaacttgtctgcctgcactttcaccacacactttctgcattcttagaccctttcagccttgtaaagatcaagaacaggcagcatttaaggaactgtgtacttggcaatgtggaagcacattatggttatttcatttactcctgcaacagttcatgggaggaagatgctctgattattctcatcctacaaatgagaaagctgaactcagagaggtgaacaaacttgtccacagcttgcagaaagggaaaaagctggcactgcaactcaagactgattatgaatttttaaagttagttattgccatttgggatttatggtttgagcctgatttcctttcattttcccctttttgttcttcatcggtgtttatacatttttttctcttttttatagtcttcaatgactttctgtctaataaacagtcaatataagcaatgacctctaaaatccttggtaaattattagaaaatcactgttttaaatacattaattctttatttcttcaacttgatctactgaatggtacttataaaaattctgctttcctttttttttaaaaaaaaactttagtgttaatagtgcagtactccaataaagtcattaagaggtagtaaaaaagaaacttctaatacaggaattgtaccttctttcatttgttcccacttattcattaaatttttttaaaaattatcattttgtttttaaaaaccattttattatgaacatcttcaagcatacataaagctagagacaataataaaatgaaccactgtaaacaccatgaatcttaataatgactaagatttttctacatttgcttatttttctttatgctgagtatattaaaacaaactcaagataccatctctaaatatttcatgataaatctttgaaaagtggggatcttttcctaagtaactataatattattaatatttgatacgtaatattaagtaatattataaataatgtttcagcaaaattaacaattccttcatattgcctacacagtacctatattaaaatttttctcattgtccccaaaatgcctttttacaatcatcagttagattgtgatctaaacaaagtccacacattgcaactcatcgttgtctcttacgcaacttttcactttgttgtcgtcatcgctgttgttaaaattgctattttcgttctagtttgagatttgctgcatatagcccctttttcccttccattgctcctagtctttgcttcatctttatcatcatcaggtcaggctgcagttgcaaggattagaaaagcaaggccagtctgcaaggccagagcaggtacccagagcaaagcccctgggccattaagccacttctcagagtgatttaattgaagggaaaggcagtatctttgggaggttttttgactccttgtctgaagtgccttgatggctgtcattgtgatgttcctatcaataggaagatcctcaatttacagtgccgtcatgcatagggtgtgtgtgacccatgcattcttgttaggtaattttgtgaacatcacagagtgcactgacacaaacctagatgggatagcctaccacacacctaggctacgtggtacatagcctattgttcctaggctacgtggtacatagcctattgttcctaggctacagacctgtacagtatgtgactgtactgaatactgtaggcaattataacgtgatgttaagtatctgtgtatctaaacatagaaaaggtacagttaaaaatttagtattacgatcttaggagaccactgtcatatctgcattccatcatggactgaaatattaaactaccttttctatccttaaaggatctccctcacctgtgttttgaagcccagaagggccagtttgcaattaggattgtaaggtggcaagttaggtttgtacctgagattagaactcattgacatatgaaatatgcgtattccccaaaacctttgttgttgttgttgttttgagagtcttgctctgttgcccaggctggagtgcagtggcgcgatcttgacccactgcaacctccaccttccaggttcaagctattcttgtgcctcagcctcccaagtagctgagattacaggtgtgcaccaccacacccagctaatttgcatatttttagtagagacagggttttgccatgttagccaggcttgtctcaaactcctggcctcaaatggttcatctgctgtgacctcccaaaatgctgggattacaggcatgagccaccacacttggcccctaaaactttttaattaagcttctggatccaaagacagccagaagagctgcctgctttacaccttctgtgccatctcaggacctttccctgtttcttgctaatcatattttagggattcctgacactttgcttcagaaacccattccctgctgaagaaaaggggtgctacaagggtgaatacttgataatgtgttcaccttcataggaaccatctgaaactggctaagacgcacatctttctttagaagggacttcagaatcagcagaaggctctggaagagggccatctagctgacagaggcaggaggattttggtgttaacctgagaacccttcagacctttcacttgagtaggctgtcttttcaaagtaagacatggcaaagtttcttgagtttcttcatatgaggggataagcccactttggttaataaagtgctattttatcatgcattgaggtttaacatttgcacctttgtatctgccaaagatggtttctttatgataattgtatcataaaagagtctttattatagccatttatggctgtgttttctcatttgactttttacctgtggaccagatatctgcatggatgttctgtgcaactgaaaatcattaataaataatctgaatatcacaaaaagagcatgggtaaatgcaagatctgatgtggtatgcacatgtgactgagtagtgggctttgagaaggagcaaagtcaaacgtgaggcaaatgttggnnnnnnnnnnnnnnnnnnnntggcacaagtcttcctttttattgattcccaattcctatatgacattagaattagaatgaatgttaaaaatgcagttgctgtgtggaaaaagttcaagttaatgttattggcttgagaatttttctgctaattattttttattttttgaaaaatctttttattttccattcgtgtttcctagtgttttccttccatttttctattaatgtataatttacatgctgtaacatttacccttcctagcatacagttctgcaggttttggcaaatgtatacagtcatagaaccatcgtgataatcaagttaaagaacagtttttggtgtcctttgtaatcagcccctctccccacccctgttttctgtctctatagttttgccttttgcagaatatataaataatcactaagcacagtgtgtttgaggttcatccacattgttgcctgtatcagtaatttcatccttttttattggtgagctgtattccactgaatggatatatcaccatttctttaaccattacccacttgagcgacagtttttgaccattacaaataaagccactataaacatttgcatacagatttttgtgtgaacataagtttccacttcatttggataaatacctaggcataagattactggcttgtgtggttaatgtatatttcactctattagaaactgccaatatatttttcaaagtggttatgccattttgtagctccacctgcagggtatgaaagttccagttcctctgcatcctttccagcacttggtattgtcaacattttgttgttctgcttttgttttttgaagtttagctattctaataggtgtttagtggaatttcattgtagttttcatttgcatttacctaaagtctaatgatattgagtatttcttcatgtgcatatttgctatccatgtatcttttttggtgaagcgtctgttcaagtctttcagccattttttaaaacttagaatatttgctttcttattactgaagtctgaaagttctttattctgtatataagtcctttgtcagatatagtttgtaaatattgtctcccagattgtggcttgtctttcaaaaagtctcttaatttgcaaatgcttatttcatacatagcttctttattttatcgccaatacttcatgcaccgtagatttcatgcagtcccagaactacatagcaagaaagtatagtggagcatgcagtatagagcttgcccaaaaaatggaataggagaggtgtatttaggatttattattcaaagccatggtctaggccaagagaaaaggcagttgttatttttattgctcatctgtatccagaaacacaactctccatgtccaaccagtgtactttttgatgggaatgtgttgtcttagctcaggggtgaaaacaggtccaggggagcctctgcataggtaagaatgcaactgtgttgttttgcatgtatgttgcatgtgtgtatgtgcatgcagacaggagagaaagagagagccagagggacaatgagactgagacagagacagaggtagaagagtttggtattaatagtatgagattcagtccttatgaccacatgccctgctgctgaagagggatagaagatataactccataaatcctgaaagcttccattctgtgctttgtggacaatttaaatgcttttccagcggtatctttgattgtatacttttttttctttcaagccagtttcctaattcttacatttcatgttatttcattgtaacaagtcagattagagaaaatagaagtggtttttcagaaactattatctgttttagcaggtccgaaataaaattttcccagtgagtaatggagatgtgtagactgtactccccttaatataatttaacatcagcaaaagtccactccttttgtgttgttctctctcttttggagttattctgtcttattctaccctgccaccctgctgactgtttcatccataccctttctgacagtgacagtggctcagggggaatctctgttgggttttgcccctttggaaacttaggacttcatttttaatcattattcacttttatcttataaaatataagaattcataaatttttaatactggaggaaactttagagagaacttctattccaggccttctctttatggataagaggatcaaggcccagaacttcgaagggactcctaatcttggagctagaatgaatggcaaaattgaacacaggcctcttacttcccagtcctgtgttctttccaggctgtaacaaaaggaaaagctgcagatggtgcctggaaaggggatgttcaaaagtatgactcaaatgagctttgggaagtgccattgtatttaagtgtgggaataattaagaatgaactggtgagactgttcaagaagttgtctcaagcttatagagaaagatagaaagctttcaattcatttaagggattaagttgtcatatcgagagttgagtgtacagcaaccaaatatgattttaaaataaataaaccaatcaagccttttctgagctgggccagggtattggggaaggtggcctgtggctggggaggaagaccagtgaggttcactggtcattggagcacagcatgcccctgtggtcactcacttccgtggtcatggaacatggacattgtgatgcaaaagggtttcagctgcaggccttataaaccagtcctcagtgcctgtaaactaggagacctgtgtatcaaaagaatgtgggagatacactccctacgagttgcttagatgcctttttaaagagctccagcccaactgcgctttaatctctgatatgagaatgatacctagacccaccacaggcaccacattcagcttcagggccacccacgagctgcagtgaaatgtcagatagcaggcagatcccagcggcaggcctgggagccacttcgttccagcagccttaacctgctgctcattctaagtaatgagagtcagcacagcccgtgcctccagaggacttcctacccaccaggccctgttccaacactttatgtagactaagtcatttcaccttccctactgccctattaggcatgaactatcattattcccttttcacagatgaggaaactgaggcacagagggctgaagtgactcaccagaggtcacacagattgaatgcagagcagctgggatttacacacgggtctctctgattcctgagctcacactcttatctcccgcaatacgctgtctctggtatacactctgcaaacacttcctgcctagaatgcaccatcctatacggtcaccaggaggcccttgagatgtggctagtgtcacatgttgaaataatattttgcataatggggttcaatagactctattattaaaattaatttcatctgttccttttgacgttaaaaaaacgtggctactagaaattcttaactttcacgtgtggcttgcattttatttctactggagagtgcaagcttgggagatgccaagccgtggcacaaagcagcctgagaggcagccatggcaagtgcactgcagccaggacagggtgtctgtgggcagttggcaccctgacaggcagaaaggtcactctcccgctactgctaagagatggagtgaatcgaaaccaacatttcctaaagggtactttgcaggatattaatagcaaaactaaatagtctcttagtaaaacacaggccctgggatgttcagcgtcttatactacttcaaatagatactttaaatattttctcaagttatttcaagtgtccctcagtttcctcatttctgaaatgaaggtaatagttcctaccatatcgggttgctttgaggaataatcaagttaatccatatgaagtgcttaggagagtgcctgacacagagaaaagcaactcaacaaacgttggccagtatgattatagcctatagtcattgttgttatcacacttagttgaaggagctacagaatggagaatgaaaaggacacagaagggcttttgggggtagtgtacccagctctcatgcccaagtcagcaaatttaactccccaggtagctggaggcacccacccccttagaaggtattgaggggaccctcagacaccttccactgcccaccaccgccccttaaaagccaagaagcttctcagttgttgccttccactcgcacgcccttctctccctgagagggaagcccatccacacatcccacctgcgtcttgttatagttctagtgatggtgctgtccccatcacttgcctcttaacttggcaaagatcccgtaagtttggcaatcatgcgactcagcacatgtaaactggtttctttcctgcaagacttctcagggctcttaaaatgctaatgtgcatggagaaagttccagatgtgcatgctgtgttaagtgttttgcaaagttaattgatttgtttttggaactatcttatgggactaatgttccataaaccactctcatggaaacatagtttataaaggttcaggccagcccaaagtgagtcttagccacaatctcttctgccaccactctttgtatttatttactgtcagcactgtgcatgtagcactacttgacactgggcacatcacttaaaaaaataataataaaacaaaaaaacaacagctcacactattatttgtttggttgatttttgttgagacagggtatccctatgttgcatatgctggtcttgaactcctagcctcaggcattcctcctgccttcacctcctaaatttctgggattacaggaggatccactgcaccccatcaaagattctttctaaaacaaaattgttttgtttgagaatgtcaatatactaatttataaagatcagatgttttgcatgctacaagtaaaacaataccactaataattattattatgttaaatatgtattggacctgtcctctgtgtcatgccctgctttaagggcattttatgtattatctcttttaatctccacagttactctttgcagttgctgttattaccatcattttacagatgaggaaactgaggctttaaagaaggaaatgacacaagaaagggcaactagagtagctttaggggaggaatggaaaccagggttggcctggctccagaatccaagtggaacaccacagatgattcctgtgcagacttccttctctctgtcaagcttgggtggagcagaaaggggtctcgccttgctcctgaatcctccctttggtcctgtgctctgtgaagtcacaaggtagcccagcgccttgaggaaactcagttaaattttgataaaccttacaaaatagagagcaataattaactttccaactgttaatgttaacattcagatctcctcggcccaaccccatttggtaggaaacacttcagtgagtaaccactgaataatgaggcctggctggtatttgctgaaataatcccagttatttagtaacatactgtgcattttattgtattgcaacgtgaagtgaagctcatttaaaacatttttaccaataaatcagcagatgttaaagttttttgctgtgaggttttttaaaataaggatactatcttaaatttttgtaatcctttttttaaaagattggacccacgttttattcttgttttgtcattgctgttgtttatttcaacttatctagcccagtacttggcacaaaatcgatgttccacgagtgaatttttttaaaaatgtaacttataatttataagaaattctctatatgctttcttatttaattctcaaaatagccataagatggaagcaagtatttatatgcccatttaaaggtcaggaaactgaggcccagagaagtgactcagaaaagagccttcatatgggatagtagggtgaagaccagccctcagcacttctggttttgtagttcctccttttttcacagtattaaaaagttggatatcagaaatgcaatcaggcacactctgtgctgatttgccccactaggagtatacagctcatggctttgaaattgttaatgtaagccagaaaattgtttttaagcacacttagtcactctaccttaaatggttccttttagttccaactcactttatgactttgtgactggcaaaaaatagaaaaatatgataatgatatttattcattcgttcctatgcactaggcactgtgctagccctttgcatgcatgatctccaattattcctcaaagccactctatgaaataggtactgttcttactccacattgtaagtgggaggacggagggtgagcaggagtcagttatttgcccaaggtcaaataggacttaaatcgggcctccctcccttcattgcatgagttcttcaaacattggctgtttgtggcagtgtaagcgtgactacttcccttttgtgagcatcgacgccaaagtagttgcaaaagcctgtattaactcatgtccttgtaataaaatgttagaactgtaatacctatgatgtggcgataggaaacatacagttgccagttagagcttttttaaacacgtctaaatttatttagatgcatatatgaggattcagattgctaagtattacacttttcttctaatgcaaacatgcgtttactacttggaggcatcaatatgctattttaggatttgagctgggccaggttcttcataagctatttaattaagtaaacatgattaatttttgaggaaccctcaaagaaaaagaaacatgaaaaaatgatgtcctgttttgaagtgtcttatttgaacttcaagaagaagcaagaaaatggtgtaaccactttggaaaacaatttggcagttcttcaaaatgttatacatagagttactgtatgacctagcaactctgcggctatgtatatacacaagaagaacaaaaatatattcacccaaaaccttgcacatgaatgttcatagcagcaatgttcttattcagttgggttgaatgtccacccaaatgtccaccaatgatgaatggataaacattatgtggtatatccatacagtagaatatttaacagtaacaaataatggaatactgatgcatgctacaacatagacgaaccttgaaaacattgtactaagtgaaagaagccagtcacagaaggccacatattgtatgactacttacatgacatgtcagaataggcaaattcataaatagaacaatataggttagtgattgccaggggctgaggaaaggggagaatggaatggctgctaagaggtatcggatttctccttgggattatgaaaatattctaaagttagatggtggccatgattgtggaactctatgaatatcctgaaaaccactgaacttcatactttgaaaattgtatggtatataaataatcttaccaaactaatattaaaaattaatcataaatgtaaaactacgtaggaggaaaaaaagaagagcaagaatacacagaccattttttcagtgctttccaggacagtgaaattttattaggtagcccgttctgattaaactgtaagcaaagtgactttgcaaattcctgaaacactagcctctattcctcctttagcattatactaaaagctcacaaaagagaaatgtggatcactttctgtttatcctaacagtgtgtactccgttggtgaaaactattctgttattacaactctattcagaagcaacagagttgagtgggtatataagatatagtgtctatttttaatgctatttttaatgagaaattcaaagttgcttgctaaaatggttaatgtgatagaaattagttggaccagttaggtgaataaatatcattctaactcattaggagaaaaaggtcaaattgataaaagactgaggaccattctgttttagaagatattgcttttgatcctgaagaaataatttgggttttacattttcatgccacctaaagtatgctgaattatttcttcgatacacagattacttgtgggtgaaatatcctccagaaatattacaattacatgagttgtttgctggtagaaattgtagcctttttctgattaatgccttcatttctttgattttatttataagtatactttgtttccatttatggccttgattcatctgcaggttttcttgtgcccaagtcctctctggtgattctgatagtacatttgtttttcccctctgatgattctgatagtacatttgtttttccccttagtggtcaaaaaaaaaaaaaaaagaattccatacaacatttcctgagtgttgttctcactgcagtactcttctctaagtaaatccaataaataaaatcatgatatttacagaaaacattaaggattatttacttttcacaaacttagtgatatagtttctcttttttaaacagctttattgaagtataagtcccatacatattattcacccatttaaactgtacagtttaatgattctttggtatatccacagatatgtataatcatcatttcagtcaattttaggatatttttatcacttgagaaaaagaatctgtactttttagctaaccacactcccatctccccactccatctctgtccaaaatgcttgagactagaattctttcagattttgggtttttttggattttaggatgcttgcatatacatagtgagacatcttgagcatagaacccaagtctaaacatatatctttcatatacacctcatacacatcggctgaaggcaattttattcaatagttttattaattgtgtgcatgaaataaagtttgtgttaaatacttatgtgtggaattttccacttggtggtgtcatgtcagcatttaaaaagttttgaattttggagcattttggatttggggttttcagataagggatacccaacttgtactactctactttctgtctctgtagatttcccagttttagacatttcctatgactggagacctttgatgtgtggtcttttgtgactggcttctttaactttcctggtagaataaagtccatcaaagtgttttataatgataaaaaagtcaatttataaggaagatataataattataaacatgtatgcacctgataacagaacaccaaaatatgtaaagcaaaaactgacagaaatggagggacaaatagacaattcaacaacaataattggaaacttcagcaccccgctttcaataatggatagagcagccaggcagaagattgacaaggaagtagaaaagttgcccaacactataaaccaactactaagagatatctattggacacgttaccccacaaacagcagagtattctgaggtgaacatgaaacattctccagcacacaccagatgcaagaacataaaacaaatttcaatacgtttaaaaggataaaagtaatacagaacatatttgctgatcacaatgtaacaaaattagaaatccattacagacaaaaaatgagaagctcaaaagtatgtggaaattaaacagcacactcctaaatgaacaatgattcaaaggagaaagcagaaaatattttgagatgaatgaaaatgaagactcaacataccaaaacatgggatggtgccaaagcagggcttagaagaaactttagagctgtaaatacttctatgaagaaagaagaaaggtctcaaagcaataacctaaccttctactttaaggcaacggaaagaaaagagcaagttaaaactaaagcaagcagaagaaaagaaatcgagattagagcagaaatcaacaaatgagaaatagaaaactaatagagactttaaatcttctaaaatgtctaacactttacttactataataaatcaaattgtaatatttacagaagacattaagcaaggactatttatttttcacagtataagtgatatactttcttaatgtattaaaaaaatttaattttcaacatagcttccatacacctgttgtaaaaagcaaaaatcttcgtgaaaatatccaccaggcactgtctttttctcaattcatatttactttggaagctgttcaccaaatcatgagctcatttcaaaccgtagctgttgagaaagctcacctaatcgaaagagcacaatttcgggaattgagcaaatctacgactgattccttgtacctccacttcctgcaatgtgactttgaataagttgctaatttctttgagacttattttcctcattggaaaaatacaggtaattttctcactttgaaaggagtaagtaagataacatacataaaagagccgaattcaatgcctggtacatagtaggtgcttgtttaatatctagtctacattcatttgatgatttaacaattgatttggtcctggtatgcatatattgaaagctcatatatgtatacaaatgccagttggtagacatgcaatacttattggcattggtatacatatatgagtgttcttgaaagaaaaactagaagaagaatctaatgttacatcttatgtaccaggtttttggctagcgatattatctataactggactgcataaaacttgtttgacagtttgttcagattttactatagtagtcctcccttacccttggggtatatgttccaagatccccagtggatgtctaaaaccacacatagtaccaatctgattgccatcagccagaaagtttctgttcctgtcttccaaccacaaatttaatgcctttccatcttaaataaactgattgcgcactgtatccgtaacttttgcagtttgaggtgcgaaagcaaaactagcaccagcttcttttcattcttcacaatttcacagagggaagatttgttcttatcatagaccttaacaacctcagcatgcaacgtttttttttctttgcttattaagttgggaattttcaccttttcgcttaaaggaagaactttacagcttctttttggcttaatacgaattaccagtatcactactcttgcactgtgaggctgtcattaagtaaaataaggattccttaaacacaacactgcaataccttgacagtcgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaagaaaatggccagtgcagtcactcatgcctgtaatcccaacactttaggaggctgaggtgggataatctgaggcccagagtttaagaccagcctgggcattatagcaagacctggtctctattaaaaaaaaaaaaccaattagccaggtgtagtggcatatacctatagtaggctcaggtgctcgggagctgaggtgagagaatctcttgagcccaggagtttgaggctacagtgagccttgattgcgccactgtgcatcagccttggagacagagtgagaccctgcctcaaaaagaaaaagtaaaatataaacaggtaaaattaattttagcaatatgttttatatcaaatattattttaaaaattattaatgagatatttcacattttttatactaaggcttcaaaatccagtgtgttttacactctcagcatacctcaatttgagctagccacgtactagtgctcactagccacttgtgatgggtggccactgttgggcagtgcaactctaggtatttcttatgcaaacatgttcgcatatacagcttcttttcaaacaggaggcattttcacatactgtattacacattgctgtttttttgaacgattcgagatgggtccagaaaagcccgtatagacttcctctttctcattttcagccgtagcataacttttcttttaataggacgagccctgatttacctgaactgaaacttatttttaataaatcccccagatgaatgtgaaaagcaatcctgtttgggcatagctttagggtttcttcttccccccttgtggcctatggtactccttgcctttttgttcactgctgtgacccattcccctctgcgccccccaaccctgcctggcctccgtgcccctctcacccccacatgccgctcagtcccagatactccagccctctcatgcccatgagggaagggaacatctaatcaggccctgcgcatatgcacagtctcattttcacctcttaatttcagttctttcctaagaattttgattatgaacatggactttgggtcaaactgccctaggttgagagttctggctcttctactcaccagtgtgtagcctcagacaagtgacttaatttctctgagtgacttagtttcctcatttgttgaacagaaattttaatagtacccagcccagagttttgctgtatagagactaaatgcatttgtgtatttagttttcagcccagagtttcgctgtgtagagactaaatgcatgtgtgtatgtagttttcagccagctcacaataagcatttagtaaatgttagctcctataattaattataatactgcaaaaataaaaaccccaccaggttaacgaggttgtcaaggacacaatgggtggcaaacattaaagaatagcagtgtcggctaacatgcacccaatgtgagattctataagttggcaatccaggacttcagatgagaggaaagagcttgatggaaaattaatatccagtgttctggtacagagaactgttaagtcacgtggcaatgcaatttcagaggaatttaaatttgtttgaattcactgttatctaaaactgtgatctatgaattttatgaagagactttacaaaaagtattgttgagtgaatgaaaaattcacaaccacaaaatgcatatgttgcaagaaacgtaaaaaagaggtggagcccaacgtaagacgtgacttgcttattgcttacacggagttcacaattaactttgaaaaatttatctcggttgcaggtagcctctatctataaagacccaagtattggaaatttaattaatattgttattgtgaacttaattgtgattcataatgaacaggtaataaagtttttttcttttttcttctatctgtatccgaaatggcatatctaattgggatcggtacaacagattaaccataattcttctctgtatttaggatgggccttccatatcttttaatgctcagacaacattaaaaaacttttgccagtggcagcattcgaagaacagtccaggtggaatccatcatgatactgctgttctcttaacaaggtatatggatttcttattcctcagatctttcagtctcaggtcaagttgatgggatgtggtcatgcattcctaatagtcagctgctagtggagggtttctcaccttaggcactgttgacattttgggctggacaattccttctgtgcattgcaagatgtttaacagcatccctggcctctgctcactacgtattagtagtactccctcccctcaggtgtgacaaccagcaatgtctccagacattgccactgccccccgtggggagggcagaatcaccttggttgagaaccacgaacctatagataccaagtgaggaataaatgtgttaggcagacctgaaaatacatgccttatataacaggcaagggcagctgctgttcagatggacctggcgttgccatgtagtatatgagttcagtgttgccagcttttgtgattttgcaaaagccagaaaaatgaattttttaaaaatgtgaaacctcccaagttttctatggtagctactatctcaaaatgttaaaacactgtagcaacaaagacgcgtgctggcttaattgtgcctcccacctcctgccatctcaattgtggtcatgagcacgtcctcttaaatgaaagtaaaacaaaggtatcttgcaccttctcaggaatgttctcaaagagtctttacgaaactggaatcatttaccccagggtattgggaaaatcctggttggagagatttcttactgctctgtgaccgccctgaccacagaagaaaacttcttaatgtagtagtttataattcttaaatcaacaattccaaaaattttttgagttttgaaactctggtcttatgaatttgctttttttaacccccaccccaaagtgtgtactgttgtgaatgcctagacgaccctaaagtatttacttgtattgacatttactctttgatgtcatcaaggcctaagtctgctttgctttcagacaggatatctgcagagctcacgacaaatgtgataccttaggtgagttctctgtgcgtatcttctatggctaaaacagtttactacatgtttgtatttcaagccacagttgctttttagagtaaatccttgttggtttttttccttctaataggcctggctgaactgggaaccatttgtgatccctatagaagctgttctattagtgaagatagtggattgagtacagcttttacgatcgcccatgagctgggccatgtgtgagttacctttcagtaatttcatttaatttggagtgacctaaaccttttattccttcgcatcagtgagcatttacttgactttcgagtgtgtaagagacttcccgagtcatagtagagttgcagggttgaagagctttgaacctaattaggtgaaatgactttgacttccaaaagttgagtaaatgcagtgcactctctttagtcatagcttgtgtgtatcttcagtttaactgctcaagtttaatacacaaggtctaatattctcccttcctactgggaactggagaaatggggtctttccattccttctactgaagcagaggatatattagcctagagaactttcctgatttaacacctttgtctaggagggtcccccaccattactgtggcccccaagatttttacaaatccagaccattcccgattctagttatacacagctctaattctgatatttagcactgggaacagtagtatcccttttttcaggaaagagaatgaacaaagatagaaagaaggaatcatttcctaattatggtcactaagtggccgttatgaaatggcctttcccttttgttttttagagatagagcacggttagaacatggggcaaaacactgcaaattgactagaaattattctgagttttgatctgcattattttctttctaggatgattaaattacttatactatctatttcgaaataattttctgaaaggatattaatagatcaatttgtgtggcagatggtaactttacttagagctaacatcatttattaaacaagattttcattcatacatttaaggtcccctatgtgcagtgtagtgtacgaggcacagagggagatgcatatacacaggtgtctccaatttagctcaatatataacaggtatatttttaaactagtacctttcaaacatatattaagagcacaccccttttcttttctccagaggaaatacagtcaaatgcctcatatttagaacataaaagaggtctggctttccattaagcatttgtggcaggcccaacctgcttagtcagcatcgtctctatcctcgtggtttctgaggcacttttgtgaaactcaaggaagccttgaagagaattcccattccagcttccccagcttagtggcggtgggacttgatcaagtaattaaagctctctgtggctcagttttctcatctgcaaaatgcagataataacagtacaggtgtagaattccttacccaaatgcttgggaccagaagtgttttggattttggattgtctcagatttttgcaatatttgcatatccataatgagatatcttggggatgggactcaagtttaagcaaggaatttatgtttcatgtataccttatgcacatagcctagaggtaattttatatgatatttttaaataattttatgcatgaaacaaagtttgtgttacacatttatgtgtggaattttccactggtgtcaggttagcactcaaaaagttttgggtcttggaggattttggatttggggttttgagattagggatgttcaacctgtactattcattgggtaaaataagtgattaaatgaaataaggcatctaaagcatttagcacattttctggtgcattgtgaatgctgaaaagttgtggttattatcgttcgtaagcgtccaataagcatttattattatttaactcctgcagtgagcaaatgtgagtaacatttgaatgaaaataaattttcagcttatttacatgaggtaataaacttgactttatcaagtaattgtgggagtggggaataaacctcatctggggatgggaaataaacaccactataaagaaaccactaagatttgaatgccttgcttgttttaagtttgttgatgcaggtattgcattgattatgcatcagggaactggaaaccaaggcattcgttcttttaagaaaatagattcttaagcataggagtctcatgttttaagaactatttctaagttcaactaagatcgagtttttctgtctctattggcaagtattaagaggcataaactttaaagaaaaagggaaaatgtgataaattaatggaatagactccataggcttttattccaacttttatatgatgcaagtctatgtgcttctgtctgactcacttatttctgtaatcaagatgaactagtgaagggaatttctctctcaatgctaaattaattacatgcattggggatagtcatccagagagagggaaggtgacccttctgaggttgtcacccagtagataattgcctgagctgagaatggcatgtgggtcacagaattggtgtttctggatttaggaaatacttcctattttttttccactcctgctggctaagccaagaatggcaaatatgtgttcatgctgctgcattcccttccaggcccataaggacgttggcaatccttcatagccttctcacaggcggaacctggattaatttaagaacccttttgtgcctggcttttcaggaagccagtaccaatcaattggtgctggcatgaagcatgaaactatttgccatctctgagttatgccagtagaattggcatgcttctggtttccatgcataccactacctttcatgggttttattgtgcacaaactttgcatgcctttagaatgatatacctacgcaggtatataatttgtcaccctgatccaaaaaggggaagatgccaagacccatagtgagcctcttattagaaagctcttggcttcagtttttgacacttccctgactctttatattcacgttatcataagctgccaaattcttgactctataaattgccctttaacagcttattaggaattccaactactgtattctagcaccaactacagcatattcagagcctctgcaattcctaaaagtacacttaaaccaaatacatgggccagcctgcatcttttaaaatacattttatgcctttacacttcgtattaagttgggtgagaattatgttttaatctacactctatcttgaattgtcttacattttattctgcttaccagggttcaggttcttatccaaaatgaagttaaatttttttctcttagatagttgcattcctgaagcaattagaacagcatgatcccttggtgtttattgacattctcatcattgtctcattggctttaggtttaacatgcctcatgatgacaacaacaaatgtaaagaagaaggagttaagagtccccagcatgtcatggctccaacactgaacttctacaccaacccctggatgtggtcaaagtgtagtcgaaaatatatcactgagtttttagagtaagacttgaacattcttttagcacaaacttctagtgcctggcctacatgtagtgaactaattgtgggaaagacaatatgaagtcaaacattccttttgagttatttttgttgacattccttggagaaggcaaaaaaaaaaaaaaaagctctctgacatctgtgtagttcatatccttgacagagtttagaagattacagactgagctaaagaaaaggttggagtcttaaagaggatgtggaaatgttgcttcattttgggtaaagttttgagatttgttcagacattgggagagggactatgaatgtgatttcttaatgaaggccacaggtatttatgcacttctaatttagtaatttgggcctgaaaaggggtggggtagtgagatgatcccaaagcagattccgtggatgagtggaaattacagcagctcccacattgttgagttgaggacattctctctctgcgtcactcttcctctccccctcttccctctcccttttctcttttttcccatttcctttcttttcttgttttgttttttaagcttcctgctaggctgctcaaagatccaattacattatacaatgcccctgtgtcacagatttattgctcttctcgctcagaagtatgaaaggttaagtgattgtcccagagtcactgggtgtatatttctgcaaccacggggaagaggaggctttatcaatcagaactcaacgggtgtgaattttccgggagaggtgtttgctgaaaacggaaagaaccagagggttgctgttgttctttttaaccagatggtgtaaggtgttttctttctatgagtcattgattcgctcacgcatcccttcagcaaacatttactaatcacctgttgtcatggacagggccctgtgctttgatgaaaaagacactatctttgcccttagaaagcttacagtctattgggaaagatagtcaaacataaacagataattgctgtgaagtgtgatcaacgttgtaacaggtgtatatttcctactggctatgttgtattcattgcatgtggttctacaaagtaaacagcaaaaatgtaacttcagcatctggatttaatcttggatgtaaagaataaagcacatgttaaaaagtaactgtcctctctaccattacaatggtggggtggcctttactgttacctgggggagaccttgacagccaccgttctcaccatctgtgtgtttctgtgtgtttccgtagcactggttatggcgagtgtttgcttaacgaacctgaatccagaccctaccctttgcctgtccaactgccaggcatcctttacaacgtgaataaacaatgtgaattgatttttggaccaggttctcaggtgtgcccatatatggtaagtgtaggagggccacttctgccctcatctactgattctgcacttctttttattcatagttttccattgcattctaactcgactataaactacccaaggaaaagctgagagtaaaattgcatattagtgatcataataattatgaggatgacacaacagtactgctgctcagtgttaaatagtgctttacctgcactttctcatttcatcctcgtgacagtccaaaaggaagatgccatcatcactttcattttacaagtgaaagtgaggctcagaggcagcaaggttacggagttgggaattacagagctcagcttttttctctccttgttgcctttaatgcccttcgacttgtccaggtgacctaaattatagggactcttctagattcggaagagctaattcatgagacaaacatgtttctgtgttttagcttgtcaaggtagcatcctgtgaccacctggggcttgaaatcatttctggtggggcctcagctggggtggctgtgtgatagttttgctgcatgtgttgtggatgtttgggccagtgataacatctagcagttatccggttgcagatgagcagagctgtgtttctatggggtggcccattctgtctctttggggtggtgtatgtgtgtttcttttgctgggagtgtcttcagagattgcctggtgaattgagaagtacaatagtattccatggaaataataacaaaattttgagtaaacttgattcatggcaatatttgtttttgtgttattcatgataggaaaaattaggagtcattgaaatgccaagcaaaagaaaggttaaacaaattatagggtctcccttttatagcaattgaaaatgatctacatctgggaacatgctcctgctataattttaagttaagataacaagataaacaattttatgaagtatgatctcaactctaaaaggggagaaaaagctacagaaaagacttggtagtttgaaactttttctatttaaaaaaataaacttttaatacttgtgcaacttttctactataagtgtggtttattttaataattaggaaagataaaaaatcttttaaaattgtgccctgaaatagagctaaatatagcaaatggaatagatctaaaaaacagagtgtttagaggaggaagaaagcaagttgtaggatatgtcagtatggtgcagttgtaaagcttaaatgctgtctattactggagatttatatgcatttgtagtaaaagtgttggaaatgatgaagtgatgaacactactcaggactgtggtcacttctggtaggaaaaggaagggaaaggaacctaggatgagtacatagggccttcagctgtgtctgtgaagttttctttccttagcttggtggtgggtacatgggtatccattaccagggatagaaatgtgttttatgggctgctgtctatattttagcatttatcataccaagaaaagaatttccttccccacttaccctatgtcattggtgaaacattagttgaaagcaagctttgctttgtttgatactgccaaataaatcacttgtcactcaattgccatttcattgaattgagcagatgcagtgcagacggctctggtgcaataacgtcaatggagtacacaaaggctgccggactcagcacacaccctgggccgatgggacggagtgcgagcctggaaaggcaagtaatgccctgttctgtccttctgtcttagggcagaaatgtgcaagattttgggtgtatgatcagacaccgatgtttagaatataagacaatgcagtctgttttagcatgcataatattttttagaggacagatgtttagaagttagacaattaaaaattgtgaaacttagattatagcataatgctgataccagagaatatacctatcattattgcttcaatattaagacattctgtcaacttaagactttctctcatttaaacatttctaaaattacagtgtgcctatgggaacatttaatgcgagattgtgtttctttttcttctcttttggggatggcactggaaagctattggtaagttgatggaacagtttagaatcaaggaaatgtagaaatatagtacatctattgcaggtactactatgataccaggcttttgccaaccggtgttgttccctttaaggagctataatgtcattcaggatatatccaaatccaagttctcgtgagctggttataattgttcctactgatttgttaatagataaacaaaatctgctacttttgtggcccaatggtaacagtgtctcatgcacctaggagtatgattaacttaaccttctgtacctagtgtgcatctagaaaaattggtgacatgttagtgataccatcatcagcccaaaaatttggtaacaaaaagttttagatataaatcttgatttaaaaaaaaaatacacatggaaattggcattctatctgtaacttaccaaggatacaatctctgaatgatatttctgagtgttttgttatccttatatatatttttcccttttttccctcctctttccattgtccactttacttacttttaataatttattctcatctcatttccttttcctccgctttaccttatagaattggtagcacccagaatgtttctgtggaagaagtcctaagagatgatggaacttaattccctgttccctgatcttatagacaagaaacttctcagtttcttgtctcacaatgagtaacttgtccacagtcactcagatcatttggtgcagcccctccccaccctcatttcctctactgctttgtctgaaggggcagcagggcctactggagtggccctaactgaagctcactgagctcctatagtttctgctggtcaaagaggaagactagtgggtttttcagtgttaaaggatcctgaggatatgaaagtttaaaaatataaagtccaatgcgaaaataaaaacttataatgaagatacttttgtatttgacttaaattggcaacagagtcagctcatgttctcatttctctatggctgggacctcatcaattgagaatacagctttcctcaatagcaacctaacacaaagtttatacggatacaagcgtaatagcttctagagctttcattggtttaaagggaaatatatctctttggccaaagagtgaatctttgcaagacatgttgaatctttgcaagacatgtaacttagtggattggtggccacaaaatcatattttggtcaaagaatccatggcagccattaaaaattgaatatgacactcattcttacaaaatcaagatgtggcctcagagtccttctaaacacaaagacccaaacaactgctaccagttggtaggagatgacaataaacatgatacctatttgacaacttggttagttggcttgggttagaaccagcccattatattacttaaattgaatctgtttgatctcagtgaaatcactggtatttagttgtggttcttaacctgatggatccacccactatgtctatttctgacacatgttattgctgcaaaagaaacacaacaacgaaaaattttcaatcatgtgatgaaatgacttgcatttagtaaaactgtcatgaacgtgctgtcaagctccagatagcagtatggttacccaaccaattctggaatgcagaataacttggaggatgtcaattatgtcttttcccaatcttctgtttttgcagaagaggagggatcgtagggtaattttctatcttctgagggatggggagcttcgggagagctttcagcagaccctgctcctgctaaacacaagcaagtgggtgtgcttgtagcaagagcaggagccttcaaggcattcccaaggcaggctcaggatgcttttggagaagaactgtgcagagaaaatgatagatccatttttagttgttttagaaaagtggccatgtctagcagcttttattaaagatgtggatatatataaatatcctgaagagtatttacacattctagaaatgccaaagaaggtgaatatattggcatagaaattctctgagtgttttgctttgtttctttttcatagagttgccagtatgtgccttttctctatatgctagcacattctgcctcccttggctgctgggttaatgttttttctttctttttcttctttctgttctgctcctgcagcagtaatctgtcttgggctgctgacacaatgttattttgatgaatgactcactaatgtctctttattttctccactctcttaagtccattagcattttccttttaaacttatttgtgagtctgaggtttgaaactcttttgtttcaagtttcatttggacaaaatcaacctccaagtccccattccaacctcttaaaaagatacatttctataaaatattatttaaatggttttggacattttaaataaaggctgactttattttggctcttatttcaccagccacttaatgttttgttataatgtaatagtaattttgctatgtgattattatttgtagaatttgcctggtaaaatagattatcttggtgcatgtttcccaaacagaccccattcccagcatctgtcatatcagacacttttcatattcctctgaagttcttcctttcttttggacacctgtcaatggtcatattactgagaaatatttaatttccatatcagttttgaattagaagttttcttttaaaaagcaactatgaggacatttgagtgcagtgctagatggtagcgctctgataaacctacccccttgttttgttccaatgtttatagtaatgcttaatgagaagagtggtcatttggaatttgctcttgtgtggaagtaaaatctatagaataaagagatccagaaactgaagtctgaagtgttaagagggaaaaaatgtatttccagaaaactccttaattttgtcctcaaggtacaaaatggctgtggttgctccagccatggagtctgacttccccgcagaatgaagccaaagagttcaaagggcctcttcaggaatcctacccagtgaattctgcttacatctctctgaccacctctatccgtagggaaactttggaaaatataggttctattgccaagataaaggggaggatggatattgagtgaataatctggagtctcagtcttacctagccatctcattaatcttacttttggtgaaaacttcagtccttatttagatgtcggaaattgtcccctttgctcacagttaagaggcagcatgtgtcccagttaagagtatgcactgttaagtcttgtctatatttcagtaccattcctgcctctttgtgatgtttggcatcaactcctctgtcccttcattttcttttcgtaaaaatggaagtaataatagtacctacttcgtagtgtgttgtgaggactaagtttgtatatataatgcttagaacagtgcctgacaaatattaagtgcagtgtacatgtttgccattatcattgccactgttatttaagtggggtcccccatgtgctaagttgtatactaagtatgttacatactttgtcccatgttatactccaaataattttggccagtaggtccccatttttttattgtggaaacagactttaaggactcacccaaggccacagagttattttgtaaaagagttaccagtcccagtgagacctgttgtattttgttaagttttgtctgtctagacctgctgtgtccaatatggtggccaccagccacgtgtggctatgttaaaatgtcgacatgaactgagatgtgcttaggtataaaatacatcccaggatttgaagacttagtatgaaaaaaaaaaagcattaaaaaatctaattagtaggccaggtgtggtggctcatgcctgtaatcccagcactttgggaggccaaggagggcagattgcttgagtctaggagtttgagattagcctgggcaacatactaagacccccacccctaactgtctctataaaagataaaaaaatttagctgagcatggtggcatacacctgtggtcccagctacttgggaggctgaggtgggaggatcacttgagcctgggacgttgaggctgcagtgagccatgattgcaccactgcactccagcctgggtgagagaggaagactctgtctcaaaaaaaaaaaaaaaaaaaaaaaattattgagtaatgttatgttgactacatgtagaaataacaatgtgttagatagattgggctaaatatattaaaattaatttaagttttttattagttttttatgtgactttagaaattcttaaattatatatgtggttcatgttctgtgtctactggacagaggtactctagacaaagccgtccatctgttcatttatttttatatgtatattttctaagaaatgttcacaaccactgtaaagacaaatatgaagtgatttccagagagcgacgtagtccccactgcctcagtgcgcatttcatgggtcctgagtcacccagggttcagatgcagaacatcttaagcctcagccaaacagcccagggaaagggacgtgccctcagatactgtaagaggataattacaagggaggaggccaggcagactggagaaagcttaattgcactgtttaaataattgtttaccaagccttgtgtgggggtggggcctgctattcccactgagaccttcacctacctcttctttttccaccttccctgcatactgccccaccccctggccttcagacctctctgcctctcccctcttggtggctgtgtcctccctggggataaatcacgacagtcgccaccagctccgcttcagagatctgagcgagccgcggggcgtcaccctcctgtggccactgccgccacttttcctttgtccactgctcagtgacctcggctttgtgtcagggcttcacaccccaacaatggcagagggtcggaatggcttctctcctcccttgtcctgctgaggagttttattttgttttattattattttttaaacgtcatggccttcttcctgctccaggctggagaatctgaaaccgctagtaacaaacaagtcataaagtttagggctctctgtagtgtgtccgttttgctttcgtctcatcctgacgctttcctggagtgtgtttataagaatcatgtaactcgctttttttttcccccctctccaatataattaaaattgggagcaataaagcattatagtttaccagacttgtaacttctctaggccttgttgatggaaattcactatgcaaatcttataactcattttggccctgtctataaccacccttcccatttccactcctggtttttccaagtaaactaattgagtggtttgaagcttgccattggagttaccctgtcagcctggagccagtcactggccagttttattcaagcaagctgtaaaggaagacccagcctaaaatcactaagtgtgagattaaaatccctatagcttccattattcatatagatgatgaacctgcagcatttcaaacccacacatggaaaagaattacagtatggtgtgtttaaaaggacagccagtcctgtaacaactcacagcgccaagtctccctcactattccccttattaaatacagcactgcaagtatggattttgtgttcccaaagaaatggatgtccccgtgacagatggatcctggggaagttggagtccctttggaacctgctccagaacatgtggagggggcatcaaaacagccattcgagagtgcaacagaccagagtaagtcctagaatgtataactgttattactgccgtggcaggaacatgaaattcctaaagggaataatttggtgggtgaagagtacattccaacttagagagctagaaagaacgtaaacttcaagggctgcttagacccacggtacccaaagtctattcccaggcacttccccctgtattattgtttactctcaagatcctttgttattcaaagttttatctaccaaacaggtgatggttttgtggtcggtctgtttcctagtgttgacaatcaggcaggtctcactctccctgctacactcagagcttaacaatgagaacccacggacacaggaaggggaacatcacactctggggactgttgtggggtggggggcggggggagggatagcattaggagatatacctaatgctaaatgacgagttaatgggtgcagcacaccagcatggcacatgtatacatatgtaactaacctgcacattgtgcacgtgtaccctaaaacttaaagtatagtaataataaaaaataaaaataaaaaaacaacaaaaaagcaaaaacaaaacaaaacaaaacaaaaaaaaagcaggcaaaaaaaaaaaagatagcacactaatggagtgactagatagattttcacatggaaacaaaaaaattggacattttcatccagtttgtagactaatatattccttctagttagacctcaagggacctgggaccccaaatcaagaattactttttattttttttctttttttcccaccaataatgtgttctgtgataaggaattacttttttaatcaatctagttgtattacaggtgagacagctgaggtccccatcccacaacctgacattttacagattgggagtctcttgcctttcagaataattctcattgtgtgaccatggcaacctctaccagcctaaccttgttaggactgacatgtttaaataaagtccatggacttttttcccagcatttgtcatagcagacatgggcggggtggagggtgggggaaggttgtttatagataataaattgctatcttcattataaaaaatgacatccaattttacatggatctaagacatacatagttgaaaaggaatagaaaataataggtaagtaaaagtaagtaatagtttgtatggcacttcctcagacttgccatggaacctatttaggctgggaaccaagaagtctataggaacaattttttgatgtaaaaaccaacaaccatttttaagaccccagctgctttgggattttgtaaaatgatttcccctagcagtctcatttatttttaatagcttagatcacggatagcaaactctattgtactgagaagcaaacaggtgaagtaaaggaactaagtaggctggggtaatacaatagttgtattgtagagaccaagtgcagggcactactcaggtctggctgattgttcggcagtgagaaaagagtctaatattggcaaagcttccgaatcttttctatgaaaaatctgaattgtgtgaatcaaaaagaatatagctgtaggcaactggtttgcaagccctggtctcagtactctgtactacaaatcacagatgatgattaattaagttatttttgttcataacccaaccttatttcatgtccatgtagtggtcaataaggaagataactaaagggctgtgagatacagactctgttccataaaactaacactgtagctatggataaaaatgaataagccttagattttctatatagcctatattttgaattagttttttaaatattagtataaatatagatcatgcttcaaaaaattcagacacaaacatatagaatattttagaagttgtcacactattcctacttcctgcctactccccatgagaaataatcactgaaaagtaattcagtgtgtgtcatttcagacttttcagattgtggatgtaaatacatattatatgaaataagtaccacataatataaaataagtatcatataatataaaagaaggctggtactgctttttaaactcagctatgcatccttgttgcttgtattgttgaagctttaaaagaaaaccttgtatcgtaacaactaatatgatgaattttttacatattaaaaactatttggtggctacattgagcaaagttattagtttatagtaaatgctatcatgagggtatggatattgcaaacagtgaccactttataagcactttaaacatttttgactcaaggatattccattcaaaagaagtgtttggccttttttaaaataatactttgttnnnnnnnnnnnnnnnnnnnnnnnnnnnnnnnnnnnnnnnnnnnnnnnnnnnnnnnnnnnnnnnnnnnnnnnnnnttcaaagtgcaacaaagatcctcacattcagaagttaagaaccgatcattaaagacctcaattagaggtccttgtccctgctgtttgctatgggaggtttttttttttttttttaaaaaaaaaaaaaaaaaaaaaaccaatccacctagttgagtgtcagcactgacatcatttcattaaaactcctccaagttatttgcactttaggatgtccctgttaattgaggaaggagactgcctctgaatacggaggttacaatggctctgggggagtcaatttgaaaagagaaaggaacacagaaaagggaaaatcagatccaaatctcagtttaaaagcttgttcagagaaattcacagagcagatggttcattatgtagaacgtagaagtggttgctgtcatgcttctcaaggagtttgaggggaacagctgcccccctcactgggaatatgccttttgtcagttcgacgagcccttacaatataatggagagctctgtttttagaatccaaggtacaaggtatgtctctattaaggacactggattttttttttcttttttcacaatatttatctgattcaagagtgtatttatttagcatccagagactttatagtatattcttaagagtttttttccccctgaaagcgtaaaagccaaaaaagataagtagccttgccgtgtacatgagattatgctctactccatgaacaagctgtagagaccatacgctttctaattttggtcacaagatattttggtctcaactggtatatatggtgttacaggtggggccctcatattttgtctttaagtgctttatttttttaatctcaattttgatccatgccctacagataagatgatcatagttctggtttacaaggacagtcccttgttctatctgttgccctgaaggaattattaatagctcccattttcactctcagaacgttcttgattgggcaattaattacacggtcacccagcctataagacgtgtgtaatagagtaaaatttaaaatcagaacctccaaaacatagcttaacagtaccaaaaccagactgagctttggaactagaagatgtattttcaggcttttgggccctatacttgttttgtgctcaaaatttggctccgagcttccttgtggctgaaacaaaatggtacgtagaattgttacagtccatcaaaaacaaaaatcgtgtcagttccttaggaaagacacagcattttctttttccagtgcttctattttacttttaaattaggagataggttaaaatttaaaaataataaactcatagatttgagggataaaaggattatgaactagatatttcccccttaggctctctccatagcaactggttatgaaatcttactttaaaaacatattcaagacatatgtctatttcatccaaaaaaatgaatttctcatttggctgtaaggaattacagcaaggctttttctgaggcactcagtttggatgaagttgtttcgaaatgttgagaattggttactgtggaagagccattaactaatgaataagtaaaagaatccagtttcatagactgccccatttggaaagatcattaaagatgggctggtacagctcccaccccatcccatctaatctttgaatagcctttcagcattcttcataattggccatcaggccccttcttaaaaacctccaggcacaggaattacactaccttctggggctgcctgttgtatctttagaaatgtcttgtgccaaccctaaatctgactaccctaattcatcgtacctaaacgtagaagttgatttctgttcaaacccttttgcagaccaaagtttagctttccttgaggatagactgtacctgtgatgacctctgcaaaaatttctttatagctttggtcatgcatcatcttgaatttcctttctatgtattaacaggcatggctgtgtaatatgtgcttgaaagaaagatccaatttggctgtgcagaatagtaattactctagcaatttccttaaaccctccctatccctatttgacatgcaatattttaaaaggatcttaatagttgggaagtgtggctactattttttaaagctatgtttcctattattttcaatatttgcctactagaaaaaatactcctattcagctaaataattaaattataaaatgatttttttccatgctgaaagatgagtttggttggctgaagctttctctattacatagtccatgtaaatcaggcagcaatctaggagagaggaaacatatgtagttcagaaggccaatttatatttgttaaagtcatgtcaataattaaggaagaaattgtaacctgcctttacataaaagcaaatcaacttgcagaccaacttttgatatggaaagaggcctgtctcaagggagacagcctggaagagaggccaggtcttgagcttctggtcagggagagttgggttgggctcccctctcagcaaagtcagtgacagaatttggaacgtaggacagtgacacaagaatagtccagggatcaggaaaccttttccatcagggccaaatagtaaatactttaggctttgaggtttatgtggtctccatcacaattactcaaccttactgatatacgaagaaacaaacagacaatgtgggtgtggctgtgttccaataaatctttatttatggacactgaaatttgaatttcccatagttcacatgtgtcccaaaatcttcttctttgtaaaaatttttttcaattactttaaaatgtaaaacttattcttagctcacaaaccatgcaaaaatcaatggcgggctgggtttggcccacaggatggtagtttgccaaatcttgtaatagctaaacttttattaatcacttactgtgagccacactttgtgcaagtgctttgaatgtattaatctagttaaccctcactacagctttatgaaatagatattagtatcatctcccttttacagataagcaaacggaggcttggcaagattaagcaactcgcctaatattgcatcattattaagaggcatagctgggattcaaaccctctgtttccagagtccatgtttctaaccataaggagtattgcctctcacatacagtattttttgtgtgtttataaaaaatgttttttataaaaataaatcccaaaatactacttgccatgttatagtggtcaaagcaagcaaaggtggaaactgttaccatctgaagggaagccacctataaataataactatttgcagtccgaagaactgctgcatttgataaatttcaagaatcagctaagacgtgtcatataagagaacaaaaaaaatcaatttaaaaaactttatgttcaaagggaaagaagtatgagttactttcaggcaataaataaatgattgatccaccatagtcagctgggacatctaaaaagattccagaaagataatttcaactggaggaaaaattgaagggggtcttccttgtagcacatttgaaacaagttttacctgagcaggtatacagtcctgatctgttattcatgggtcatctgtgatattttatgcatgagactggggtgccttggtactgagaaaagggcttggatctaggaaacccattctgcatctctaaatggcaccaaaaaagaaaagaaaaaaaaagaccctgaaacacagcatatggataatgtagcagacgtgcacagagaagagtctgggagacttggattccagtcctgactctgctcctttgttagctgtgtgacctttgggcaaagtacttctctaaacgtcctgtcacttggtataaaagcacctcatcttccctagccttggacaagataggaaggagatttcccagtttgaatgaatagtgcagatatacagtatatgggcttaattgtgcttaatgcagaaacagacagacgtagacacgactgtgttatgtgccattttgcatccctagatgcagtcttccttatgataaataatggtgaatgttgatcagacttcttgctaagttcctcagagtcacaacaagccttttaagtacacagcatcgtctctgttttacatgtgaagatagagcccaggaaggtgagacagcttacacaaagtcaccctccccagcttgtaactgcaaagctggtgctcttactttatgctgcaaatctttgatcgagcaagtacgtttataacagtatcaggacgagcttctctaggagggcctttgtgggacctgggcacgctgcaggagcactgagtcctgcctcggtgctcagagtgggtgctcaagccaactgcagaattggatcagattagattgggcagtgttgacatgaagtatcatagtaggtaacattttatggcatctactatgtgcacttattgtaaagaaggggaaaaattgaagctcaggaagactgagaacttagtctagggccacacagtgaggatagggccagattggaaccaagatccaactctagagctctttctacctctcattctatatttcgtgagcagggatatatttctcattccccaaaactcctgtttgaaacaaagcagccaaaaacccattttttatagtccagattactctgaaagattcattctaaaggaaaaagggtgaaaaatgtcctttcagttgcagggttgtcctagggcagttgtgaaacccgagctgtttcagccctgggtgagtgagccccaacgtcctacgattctgtgatcttcctgtttccatgatgaatttggcatgctgctgactgctggtagatgtgttgtataatttactctctggatcacatctggaatatacatgcacagggttgcatgcggagattaaatttgcactgtgatgctttgcaaggcgtatgccatacactcgtcacacaaaagctaatgaaaccagtatgctctttcctgcttctcctcttaagttagtcaaaatatgaacacattcccattattccattttatgtgtgaaacaaaaaagcaaaaacaatggttgtctggagagagggagtagagggacagaatgaatggaggtgtgagggaacaagtttatgatggtctcctgtgaatatgtcaaggtacaaaaggaagatagggagcattccaaactactcttgggtacctttcaccttctacattttaaacattgaagcaccatgaatgttgggaagaaaaggaacaaaaagtggcctaatagattcagattcaggcttcgcatctcatattttaagctatacattctaacatttattctcacaacagcctacaagatagctacatcccattttgcaaatataagggaagattgcggaggccaagtgacttacccaaggttatacacatcatggtattgaaggcaggatgcaaaaccagggatcagagctcttgcccattcctctgtcatttgccaccctagatttacttctctagaagacaggaagtcatgaatgaaggagtgatgttcagaggaatacatgataatacagtgtgtgtgctcttcacattttttctttttcagaccaaaaaatggtggaaaatactgtgtaggacgtagaatgaaatttaagtcctgcaacacggagccatgtctcaagcagaagcgagacttccgagatgaacagtgtgctcactttgacgggaagcattttaacatcaacggtctgcttcccaatgtgcgctgggtccctaaatacagtggaagtaagtgtgtctggtgtatctgttcaccgttggccggccggcactgaggccaggcacaaaagtcaagttgtattgtttctcctctctagttctgatgaaggaccggtgcaagttgttctgcagagtggcagggaacacagcctactatcagcttcgagacagagtgatagatggaactccttgtggccaggacacaaatgatatctgtgtccagggcctttgccgggtaagtccttgatggtgttttcttcactgtgttttcccgctgccaacctgtgatttgtggcttcctagatagaatagcaactgctagtatctgtgcactattgccagggcagtggttctcaaagtgtggccccgggatcagcaacagcatcaatatcacttttttctgatgcgtgtagtgccaaagtttgggagccgttgccctggatttttcttgacattttcagtctctgtgggggtcttgcacaaaacctctccttaaaaatttattgtaacaatttacacccacactcctttgctataaactcaatgcttaagcaaatgcttcccaaatgcttcctgacagcaaattttttagattgaatagctgagggtgagaaatatgtcaggaagaagagctggcctcactcaagtttctctttgcatttttaaccacgatcatttttacctgagacattcctgttaattaattattcttgaaagggaaattgagaaacttctgggaaacagcaaagcatcagagcagtgatttctcaggggctagataccatttcaacgttctcgttagtcaaaaattattcctaacccggttgggctctgagatgatgcctctggttgttttttttgtttgtttttttttttttttgcctgtggtccaaaggcatattggagttcctggttggaaggatttgattgaaagagcccctaagggcatcacccactgactaatagcttatactgcagatttccttgtctgtccatttcacagcaacacattgagtttttcctcaaagattagttcacacaaatgaacaaaacggacaagaatgtggactctcttcttctggtcttctggtcattgtcagtgtatgtttcagagttcagtgtacatggctgcattgtgttaatatgaggagaaattcagcaggccactcgatggagcctcaggcctcaaaatggaggcccatggtcatactttggctggcattcatagccaatatttaaacgtatgggattttacataaagtcaatttttccagcttctttggaaaattgggaaaaaatgtcaacacagggctcccattccctcatggcagcaatagtctggagtggacagcagctactcccttaagatggggcatgagctctttaattagatacagttcttacctattccctttttttttcattcctaagcaattttttaaaaaattactgtgcttacttacagactagtgcttttcaaacttttatctgtagatgaagcacctgaggaatcctattaaaatgccaactctgatccagtagatctgggtgggtcctgaaattctgcattcctgaccacatcaaaggtgcccatggctgctggtccaaggaccacattttaaatagcaaggcagtatataatttcagttttcaacctttccaagttttaaaggacttgactttcttgtcatttttagtgcacacgattaaaagaaacacattatttgccattttataatctctataatgcttacatttatttcaaatcttttctttttaaaagcaagctggatgcgatcatgttttaaactcaaaagcccggagagataaatgtggggtttgtggtggcgataattcttcatgcaaaacagtggcaggaacatttaatacagtacattatggtaagaatctgctcctaagaaccatgagaaggaatatggtcaaagtttgaaaattgttaagcacatgtaatatgcaaaaatattaatgtcgagcataaaaatcagtctcgttgtggtggattatccatcgactagaaggcacctaatagaattatatgagaattatattctattcctttgttgtccactttttattccatacttagagaaagtgaaccattctgtggagtactgaatttctgctaaattcttttcaggttacaatactgtggtccgaattccagctggtgctaccaatattgatgtgcggcagcacagtttctcaggggaaacagacgatgacaactacttaggtgagatgggatgcctcactacttgcgagttctggttctatggagcagtggccagatactacttccttccttctctggcatgcagagggagaggtttcagatgtcatggattttcataaaataagtggctctcaaaattcaccattgtatttctccctcatacatacgccctcagagtattgattgaaaagttgtgtagctgcactatttgatatcaagggatttactctggatcttaaaaaatagaaaggccccaagtcaaattttgaaagtacttatcctctaagtttagcataaaatccttgctctcattgagtcttttcaaaaagctgtcctgtggggaactgacttgcaaatattttattagaagcattacttgacttaatttttatgttatcagctctaaccagtagcagaccactggtagacttattcagtatttcattatgcctgttcgttgcaaaagtttctatggtgacacgtatttttctcaagtcattactagaatagcaatactatacagattttttatcctcttctcactgaactgaggtgcatgattaattcatatctattccttatatttaaaccacaacatgccgatgaccctgtgttgattttcaacagtttgctcagcccagtcccatcttattttattatttttttattttttaacttaaagttctggagtacatgttcaagatgtgcgggtttgttacataggtaaacgtgtgccatggtgatttgctgtacctgtcaacccctcacctaggtattaagcccagcatgcattagctatttttcctgatgctctcccttgcccacacatcctgcatcccacaagccccattgtgtgttgttcccttccctgtatttttgggacagggtctcactctgtcaccgaggctggagtgcagtggtgtgatcacagctcactgcatcttcaacctcccaggctcaggtgatcctcccacctcagcctgagtagctgggactataggcactcaccactatgcacagctagttgttttttatttatttttatttcttatttatagagatgatgtctcactatgttgcccaggctgggcttgaactcctggcctcaagcgatcttcctgccttggcctcccaaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatctagaataaattagagctgtcttgctgggcagtcaatcttaaaaagcaatgaatgtactttctttattgtaatatgccaggcaggaactctatttattcatctgaattcaacctgtatagaggcccttaatctaagcatttggacatattcagctggtaaatgagtatttgttgaactgaattaaagtctatatctctgttttggaatgtctacatgaagctgcatagatagacagtgagccttcagctaagcatgctaatcaagtatgatatttatacatgactccattatggcatttgctatcactattcattcagtcactcactcacttatttaatatgtgccaggcactgttctaggcacaatgaacaaaacagataaaaaaaaatttgtgtcttcttggacgttactttttagtgggacaataaacaataggcaataaacagtaacctgatagataagaaaactccatagtgttatagtgataagtgctgctagaaatcagagcagcctaaggcaaatcgggataccaagggtgagatgtggacagtagagttgaaatgtttgaatcatagagcaagataataagctatttaggggaagagcattccaggcagagggaatagccattgcaaagtccttgaagtagggaagacggaggcagtatggctgttgccaagtgagcacagaggacactcctaggtaaggttaaacaagactaggtcatacacgaccatataaccattttaagaactttggcttggactcagagacatcaggagccactggaggttttgagctgaggaatgacgtcttactgcatttatgtttttaaaggagcactctggctggtacattgagaagagatggtgggggaagtgtgtacaggacagaagcggtgccattgattaggaaatcattgcagtaatccaggagggagatgctggtggcttggccccaatgggagcggtgaaagtggcagtatgtagttagattctggatatcttttgaagttggaaccaatatgacttgctgatggattgaacatagtgtgtgagttaaaggtacaaaggagttaaaagtacacaagactaaaggtacaaaggaatctcaaaactccaaggtcaaaacctgagcaatgggaaggatggagttgtcatcaactgagatgacaagactagttacatatttattatacgaccactagtgttttaaagttagggcagggtctttacatcttcagctactgatatgaagcctacatatgattggtacaaagcagatgattgctgaattgttgaacagccgttgtcaatgctgtctttaatgactacctactgtgcacttaatggagaatggggttagcttgaaaatgtacattcacctcttctttcaagggccgtaaagccttacttggaattaattactcaatcactacatcagcttttcactaccccaaacatccaaatgagtgacaattttataagacaattaacaaagttcttggaggactgtttacaaattattttggggggggaatccatttctccttgcacagctgcagaatggggcaagtatttttctttgtacacttggttataaatttgagcatgtggctgcagtgtccttactacttcctaattaaatgaaacagcattgcatgcagcctgctttataaattaatttcctgagacctgaaggccatgttgagttgctcctttcttctcttcgaaagagagaaggattctctgctattcttccctttcttggaaaaacaatctccctccaagtagtggcctcaattcaagtcaacttaatcaatgcacatcaagcacctgaattcagggagggcctcctgataaccttttattattcagtggaggtttcttaatctccttgtaaagaatgaaaacaaaattaaggaagatttgtcatctggcacaggcaatctgagccagttatgacactttaacggaatagaatgggaaagtcacctgttggcataaggaagtctctctagaagcaaatgaaaagtgtgcaagcctacattgcaagtcacagtccactgagtgtgaaagtcgagacctcagagcctttgaacctcacggtggttactcaacaagttaggaagaatttgatgttgtcatcaagtctggcatatgtaaatatttactcttggcttgatggaagatgcagcacatgcactgagaaggttttacaacccacactgagtctcgcgttgagtccagtcacagctgttccattgctaagcaatattcatccttatcccttatgttttttttcagtgtcagccaagccatacttttctgtgtattctaggagggaggaatttccaggagagagggccttttgtagcaacccagctctgatgggtgcaatgggagggaaaccaacccaggaaattagctcccttaatcgcattagtgggaggttgggcattaggctcttgttttcaggaaactatttgtttcacaaagtaccaaagcaggaagccttcctgtcaaaggtcatcctttcacatggaccccttcctcctgttgagctaaagccaagttgtacccagggccaccatgttcgtatctctttagaagaaaaagtagccatttctgtgatacttatttgtctccagtacacttagctcttgattaattgtggcaatgggaagatgggaatcgatgcagtgcaagataaaataggatttttttttttcatctgatgattttaaggatgtctggggccaaaccatttatcacggcagatcgtaagaggaatccgatatcatttgtgctcctctctttctccctactcacatctactggaataaagaatatgcatggaagggtgaaatgccctgagtcagcaaagcatgaaaggaaacctggagacattggaaaagaccccccaaattaacccagaatagactatcactctttgcatatgaccacactggattatcacttgatttacagaaccggcatctgactttttatttcctcctttttatcaagacatcagctgggtagctagcatgcaacttcatttgaaagaactgggtgattttgttgacagcacatcatactgtcaccatttgaatgacccgcattagggagcagcctcaggatgcccaaggtgccacggaaacaaccttggcttcagtgacccattgaaactcctgcctctttcatggctgatgggtctcgcgctgcaggagctgcaggcaagacgaggttgtcagaggtttacacagactgagaaagagtcatttggctggaagcactctatcctccttgtcatgagtgtcagactccatcaatcacttattctttcagcatcatcgattgagcacctactatgggttgggatctttcctgggcttataaaagtaaatttgtattttatcatcttatatatttaaggggtaggactacaggtttcttacgtgcatatattgggtagtggtgaagtctgagcttttagagtacccattacccaaataatgagcattgtacccaataggtaatttttcaacccttatcctccttttatcctcccacctttggtactctccaatgtctattagtcaaaaaagtggatttttaaatggctgctttgctcaagggctcatgcagactaacaaaatgagcaatttacatttaagaaaaatctacaacacaaacatacttagtttctatttgtatacaagagaacgaatgcatgaactcatttactcatttaacaaacgtttgttgacccccttcttggaaaattttagtagtttgtagactctggaaatggatttccatgattaggagccacctggccttgggaaattaactattttaagtcatgcctttctcatccataaattaggcttctataatagacactaccttatagaagtgtgataaggagacagtacatacaaaggcattttgatctgccaggaactaaagctgatatggattcttatttaatccatataacaatcctataagaaactcattatacagaggaagaaactgaggcttggagaggttaagtaatttatccaaggtgatacaaatagaaaatgggaaagattggtatccttatgggtcagacttcagacgctacacacttaaccagttcactttactgccaccatgtagaaggatatatggctgacctggaaatatacaggacttgaaatttaggtttattggtgggagtgaatggtcagactaggaagataggtgaagattaagatttgtaaagttacagggaggctatgctaaggaggttgtactatcttgtaggtagtggtgacttccaaaggattttgagccaagaagttggagggtattttatccttttaaaagctaatcttgacatttcccagtgtcaccacattcttctcagtcatttcagatgaaggcaccttattcttctcttggggccagatgttgtttatgtgggtgagaattctggtaaatgaagtgctggattaggaacagaattcaatgcagttaattcctaatcctggaatgaatagccctgcgtcagtaaggtgtccaattgcatgaactctgtgaggttcccatgtctatgaaaattaaggatcctgctgctgctgaaccacaaatattcagagcttcatctctgccctctttagtatccacataaggatataatatttacttaacctaaatccttggaacctcttctgtgtacacattgcttctctcctgagtggtgaaagataatgtgtcacctacattgatgagatggcctgcatcaatgaaagatgagttaggatctagctaatacctaagacatcttgtccactcctcattccacaaccaatacaggtatcatcaatatgatgctaagacatgatgctgttggtgaatcacgttcagcatggtttcttgggcagctgttaccaattgattgacattggcaccggggatgaaaattatttgccatctgtgagttaaatgtccttgtttcttttattcacctaaatatatggcctgtatctttcaagggcatcctcactactaaaatttgctactcttgcacaaattacagacggtaagggggggcctttctctagtctttgttcagagcccaaatttttaatagctctgatttattaaatacctgcttcatgtcaagcccaacactcaagaggacttattcaaggagcagtggtaccaggggagaaaaaagcagcacaatcaaaattttgaattaaatactaaaaggaaaagatgtgattgagattttatcttgagaaattaatcaaaaattatgaaaataaatttatttgtatttgaccatcaacaaaattacatcttcattttaatcatgccaaggttttgaaaagaataaggcaattgataaatatttttgcatatatttttcatatcaagtcacataatagcaaagtagtatattcttgactgaaagtctggatttaacagtgaaatctgaaagggagtcaattttagaaaagctttctagagatttattaactttcccaataagctctcttgaccttttaataaataaataatttcttctgaagcagctgttgtctcatcctccttgtcaattttctttcctgtttcttttttcagcttcatcaagggatacttgacaaataaaaattgcatatatttaaggtgttcaactttatgtttttatactcctatacagtgtgaaataatcaccaaaaccaacctaattaatgtatctatcacccatatagttaccatttccttttgttttcttttttcttttcttccctccttccttcctctttccttttctttctttgtctctcttttcctttctttcttctttctctttcccactctctttgtttatttcaacacttatcatctaccctttaagcaaatttcaagtgtgcaatacactaaagttaactatagtcacattgctgtatactagatctccagaatgtattcatcttgcttaactgaatctttgtatctttgaccaacatctccccatcccccctccctcctgcccctggcatttaccactctaccctctgcttctatgggtttgactattttagattccataactggtctaactctgccaggttctcatttggccaacattttggcactcgattcaagcagttctccaatatcacttttgcagcatcactgatttttttcatcttttgcaagatctggagtagattcattcattcttccccgaagatacatatttactgagcacctgccatgtgctctttcagaaactggggtacagtagtgaataaaatgatcccaacattcttaccatcatgggtcttacattcttgtttggaaagagagagtataaacaaagtgccatggagaaagatgagaaagcggatagagagtatgtaatatgtgctaacaatgggaggcagttgcaggtttagaaataatggtctgggttggtgtattaatcttttactgtgtaacaaattatctcaggacatagtggcttagaacaacaaatatatactatctctcagtttctcatgtaaggaatttgggagcagcatatacgggtgtttctggcttgaagtctctcatgaggttgtagtcaagatggcagttaggaatgtagtattatctgaagactcaactagggctggagaatccacttcccagattactcactcagagggtgttggcagaaggagtcagtacttccctgctgcttgcaggcctctctgtgggttctttagtatcctcacaacatggcagctggcttcttccagaaccagaggtccaaggaagagcaaggcagagccaaagtgcctttggccttgccttagaagtcaggttctgttgtttctgcattgtcctagtgattgcagtcattcctattgaatgtgggaggggatgacacatagtgtgaataccatgccacaaggctcgttggggccatatttgaggctggctaccacagtgagctacactgataaggagatctttgagcatcatattaaccatggattttcagatttcaacatctgtcaaacaaaaaagacttaacaaagattcaacaggcttgactaattctagtatatatagatttgtctaggaaccaattttgtaagtgttccgttcactaatgcatattttcaaatcatataaacacttttgtttccatctataattctataactgtgggtcttgtataacaagatcaaggtttattaggacacctaggttacattttatttttcacagataccacaagggagtaggtgcttttatctccactttagagataaagaaatggagatggatggaaaatgattcccaaagccacacagctggcaagtagcaaacttgggacttgaagccatgcctgtctgcctcaaaagtccccattccgtgcacagcgactctctacctatccagatgttacttcatatttcaaacagctagtcattgacagcagatcaatgtattattctgtttcttcacctacagctttatcaagcagtaaaggtgaattcttgctaaatggaaactttgttgtcacaatggccaaaagggaaattcgcattgggaatgctgtggtagagtacagtgggtccgagactgccgtagaaagaattaactcaacagatcgcattgagcaagaacttttgcttcaggtaaaaacttgaccatgagcccaccacccttttcttctgcttggcattactaagcccacccagttcgtttctgttttgtccacacattctaggttttgtcggtgggaaagttgtacaaccccgatgtacgctattctttcaatattccaattgaagataaacctcagcagttttactggaacagtcatgggccatggcaagcatgcagtaaaccctgccaaggtatctgctttgaatttgagttctggggatttgagaagtttattttatttatttatttatttttaataacagccaaatgcatgcaaactgcaaacccttctatctgcatacgttctctaatctcttttctttgaatgtgtctggtcatttttggctgggaagttgaactttttaagtgattcaagaaattttagatttcttcatcctaagaaatttttgtacacatgtgtaaaaccaagcaaaaatcacctccgccattgtaattttccagagcatggttttagtagtcatagcatatgttatttattttgttttcttttgtctaaatgaggagtcagcaaaccacagccagcaggccaaatccagcctaccgcctaccttttttttctttttcttttctttttatttttttatttttttatttttttatttttttgagatggagtcttggtctgtcgcccaggctggagtgcagtggcacaatctcagcccactgcaacctgtgcctccctggttcaagcaattctcatgcctcagtctcccgagtagctgggatcacaggtgcatgccaccatgcccgggtaatttttgtgtttttggtagagaacgggtttcaccacgttagccaggctgttctcaaacatctgacctcagatgatccgcccacctcagcctcccaaaatgctgggattacaggtttgagccactgtgcccggcctacctacttttacaaataaagttttattggaacacagtcatgacaattttgtttatgtattgcctgtgagtggctgcttttgccctgtaatgtcagggttgaatagtgcaacagagatcatacgctctgaagatatttactgtctggctctttagagaaaatgcttgccaatccggggtctaaatagtttatggaatagattattttccctgaataattttttttccctttctgcttaggggaacggaaacgaaaacttgtttgcaccagggaatctgatcagcttactgtttctgatcaaagatgcgatcggctgccccagcctggacacattactgaaccctgtggtacagactgtgacctgaggtgggccactgttttctcaaggcctttattactgaattgtgagagtcttgcaggaggtcccagcaggagaagcaaaaggaggggatgctggtctttagttcccctttcttgtgtttcagtgaaataagctttaaccaattctccatccctctggaactgattatccaagacatacatgtgcagatttcttgttcacctaagaattaaaaatagctaatagagtatggcacttgccaaaaaaaattcagttgatcctcacaacttgctgggtaggtattagcattatgattgagtcacattgtacgtgaaaacttgttttgaaagtcaaaagaaaagggggagaacctcatccctcaaagtacccataatgacctatatctaccgagagtgtataccacccagtagaagaactcctacacacctgaaagttgcagtacactaaggtagcgtcatggaagaaacaagaagaaaatgtatatatggatgtctgagatattcaaacaattctgtgtttaagaaaagtgtaaaatccgaggcaggaaatactgggtgggtagagcattctgaagcttttctatttgcctgcaaggttgactgtgtcatattgaaatattaagtagtcggggcttgcattttatactctgcatgacagttaaatgcagttaaggtgagttgctgttttgtcctccttttaagaagggaaattcagtggagagtggtataggaatgtgttaaggtctcaccatttataagcagaaaagtgaatacttaagcactttgaaggctccacattacaatgccaaatcctatcaaagggtattggctgcctgtagtgctttagtgcagattatgaggcctacttgaggctctgagaaaatagaggagttctgagattgactactaatgtctgccatggaagtgagaggagcagttatggtacgagtgtcatatttttgccagttctgactgaaggctctgacttcaaagcccaggatctttctagcctctacccagtgtcactgactttctagctcattgccctagtgaaattggcttgccaaaatatattgacaaaagtcattgtaaaaaaaaaaaaacaggaagacattaaaaggcagacgtttatactaggcaatattcttgttgtagatagtgtccatataaacccatctttgtttcagccaattgagttaaattaaagttcaagtctcttcaggaaaaaataattagttaactaaccgctaaactgaattaatcactacagtttggggaaaaaaatgaattggtggatagattccttgaggcacaaccttaataaattgagaatggtgacattttctgggtagccttatatcaaattatcactatattccccagtactctgtaatggttatggtaatagagtcaaccatttactaagaactattttttctaacagttatatattatcctattaatattcttttactaataggattgttcttatattatcccattatctattatcctgttaatataattaataccctactaattcttcaaacaacattatgatttatatattattattcttaccactttacaaataaggaaaatagaggctgagagtcgttaaacaaattgcacaagctcacacaacgagttagtggagtgacggaaatctaaatctgtacctagatcctgtgcttaaatcctaggagagagttatttttattcttaattcagttataacgatgagtgttactcatggattctattctgggtagcttctcttcctttgtgaaaagaaataattcccatgagtttttttgccccatccctgttccctaccttgcttggagccccttacctgttttttctccactgattgaatcagaacgggactggttgagtctctgattataactatagatacagcagaactcctgcctacagtgctaagtatgctcctatgatcgcacagatggtggatttatacatagcattgcgaataatagaatgtgatctaaaaaataaataattctttaagaaccctctttttaagtttacccatggagcaccaatttgagggtggagataatgtttgagctgttattttgaaaaactatttttcactttgagcagattccaaagtgagccactatttaatttgtgatgatgctggcttatgtggtgttctccaaagtttctcctgcattggaagcctttagacataaaatgtaaacagtgcttataaagctaatacattaaaaggtacccccgaagccatgagtttttgtgtaaaatgatgcaaaagatctcaaatagatttccgctcattggtttacgtggagttacatgatgcttaaaacttggttggagaatgaaacaccaaggataatgataataataataataaattataacaggaatagctacttttcttgaatgtctgccatatgtgtgaaatgctacacatggcttgcctcactcaatcccccaaatatcccagtgaaataggttctgtttccctccatttcacagatgaggaaactgaggcttagtgaagcacgcaactagggtcacttaattgacactcacatccaggtctttctgattccatagttcatcctctgatttttattaaaaataatgtcacaatacctagctgtaattagggcttcagttctttgtgtttcatatagtaggtatgctagcacactaagctattctaaattctaaatttcccatttggagaaagtcactatttttttgacacttaacttttatatgtactctactcagaccaaacaaggacagcacgtcagatcataggccaatggtaataatagcacctctaattaaagaaaaggtaaagggattatgtccaggtcttttggtagatatgaagatcatagggttaggaattttaaaatgcaaagaaaaaccaggagtttaggattagtttccaaggcctcattagacaggtgcatgctcattcctaaaattaaccagaagatcatgcctatttgtcagcttttaaatgcgtagcttactggcctgtatagattgttgggaaaataaaatcgttcactgaaaaatacaccgacacaaaccaagcctaaataaggtgttctatcttgcatctatcaaactgacagtcaatataaccatgatttatagtaattattgtcaagtagctgtgtccaaaactgaaagactgaagagaagattgttactgattggtcaaactctgaaatagcttttccaaacgcatggttgtggatcactcattttgaatgatgattcatggcacaccagtatgtctgacaagacttaccaagaatctccttccccctgtggaggttaataatgctgatcaacattttgaaggccttgaaaagttctgtaatatataaaaccttttgaattcagtcgttcttaaaattatttaatcccacaacttcccctgcaataaaaacacacaggcttacactttttttttctcagtttctacttagtaacaacactttggaatatggtttcctgaaatatagtattaaaatacaattgtattttatgtcccttgaaatgaactaaatgaacacgaaacattgaagaccaccatccagggagagactacaaagcagggggtagcattttgagaacttttctaaggctgcgctatgccctttccatagactcttcaagattctctgctcagattctggggatgatgttactgtcaggggcacttgagccactctgccatgctaagctgctggcatgttttcttgtggaggcaggacaccttccttcttcatccaggatggaaaataacctttccacaaggaaatggtgacgaaggcaaagagaaggtagccaagaatcaaagggcagatgaaagttccagatgcttctgttgaattgggccacatttttgccacacttcctgaaggaagtgagagtttgccccactacactgtgacaggatgagataaagcattgttttacaatttctcattgaacatgttccgggttagaacaaaatcccccaaatatggtgtcactctattggaaaatctccatagcccactttacttgccagatggtcaactctgacctactttggggcattcatgagaaattccaagataagcatgaggccagaactcttttttaccctgagttctaccctggacaggtacacatggaagtagtctcaggacattggtaaccaacaaaccacacaatttctaagcagtgatgagtgaacagtcaagagtgaaatccaatgaagagtacaaggaaatcaccctttttggatttctaaatctaatcaacaaaatacattttaaggtcatttatttagaatattctatttagtttaagaatattatttattttctttttaaatttaagcactgctgatcatattcctagggtattaaaagaaccagacgattggccagcacacactgaatacctactgtgtccccccataatctcattacaggtagtatggatacaaaggtgacagagatttatagattcaaatctaattttaaagtgtataattgaattgtataaaatatagcaaggaatttaagagcctttatttacagataataatgtacacaggttttaatacacttgaaaaaaattttttccttttggtagcttgaatttcagattgactatcggggtaaaatcatcacaaaggtaacacctctggctgtcattctgtgacttctatgtacattggcagccatgaaaaacacatggatatgttggcttaaaattagattttagcaactgactgtggctttgggcttcatggtattcgagttaagaaagaaaaaagaactcaactcttctatgaataccagttgactatagataaggcatatatttttaacagaaatgttggttttgccccattatttttgcataggtggcatgttgccagcaggagtgaatgtagtgcccagtgtggcttgggttaccgcacattggacatctactgtgccaaatatagcaggctggatgggaagactgagaaggttgatgatggtttttgcagcagccatcccaaaccaagcaaccgtgaaaaatgctcaggggaatgtaacacgggtggctggcgctattctgcctggactgaagtaagttggctctcactcaaagagtcttcttggatgctgtctgattagttgatggtggctccttgcaggtgtgtaagccccatttgggctgtgcggaagagatgaccgtgattgatttgtaatgcctgaccccattcaagctttccagaatagagtagcatggttgatttgtaatgtctgacatgggcatgacgtgtggaaatttggaagaagtggaacaactcaactgatttcttttgcatactctacaagccatttccggttttatttttatatgccaatgagctaattttgagtttaattataaacctggtaagcaaactgataacatgaaaagatctccaccaaaataactagagttggccagcttgtgtgttgtttcttaagagctggaagagacaacatagccaggatcttcagcatactttataagaaacttagcaacagttttatttatttattttgtccctacagtgttcaaaaagctgtgacggtgggacccagaggagaagggctatttgtgtcaatacccgaaatgatgtactggatgacagcaaatgcacacatcaagagaaagttaccattcagaggtgcagtgagttcccttgtccacagtggaaatctggagactggtcagaggtaagatgggagggctgttatttcccctaggtcatctcttacattctagttctggtgctctctatctgtttaagacaaacccttgtgcacctttctcccacctctccctttctcccttgtctcccttgagaaaacaactccagttctctgcctgcaccatgactgtcgtactggatgtaactagtctaccagtgacctcagggcactttgggcttggctagatcactcactgttgtagcttctgttgtgattttgaagttgcagtccatcaccttccctcctctttgagccctagctaagtcactgaaaggaaatcatggatttattaatcataaagctatactagctcacatctgaagtcaacatgaagtttcctacttccttgtctttgaaataagagaattagaccccagggagtgacctctctgacttacccatccaactgcaagaaaaaaaaataaaactcggaaaaaaaaaaaaagaaaagaaatggaccagactgagtattccagatttatgcctttctcatcctttactttatgaagcacaaggcaaaccctccattgcttagcacagatggtcccaggacaacaagagaaagaagatgcagcctctttcttgcttttatgatatagtattagcactcactattaacacagcccagtgttaacacagcccaaggagattcttaccaagcagggactcactccacgttccttaaggggaagaagggaaataagaaatacgaaacagaagtttcctttttaatgggccaaatcaggaatatggggaaagaaaaagtctccctgctacagctcctacatccatgctcttatcccatccttataagtgcagtattaactgcttattttcaccatcaaataaatctgaaaaggatactcttaatgcccctgaaatggcagtcaattaacagtgtatttgattaacagtgtctgattcctggacaaatgaactgcaaacctagtgctttagttctaggttaacaaattgcctttgcttaaaaatctctagtatttggttaaaaaaagataagtagtaggtttaaattttacttagatagctaatactaaagtataatttcaaactaagtaacaaacctttgcaataatatgcgataaaatgggggttgggagatcaaactgtaaattcactataatccaaagttgcttaaaaagactggaaagaaaataataaaatattgataatggttatccttgggtagcgagattttgggtcattataattttttcatttatgtttttctacagttttcaaattttctacagtaagtatggataaaatgatgattacatttggcatttattaaatgaacattgtgccaagagctttacttgtatttgtttcatttagttttcacaaccctttgcagtagacactaattctcattttacagatgagaaaattgaggttcagagagatcttgtgactggttatataagtgttaaaacttaggttgatgtgatttataattccccatgcttaactcctatgctataaaattatgaatgttgtttttcaaattttatagcatggagctgtgtttagtttattttgtgctcaaaactggcccagagactataaatatagaatgaatgaataaatgaacgaacaaaaggaaaaaaatgaggcttagtatatttacaaattgctatgggagagtgattgctgtgggaaagggacacacctgttcctactcatcaataaataaccccagaaaccacaacacattgatcagaaatgaccctgactagctccgcttttcattacagtgcttggtcacctgtggaaaagggcataagcaccgccaggtctggtgtcagtttggtgaagatcgattaaatgatagaatgtgtgaccctgagaccaagccaacatctatgcagacttgtcagcagccggaatgtgcatcctggcaggcgggtccctggggacaggtattttgaacgataagattcttaactgctacattctttccttcttatctggagaggacttgcaaaggagcattccagtggtggagatttaaccgctgtgccgggtggcatgcaggacacctccatggcactggatcaagcacatgtaactctgcaaccattttgccccccttccaaggattgctgcctgccctcctggagctgattacccttttacagacccacgtgcctatctttgccctttagcttgagcagacgagcgtttgaacaaattcacaacagatttcatgtctggctgatgttatcttctagcgtgcctctgtgggtctgttacagaaggtgatccagcaccagagtctctggcaggaaggtctggaatgagatttggaaaagatattttggctcccaatgtcacaattacaaagctcacctctcataaataagccagactcttcaaacataattaattagatcaaaggttgcaaaaccctcatgcttggaaataatcttttccaagtcctctagtctgtaggttccacagtcttaacttgagctattcttaaaggagagagtgaaagtctcccttgggcttgcatctgagaagccactactctcggaattaagtccttcctaatatagaagcagaagcgttcagggtactatttaagtagcactctgagttcccattagaagtagaacagctgtctgctgtcacttgcgtaatctcttgaagaatgaccctcccttcaccctgaccagccacagccactcagtcttttagcctctatcttcatttccaaatatgcatgcaacaagtggaagcagttttattatggcannnnnnnnnnnnnnnnnnnncacttttctgatcttcccctttcatagcatccacagtccaaattgccaatcatgtctgaattaatagggagagttcacttatacttctaatctcatcttctttttgtctgtatctgcataacttttagggaataataagaggaggagaacacagcttagggtcactgtcaagatctgaatataacatctgttagaattgacaggcctgtttgtcatctgtctctacaccaggccattcctagcacatcttataattagagatctttttttttccttgaactgaacatgcagttcaggggaacagttttttggaggtgttatttaagggtcgtaaatattcataagagaaattttgcaaaatgtaattcagcaaaaagaagaaaaccaaacccagtcctacctctacactgaagaaattagttgttgctaacatgtttatgatttgcttctaatattttttaaattaatattgtgactgtactctgccaattgtttgttttaatggaaatgaaactcacataatacaaaatgaaccattttaaagcgaacaaatcagtggcatttagcatattcttaatgttttgcaactaccacctttacctagttacgaaacttcatcaccccaaaaggaaaccttgtatacattaagccaggggtccccaactcttgggtcatgggccatgggccatggcctgtaaagaaccaggctgcacagcaacagttgagtggtggataagcattaccgcctgagctccacctcctgtcagatcagcagcagcattggattctcaggagtgcaaaccgtgttgtgaactgtgagatctaggttgtgaactccttatgagaatctaatgtctaatgatctgaggtggaacagtttcatcccaaaaccacccccacccaccccatctgtggaagatgtcttccatgaaactggtcctgggtgcccaaaagtctggggaccactgaactaagcatttgttccccaccccactcttccctcagtccctggcaaccaccagtctgcattgtgtttatggatttacctattctggacatttcatagaaatggaatcatgcaatttgtggccttttgtgcctaacttctttcacataccgcagtgttttctagattcatctatattgtagcatgtatcagtacttggccaaagaatattccattgtatggctataccaaaatttgtttatccatttatccctcaatggccatttcggttgtttctacctttggctattgtgaatagtgctgctatgaatatttatttcaggcatttatttcagtacctggcttcacttcttttggatgtgtatctaggattggagttgctgaatcataccgtaattctgagtttaactttttttttttttttttttttttttgagacagagtctcactctgtcgcccaggctggtgtgcagtggcgccatctcggctcatggcaacctctgcctcctgggttcaagcgattctcctgcctcagcctcctgagtagctgggattacaggtgcgtgccaccatgcccagctaattttttgtatttttagtagagacggggtttcaccgtgttagccaagatggtctctatctcctgacctcgtgatctgccctctttggtctcccaaaatgctgggattacaggcctaagacaccgtgcccggctctgggtttaactttttaactaccaaatgatgttctacagcaaccgcataattttgcatttttattatcatataatacaagggttccattctctccacatcctcgccaaaattgttattttccctttttaaaattccaagtaagataaatttatcttactatggttttgatttgtatttccctaataacaaaagatactgatcatctttccatgtgcttgttggtcatttgaatatatcttccttggagaagtgtctattcaacttctttgccaattttttaaaaaaaaatatgaattgtgttaatagtaaaataaaactcatcacagaatttctctcaactattttaaatgtataattcaataatgttccttttctcattttttgatctgtttttctcgttgttcttgagttgtaggttctagatgtcaattccttatcagagatatgattggcaaatatttcccccatcccctgtgttgcctttttactttgttgatagtgtcctttaatgcacaaggttttaaattatgatgtagtccaatttgtctattttctgttgcccttgtttatgatgtcaaggaagtcattgccgaatccaatgtcatgaagtttttctgccattttttaaaagagttttctagttttagctcttacgtttgggccactgatccattttgggttaattattgtatatagcataaggcaggattccaacatcatggttttgcatgtaggtatccagttgtctcaacaccacttgctgaagaggctgttctctctccattgagtggtcttggcactcttgttgaaagtcacttgtccatagatatatgggtttatttctggactctagattttatgtcagtagtctatacatctattcttatgccagtagactattttgatcactgtagtatgttttgaaattgtgaggtatgattcccccagctttgttctttttcaatatcattttggctatttggggtctcttgtcattccatatgaatttgagaatccgctttttcatttctgcaaaaatgctattaggattttgattgggatttcactgaatctgtgggttaatttggggaatattgtcaccttagcaatactaaatcttttaatccatagacatgtaatatctttttatttatttaggtcttctttaatttcttgagcaaagttttatagtttttagtgtagaaagcctttacctccttgtttaagcttgttcctaggtatttcattcttttggatgttgctgtaaattgaatttttttttttaaatttacttttgggattgttcattgctgatgtatagaaacacaataggcttttctgtttatcttgtatccttcaatgttgctaaatttgtttattagctgtagtaatagttttaatggattcttgggattccaatgtatagtatgatgacatctgcaaatagaattagttgtacttcttccttcccgctttctttgcatgtcttttattaatatttctttttctttcctaatttctctggctagaacttccagtacaatgatgaacagcagtggtgaaagcgggcatccttgtcatgtttctgatcttgtggggaaaagtttttactcttctactattgagtatggtgttagctgtgggtttttttcctaactgctctttatgatgttgaataagttcccttttattgctagatttctgaattgttttatcatgaaaagatgttgaattttgtcatatggttttctttaatttagataatcatgtttttttttccattgttctattaacgtaatgtattgcattgattgattttcttatgttgggccagccttatgttcctggactaaatcccacttggccatgatgtactatccttttagtatgctattggattcaatttgttagtactttgttgaggatttttacatctgtataagcaatattaatctggtgtgtgtgtgtgttgtcttcggctatggtgttagggtaatactggcctcatagaataagttaggatgtgttctcctattctttgatttttttttttctgaaagcatttgaaagggattggtattaatgtttatttaaatgtttggtaaaattcatgagtgaactggtacaaactttttgaggaagactttgattaatgattcagtcattttacttcttatatgtccgttcatattttttatttcttcttgagtcagtttttgtgatttgtctgtttctaggcaatctgcgtaagttggcatgttttatctagattctctaatatattggcatcacttttattgctgtaaggtcagtagacatgttccctccttcatttctgatattcagtaattggagtcttttctcattttttcttagtcgtgctagctaaaggtttatcaattttgttgatcttttcaaaaaatcaatttctggttctgttgatttttttctattattcttctactctgtatttcatttatctccattctaatctttattatttccttccttttcttgttttttttttttttttttggttttagtttgctgttaattttgtagttccttaggaagtaaagttaggttgtggatttgagatctttcttcattttttttttttctttattagtgtaggtgtttgcaactatagatttcctgtgaacattgctttcattgcatctcacaaattttcttatattctgctttcattttaatttatctcaaagtattttctaatatcccttatgatttctgttttgacctatgggttaagaatatgtagttcagttttcacatatttgtgaattttctagtttttcttctattaccgatttcttgcctcactccattgtgcttgtgggatctcattcttttaaaacatattgagacttgttttgcagcctaacgtatggtctctctttaaaaaagatccctgcacgtttgagaggaatatgtagtgtggtaggtgggtaatcagaaatgccaaaattgagtggcttctttttttattaagcattcacctagtttctgcaaggttttgtttaaattccacagttccaaaaagttgattccagtttttgccagcttaacagttgcttcagtggagggaccaattcttggagctccctagtctgccatttctgtggcatcacttcctctacttactgtttttagtctgctttttataatctaacattttgccttttagtggctacattattttcctaactacctgtatgctgtgatattgaacttttggttgttgcatactttggtggtgtccagtttttttgtctcttataaaaatattgatgcaaactccagttatttcttcaggataatttcctagaagtcaaataaagtcacagagctctattaagtacctattttagccacagcactctgctaggtagtgtgaaagatgtaaaaatgatggagatgcagtctgctccttctaggagttcacagttaatgagttgaacccctataaatatcatttcaatgggaggcagaaataattccaagggtcatcataataatgaatcagtataatttgtacagagcaggattgcccacttcgacctagtttatttgagcgccagccctctggcctactgtgatggaagtatttctctcttgcagaatgttatggggaaagtaagggaaagagaagatttgctgaattgtatataccttttgtcctccttcttccagtgcagtgtcacttgtggacagggataccagctaagagcagtgaaatgcatcattgggacttatatgtcagtggtagatgacaatgactgtaatgcagcaactagaccaactgatacccaggtaagtttcctttgtccaactcagttattgactttggggaccaaggtaccaaactgcccagctgtttagacaaaattgaaatcctttcatagataagtatgtcagtagagcaaccagtagattaatttgtccagatttacctgtatgttacatttataatcaaatatcttgtgtcagttttgttcttctctggttatttgaagtatatgtagatttgcttttgattcctattggatgatgaatgttgggttttgggctcattttcttaaactcatatttctaaaatgatttcaatgtagtattcagtaactagtgtcacatgttcaggcggtgatttgctggagctaacttgtaccagctcacaagagccaattgataaattttgcaggagttttgcaaactgattattaagtataaccattactaaaaactgaaaatataaatctataattaaatgtagggtattaaaagcaaagtttataaacactcagaacttaacttatacaatgtacgtatgtgtctgtatggtggatgtactatgtaagggtgtgctgccacctatctctccccagctctgtgttcattgacatcaagttcatagcttgaaaatggccatgatgagagtatttacaccacaggaatcagcaagggctacaattcagggcttaatttattatttggttgattggttagacttaagaaagtaatggagaaaatgttaatgatgcagattaaatgtaaacgagtcttgtgtctgtagcagttacattgtgaatagaacaaaaggatgtggaaatattcttctaatatctgaaaggtatctgattcagcaaagacatcttccacatcactggtcagtgagtcaagttctggccatacatcttcatcattccactttcatcctacccttaaacataaagaaaatatcaactaacattcatgcctgaactacgctcatttggcaattacaaacataggtgggcaacaggttcaaaagttcagcaaaaatcaacaaatgtattctgtgagaatcagttggctgtatggaatttaaaatatataattgtatattttattgttatttcaaaattgctatacctcctttatatcagtaaaatttataataaataagcatatatgtacatatgtatgtgtatgtacatgcatgtaatatgtgtgtgtttgtgtacacaaaatatctataaacacacacacatcttttttctcaagaagctggtggataaccactcaccagcatactattctatatgggccttgattttggcatcatgtatgtaaagagaatacataaagagaacactcgggtttgcatagcagctttgctaattgctgaagatggcatttgaacccaggctattcccagaactcacactctgagtgaagccccatgtggctgatgtactatctccatcctgaacaccctcaatctgctgcctttcaaagtgtgttgttaatggataaagagtgttaaaaaaataaattaatatggcagtgctgttcatgttgtcatcatcgatcaattaaccaacatatgtgacttataataaaaaatatattattttattgaaatgttccaaatgatgaatgcctggaaaatgttagctatggcatctaaagcaatcatgaactgaggacttggctgctccctttcagattcaaaatatatttccctttaagttattctattatatccatttgactatgggatggctcccaccattgcagtatgtgaataattccttcactttgtaaaaagttcccggtggctttctttggaccaaaaacagaggaataggcaaagtctggagccacgtaacaaaatttcacattccacacatagattttctaaggcaaagatgtctcagtcatatttgacaccaagcctcagcacttttgcactgtgtacagcacactcaggcatttgatgaatatgtattaagtcacaggataatttttaaccactgaggctgagagtgaatatgagcaggtgtgtacttttgttcctgtttgcatatcttggaatattacctgtacgcagatgacctcagttcataacagggacttcgtctgcatgattgaggggtgttatatgaagtccaggcattggccaattgaatacaccttttatatctacatttgacattctgggattctgatgttatctttgggcaaacagggaaagcaagttcatgattagcaaattctgattaagaaattaattgaaatgtgagaacatcatttggccttcagagttttaaaacgttaacaactaatgattttaaaatgatatcctgctatttcatgacttacatgtccttttacaatattttttctctttttacacaaacggatgaataaatatggctttaaaaatcctcaagctgacccctgccctttattaaggcacccacaaaaggactaagattatatctcattttgcagttgaagacattgggactgagagatgtcatgtgacttgcccagattcacacagaaatctgaagccttagaattcttagcctttacatttttatccaccatgaccattaccttgaaagtgcattgacttgaaagtgactttgtttttttttcccccatcacgtctaggactgtgaattaccatcatgtcatcctcccccagctgccccggaaacgaggagaagcacatacagtgcaccaagaacccagtggcgatttgggtcttggaccccagtaagaaatagactgggagaaatggggagggcaggatgggggctaacattcccagacatggctatagaaagtgggctactgtccagtaagcagccattccacgtaatataactgcatgattttactccaacacccagtgctcagccacttgtgggaaaggtacccggatgagatacgtcagctgccgagatgagaatggctctgtggctgacgagagtgcctgtgctaccctgcctagaccagtggcaaaggaagaatgttctgtgacaccctgtgggcaatggaaggccttggactggagctctgtaagccagtggattatttggaattagggggaatgggggaaacattgagggctatgaggagtcagcggaggggggcgccacttggaaatgtcaatgggtaatatttcagagctggatttgtcttatgatttaaattgtgctgctccacttatgtgtagttggccaagtgtgcaaggactcttagctaaatgtttaaggaatgcacatttcaaaaaatggataaatcggtttacagtctgcttgagtgtctgtcctgttgggctgatcagaaatcccagtcttcactgagtcatattagtatgcagtaggtttgtagaggaccaaaaatgtcaggagagtgaggggagaggctcttactctgagtctagattcctcctgcatcctgtggtccctaaaaatcaagtggctcttggtttcccctgacaagaatgggaagtgggaatcctcatccagtgctgtgaacctgcctgctgtacaccaagcactatctatgggttttttttacaagtagaacttttatctttaggcagcttcttgttttctgccctgcaaaaagcccagagttcaagaaatacattagtataggtgaggagagggcataagaagaatggagattaatatctcaataaatatcataatatagagagagaaatttgagaggtgcaatgaaacagagctgtgtaaaaacccagaccttggcatttacttgttgcatggccttgagcaatgtggtttaagtccatgagtctcagtgtgctctgctcttaaagaagacggaaaagaatactactttacagggctgttgtgaggattatttgagattatgtacgtcaaatgcttagcagaaagtactactcaataaatagtagataatctcactctcatgtcttgagcttccaaacacttatccatgcatccattcatccatctgtccatccgtcagttcatcttctctaagatccatctgcctactcaccagatatttgtgaaagcttgctagagaaagagcagtgaagaatgaataataaagcccctaccttcatggagattattccaatggatgatccagtcaatgaacaaataaggaagtatgtaatatagcaagaggtactgataagtcctagaaagaggtcaagaggagaagtggaatagagaaagatgggatgtgcttttagagagggtggtcaaaaaaggcctgacattgagcaggacctgaatgaagtgagggaatgacacacatgggtatttaagtggtacagcaaaaggtgcagtaggtatgaagtccctcagatggaagtgttcttggcttgttcaggaagcatcagtaaggccagcatagctggagtgcagtgagtggcgaatggtagatgggtcaaaggggtagtcagtggccacatcataaagggtctagtagatcaatgtaaggattttgggtattattcaaatgagttggaaaatcactggaaggaaggataggatttgacttttgttgtaaagggttatattttgtgattttgaatactgagctgacagatttctcactgaaatggatatgggatgggaaaaaaagaggagacaagggtgattccaaggtttttggcctgagcaatttgggaaagtggtgggccatttacagaaatgcacattcaggaattgtcaacccctccaccaaatgactgaccctttctctttctgaacattcaacctagtgctctgtgacctgtgggcaaggtagggcaacccggcaagtgatgtgtgtcaactacagtgaccacgtgatcgatcggagtgagtgtgaccaggattatatcccagaaactgaccaggactgttccatgtcaccatgccctcaaaggaccccagacagtggcttagctcagcaccccttccaaaatgaggactatcgtccccggagcgccagccccagccgcacccatgtgctcggtggaaaccagtggagaactggcccctggggagcagtgagtattccctgaagtttgcttgcttctctttcacttgaggttgggtttagggtaaaagagactagaaacacctttagagcatatttttttctttacaagggattgacattgtgcattttcatttgctttgagtaacttgtaatgggttaattacagcccttgatgatactgatactgcctgcgtccacctataagctgtctcgattgggtggagaaaggggatatcatggctaggtgatatgatcacatggcctcctggaggtaccgtaaataccatcaggattcatcctggaggccacaggcagctcatacctgtaggggaattaagaagacagagaaacttttctgaaagggaattcttaatgaaagtcactttcccctctactattttccagaagggtgcagtctcaaagtggcatggttgctgtgtaatttgtagtagtaggtcattgtcctggattagggggaaatactagactaggtaagatttgtgcttaggagagaagtaccctaaccttaaggttatcagcacaatctctgagggaagatgcgtaggtttgatccaatgacttacacttctaaatttggggaccttctgcaggtcccttctcctctttgagcctcagttttcttatctgtaaaatgaggataacaataattcctgctttcttgggttgctgtaagaattaaataagatgatgcagataaagtgctttgcgccccgcctgccacagagtgagaacttaataaatgtcgacagttgtctttattattatcattatcattgtccttcaaattagggaggccttgacaaatatctgatatcaaaggaaaagtatgctttggaatgttttgaagtttttactaaataattaaaaaaaaatatgctgtgcaacaccagacatgttaaatggaactgcaggagggggagggttttaaaggatcctgggtagggacgtagttaggtgtttactaattattcaggggtcttctttttaattgtttactattagtttccttctagtactgctaattctgtttaattgtttctgggctaaaaagaattagaaggaagctgtctgtttcccactgcggttatgtttcagtaaattagacgtactttctgatgaatactaattagccactgagcatttgcacccactgtctttgctggttgtgtgcagaacagctgccaagttgcccaagaccctcgctatcccatccccctctcttgctttccacttttgggcttcctttgcctagattagaagagatttcagttctgagaaagtaaaaggtgatccaaggaagtaatcaccgagtgtctcatggtttttccttgttgacaaaattcaaaactcacacatgtgtagtctaatgatagcgctaggatttaaagaaagtgttttagtgctgtgcttatttaggactacatttggggatgatgcattcctttaagattgaatgattctgcccttgggcagagctcccaattagggaggattaggtaagctttttgtggcgatgggtaataccattcttttcctcattgtgcctgttttttgtttggatattttttcccctacgttaagtgaggctgaagctggacaatgtgattttcagccctagcttgacgtgtctgacctgctcccaggaagatgaaggatgtacgtcatctttgcattgcattgcatggtacacaaactgtacatggtcttcctgccttccatggcagaaaaggcggcaaagggttataaacactggggaatgggaatcaagtttttcagtggtttctggagtaagaacttcattttataatagatttctgtatacacttgagcaaggtgtgttagcaattaggagttttgcaaaaaaaaaaaaaaaaaaaagaacagaaactgactcaagtgaaagaaaaacaaacaaagctgttcatttagccgcagtagggacagggaccagagcatcttcagggctctgtctcaggggctggcaagttttgtctgcagagggccagataataaatcttttcagctgtgtgaaccatacagtctctgtcacagctaatcagctgtgtgttgcagcacaaaagcaggcatagacaatatgtaaataagtgcacatggctctgttccaataaaaccttatttctaaaaacaggtggccgcacacatttggtctttgggctgtggcttgccaacccttgatctagatagaggggtaactaagggataatttctttagagagtttctgtcttaatgaatctcttttaagcctttgccactcttgagttattctgctgaggattcaaattcccaggaaagtccagttgcccacctctgaccacaatagggcagagtgtcttaattgatagatgaagatggcatctgccatgaggaggaatgttttcttaaaggaaattgggctgccagatgtaaggaaaaggatgttgatttgagcaggtagaaaaaaacaaatatctgtctccctttgcttctctaaaggccattctcctttattttgtccattgtggatgacaaatttcaagtacgttttactaatagattcaaagtttgttcaaataaatgtttacctaagaaaatgttgtcatttaaagaggacagggactttgttaacaaaagtccagactgaaagtctgcaacatggagaaatggaactaagaatccctgttaatcaaataatggcaaaattagacctggagaaaggttatgtacaatacttcatctgtctgtaggagtataaagacccaagcaggctcaggattcagatagctcaagaatgtgcagtgcaactgcttggcccaagctgagagctatcaccagcacttcagttggattctcggtaggaagcatccagtcactccctgggtggccagtggattgcttgaccatggatcaggtgttcatccttgcacccatcagacatattggagagagaataccatggagtttctagagctgtttcttccagaatctttaactggaccaggtagcaaatcctgtgaccagcactatggaaggtaatagggacacaggttaaaacattgagcctttcctcaaggagcctgccattttactggggcaataaagctgacaggtgacataataaaggaatgatacaagattatattatcaaggagaaaactcgaggaccaagatatagatgacaaatctatttataccatgaaaggcccttcctaacatttaaaattctggtccccaaacaaagctaattaaaataatagttctctgttttttattatgtactaagctgcttaaaagtaggaaggtaggaagtaaggccaggcatggtggctcacccctgtaatcccagcattttgggaggctaagacaggaggattgcttgaggccaagagttcgagaccagttggggcaacatagtgagaccttgtctctacgaaaaattttaaaaatttacccaggtgtggtagtgtacaccaacggtctccagctatgcaggagactgaggtgggaagattgcttgagctgagaggttgaggccgtagtaacctgtgatcgcaccactgtgttctagcctgggtgacagagcaaaaccccacctcaaaaaaaaaaaaaaaataggaaatgaatattttgagatttagagtaagtataccagaatcatcaaagatagaggtaacatttttataacttgaaaaatacctaaatattttctcaagaggaactaataaatctattatccagctctacattaaaaaagtaaacccaatataaaatgaaagtgtagatactgatttaaaaacacttataatttgaccagcatgggcagggaaattaacagtggtccagttcaattagcaacaaaatgtattcacatcttgatacggaagaagatgaccagcaagaagcaatgtttgatagagcctatcttgaaataacactgatatgagctacgattagctagaaagcaaaaatcagccttcagaacctggaactaacaacatacttgcaaatgcagtttgagtcttgataaatcgtgagaaatacattgctttgaggaccagatgattattttataggcaaactgattttacaagggtcggggtaaaggacactagcaaacattttgggtttaaaaagataaagaagttatggaaagaagaaaacacttcaggtgtaaataagtgaactatgagaggcttgtatgggaaatgaaatgaaatgcaaacataaccccatgacaaaccatgaaagagagggtgttaggctgaaagcacggccgaagagaggtttgtcatgatgaaattcaattaagttcattggggaagtaaaaaataaataaaacaagtcttactaccattagccaccgaagttcaggctgttgtaaagagagagaaaggaacattttatctgctaggaaatgatgtctaaatgacattccatgatgttttcctggagtaattgaaggagttcatacagaagcttaatttctacaactggcaattcattaggcatgtaatttgacctccgcgttgaaaggaaaatcaaatattggttctaaataggcacttgaagttttgaaaagaatttccaaattaactgtcgtgtccatcaacacctctgtacctcttagagatgcagaggggataaagacagtaagtggcctgctttggaagtcacattaggcatttatggaacccctgtagagggcctgaggcacaccagaagagaagacacatttctgccctccaggtgtgtctataggatgtgtacatgaaacagccccacagtggggaagttcttgggttttcctgattgctttttgtccttcgtggatgacttgagaatgcttttcagcacatttgtcttaacctttcaaccagctgcttctgtgtccctaagatggagattgaggtggggattaacttgtcgactgatgtgtttagtgttccagtacctgtgctggcggatcccagcggcgtgttgttgtatgtcaggatgaaaatggatacaccgcaaacgactgtgtggagagaataaaacctgatgagcaaagagcctgtgaatccggcccttgtcctcagtgggcttatggcaactggggagaggtgagagtgaactatccgtctataaatacagaggaattgtgttaaccaaactgtatttatcattcagattttattttcaaggagaagaactagctctagtagaagcttctggggtggggattaactaggaaacctgtcttcttaaattctggactattttaaagtgttcctattaccactaagagacagtttgggtacacaggtgaggaaaattaggtgagaatacagataaatactggtttaagttatttgttcacctctgatgattaaaaaatagatgcttttaaagtgattgaaaatatgtgttaaatcggtccatggaagtcttgccctcttcttcatagttttggggtgtttgtgttatgccctgttcccatggcataatgtctcccaacattccaagtcactaatgaagccagattgagtaggtgttataattcctatgaaagatgatgtatttttattgcagaagtgagtagttagctgtgttttctcaaatatggaattatttagctgctaccttttcagggttgcctgtgacgactgataggggacaactgagtattggaagctgagaaaaccgtgtcctgttctcagctctggctcttaaaagttttgtgaccttggcaaataatgtagtatctttgccaaatatttatatcctcatctgtaaataaggatagtaatagcaccaacttcttagtatttatgaccatgatatgaggtagtatctatcaaatgcgtagcacatcgcctttaatcaattaactgccactataatgtagtaataattaatgttaagaataattattaataatactgtgactaagtgggggtttgagcccttattatacatagggcctagatgcttattgttttgtgtttaattaactaagaatatatctctctattcttgaatccacagggagagcacatatttaaagtttgttgagttgttctgtcttgactataacatttatcaaataaaacacgagaaataacactttggaggtcccagtgccaagggggggaaaaagacaaatgagattgatgggcatgttagtccacatccttggctgaatgaaatcacgtgtccacatttcatggtttcagccatataacctagtagtcataggcagtcataacgggattattgttgactttcattgacagttatgtcattctggagagctttgttgaagggaaagaaaagggaatgaggctttgtgactcatgtattgtggatttcccaaaacctcctcgcaaagttctgtcctgtggggcctgtgattaagcttctgtaattggattcaagccaggagagtacacgaacttgctgggatgctttgctgtcagcacagaccagatcattccaaattctgtgggagatctggccttgacacagcagggaaaccaaatgtcagtgttgctggatttgagcgcagcagcactgtccaagaaatacaacgtgttcctgcctcagaagtttagatctagccaggagtcagaaccttatccagtgttcccaccatgctgtttattcatccaaggggaaagtcatagttgtcctcacattcagagatacagtaaaataggttagtgtcataaagggctatggagacggagtcagagaacagccaaggattggtgacagcttcttaaaatttgccagaaaatagaaccagttaagtcattgtctcctttgtttggtattgggtagtttttgtttgtctatttttgttttgttttgttttggtttggtttggtatttctcaaagaatctttgttgggaggccgaggtgggaggatcatgagctcaggagatcgagaccatcctggctaacacggtgaaaccccgtctctactaaaaatacaaaaaattagccgagtgtgatggcacacgcctgtagtcccagctactcgggaagctgagacaggagaatcacttgaacctgggaggcggaggttgcagtgagccgagatcgtgccactgcattccagcctggatgacagagcaagactccgtctcaaaaaaaaagaaaggatctttgttacttgctaacagattggacttgatcgagttaattaacctcccttcaccttaattgcttcatatataagatggggcaaataattacactcctcttgattagataatatatgcaaaagtcctcagtgcaagttaagagaaagcacttaataactaatacctgccattaaagtaggagagtcttggtctgttttacgtatcactattggtaattcaccttggttccatctgtcagaggcttaccttgcccaatgccataattgagtttggctaagaaattagggagaaaggaaatttgtcattggcctttcagacaaaataactgcagccttccttttccttcttccagtgcactaagctgtgtggtggaggcataagaacaagactggtggtctgtcagcggtccaacggtgaacggtttccagatttgagctgtgaaattcttgataaacctcccgatcgtgagcagtgtaacacacatgcttgtccacacgacgctgcatggagtactggcccttggagctcggtacggccctaactattcatgtttgttaaccaaactatctaattccaaggtattctggggcactcctctgtggcagataattgtcacacttacaagggcatcccagaaactctgctataaatagtctattattttctccatattggcacataatagaattaactttttatgatattgccaaagtgactttaaagaataagtgtacctcatacaggacctggtgccaagaagtagctgccttttcttagcctaaatacacacacacacacacacacacacacacacacacacacacacatcatacacacacacatacatagtgattttaacagacaactcaatagcacacattctttccttttctaagctgtagtagttttgactttttgggaaagatacctgcttactgaggccaaagcaatttttcttcagtgactgtaatttgcctgtgtgactcgggtacagctctgaacataatttttacaaagtctgtgcccacaaaatagactaaaatcatttaaaaatgcaaaagaccaaaaatggaacaggtgacctggtgccttttagggtgtcggaaatgttctctctcttgcacagagataggaagcccgtttgggaccattttttgctttggtcctagtcttcctttgctatctgcttagccagcagctgacatggtgagacaggtttgccactgtaaatatgatgcaaacttctggggcagctcttggcaaacagaagcatcagctgtgtcaaaacaatactttggctgagttgtgcccataagctgtggagccgttagggctgtttcatgtaaatagaggaaaaatggtcctgtaaatacattaattgcactgaagctgaatttagtattgtattaagtcatatccagaatgtttttttacccagtatggttctcagaagtcttaaccatccctgaaaccagctaaagagcagattaagtgaagtgacatggttaatacctgttgacatttctaagagtcaagggtttcaatggctggggtcgtgtctgcaggtgtaacactaactatataatcactatactttgtattaggcagaaatctagaagaatttggagcattatctccactggtactatttagctggactgttaagtattttcttccagaacttaagaaacgccactctgggtcagagagctctggtctgttgtatctctagtcagttcagtaggagcattttccctacaataatggcaccttccccagatgaacatttttgaagatcagaaataaccttagaatctcaggaacatcttctgacattcccaacttccctcatctcctattatatattatttttcgtgaaattccctcttaagctcattgtgttttcacccagttcactagaccaacagcaataccagtaccagagttatgttttagaaagtctactagctgtccacaaagtcgtagttcattaactttgacccaaaaaaaaaaaaatctcttaacccttaggaagaaacacacaaggctatttattgcatattcttgtggtttggtgaaaaaaagaaacctgcatttcccttcccagactcaattccattgatcatctcagttccattgattattctatatttacctctccaggaagaattatttgggaaaacagggggaaaaacataagtcttagagaattataaattaatttccatggtattctcttccttaaacactttctaaatacgctaaatttttttttacacaggatcactaccctcccccacagatattttaagagcataaatgtttaaattttaaaacatgaactgctaattattgtaactgaaaacataaggtttatttcatgtagttgttctccttgggcctgcacacagttctctgaaacagaggaagaaagagagagagagaaagaaattataatgctctagtatgcacagaagcaagtgcacgcatttttaaaatcattttgctgcctatatgatttcaatggtttctttataaagtgatcattattcaaatatgcgaagcctctacagtctaagagcaaggccacttctgcaaggcttttaattgtgatcttaaaaaattaaatcaaaagcattttctttaaaatatctttgtaatatattacttttcctaaatatatgagtgagagggcagtctttcagattcttactgtagagttttgattttaattgtgtgtttatttctgtggatgctttggtataatatcttagtaattccaaatgtaagcatacctcagtaattgtgttaatagccataaagccacttccatggtgcttcatcattgtaactgacggtgaaactaacaacaataaaaagtatgttggaggtgctaacatgttgctttcaacagaaagcaacttagatttattagggaccaagggtagcaattaatccttctgcctggttgctttctctctcccagtactcccatgcattagatgatgtcaagaagcaactgctgctgtgtgaattagccttctccaaggtcaaaatggagattgcctacttcaacacttgttactaaagagcagtatttaggagagaaaccccaaatcactattaatatagcttccagcatccctaaaatgaagcttctgtgaacctagggtttaagtccccatcttagatcagccattggttctggctcaagtcattgcggatttaagaatcatgatggtgagaaatatcctccagaaattcaaccttttctatcctttttaaaatgggcctttggactctttttttggtagtgtttgtttttgaaataaggttcctttttttttttgagacagagtgttgctctgttgcccaggctggagtgcagtggtgcgatctcggctcactgcaacctcctcctcccgggttcaagtgattctcatgcctcagcctcccaagtagccgggattataggtgcccaccaccacacctggctaatttttgtatttttagtagagacggggtttcgccatgttggccaggctggtttcaaactcatgacttcaggtgatccgctgccttggcctcacaaagttctgagattacagacatgagccaccatgcccagcctgaaataaggttcttaaactcacatgcctttcagttgactcctgcagtcagtcccaggaggacattaagtagtctatgcatatgtcctatgacttgaggagtaaattggaaagagacctctatactatcgaaccacagcagaaagtaggctaaaaatccagagcgttctagagaaagctaattcatctagataatcacagattaaaagtctgctaggtgataccatgtatccaagatgggtcttcggtgttcctttgtgcattgccctgtcaacctgcttgctgatcaccttggaaactgtgcttctccttaggagaaattgcttgttcgggtttttcatgacaaacctaaaaatgttctctgagccttgctttaggtgcattggaataatgcttgtcgacccaagtaatgagaatttatgagctcatgaaggaattgtgcttttgtttctgcctggctaacttatgaatttttgtctacctcattttcgtattaaagtttgcagcttctgtaggtaggaagagaaaatgtttgataccagtattttataacctcactgcttctctccctagaagaaataaagattgtaaatatcactaccatattttctaaacacagttttaagcagccacacctagaattttctgaatattttgagcagtacagatttctatgtgttatataataaagcatatttattttttcatgttatttaattttatatacaatgtttaaaaaatcagtgtttatcagcagactgtaaaggcaagtaggctctgtggattagaaatgaatgtatatgtttcttttggttttaaaaagatacattttaattttgtaaattccctccaacctgtacaacccctccctcaaatctgagtagccaagtatctagctttgtgtaattagacagcttcaagtatgtattttaaagggatactttaaaaacatatttctgagttggaaatgatgcttagatttataaacaaaaatatatgaggcttaatattttgttgggtattttttcttttctagtactgttgtcctgaattattgaatctcaactatgaaatatgcatgctccatttattgaatttgtagataatgataaattatagccagaagacaaaaaaaggtgattggaagaaatggttctgaacacataagagacagctaggtacaggaaaaagcaaacctaatgtgcacaaatttgattacactttattctgtgtgttcagataactgtaaaaggcttacagcatttgtcaattttgttatttgttcactgcaatacatttcagaaagcatttcttatgaaaggaaaataaaatactacaacaactaccttggaagtttcaagagagcctacccttttcaaaaaatacctaaatcataaaaatgacccggaggcctattgatacctcatcctcctcctgagcctcctttttgcagtataggttattatggtattcatgggtgaaaggaccaaggtaaggagggtccctgtatgagttagggtttatttttaataaggtgagaaataagataacttctccaaaggaaatgaagataacaatagctaacgtttgctgtgtgtttactgtataacaagccaaattaagcaaatacacatcacattaaccctcttgttttaacccatgagggaggtgctgttaggaacccatttgactagccgataatctacttcagtgataggaccttgtcgttagggtactgactattaatcttgttttggcagaaagaaacaacctatgttcagaatgaacttttaggttcctgtttatattccataaaggatgtgcctaaaactcaaacttcatttagcctcaacattatttagctaattatgacattgtccatttgattccagcaaaagaaaatccaaattcattcctgttattggtaaattcccataaccagcaattacaaaagcttcaaacaactgttgtttagggaatggcaaaatattcctctctttcattttacagatacatttttagccagattaacaggatgatatcaagattttgactataaggaatatcacattaaatgcatatgtattttttataaatatgatacttttactacaatgaagacatgtttaaacatattgctggcatctttagaaaataagagccacattatttggctgtatcagtatggagtataaaaaataagatagttttttgtggaacaaagtgttatgacatacgaatttacaaagtttaccttagttctgtgtagcactcatctctaatgtgttcagaacaatcaaaatacttgcctgcatctatttcactggagacaaaacttagcaggcttttaataatcttttttcagtatttacagagattgtatgcctatgaaagactgatcctgccttctgatgctattttgtggtagcttgacaggttctattttcatggatttaaaaagtccacaggttgggggagcagggttaggagtgttattggactctgaggaggagtccaggtcctctccctcactcctgttgtggagttgcccttctggaatggaaagaaatagaaactttggaatgtggagtgggaggtagaggttgagtccaagcataattggctaggagggaatcctggcgattagtgatggcagttgaggaagatttattttaatgccaggggttgggggttggggcagaataaaaaaactctgggttgtttctttaaaaaaaaaaaatcaatttttaacaaatactttctaagtgcctattgtaggccagggactgttccaggtgctaaggatacagcagtgtacaagttagagctctttgttctaagggagcaagagaaattttagtattaaatcaatactaaacaaatgtaattaaagaactgatgctttggttttcctggcagcttcgccaccaccataaaaataaaaatacaacttgctattagggtaggtaccttcatggatactgctgatgtttattcagtaagtataaattagcaattttatctttgcttttaaacgtgcaactggccagtcattttaaatgacagatgctgcctggctgatggcacagaacttttaaaaacctcctattggagaatatgcttccaatcaccattccattagaacccaaatgtgagttcagtggtctgagagccaggatgagtggagaacctaatcttctgccttctccctgctgggtccttggcctccacacaaggtggagagttgtggtctgagggtactttttccctttgttatttaatgggtaccaattaaaagatgtggaatgtgcggatctccacaccatcttctttgcttgttgctgttgttttctctaaagtgggatcattgtcatgaatggttttaacaaccataatctctctttcctgaaatttataaaatagaaaattggcagccaaggaaagcatgtccaggggtagtatggaagatgactcatgtaggctgaacccagaaatccatcactcttagcaagatctgcatcccctttctcttatgagaaagagcttatgccttggccaaaaaaatctagtagctttctgcagcgatgtaaatgttctctatttttgccttcctttatggaagccactagtcacatgtggttaatactgagcacttgaaacatggttaagtgacaaggaaactgcatttttaatgtaatttttaaattactctaaatagctacctgtcgctggtggctaccatatcggacagggcaacctcaggcaacaggacatctctaacaattaataacaaactagcaaagaaatcaataaatttataaaaataaattggggagaaaaaccgtattccacatgtaaggggttcccccataggatgcccatgcatctggtgattagcattctcttgcctttcttgtgtttcgtgcctttgttttggaaaacttcagtgggtgttccttgacagctgggcattagaaaatgcagaggacagtgaaaagatggcctatcagaaccaggggtcttgagagtagtaactccagggcttcattgtaaaagcagctgttaaaacaaactctcctctgtgaatctcagagttcaagttcatcgtggccataagttcagttaaggagaaagcatgtttatgtgttcagtgggttgaaagggcaaggcttgattgatgctttttaggagacggcaaaagtggaaaacaccaggtagccaccttgtagaagcttgaattccaggagatcattccctctttgaaggaaaagtttcaggaaggcagcttttcatattcattgaacccagtaggtgaaggttgagcagattagctttgcagggctctgtttcaaagacacatcagaagaaaccgagttgaggcaatgtctctcctccatgactgtaaatgtagtcatttaattttgcaaaacttaatgtctacagtgtcaaaaagaaaaaaacctcttattcatttacatttttactctatactgagggccccaagaaatttaaacttatgcaacaacattgactgcaaattgactgataattgccatcagttctcttcctcagtggccagatagagtgttttccccccgtttagggcaacatcctgaattaaattataatctgacagatggtctgtttttagaagcactgattaatctactatgctcactctcaggttgactatgcactaaaatgagaaatagttcaaatgattctccctaagccattttcttctgaaatatctcagacagtgaatgaattgatagcttcagttatccacaaaggagcagatttttttccccacttaatttgtcacacaatgtgtttcctcccataattatagggaggactttgattttttttttattataacaaccacttacattttggaacatttactttgtgctcagaattatgctaaacaattcacccacgtttgtctaacttaatcctctctacatgatgaagtcagcaccatcagagaagttgcttagttgatctcattgctcagtagtggtctctaggtctcactgctgggaagtggctgaaccaggatttgaacttaggattttctgaattttaagctagtggtttaagccaagatataatcccctcatctcattgtttagttgatgaaatggtaaaatgtaacatgagtggaaagggtatgtctacaatgtaggattttatgttatcccagagtgtaactattaatatttgaaatgttctgaagctaattgagccatttacaagttttgcttaggggataagcaaagaaaatcaggaatgaatataagaaaattgtctcaaaccaagtaaaagagcaagatttggggttttcagaagattttaagaaaaaagcaaccagtattaagcacatattgggtgctatctctggcatttttagtagaaatggaataacttgaggtattttctttatttagtagatatatagatagtcaggatgatagattttattagagccagtcaggtgactttacatctgttcatggtgatgaggttccttgcagaaggtaagatgctgtagcacttacaagtgaattatgaaaaatggtaaaatttactaaaatgtgatctcaccgtaactctctggttgaaataaagcatattcaatgcattggaacgtcttccaaactatttattgagctaaaattaagctataggagctgaactcttcttttagcaaagctgtcttattcattcccattggtaagacagtcaaccaccttgaaccctgttcttgcatcctcttcctctcatcacccctcattctcacaactacctctgtattccttagtccatgtggcaggtgaataataaaacagttacgcttgggaacttggtaagatgaacagagggaaatacaacagggaaaaagcagactgtgtttgcttcctttttcttagctaggacagaggaagaaatatagacagagccaacacattttaagtgaaaaacctgtttccccaatcatttatttaattgccccatacctgaatttccttctgcctaatgaaacccacagttcaaactgggtgcctctctcaaactaggcatactataaacaatgttgaaatgaatgaatgagctcagctactcaggtgctgaactccttatcacattagcccagaaatatggaagtaaagagctaactggtagaagggaatcattaaaaagaaaggcataggattatttagtgctgttgtattaataatgatgatatcctgacttagagagttgtacggtatttacataaaagagtgtccttgatttgaggaaaaaagagttttagagatgatgggatgttatgtctctaaattactctcaaatttttcagggaaagacaaaataataatagcatatagagagagagatggggggagcaaatgtggtgaaatgttggcaattggggactcaggatgaggggataagggagatctttatgatgttcttgcaatctttctataagttggaaaattttcaaaataagttactttataaaatttcttaaagaaacaaatgtattcagagtgtgttttttccttcacaaggaagtaaagagtagatctggatttatttcacaactttaaaaattctgacacattctaggaagctgtttttaatctgagatttgcactgtaatgtgataaaaaagggagtggggtgtggcagagctcagcagaaacagaatctttcctacttttttattggccttttcccatgattttctctttcctaagccttctctcctcctccctcctccccatcccacccatgcagctaaactgaaaggcctctgagaatggtgcattttttttgcttcccttttcccaggggaatctagacttttattgcatctcttcctagtaaattccagtaaatatctggccatatgcagactctgccttttcttaatcgactgctatccagtccacatccagattcctttgaaaatgaaagcattttcccaaaaatgtgtgctgtttgttttccttgagattaataaaagccccacctagcccacttacctattcctgccttggtatgtgtcctttcttggtgaaatcattatttccttctttttggttgtctttgaatcagacgtaacatatccgagccccccgcagggtgcagggtcatggacataatgtcagggaggaagttctgttcagaagaacgtgtttgttcattgtaattgggatcttcattgttgtgcatgggaattgatttcacgttgtacacggcacgttttctatagatgggggcttcctaacccttttagctggagcccctgacttcattgagcggatgttcagcaggccctttacaactcccatcaacaaagaatctctgtgtgccctgacctcaccaagtcaatttgaatcaattcagttttgagaacttgctgaaggactttctgagaaccttagtataattcaatagttctcaattgggaggtgattttagcctgcggtggacatttggcaatgtctggagacagttttggttgttacaatggggatgcaggtgctatgggcatctagtgggtagaggccaggaatgctgcttaatagtctacaatgcacagcacaaccccaacaacaaagaattggcttaccccaaatctggaaatagtgccaccattgagacatttggagcctcattcaaaagcgaaagctgaaagtcacagttgcaagtcccgcagctatctgaaagctcttctctctggagagttgaatttcccataaaatgtaggtgagattccagggagccatcaaggtcagtcaaatcgaagaaaggttttcaaggatgagctgaaaatatgagatctcaaacttgtctcaccagactgtgaatctgcaaatcaacaagcaccatcactcattttgtggggcggggttgagggttaaaagaggtggcagatattgtaaatgtgtgcagatgtgcccaactgaccaacagacattctgcatggcaactttgacaagagtaataaactaaaaacagcataaatgtgggtgggcatttctaagaaaacaagggttatatcctcatcatgttcataatgttagcattgtctgatagcactgatagttcatatatagagattcctttttaagtttatgtttcaaacagagcttcccatatcagtgatagaatatgaatatatgaataggtcagcagtatctaggaattggtcagacttgagcatcagagttgagtatataggtttctcttttgagaactcttctggaagtaggattaattctagtgagcattttacctgataatttctgattagggactaagacagcagtacataaagtgttccatggattgtgaataggtatgaagaagggtttcccaaccttggcactattcatatttggggccagataattttttgttgtagggactgtttgggacattgtagatgcttatcagcatccttgacctctacctactggatgccaatagcataccccctcggttgtgacagtgaaaaatatcttcagacattgccaaatgttccctgggaggcaatatcacccttccttttctgccaggtagttctatgaatttctcacagcagaatttctctttccatattcctatgggcattagagaggtagaacatcagcatttaccagacatatttgatactaagtccctatttgttaagtcagagaagtctgaggttataaaatcattcccttcctcctcaaagggaagtgaaatccttatattgtagagatcaccaagttttcatagtcagacatttccactttgtctgggtttttaaaaaacctatcagagaaaactatacataggggatcaccttttccaaatatgtggcattaacttggctttcctatacatgaacttctggggaagcaagtttctgcagttctacctcctcgcacctcctcttttccactctgcaaatctttgctcctctagcagatggcaaatgctatatatttcccaaccccaacccccatgccacacaaacacactcaaaatggcaggtacaactctgagatcagagggtcagaaaacattttagatgatatgtcttggtcccagaaggaaaatcaatctcaattcttttcctttaaaaaggtcattaacaatggccataaacactagtagtgactccaaagctttgagactggagaagaaatctattggtagaggaaaggcaaagaaaataaacccaagacactgtcatcaacctcagaaattttatggtgggacctacactctaatgaaacattggattttccctgcaatgttcaaactttatttgatggaagaccacagaaatatgtattaaagaacagacttatgcactggtgcccaatgtggaagagatcttggttttccataagggaagtggatgctgtctttcagaattaattggaaccttaaattaccaattggctatgtgaaaagccctttaaaattagaaattgaattttgacttttgcctaactgtaatcttaccggtaattctaggctataaattgagcacatgcaaatgttttgcctaggaaagaatccctaaaaaatgagaaatcttggccaggcatggtgactcactttgggaagcccaaggcaggtggtttgcttgagcccaggagttcgagaccagccttggcaacgtggtgaaatcccatctctaccaaaaatacaaaaattagccagtctcacaacctggtctctaaataaataaataaatagattaaaattttaaatgaaattaaaaatttttttaaaaagaaaaattgcccctaaacaaagacacaccaccaccaccaaaaagctcactgctctgaatgaatgaccttctccacttcagtagttaccaactgatggacaattaattgtcttacatttcctgatgtggcacatataggtgcccatttgcaattggccaaatggatttgactagaagtggaaaataataacaaaggccctcatttattaaacatctgatgtgagccctggccttgaccaggtcctttgtgtgcattattgccaatcctcttataatccttgcaaaataggtcttatgatgtctatcgtgcggacaggaaaactgagatttagggaagttaagaaaggttcccaataattatacagtcagtaattattggatccagacctgatggactccaaagccccatgtttttccactgcctctcttggggagctttcaaaacttctagaaacatgaattttggtttgtgatgcataaaagaaacaagcctgaatagaaaccagttcagccctcttttgctttataaaagtccctgggactgggtccttggaatctgaatgtttcccaagggtttttagccagattcctgattttgtttattttacttatcacaagtcagagatagctgaatatttgcatttctgaataggatctttttttacatttcacttagttttgaatggctttcaaagaaactcaaatttggactgggtcacccagcaacctcaggccagagctttgaaatggatcagtttccccctggacttttacagcatcctaaaatgatgagaattagtacatttgtaaggaaaggtcctactgagctaagaaaatttggtctttctggacacggcctgatcctcatatttgggtaaaaagtactctccataagagttagacttcgtggggactggctgtagagagtttgcaggagggtggctatgatttcattctatcaaattcactttacaaaatcttgggctcggtattggttttagagtcctggatatcctatacttagaaagcaaggctttttctaaatgaaagaaaacttattaaaaaaattgatcaggatcactgagacacattgttttggaacagaagagtgaatcttcagttttatgcttttagaagtttccagccaaaagaaagaaaatacctggcctggataaaacccattcttgagtattgcatttcattgtattctgtttttcatatatatatacacacacatacatttttgcacccatctgacaaaaatgtcactctaagatgacatcttcagggagaggaaacaacattatatgacacgcagggtatgtggtgggatcagtggctaagaatgcactgtcaatgtttcttgcatttacagggcagtgtagtattctgagttcctagcttctgcctcttgtcggcttcttttatatgatattctcagataatgttccctttagatgtcgcctgtgcatttagttctgtagatatgagttaaatattaaaccacaagaatatgtggctagttttggactgaatggatataagagacaggagacagcaattgttatttatttggttctaacaataaactgagcattgtgcagaatgtttacttaatctttattcttgtgagataagtggttctaggttctattggatattatttattcacttgtttcatgcattcatttggacattccataaatgtttgagtgttttttataaaccaggtaccattctaggcattttggatataggagtgaaaaaaaacacacaaaaacctttgaactcattacgcttaccttctagtggagagtggagacaagctacgaatcacaaacaaaacaaaaaagtcaaatatatattatgaaagaagacggcagttgccatagataaaaataaattagggaagaaggataggagatagcgtagaagagtaggtgagaattagattaaattaaattagagcttaattaaattaattaaaaggaggtttagggaagtctccattaagaaagtgacatttgagcaaacataggggaaaatacaaaaggaagccatgtaagtatctgggagaagagtattacaggttaaggcctgaaagcgggagtacaccaggcatctcttagtgataccaaagagactaatgtggctagaacagaggatgtgaatgataggataggaaattacagatgaaactgagggagacgaacatggaggcagactgttgggcaagtagaggaaggagggttagcctattggacggagtttttgttttcactttgagataggaagggactggcagtgaaaacgtgggtggaggcactaagcaggaacatgaatttgtttttaaaggttgactctggcttctggatttagcagagggtacaggaggaacacacatggaagtggtaagaccattgtagtaactcagatgagagaaagcattgctcagatgacagtggtcacaagggaagtggtaaggagtggtaggatttggaagaatttttgagatagtgccaaaggattagctgagagttgactacggggtgcaagagtcagaaaggggtcacaatgactcccgttttatggactggacaagtgaaaggatggagttgccaccgattaaaatggggaagcctacaggaagaacagatttgtggaggaagagcaggacttctgttttgaacatgttaagtttgagatgtgtaggcgtcatcacttcatatctctgttaaacagaattgaatatagatgtttgcagtggttaagcatcctgccaaaaataacaaagaaagatatttccagtcagaccaggtctgactgtcctaacaccgtattcatagccactacacccttctgcctcaatcttttgatttccatctgaatacatctcagagtagtgtaggaatcatttgaatttgcagaaaaccatcaaatgtaattttagcctttttcaatgccaagtcttctgtgttgtgagccatttacattttatctggttattactgctcatcccgtcctttcatagtggtacttttgagcctttttttttttttaaccaaaggaaggcaggaagaggagacaagaaaagccacaaaggacttgaataatgcatattgagagtgactgtgtgctgtccaacctcccgatagagcaatgctaaattggaggatgagcatctaatttgataatggttaaaatgacctttatccctgctgctgagatacatttctctggatacaggctcagacacgtatgcaaatcttagttctggagttggcattaatatccacccacaagtaaattaattacataagctgcttcccgaaaatgttataaaattttcaggatagtctacctgacatgctggcctgtaaagatgctcctttcacaatgagcttacagaagaagggccagacaggcagagaaagtaagactggaggaagcaactgaattaactgtgtcctggtgtcttttaaatgacttgttgacacatagatagttctttgggaagagaacaagatccaaggggcagatattggttaggtacatggatcacttctctacagaagcatttcagaaggtggctgaagctttccagctctgtcccctgactgcttttgacagtagcataagtcatgtcaagtgggtctgccccagcactgtcatctcctagcagactgacatctccaggtagccttgaactctccagtccaggccttcaatcacagtccaccttgagagtaccaagaaactttggtcactgttcctaccagtcatagctttcccaccaattacttactcagacacaacttcactcacctctggaacaaatttctcacccaccgccctccctgtcttccagacggctttcataaataatcccatggcaggcatagagtgggtccttgtattatcttcgcctctttcttgaaaaatgtgaacatcattattctgctgatgtcaggttacaaataatcacccggtaaaccttgaaagggaaaagaagtcctacaaaaacaggcaatgtgtttgggaataaggaatcaacaggctaatagagccctgttacccacatgaggggtaacactgcctggtgattattgtcatcagttccccagggtactcctggatatagccacgatagaattcaccaggtgctacatttgcagatttccttggtttttgtttctttcttgatgggaaagacaacggtaaaatatttccactcttggagaacaaaaagagccctaatttgggtttcatagcttgcataactgatttcatatactgctatatttaatgttaaaatttattttcccctctaatatgaagttgttacattgtgagatcgaaggttggggaactggagcgccctgtcccccatattcctgggggcgttggggtgggagtggaagatgtgagcccctcgttgtctccctttatttgcctggccctgccatctcccttactaagcatatgcagggccacctacttggttctcatattgacagcagccttcgactgtgctccaagagttgacatgtgaatcttggttccttttcttagacctttgtagcgttgcaaaggctggagtgttggggggcagtggggatgggaggatggcctaatgccccatccggctgggatgaccgtgactcccacatccgctttcttccttggtgttccctgccaatctcaggcgctctcagctccttttcatggtaataagtgccagggtggtcccagacataaacagccatcaggcaggccttgtcaacactggctttacgccctgaagtcacagcccttgtttcctggtaaagctttctctccatttttcctcaatattttggttgtcgctgccactgttcagagccattcttgttttgtgagaagcctgtaaaacctcccctgagtgagttcattgccaataaggagatgtgttttttgacaaaggactgtgacaactctcacagcagagcagggcgtggcagggaagtgagtgactgtggattctgtaatggttatcattgacgctgcttctgtggctcaggacatttaaagaaatggcataacaaaagacaagggagaaacgcaggagttcttgagaaaacctaagtgtaagcagggaatgatggagtagaaaagggatgtggcattcagatacagcatctttcctctccttactctggtgagaagagacaatactggtaagtaatagtctctaagagagaaaagggcactacagaaggaatcttcaacgtatataactgctctgtggattgatttctctgggaactttggaaagaaaagcactttgcccattcacagggatgagatcttgccaaagtcccacctttacctatcaatgcctctgttagaatgttagactccattagttaacaaaatttttttaaactcaccttttaaacttcgtgttaagagatattctaaaagggtccactgaatagaaataatagtagtaatgatgcaaaaaaaatgtaccatttgtatgctgtctggctgaaacacaaagagctttgcatgcattgtctcatttaattgtaacacagtgatattgggtacagttactactattctcccatcttacagagaacaaatctgagctgagagatgaagtcacttgcccctagtggcaccttggtaaaatgacaggtagggtaggattccagcccaggcctgtctgactctcaaacctttgcaacattttaaagcaaaatgaagacaagcaccctccccaccaccccagctgccatttcctgtgttggcagcacccaagcaccccttggaatttgctctttgctggtgctttggaacaagaggttgttacactcttgcttaggggtgagaaagaatcagagtgtgtggttagctgtggtttttgaacaacaccataacctagccccaggcccccattgcgacgggagccaaatagcattctgtgctagggacagaagattcttcagcctgcattttctccttccctgctgtgtgaccttgggcacaacatctctccttttctctagtcttgaatttgtaaaataaatagatggacagaataatctttgagatgccctgcagattgagcattcaagagatttttccttggtgaattgccagggggccaaaatttacaacctgcagccttcccttcttgaccgtgtaaagagcattcacccatcaatggaaatagtaatctactatgtggcatctggcaggcctcaacgagttaataaaccctgaaaaatgtccaagagaaaagtagggtagcttcagtcaaggggaaatgtggccctttatttatgggattgtatgtttgctttttatagtgtctttcttcacaggcactaaaggtgttgtgagaaaaggcattaaagtcagagctattaacattgcgtagctactctcttcgtgggagactgaggaatcaggcaactctaaaagtcttaagagacatttcctgaggtccttgctttctgttgttgccatgggtaagtagaggtgagcaactggttgtcttaaccaggccatttttccagtgtagcttaaggattaaagtggttggggtgtgtgtgtggggaggggggcggtgtgtgtgtgtcttgccctgtcaaccaggctggagtgcagtagcacagtcatagctcactaaccccaaacccctaggctcaatcaatgctcctaactcagttgcccaagcagttggaacaacagctgtgcatcaccatgcccagctaatttttcttttttttttttttttttgtagagatggggtcttgtcatgttgcccaggccagtctcaaactcctgggttcaagtgatcctcccacctctgcctcccaaaattctggcattaaagtcatgagccagagtgaccagccatgctgtatgtaaagcctaactctcctgcttcctggtgctatgaccctgggcaagtgacgtcacctctttgaccctcagtctccttatcgatacaaaaaaaatcctaatagctcctgagccaccagactgctgttggaattaaatgagagaaaccagtgttctttatcccaatatcctgctcataataagaacacaatgaaaggtagctagtatgattttcaggagttctgctcaaactgaaagagagtgctcttggggtggcctttttgaatctaaataacttgtgccaaatgagttcagtattagcaccatgagtcggattccaggtggttctttcattccggcctttacaaaaacatggcattggtttatagtacacctctgtgatggctatagttttcatatgttcattcatttccataaatatttgctgactgactacagtgtggaaagcagcaagtaaacatgtatgagttgcagctactatcttttttccatgtggtaagccccacatggttttccaggccttccactgagcaatgtttgaaactttgatcactaaatctatatccttgtgtttatggtctttcttcagtggaatagtaggtacaggctggcatctcctttgcctcccccaacagtgtgacgctcatgcagtattcacttcatttgtcactgtcattggcaaaggcagtcctgaaccttgggcatatgcgttgcatcctttctgatgacatactttccagatgagctgtgattttatgttttgttaaagttaaaaggagagtggaatcaagaagagtttgttgttgtatgaaaagatacaactgaatattttttaaatgaagtgatttagatgttattttcatagtctgtagactcacaagggaaaggccttgaatagtaattccttcagtctcctgtctcaaaacacctatctgagtaatggttagccatctgttgtcaaaaatccttagatcagaagagccttgacaacttggtaataggttctcgtatatgacatttatcttggcctttcagtgcttgttatttctcacctgctatcagccagtcctgtggttggaaatatggactagttggtcagcacccccatttcatatttcatgtatacagaatctcatcaatccagaccacttgggaatgggaatcacctagatacatagaactgtgcccagacactgtgctagggctgtccccctggcccatgcattagtccttgcatagcaggcatctgctataactcaggcagtcctggtcctcattcagtccccttctagtgctttttctaagcccctgccttttctttttttctttttccattttttttttttttttttttaagatggagtctcactcactccgtcgccaggctggagtgcagtggaggatcttgactcactgcaacctccacctcccaggttcaagcgattctccttcctcagcctcctgagtagctggaactacaggtgcatgccaccatgcccagctaatttttgtatttttagtagagatggggtttcaccatgttggctagaatggtcctgatctcttgaccttgtgatccgcctgcctcggcctcccaaagtcctgggattacaggcgtgagccaccgcacccggccgcccctgctttttctaagcccctgcatcttccagccccacccagaagcctctttctggccagatcctgtgtacatctctgacctctaccttccccttcttattccttcttggttctttatggtatctttagcaactctgtgtagaaatccatcttgttttggatgtccaggtccttggcagcctcagcaaccccagggatcccattctctttagttctccagcccttctcattcaggcagacacaccagggctgttttctggcttctcaataactaagaaaccacgttcctctgtataagtgaaaggaccaatgtggggcatccctaaaaccagagacagcacaccaaacccatattcgtctgcaccatatccagtgctacttcttgagagagagccctcgatagaggttaagaacagacggcccatgtcttgagtttcctttccaccagatgaattgaaatgcaaggatttcaagctcttagaccttaattagtgaaaagtgttaacacaatctctgaacaaaacaccacatttcaacatccccttcaagccacccaacagaaacaaaagcctgaatacccaggcacttgggatgctgaccttggtgctgctaagtaacaaacagagattacattgtctgggagtcttgctcaaagttgggaggaagatcattctgttacacaaagttgggttgtttcccaagaaaaaaaagtcagagtcctattggcaaagtaggaggctttttggctgtgaatttgaggaattaaatattccctagagcaagaactatcagatgtgtaaccaataaatagcacgtactaggtgacacactaaatttgacgattatgtctcagtgacacatggtgatgtaaaagtcagtgcctgagaaaggactggaaatgatctgatggaaatttccctcagaatgtaagagctgaaacttgtgtttatttgattatcaaaatgatagcccctctatcaggtcatagtaggcccattaataaacctgttagatttgaacatttccacgagcagctgcttttcttcattggtaagttagaaagcattaaaagaagagtatttgctatcagattagataccttgagaatttcctaattgcctttagatcttaacaatattaggcagataataagtatggcaagtgctgcattgttttttccaagtcaattccagtcaagtccccaaatttaaaaacaaaaacaaaaccctggaatgggtaggttacagctagtccagatagtgaaaagataaggcattgtatttagaagctacttcattcatcttcattccattagcaatagatgtcagttatacctcagatgaatttttatcagtgaggttggtgataatttaactatttttcactgtgctgttattgtttccaacagaaatgtattcatttgtgttgaagtcatgtgggaagcactatataaagcattgtggttatgccattctgaaaacaccaattgtctccactaatagtacctatctctattactgagtttcactgggttattgggatgattaaattagatgatgcatataaagtcttagggcagtgcctggctcataaatgtgagagagttgtaccttttccaattcttcctctacaggttgttgccaacttttaggctgtaacttctgatgaccacagtagattactaaattaatatttctaacaactctcttttcccttatatattaagagacagcttgtttggactatttgtatattgaagtgactgtccctacatatagacttgtgttaaggtcacccatgttcatttgattactctgacacaactatgtttcttcaccctagtcaagcaaattttaccacccatgattctatatcctttaagttcaactcatttcctagaaataaatatatctttgactcccaatgctgtatctcccagttttccccatctctgtaagtgttatcactatctacccaattgcccaaaccagaaacctgaaagttatccctgatactgccctttcctctccaccctagagtagatccatcatttctacttcaaaaaaatacatctttttttttttttttttttttttttttgagacggagtcttgctctttcgcccaggctggagtacagtggcgctgtcttggctcactgcaagctctgcctcccgggttcacaccattctcctgcctcagcctcccaacttcccctacctaagcattcctgagtgactttctcatttccactcacactgttttcccacttgggctctactcaggcaaagtaaatgttttgaaacaaaaatcagaccatgtcttactctgacttgaaactcttcagtgatttttcatcttgtgcagaataaaatccaaactcataattgtagctcatagctttgctgcctgaccccaggaagtacctcagtgagccctcttccaaccattccagcctgtttgtttcctagtacttacctcaatgaataatcatatatttatttttgtcatcacttaattaatgtcagcttccctcactggtctgtaagctccatgaagacagagacttgtcaattttgtttatcgctacatttctagtactttgcataatttctggaacattgtaggtgctctataaatgtttgtcgaataaataaatgaattcattccaaatctaattgaacccttatattattttcttttcagagaaatgttttaaaatattaaaattggtcactattaatagggattatctgtgtgcaagtcatcagcatacttctagagatttgtggagatacttctaggaacttcattctaaaagccttctagaattatatcgcaaagtctttatatagatcaaacactacaggttgaatgatgaatatttttgttttggtatagatatttcaagttggatggcttccttccatcctgtatactccattaagattttcagaatgactactccaaatcataatattcataagattagagctcaaatgaaaacagcaatattttcacctcctaaagttaaaaaaattaaagccaaatgtattaatatacgtacttcacatttctctatgagcaactattgaactttttatagtggtttgtgtttactagaaaaacatgtctggtacatttatgaatggataactgagcatgcttggtaatagtggttgagttaatatgtttcatgagttacatgtttcacatggtgctatttattaggcataaaagggcatgttggtaatttaacaaaatcacaaagttagtgggggaaataaatattgaatagaaggaaatgacacttgaaatctgttttcattgcgttttcacattttgttcttcattcttaaattcatttccctctaaaaagcaagaccattatattgggaaataatgtgtcttgaaaacccgagccagcagcttatgatctgagtggtaatgacttctgtaatcactaatgaggcaatggacattgcatatctcagcacactcactggggccagcctcttgcctgttttacaagaagctgtcatatcaaatttttgtcccgactccatgggcactttgattcctaaacctttctgagaaacctaatctgaaatcaaagtcaagtttctcagatgtggtcagacaaggtcacatttaaaacagtccagtgaatctgcagatcaaagttgaaaggtaatgcctccctcccaaaattggcacagacttacctgctagcttacctttcagtttctaacgtgcctttttcacctcttcccagtggactgggaaaacgagagcttatcctctggaaaatggttcaagagttttattcttaaatcatttaattaagaaattgaacatagttgtattttggaaatgcacctttatcccagtcagtgaatcacaggcattttgttgaagaaatatatcactatttcatagtaggacttcttaaaatcagaatttcatggtaatttcaggttcatgagctttatttttggctccaattctcaggatttacccacactcttgagtgagccaaaaatgccacacaggattgctgctgtaatgctgtggacattttttttttcaatgccaccttccttccctattaagccttgagatattatccaaactggcgctgtaaaagaggggaatggtaactcttgttaggcattgtcttaacatctcaagacgcaggttttttctcaaactccgtgtaattaaaaaacaacaacaaccttgccattgctttatattgcagtgttctgtctcttgtggtcgagggcataaacaacgaaatgtttactgcatggcaaaagatggaagccatttagaaagtgattactgtaagcacctggctaagccacatgggcacagaaagtgccgaggaggaagatgccccaaatggaaagctggcgcttggagtcaggtgagcaatgcttctcctctactgactgcttccttacgtttggccacgtggctgaccccagtgtgttcacttgtgtttctatgcacggttttggttttaccgaggggagctcggggactgggaggggagaatcattacctagatagtcaggatacttactagctgtgtgacattgggctccagcctctggagctttggataatacctataattaggggtggctgtgagggtgaattctaagtggaaatagggatcagatggagcacaggtcagcccctcaatacttcactgatggcattgcattatcaccacatagaaaactactaactcagactgcactgaagctgactgtggtcacctggcagaaattgagtctcagtttatcttggaggttcttgaagaaagggctgttgacgaaagttctagaaaatacctctgcccatttgcttgcttacaaaaggtgaaggacagaagagagagttctctgttattttctagctatatgaccttgggtaatttaattttcctgagcctactacacatggctcttatgacgatttaatgcaatcatgaatgcccagcgctttgcaggggtcttcaatctagtaggctctcaagagttatattttgtttggacaagtgtgatgtgtgtatgggatggagaagggtgtgagtacccaagacactgattacagttagactccactaattctaaacatttcataagctagtcaggaactgggtgtgagtttccctattgaacttgaaacaggaaccttagaagcttctgtttaatctctaaacactggatatgtgaactaaagccgttcatatcaaatccttagagtagatctggtaactccacacttgcacattttcttagtttggttgaaggtgctaacttaaaagtaataaggctcaatttcttttaaaacattctgtatttaatgctgctccttctctccactgatctgaatcaatgaagttttactgtatttccggtgcttccatgcagtggagaatcattcagatgactccagataatcgatgggaatctaggttcaaggttggcgggctctagcatggattcttccagagcctagaatcttgattcttaaggccccaaagcagctttggtcatagcgtacattaatgtggggaggattcgagaatcctccatttcaatatgactaatggaaaattccttcagaaacctgaatgtattttcaatgccctgatctggcatcactgccctccatatcctccagtcatcattcctcagggcagtggcctcatgcctctcaaggcctttatcataatgaaacatgggggttttgtttgttttaatttaacaataaaaaaaaaatctatacccagccagagctggttcctcctttgccttccttcggggagcatattcaaggcaatatttcataccagtcatccttcttaatgtttttctaagtgatccttgtcatctgttaacttccatccctttttttttttggagctattcgattcatgtaaaagcttgcagctagcattatttaagataccacgctaattagcttgtctcttgtggactttcatgatctgttacttttttttttaatgttccttggcctctacttatctgttttatttacctctgaatattaattaagttcagagcatataaatgatgctcatgttaaaagccaatattcacaaaggataattaaaagaatcttttgctctttattggtaaacacagagtgagttttaatccagcatcatgtgatcttgatgggaagcctaaaattgcttacaaagctgaaatgattaggtttaaaccctgggggtttttgccaacataaggtaataggattatcagaatgcctccccagaataaactgcacctgttcaaaatgattgctcggaaaagtcaagtcacctttgtagaaaatgcaagtaaacacagttatataatggtctgtggccagccttataatgtcctgatttgatttgtagaaataaataagaaaagcaggcaagacaaagtactgcatgggtaaaattcaatttgggcaatttagaagtgtacctgaaaataatcagacccagtggttaatggagaaagacggtctgcatgattaaagattattggcttcctaatgatccagtggtaaacaagaatatccctaagactgtgatagtaagcaagagtaatgattgtccacttgcagcaatatttagaagattttatatctggtctttctgttttctgctggtagttacagcctagtcatcctgtcttcaaggtaggaaaaataattggtttaatttctcatcacatcgaaaggtctgatgataatatgatatataggatattcggatagaaactacaatagccatgctaatctttacagtttctctgctagtattgatgttttgagatttaaagtggaatatttcacttctgtgtcttctgaaatcttgaatttgtaaagaaaatcagcttttcttgaaggaggggtggaattattcttactgaagccttaaagggtttttctctctccaaaaagattacatttcatttgtttagatatttttaatcaagagctaaggaatgcctatgaacttttacgacaaaaattagcatcaagttcttgattcagactgacaaatgtgaagactcaatattcccatgatacaaaaagcgtttcacagtaaaacttttttaacttatcctatcgctatagagtttttaaaataaagatcaaaaataaaaagaataaattatcagattagaatgaaggtaacacaccaatgcattaatcaatcatgaattcatgcaatcaagtcattcatcagttctgagatgcagatcttcttcacagttcaacacctttgtggtcaggatgggcttcacaaactatgcaatgtcatgatttccttaacagcccttgttgtctttcttagtgctacaaaatataatggtgtgttttgcaatcagtgttgtcttacattcaatgaaataagcatcaatttttaaaagatctccagtgctaatgctgaaatggaatctaccatccattcttgattaagacttttcttataattataattagagcagctgtattgtgatgtcattctgaagtgtccttcaagtgtttaatggagaaatgtggcaaatgtgtggcttgtgttctttgagaaattaaggaagccatatgcacatggtcagtgaggagaactagagttgctttagtattttgtgctttccatttattttgtttgtatttgaagcatgagcattggtattgaattgtttgaagacaggcctctcacccacaccctcactgacctgctacaaaagactgcatcatattagcaccaatttaaaaactgggatcgcaaacgcacattcgcagtagctatgctaccttgtctaagacaaattttactttgtgtttttggttttgtttttgcttgagttcgggtgattatctctgtttttttgttttatttatttatgaagtatctgcctaaaaggtttattgggaagtatcagaggtattttatgtaaaatgcttagcctagagctaagctttcaaatgggggtgattttgtaccccatgggacatttgggaatgtctagagacagttttgtcacaagttgggggggaataagggggaactagcatctggtagttacaaaccaggtatgctgctaaactttctacaatgcacacgacaacgcccccccaacacacaaaaaagaattatttaattgagaaacctcagtatactagcatatactgtatgctagtatagaaaccctagcatatagtaagtgtttagtaaaagtttgtgttattattgctattattgttacttataaaagttggtttatatagttgtttttcaaactaatcgctgctttaatgtcatcaccataatttcagcagtaatcctggaagaaagtatataaaactatttctaggttttcaagtatatattatgattccctaaatatcaaaagttcaatggagattctttctctctatggaaataagcatcaagttccccttttaagttggtgagttctgcatactagcattgcacagtggggagtagagagagatgaaacatagctcccagctcaggagttcagaatgaaaaacgtctactttgaaacctgcacgaatagactgtggtggtgggatgatggctgtggggggagcacattaatagaggccattcagatgttttcatctgcaaacgaactaaaaggtgtactgaacagaacaagaaaacttggatttacacacacatacacataccaccaccatcactgcctccggggtcacacagaggtctttctgctgctgttttattcatggggtgcctgcacaaatctctcagaattccaagcaagcctggctggctctctatgcaaactgttgcctcccttgagatagcacaggaagaaaagttgaacacagaaaactaactccgatggagtggacctcattttgagcaaagattactgtgaatgcattattcagaaaggcaggcttgtaccttgctgtgagcacttaagtcatgtagaaacttttgaatgtggtatttcaaagctggctttgcatcatgaaaatcagaagccagaatgacatatcgtataattgaactttcctgtgtcttaatttgtcttttgaaaaattatcaaacattgtaggaagtgattttttaaatgttggatacttatggctcttagtaccgtgccttcgttgaaccataagtaattttttcaattacaatagcttcaaaaagaggtttcatttatttagtagcctgaatagtcttatacattctaaaagtctttaaatgttttcatttttctttaggttattaaaacattatgagattctgcatatagttgagtcctataccaaactcaaatttgtttacaatattctttctgtatttgtatttggatatattgttccagaaacgtgctcttttatatttaagaccccaaattgaaatagtcaaaagactttttggttgttgtttattgatgatgataatgtttgaacatgtccatcatttatggggtaactctatcatgttacagtacattcttttccagtgtaatcaatgggaaatattattcatgtagctctaatgagcattaaatggccattctctatagatagggtcatcacttgtgttcaggaatcctcccattacacccaggacataatgactttaaaagtctggtttcttgtgggtcacaaactcattcaatccaattaatacaattgaacccaaacaatagtagctatgttgatccaaaatattttcttctgttcagctagctttgatgtgaacatatggttctcctctctggcatagatttatctgaaacagtatgatttctcaagttaccttctaaatatcgttacctgttttcttaaaatctgaaatggagagaaaattaccattcagcagaatacatttgggtgtgattcttgatagtaaatttccattaatagtctcaaagaaagttgaatgttgctacaggttaattggaaaataattttttcaagtttgaaaggtcatgattctattatttaagaagacttcctcttaggaatatggctttaatgtatgttaagcttattttctcaacaccagaccaaaaaatggaggctgagctatcacaaaaatttggaaataatttttaatagctaagtgtaataatataccattctttccaaatgttgcctttagtttctggctgtcaaaaccttaatcaagacaataattcttggcctggccataagtgagattatgaaacccagcaatgaggaaaccattaaaaaattaatttagaggaaagttaattgcagatttaatatggtgttttgcaagttggtcagcaaaatgtttcaacatgattaacaatatttttcaagggctgaaaacattaagcccgaggaaatggtttttcctgtcagcttttattcttcatatattcatctgaggttgtaaatagacacaaattctttagtgaattctgtggttaaaaaaatatcgccttatctccatgaataggagcaagaaaaggaagagactggagaaaataattctacttataaagtcctaaaatcttcagtggtttacttctccttgggttatatttttaatctgccaagaaattcttcttgtacaacactgtctctccagttttcatgagtctcaaatcctccaggatagaaatcatttcaagttttcatttctcatggcagcactatttccaggttgtgctaaatgattcataatgatttttattaacctcttcaatcctctaagaattacattaacttgagggattcctccaaacttgagcaccttcctcactctccagcgtggataagataagcagtgagtttccaggtttaagacatgatctaggatccctttcattgcaaattagaaagcgatgtgatagctatgaaagtcattggattaggagtgcattcccctcctctgtgaccctcgacaccccccgcccccccaaaaaataaatgagccgaagctcccacttacgttctctgtcttcttagtgctctgtgtcctgtggccgaggcgtacagcagaggcatgtgggctgtcagatcggaacacacaaaatagccagagagaccgagtgcaacccatacaccagaccggagtcggaacgcgactgccaaggcccacggtgtcccctctacacttggagggcagaggaatggcaagaagtaagtagagccacaaaggggtacctgccaggcatttcacgtgtgcgccccttgctatcctcacatctgttccctataaagccagagaagtcaccgagcacggttacaatgctggctctttcccaaaaggttcactgtcagactcgcgcattcgctccaacaagggtgggagaacttcttgtttttaagcaattcctacgtctgtctgtattcctgagtgttccaagtctggccgcctcaaaaaaaaaaaaaaaaactttaacaggctgtgggccgaatgcattcagatatctttcacagaaggagggggagatagaaggaatattttaaatacgtgtctccagatttggtcattctgtatctgtttaaatagccgcagggcagactttaggtagaacctactctgtatttttcctctttctatgactttggctgtcaggtagaagataggcattcatgtgaaaccttgattaattagtgaaagatttctaacatttaaaaaaaaaaaaaaaggatggtatctgaagaaactgctccgttgatggtccgtgcagaagtggacaggccttgctttttccctggcttcaagttaatgtttggttaaggaaaacattgtgtccatggggaaaagtttggccagggaggttttataggaggtaacctctgtttccagaacagaagattaaactgtagaaaagggggggaaagaattagaaagcaaaacaatatccactgatgttggcataaaaaacaaaatgcatgctgcttgaggtgcagagataatgaaaaataaggcaggaaattccccaccatgaagagtttttcagaacataaagaaagggtatggtttggagaacagttagactgtacccctggcactgtgctgggtactttttgttcattgcttcccttaatctttttaaccaccagacaaggtgagcattattattattatcatcatcccattttgcaggtgaaaaaactgaggttcacagaatctgtgtcatttgtccaagtgtcacatacctagcacctagcaagtggaagaagcaagacttcatgctaagcttgttctcttaaaccattaagaaatactagaactgcattctttaccccattgggattcagccgcccagccctgtcttcctcttccctcgcctcctcatggattacttccattggttgcagtaatttcttttctttaggaaactcaccctctccatctactcagtctttttcctgttttccttctttacttttttattcccaccagacagtggcagggaggaatgcctaaagcagttacatttcagattaacagctcttgagccacaccagttatttggaaccctagagactataaaattctacagacttggttcatatcctagcactgccacacattagccaagggaattagaacaaggattcttgatttctctgagccttggattatccatttgtagaatggggataaaataacttttcagagttgttctgagaaaactggaggtaatagtgttatctattatggtttggggattggcaacgtcagatatagaaggaagaggagactccctcatctctctcgctctccccctcagtgtgacctcttgattctctttttttcagacctaccatggcctgctctctccatctccctctttgtgtcacgctaaactcaaccctgctccgaggagcggaaagtaagagagtgttcagaaatgaatctaagctgactgcttgtgctttagccagcttttgaaaatgctagagccaatcacgaaaatgcacactctgtttacaattccttttgcatcccgaagaatggaaaaaccttgccacatatgcactgaggaaattcctcttctctgatcatgcacaatatgcctaaaatttacttctttgcatgtgtcgtgcagatggatcttttttaaaccttactcaaatattcctgttaaactctgtggaagaatagacggcttcaggagataacctggcctgggcctctatttaagaagcttactagagggttgccattctcacaaagagaaaagactctgtgagtaacaggaaaagcagagtctaatagtcaccctcctgggaacacgctttctcatctgccttcacccaaagtggagggtctaaggaaggaatactggggtggtgaaagtggacggaatatcataggagtatctcctatgatattcctatggtattctacaggaggcctctcattggcagagtgaggcccagggcagctggaggtggggagaagccccaccaaaagtcttcatgtttcccatacatgcaaggcctgctgacagcctgctcagaatgtccccaaagcagcaagactgagcgtgaaggacgacagtaactgggcaattaccttaattgatcaaatcaggaaaagggtggccacgcctcctgtttgcctggggtagtcctcatgtaattattaattcttcctacttttatgatcaaaagcgcccttgttcaacagtaaactgggtggtcacttgataagacagaacccttcaggctcccctaaatcacagccctcacctccgatcttgctgccaccgcctctcacatccattctttcagccaccgttttacctgatatccactgatgcaggcacacgtttccacttttctcccacacctagtgacgtcttgacctgaggtcagagagtgtgccacagggcagcctctcagcccactgaatgggatgtgcaggagccccccattacaggataccccttctttcttagcggtccctggccaccacctcagaactcttgtttgcttgagtatgcactttgccttttgcttccccttttaatagtcccctatgtggactattaaaacccaccagtttgttggcaaggtgtattgcatgcttggtccgtaggatatggcaccatcctctttttgagaaataatccaagcatctgcctagagaagcacagtttctgcaccctcaccatggccatggtcatcagggatgttctgtacagccacacaggttgtatactgcacaactttgagggatgccatttttatacaatgtgaggagcgtcccctagagttgtatagtacaatggccctaatactgaagataataaaaataataaagcttattgtttactaagctacaaactaggcactatgttgagtattttcacatgaagtgcttcatttagccctttccataactctctgatgtagtatttatatttttatcctcatttaataggggcaacttgcggcttaggtaggttaatttatcaatgatcatgcatttagtaaataatatggctggaatttgaagcccggaagcttgaacgctggcacctacactctgaatcattatcttcactaatccgatgccaaatacacctaaagtgaattattttattttcctctcaatgatttgccaagcctcttactggagagttgctatcaaagtgtattccctttactgggttgtaacacctaccccttctaaaaaggagattcttgatctagttagctatcagactttaagccatgtcaccaggcgagtcttgatgatgttggagcccctcagtggacttcctgttcattgtgaagcccattggttgttcaggggaaaggggccttcttgataccatgagagtagagcccagactttcagatatagggcagaataattggacaagagaaaagtgctctatccacacatccacatctcattttgtttacatcctagaaacaacatgttgtaggcaaaattctgttcagtgtgtggctctgaaaagttgactctgaatttctagacttcacttagctcatctgccaaatgggaattctatggcagactttgctcaagggtcacagtgaggatttggtgagatgacatgattcgacatggtgactagcacattttaggccatcccaaagtagacttctttttagtacggtggccttccgatggaggcttctggtgatgacagcagtttgactcagcctgcaccttataatgttgggcttctaatatcacccgccagcttcaggtgagtaatttgtcattgcagtggtcagttttaaccccctttaacaattataatgctcatgaggctgtttggaagaaaaaagttaaaaaagactttttaattcttttgagaattattatcacaaaggatttacttgttaatagtatcacaatctgacatataaattcacttagagcagcagaggtccttctggtcaaatttgaattgtgatcgtatggggccatgcatctgcagcattgaggaatagatctcacaggtcctgcatgtgttcttttccccctttacctggaatacactcttctcttgtagtacctcttcatcataagaccaccttcctctgaccttcacctcagtcaccctttcttatccttcaggcctcaacctagatgtcacttcctctcagaagcctttgccaatcacaccaccccactaaatctgagtcagatgctcctccactcagctctcacaacacacgcagattactgtactctggcagttaacacctggaattctcattgcctgtttttctcatctatgttatcagttatttaaggtcaggaagcttgttcaccagaatcttctctatcatttaacatggtacctacaacatcaaagatacctgttaaatgaatgaatctgtgaatgaatgaaggaaacaaaataatggatgggtggaaggaaagaagaaaggaaaggagggagaaaggaaggagggaaagatggaagcaaaaaaggaaggaaggaggaaggaagaaagggagggaggaaggaaggaaggaaggaaggaaggaaggaaggaaggaaggaaggaaaaaaacatagaacagtgcctgctaattgatggactttcatctttcactctatagaataaaggcattctaaaatgacttttagaacagtcaagcaggctggacacagtggctcacgcctataatcccagcactttgggaggccaaggagggaggatcattgagccccagagtttgagaccagcctaggcaacatagtgagactccatctctacaaaagatagaaaaaattagccgagtatggtggcatggacctgtagttccagctacctgggaggctgaagtgagaggattgcttaagctcaggaggtcaatgctgcagtgagctatcatcaggccactgcactacggcctgggcaacagagcaagaccctgtctcaaaaacattaaaaataaaaaaataaaagcacagtcaaactctgtttttcctgtaagaacagctgttttattttcttctcacaatgccatggacaagctgtgctcagatatgtctgactgttgcagaactgctcacctcgctgctgtttggtgcggtatggggacttgggccactctgatacatacttggagtctgagggcttttattaagatcagctgtagaatgatttccaagtgcatctccttaacacagaaaagttagaaatgagcagcaggtccttggtcagttgatttaaaagattttcctgaagttaacagtagggaatgaccaggttttgatgtgcgcacagagccagatacgaactctttattgctcattttattaatttattcaaccagcgtttatcaatcccttgtgaagttccaggcattaggcattagggatgctctaaaaatcccaaaccacaaataatctgctctgaaaaccccaaaatgctgtggtcattctgctcccccgcttctccacccatgccatttctcacctccagccaccgtgcatgctgagcccctcctaagaatgtcctcttcccctccttgcctggtgaactgatgtcctccatcattctcctgctcatctgctgctacctgggcccacctttgcagcatcatgggaattgccccgttgtgtttcctcttctctccctggtggcttcttactcaattacatgctctgttacaaacacaactgcttacacaactgcacaggtagccctaggtgttaaaccccaggggtcaccagtcagccagctgagctaacacatgggaacccaagttgggaatagctgccaccctgggtgtcctaacagggagagaggcagggtacgaagccatggaggctgcctcccggggccccagcatagaccttggctcattgtaaaatactgattgattgaatgaatgaatgactttaaagttacaaagtgtctccatagtattatttctgcctccttctccccaccgcacctcctaacaaatatatactatttgggagcaaaaatgtctaaattctgtatacctgactttaaaatgagctttaaagtaaggactgcttttttcgttgttgccatttaaagcaacgctagataaactgatttgtcattgctgcttctcatgacataaaaacccaggaaccctgtggttctgtgagttgccgtccatacactgtgcaacaatggtaacccagcactagagaagacaaggtctttcatccatggagaaaatcaacaaccttaaaaggtagagcctgtgactctcaagtggttttcttccccccatggttagggaattgcaccaaaagatatatctgaaagtgtaaagcaacttgattataatctttaatcaaagaaaatttctacccattgcattaaatgatccttttcagaccatcactctgtggccaacctacctggctgaataaaataccaccttcagggtttactttaggtcttcctcaccctcaaattcggagaagttcttttccccctgttaatttcagcatattttaaggcacatgtagcttgcagaacaatgggcgagctgcccgatttagtccagcactgtgattattttctttctgaattatagtgtgtgatgaaatgcaaggaggctggtggtgttacttgtgttagagatttttctaaaagccatactgaaattagagaaaaccttttggaaattaaaatgaggctaattgaactttccaactgtttttcagaacattctagatcatattccaggacaggggaaagagtcataaatcgtagagggttgagggggaagccatattacaaaaagctgatgaaacctgatagcatggactcgatttgttttctgattacccagcccccataccctagttaggatttaagattccaggagaaaacccttgccatgtgattttcagagctgctgttgactaatttaggaaacactgggcaagtcacttatttacttagtttaatttttaattttgtaaaagttatattcaaggtaaatttttccagctcccctttccaccgctggcaaaatagtctttacagtagttaaccattctttaagactgagagagaaacgcttaacaagcataaagtatttaggattcattgtatttctgctctgaactgttacttattgatgcagattaaagccttgtggattagtgaaaacaagagaggatactggaaggtttagtccaggtttagctgcgcaataattaggatcttctcagagtcacctaagtcctaattttctaaggaattactttttctatgggtggttaagtatttgcatatatctacacatcacagattaaatttttcttttcttttcttttttaacattcagtggccctctatctcacctttttaatgatgaaaaaaacactttttttctaggggaatagagaaccccaaaaccactgagctagggatgagctagggaactgggctcagccggcctcctgcactaatttgaaatgattctgctcctccatgctcacctcacagtggtttcaagttatgtttatgctccagaaaaatgaggactgactccatattctagatattgaggtttactcccaagcagcagaaattttaagtttagtttgcaagtgacaaggggctaccaggaaatgccagcatatcccttctccttcctaaaggaacagggtagctcacgaaaggcacggggcatactatatgacccagcaattccactcccaggtatatatacccaaaagaatggaaaataggtgtttaaatttgtacatgaatgttcatagcagcactatttacaatagccaaatgagaaacaacccatatgtccatcaactgaggaatggataaacaaaatgtggtatatccatacaacagaatcttattcagccttaaaaaggagtgaaatattgatacatgctgcaatatggaagaacctcgaaaacattaagggagagaagtcaggtaataaaggccacatattggatgattccatatatgtgaaatacccagaataggcaaatctgcagagacagaaagcagactggtgtttgctaggggctacaggaaggaaggaatggggagggactgctgaacgggtacaaggcttccttttgcagtgatgaaatattctggaactagatggggtgatggttgcataatattgcaaatgtactaaaggccactgaattctatacttgtgatagttaaaatggtgaattttatattttgtgtattttatcaccaaaaaaaaaaagacataggccatatcatagaagacatttctgagtgaagctgagttccaaacataaatgcctttgaggcaaggcagggataaaaggaaaggctgcccattagatgaaaaagagaggtggggtctgtagttctccgtaaagagactaaaattagacattttaaaagacagtgtgctagctgggcatgatggctgacgcctgtaatcccagaactttgggaggccaaggcaggaggatcccttaaacccaggagttcaagaccaaactgggcaacgtagtgagactcatctctacaaaaaatttaaaaataagctgagcgtggtggctcatgcctgtagtcccagctacttgggactaaaatgtaggagggaagtcgaggctatagcaaactgtgatcacatcactgcactccaacatgagcaacagagggagactttgtctcaaaaaaaaaaaaaaaggaaagaaaagaaaagacaacattctgaccacacaacaaaaatcacagttgttagataagcccgttgccaacagggtattcaatccctggcctaaattaagaaactgcagcagtccttggtacaggtttcacttagctcactggggcttcccaatgagtcttgaaatgttgggtgacacagaggctttagatacaataggctttcagtgacctttagcaacacagggcactaaggataaacttcaggggtggggtttggtgttggctaaagcaaaacaaataagaatctgtggacatagagattatcctagaatgaaacataccacttgctctgtaatcatcccttggcttatgggaataaacatagctgtcccgtctacctcacaaagagatgtgtgacctggggcaagtaacttaggctctcaaagtcccattttcttcatctggaaaacggaattacagtaattgttaaatctcactacctagctatcttctttgttgtctgcctttgctactaacatataagctcctctctgaaaacagagaatgtgccatttgtgtgcactcttgttcacccaggacccgtcacagggcctgacacctagtaggaacttagtgaatatttgcagaatgatgtggcatgagagcagttcccctggagaagaaaaggcacctggggctaaaggaaagccctcttcaaatagctgaaggagattacttgtgagagctgaaactttcctttatgctttcccggaatggaaaactaggacaagggcctggaacatacaaagagatttgtttggttccatgttatgaaatgagatggctacctgggaaggtactgatgtccctgatcctggaggtatttagacaccagcttggtaaacatttggccataagtgtcaatatcaagtcacttgtgagtaggtgtttgaagtaaataggatttaaggtcctttctaaactgagattgactcatttatactttccttccttcctttagacagctgggtggtgaatgccaggaacagagttgttaggtaactggggtaaaatgaggagttctcggccgggagtggtggctcacgcctgtaatcccagcactttgggaggccgaggtgggcagatcacgaggtcaggagatcgagatcatcctggctaatactgtgaaaccctgtctctactaaaaatacaaaaaattagcctggcgtggtggcgggcgcctgtagtcccagctactcgggaggctgaggcaggaaaacggcgtgaacccggaaggcagagcttgcagtgagccaagatcgtgccactgcactccagcctgggagacagagcaagactccatctcaaaaaaaataaaaccaaaaaaacaaaaaaacgagaagttctctggcaatccctgccctcagggctcttatgatcttaaaggctatgtagacaggtaaacacataattacagtcataggatataaggaactacggtttattcttctcttttgcttgtatttaacagtgcaccaagacctgcggcgaaggctccaggtaccgcaaggtggtgtgtgtggatgacaacaaaaacgaggtgcatggggcacgctgtgacgtgagcaagcggccggtggaccgtgaaagctgtagtttgcaaccctgcgagtatgtctggatcacaggagaatggtcagaggtaccgtcctgggaactgtaaccatcgtcagctcagccatggcctgagagtggcagagggatgagtggagggatgagtgcaggaatgtgggagacttgaggctacccgcccgatttgccactgtgaactgtgtgttttctgacaagtcctcagctttcccaagctagaattccttgtatgcaaagcgggagagatgtaagagatggtctctaagtcccttcaggtctacattctgtgattcaccttgatgtcctattggcataaagaagaaattattacaggggctgcaaactcataggatgctgtgaggtgcctgaagacagttaagtataagaaaatattgtagtgccagggatacaacaaggagagatggcaactgtgacaaactagcacatgctgtgtgaagggagcagaatctctttcactccagctgtggccatgcagaaatgtggtctagcgttaccagacctgatttttcaagagaggctaaaaatctggactagtatgtgagatttcctaacttgaaaatgggggctgaaatttttggttttaaaacattgtaaggggcaaacaaacccctttcatgaaccagatgtgttgtgcctgtttaacaaacagcttcagaggaagaaaataattttctataatatccgaagtatctcaagtaccattttttcatatatcttcctgtgcacagtgcttatctagaccctttttaatggtaataaaccagtagtaatcatagcatgattatattattttcaaacatcgtaatatgttcatatctgtatgagagatctgtagcagtcaaaccagttgtcatttgcccaaaagcatttagagattcgaaagggaggcatctggactcacagtaaaggtactgaaaattgttaggtaatatgattgctgccactgggtctcttcaaagtttgacaggcagcaatttcacatgttaatgagatgaatatttgcatttagatgatgtgtgtgttgggtgttgaattgcttcctgcactaaagctgatcccaaagtcttttctaattatctcgccctatcctttattcctgtgaattttgtccttcgaggggacatttggcagtgtctagagacagtttggttgtgacagctggggaaaggggaccctactggccagggttggaaggtggaggccagggatggggctaagaatcctatagtgcgcagggcagccctcacaatacagaattatctggcccaaatgtcagtggtgctgaggctgggaaaccctgctcgaccccaaccctgcatcttctcggtatgccctgagtagtaccgcatgcccttagagagtgaagaggagacatggttctgatctttacgacattgatttgctcttggccagccaggaacatgtggaatccaaatgagtgttcagaatagttcttgatattgggtttgaggcataggttccaacccatccagatcccaacgcagggggatctcacctttcacctggccaagattgacatcttcatcttagcttatctcttgtgtagcacttttattatgggacttgagtcatattactcctatagctttaatataaccataacccccaaaagatgaaacagggagaagattgaaaagaaaaaaggaagccttccacatttctgtaaatttgcaggtgtatcatgaattgaaaagtctgcaaatttatgggcaacaactacagggctggaaacagtatttagcacagatacagggaccacagggaaggaaacctgcaatgaggggagaggggccgaaagggactggcaccagcatcctctctagaaaagaagacatgccttctctctgggacctctattacctggaggcttctttgtgtgtttttctctgagctctactccacctgaattggcggaggcccgagctagactggcaaagaagagctctgtcagtcctgattgacacatgcattttctagcagggcctgaagtgtacagctcatgcagggagcccacagtcttattgttttgctttgctgttattttcaatttagaaaagtaatacgtgctcatgtggaaccaagcacatacaccaaggcatgcagagtctacagtatgagtttctctctgaaatggtttgaggaaaccagcagcagtcaacgttttcacaatgctgatatcagctagctgagagcatctgttcttgccagcttctttatagagatgtggaggcctctgtgtttagcctgaccatatttggggctcagttccatcagcaaatgcctgtctcccactgggcccccccccacataaatagccaggggacgacttttgctcctggtttgtaggggtcaagagtctcattccttgcccctctcaaatgcacaactttgtttaagttagtatggactgatgtcaatgcatgcaacactgggtcagacactaagattacccacagcttggacagagtttgttagccatctgcatgaaacaccccgggctggccttacactttcctggcctggcgtcaacttggccttcaaacatttgaacagcagcagccaaagaaggaagaaatgtacacagagcatttctatgtctcgagccaactggaagggaaggcctagggatgctctgcgtgcctctagctggacttgttctctcctgcctctgggatttcttcaaggagagccttttccctggaaaagttgcaggagaagaaaactatgtgactaaaagcagcaggagacattagggcagagcagacactgtggcttctcactgcccttgagaattgatgaaagctgtggtccctcaccccagaaaaagcataacacaccacatgtggcatactgttttggggtatttatcccaccctcacccaagaaccgtaagtctagagaataccggcactctaccccaagtttatgaagcacatttacaaaagatgaccagttatttgatgctgttgcctaaaaatatcatcaaaactaaattaattgtaactcagttttattttttatatagaaaatgataaaaaaaaaaacttagctaaggaggttgaaagttgggacactataacgatgtgtatttcttctgcatttctgtattggtagagtatgtttaaatgccatagacttaggataaaagagtacagatgagggcgtgatatagagcaagaggtagaaaagcagaaaggtaacatgccagtcaacatctatagcctagctgggtgtggtggcacacacctgtaatcccaactacttgggaggctgaggcatgagaatcacttgaacctgggagacggaggtttcattgagcggagatcatgtcactgcactccagcctggacaacagagtgagacacagtctcaaaaaaaaaaaaaaaaaatctatagccagggagagagataggagaaagaaattaaatggagggcaggtaggaaagccaacagcaccacggagggaaggaaaacagtcccagagtccccgttggctcagtgcttggatttcacactcaaaatgccgactcacgggtcagctgctgctgtctcctcttcccttcccaatttggtggtcatcatagctttagaaaagagcagtttgccaacctgtgcagttgggctgaagatgcaaactgaatgaatgacagctggagcacctccccctcctcctcccttcgaaacctccagaaggggtttgaggcaaccccacctgcagtgggggctgagaagatgccagtggaagcaccagatcccagaggcaccctgtagggttgcctgtctcctgtgcgctcagggcctgccacttgaaatgaataaataagctaatgaagtgggagctttctgcagcatagtcacacggtcagcgcttggtgtggaggtcaggggcctattgtgggctgcccccaggaactgctcgaacctctcctctcaatccctgtctttgcagtgctcagtgacctgtggaaaaggctacaaacaaaggcttgtctcgtgcagcgagatttacaccgggaaggagaattatgaatacagctaccaaaccaccatcaactgcccaggcacgcagccccccagtgttcacccctgttacctgagggactgccctgtctcggccacctggagagttggcaactgggggagcgtaagtagaagactgagcactcaaatctgaaagcccttggatctcaaccccgtcttaaacatgtcctgcctaacccgctctccttagtaactctacttccaggagaaaccctggagttagcaacttgaaatgggctaacagggatcaaagggacttctttctgtttaccaaagtggcttcgtgcttagaacatgggctctgaagccagacagtctggatctgaaccctggttctgccacttcccaggtgaacaaccttgggcaagttgcataacctttgtgtctcagttttctcatctgcaaaactggtagttgtgaagatgaaatgagtttacacagattgagcatccctaatccagaaatccaaaatccaaaatgctataaaatccaaacattttttagtgtcgatatgacaccataatgaaatgttccttggagcatcttgagtttcagatgctcagattaggaatatccaactagtaatactgcaagtattccaaatctgaaaaaaaaaaaatcttaaatgcaaaatactgctggtccccagcacttccaataagggatactcagcctatatataaaaagcacttaggttataatggcaaaagttttatatatattttactgcaaatttgttttaaaaaaatgcttaaaatctgatactcataagagttacagaaggagtagttattgttgcttatgttgttaagaagtctgtatgttctagtgcttctatgtaagaaatacttcattgcactgggatacaacaaggcagaatattttaaattgggactgccctggaagactgtcacagccccctggctctggaccaggcagctctcagtcttgaaaagttgtcaggcagccaggcatggtagctcacacctgtaatcccagcactttgagaggccatggtcggcggaccatgaggtcagcagatcgagaccagcctggccaacatggtgacatcctgtctctacttaaaatataatttttttattattatactttaagttctagggtacatgtatacaaagtgcaggtatgttacatatgtatacatgtgccatgttggtgtgctgcacctattaactcgtcatttatattaggtgtatctcctaatgctatccgtccccctgcccccaactccatgacaggccccggtatgtgatgttccccaccctgtgtccaagtgttctcattgttcagttcccacctatgagtgagaacatgcagtgtttggttttctgtccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattttatgaaggatttttgcatcgatgttcatcaggggatattggtctaaaattctctttttttgttgtgtctctgccaggctttggtatcagaatgatgctggcctcataaaatgtgttagggaggattccctctttttctgttgattggaatagtttcagaaggaatggtaccagctcttgtttgtacctctggtagaattcggctgtgaatctgtctggtcctggactttttttggttggtaggctattaattattgcctcaatttcagagcctgttattggtctattcagggattcaacttctttctggtttaatcttgggagggtgtatgtgtccaggaatttatccattccttctagattttctagtttatttgcatagaggtgtttatagtgttctctgatggtagtttgtatttctgtgggatcggtggtgatattccctttatcattttttattgtgtctatttgattcttctctcttttcttctttattagtcttgctagtggtctatcaattttgttgatcttttcaaaaaaccggctcctggattcattgattttttgaagggctttttgtgtctctatctccttcagttctgctctgatcttagttatttcttgccttctgctagcttttgaatgtgtttgttcttgcttctctagttctttcaattgtgatgtcagggtgtcaattttagatctttcctgctttctcttgtgggcatttagtactatatatttccctctacacactgctttaataaaatacaaaaatttgttgggcgaggtggtgcgtgcctgtagtcccagctactcgggagtctgaggcaggagaatcgcttgaacctgggaggcggagattgccgtgagctgcgattgtgccattgcactccggcctaggcaacaagagcaaaactctgtctcaaaaaaaaaaaaaaaagaaagaaagaaagaaatgaaaagtgatcaggcaaaagtgtataacgagttggaagcagttagggtttgaatcctggctccactatgaccttgaacaaattccttaaatttgagccccaatctcccacctgtaaaaataagataatggtaatactatctcataggggtactgtgaggcttaaatgaaaaaattacgtgtgtgtgtgtgtgtgtgtaaaattacacatataagtgttttatacatatatatgtttgtataaatgcatgaacatgaatatataaagcttaccacagggactggcccatagtaagtgctcagtaaatgtcagctttttgtattcagcgacacagggtctgaagtgacaccctgtacatgatgacatcagggctctgagctccacaccaccagaagcctatgcctcccacattccatagccacaccgctgactctcatttgtcttacagtgctcagtgtcttgtggtgttggagtgatgcagagatctgtgcaatgtttaaccaatgaggaccaacccagccacttatgccacactgatctgaagccagaagaacgaaaaacctgccgtaatgtctataactgtaagttggccaactgaagttatctttctttagcatgaagaacaggatatctttgttcatttgattgcctgccctttttagaaatatagaattttttctgaaggaaatcattcgctttgctaaaaagttttagtgcgaacaatgtcattcattctataggcagataattcacatctcggatcatcacaccctattttttgtgattggtgttttctaggtgagttaccccagaattgcaaggaggtaaaaagacttaaaggtgccagtgaagatggtgaatatttcctgatgattagaggaaagcttctgaaggtgaatgtcagacaccagtcattatttcaagaatgtttttagagtgagtgatcaccgctctcattacctcatttctgagccactcttcatgggttatttatggtctttcagatattctgtgcggggatgcactctgaccaccccaaagagtacgtgacactggtgcatggagactctgagaatttctccgaggtttatgggcacaggtaggagagccaggctcagaagatctcagaggcctggagatccctggaaatgcgttcccatccttaccagaacattctctgtataatttaggttacacaacccaacagaatgtccctataacgggagccggcgcgatgactgccaatgtcggaaggattacacggccgctgggttttccagttttcagaaaatcagaatagacctgaccagcatgcagataatcagtaagttagtgaggagtcctttgggaacgtgtgcgttcttctctccattcagagagcaagcatgtcttgcacattggctagcagggaggtgcgtattgcacattgcacattggctagtatggagaggaagaacattgggagcttacagtgcagtgaggatagtcctgcaggcagttttgtctcttttgttcactgctgtattccccagtgcctggaaagtggctcgcacaaggcaggtgctctctccgatttgtgatgaatgaactgaatgaatgaatgaatgaatgaagtaggtgaaagtgcatgaaagaagcaccattgaaatgtgggaggtcagggcagcattccagaaaatatgacattgaaatagagaccctaaggtcaagttagggttagccaggcacaggggtcagtgtgggggaagcagagctggtagcagaagtgttcaaggtagaataaacagcagatacaaaaccccaaagccaagaaattcatgggcaacattcaccacccccagcccagctttcgccagcacagtgtacatgcttacacagacgtaaaactaattttattcagtcgtcaatgtgcagaagaaaaatggaacacagaattaccttttctaaactagcctgtgtgtgggctgatttcatactctcgccaacactgcatctctgttggggacattaatcataggagtggttaaagacagctaaaatacctcaacatgttcccttgcataaaggaaaaacagaaataatgaataattaatttttcctcattaacattatacccataatattgcattccttttctcttgagatagattaaacgtgatttgtaccaagatactttaaatttccttgagctagaatgatgaggggtaaaggcagagggtctgcagtttctccacttaggaaaacaccccagctaagacccaagggttctacatgctgaagcaggcaaggtcccctttccttgcagaatggagcactgggatttccctctcaccaaagtgtagtgaactgtaggaagattaaggccattcctgaaagacgaggcagaaagatgaaacctgcctctggcctccagtctccctggcagacagcttttgcaggattctcgggttaactcctccctttgcatgtgcagagctcatctcaggagctacagtaggggttaacaacgtgcactttgggttagccttgtatttattggctctttaaaaaataaaaaattacaggctagccccgaacttgagaaactgctgtcaataatttcaagatgggggttctaattgcgccacattttggcaataatactgcctaggcaacaggaggacagaggaaacctcagggaatcgctcctaagtagctggaaatgctctcttcctggcttatttccccctggcctgaagcctgtgatgcaggataacaggaggttctcagccagccaattacgctacatttaagtgaggtgattcacatatttatttatgtaggaatcaattccaaagtcatttgaaaccccctttttggcttccatactgtggggagacagacattcggggctgatgaagctcggggaatgaagcttgcagaaccacaaatataatcaggaaaaagcaagtgagcatctggatccatttacccactaatatttcacattgcttctttctctcccattccctcttattcttcttcttcccttctgtctccttgttaatgtcctgttccttccttgcctttctcccactcttaccttcccctgcctttaaccccttctccaccccacagccactgacttacagtttgcaaggacaagcgaaggacatcccgtcccttttgccacagccggggattgctacagcgctgccaagtgcccacaggtatgtccttggtgccttcccccttgccagggattcacctcccacctttcccgggaacatcctcagttgcatctgttcctgggaatgtgattagaacagttgctctagagggcagtttggccacatgtatcaagaccctctcaaatgctctggagtctaatctcgtaattcagctcctgaaagtgggtcctaaggaaatgatcatagctacatgcctaacttctgcattcaacaaaacacgccaacttagaaacaaattagatgtcggttagcgagggcttggttaaacaaattatggtggtaaataaaatgaatattgtacagtcagcggagtgctagtaaatatttaatgactgacacttctaaaaaaaaaaggtcctgctttgtaacatttgtcaattgccatggtgtaaatattctccctataattgatttcaagccgtcaacattatgtcactaaatggagggctaggaagaaggcagacagttgactctcaaaagccagttcaagcacgtgccaacacaccactgtcagcctttatgaatctgaatattgcatgatatagaaaaacactttacatggattagacagaaaaaacaagatgcaaaacactacatgcagtatgatcccatctgtattttcttttaatgtataaacagaaaaagtctggaaggactttttcaaaatattagttgggtgcattggtaaggtttttttttttttaatttaatgtttaactttgccgggtttcctaaatttttcagagtaagcatgaaaccaatttttaaaaaaataaataaaagttggacggggagatctcaaaattttcaagacttatctgggtttcctttggttcctgaatggtagtcagaaatggctctagaatagtcttagcaacaaaacagctgacctttctcaagtgctcactttgtgccaggcaccatcctttttactggagactcacaaacattcatcccttgagaaatctgtagcctattagagaggatgacaggttaacgaatatccatgagataataatatattctagaagtcctccgggaccaaggcttgcggctctgtggatgtcattgactcaacctgttacccctacttcagttctacaacgtctgcagtgttcggaccagaagtgcaaattcatcatcttctgttggatggcttttcagcggagccactcagcagcaatctttctgcccattctgtggttctacactttcttgcctgagagaggcgtggcaagttttagcttgtcttttgaaacattttgtcataatcagctcgggctaattttgcaaagcagacgttagtctttacaagaagcttctgcccttggaaggcaggacaaacataatgaactcagtgattctgggcaggagaacttggccagttttctcttaggtttaaaggaggtcttcacaaagctgttgttaaactctgtcaagagtttcttactttgcctgtgaaccttcaaaagtctgaagactgggattctgtgacgcgttcagaatcccaagccctgtctccataggatggatttacccccaactacagagaacgtccgaagacaaacacatctgaacgttgttttaacgaggcgttttttcggcctcaagctttagaagagcattgctaaacgttttagagaagtggagaggaagctctcaggagagaaggaaaataaacaaaggacataatggtaaaaagagcctttcttccattacccaggaatcaaaaacttttgaagtacagttttttttagggcaattgatggcttcaaaaaccccattggtatctgttgcattttagtggctaacagattggccctgtcctgcctttttcaaatgtctcaggattttcttgtttctatatgcacatcctttgggaagcttaagtaaatgaaaagtaacttgcattcatttattttaataattcagagacaaatgaactgattgatttgctaaatcctgacaatgaagcaattcctaaatgagaaaacccaaagcttgagagaggctaatttgtattttttcccagctcattcttcaaaccatattgggtactttaagaattcaattccttagacacatattgagcaccagctacactgatgcaagatgtgagtttttcaaatcagttttccaggaaaaggtttgtagaaagcatgattgtggagactgcttcggagtaggtggttcagcctttgacctagtgattgcacagaaatcaaagcagaatgatgttgtgtttgagaatttctttcttttacctcattgaccactattgctttgtggatgtatttattaataagagtggattccccgacagccctcatcttgaaacataaccagaatattttttatcctgatgacagtagatgtgacactattattattgatggtattaatagctagcatttattatgcgtctttgctttagtcactgtactcagtattgtctactcaatgtagcatttaaatcaccacagtattctatgaaaatgcctcctttttaaagaggaggagggtaaggagtagaaattgggaggatttgcccaaacctacacagctgccgctcagtagagtctggatttgaacctaagtgtgtctgaattcatatccatgatagtagacatgtctttttgattctgttttcaggcaagatttctgcaacatttgctcctgtacaacagaaaacaggattatcctttggtctaagcacatcttttgcaaacctttacggaccaactagtaaacgtataactctcaatcactcttctttagaataggcaacagaaggtggtatttacaactcatgtgccctttagaccttgaagataaggcctttaagggcaaagatgtcccagagcagagccagaaagaacattaggtctttacttctctggtggaactcaactttcagagtgctaacaatcagctaggacatttgctgaaatgcagatccctaaactggaaagggcagaaggagaatgaggaggatgatctcctgttgcatctgggttcatcaacccctctgggaaggcagacttagtagacgtatatattgagcatgttcagacactggacgcccaggtcggctgggggcattgtccagaaagaagctgggtcagccgcctggacccccggaaaacttcagtgccaaagcagatcaagtctcctttctcttgcagtacaggtgggacaggcagtctgagtggaaagcagaatggagggagaaaagagggacattcttggcactaggatggcctgggcactttgagttatgtggacccactcctgggggcaggaatgatagtaagataagaaaattttggggggagggggtggcaggtgcggtgggtcatgcctgtaatcccagcactttgggaggctgagggaggtggatcacttgaggtcaagaccagcctggccaacatggtgaaactccatctctaccaaaataaaaattagctgggcatggtggtgcacacctgtagtcctagctactcaggaggctgaggtgggaggatcaccagagcccaggagttcaaggttacagtgagctataatcctaccattgcactctagcctaggagacaaagtgactctacctctgtaaaaataataataaaaaaattaaaaagaaaatgacaaataccaaaaagaaaaccaaggcaaaggacataaggcagtttacaaaagaaatacaaatgaccaataaataggtgaaaggaaatacaatcacattagtaatcaaagaaatacaaatacatgaaatatcatagcattctctcctctaagacaagcaaacatgaagactaatgatgcccattgtcaaagagagcatggggaaatgggcatataagcacacagctggtgtcaatgcagattagtgttacttttctaacgagtagtttgacaaaacatttccaatgtttaaatatgtgagccctttgtcctaacaacggtacttttgggaattcatcccaacaggacaattaagttcccaaaagtttatatttcaggaagttatcaaaacaagacatttggaacaattctaaataagcgcttagcaataggggaattaggcaannnnnnnnnnnnnnnnnnnnggtgtgagccaccacactcagcccaaaaatattttttaaatattacctactgtctgccaggtaatgcgtgacgtgcattgtgccttctgtctaatcacctcctattcacaggttaagtcttactaatccattttacagatgatctccttgcctgaggtcatgctgaaagtaaagaagggagcaagattctagggtaaatctaccctttgtaccaggttttcaatcagcctcagcacttttcgggctggagaattctctattgtgggctgtcctgtgcatcgcagcagcatccttggtctctaccccccagatgccaacagcagcaccattccctgccccccacagttgtgacaaacaaaaatgtttccagacattgccagatttcccctggggtcaaaatcgtgccctgttgagaaccactgatttagtccaaactaagtcctctggtcacctctatcttgtggaatctagcactccagaagtgtttataaacttttgttagtcaatatttatggaactggcattgagagacctctaagctacacttagtcctggaaatcttaattgaggagctgggatataatatttaagtggctagtcgtatgttacaaaccatagctgattcaataaacaaagcaatagtaaggccctgctctcaataagcttactgttatattgaagagatcacacgaacacttacaaaacaattagaaaatgtaagacagataccatctttttgcatatctactaagcgccagccatagctgatttcttttagtcctctgtacggtgctcagagggaagagagttttagtgctttccattttacagatgaataaactgaggttccaagaggtgagaaaagatctggccaggatctaatcacaggtgaaagaatttttcttacacgcgggtctgatcagctgtgagctcctccttgcctctcttcttgtttataaaagactgttttgacaaagtgctggtttgtcagtttcagagagaaagcaatcaggagtgttcatgtggaatatttttagctctgaaactgctcattgtggagtaggaagcctcaagaagaaagtatttcagatgcctttgcgagtcatttttgaaagagagagtgagagagacaattggagaaagcagcgagagggtctttctgctgcaccgtctctttagaaatcaatattgaggcaccagaggccatgttctgaaaggcaccctcggaggggaggggtttgggagatctcccttaccggagcctgaaagccgcatcctccaggcccaggtggtcttgagcaggccaaccctgccctctgctgaccgtcctggggaaagcgcctcttctttgaagtcccgccctgctgtgcttagtacgcggtgtgctaatcgccccagggagctggaagcccaggaagcttggcaccaagatcttgttagaaaaattacactgtgacattttgttcctgaaggaatctgataattgtgagcaacatcaggactgctgtgttagggaggccgaatggagcaaggactttgaagtcaggaggatgtgagttggactcctaccgtatcctggagaagttaatcacttccgctaagcctcagtttccctatctgtaaagaaaacctccttcatagagctctttcgaggatgactaacatgatgcatgaagaatggctggccctgaacaaacaaaactaaatactatcaataattagtagctatcacaattaatcaacatccttctcttttccaaagtaccttttattgtatcacctttgcctttgcttttttggggacatcacatggactgaaaatctcttttgttggtcgtgttttccagggtcgttttagcatcaacctttatggaaccggcttgtctttaactgaatctgccagatggatatcacaagggaattatgctgtctctgacatcaagaagtcgccggtaaggttctacagatgggttgggagatgaatttttatttctttctttcgttcttgtctttattactgtggtagtggtgctgaaggagcaaacgaatgtgctttcccacttaagccattttgtagtgtcaggaagaccatttaggaaataaacctagggtgcagtgtttacacgtgattaaagtgtgagagccttgttcacttctggtgaattcttcctcgagaggtgaacatatgaaccatccaagtaattagaaaaaccacctaaccagggaggtaaaagcaggaagaagcctctgtcgagagtgtggctcagatatctttcagttagccagcttgcggttcgttctatgaaccgaggggaaatgacctcttctttttatttagaaaaattgaaatacagatggagctagaagacagataacttattaagcgatatatctggagaattagagatacacagggtctacaataataagtttttcaccctctaaaatctgggtggttaaggtgtggtctacgcagtgcatcagtgtcacctgggggcccgttggaaatgcaggttctgggtcccagaccctagtgagtcagagtctacagctgaacagtgtctcaggtggtgatgggcacagtacagcttgagaaacactgtgctgtgcagatggtccctgacttacgacggttccacttgatttttcaacttcaccatggttcaaaagcaaaacacgctcggtagaaaccctacttcaggtaccgatacagccgttctgtttttcactaagtacagtattcaatcaattacacaaaatattcaacactttattataaaataggctttgtgttagatgattttgccctgctataggctaatgcaagtgttctgaatacatttaaggtaggctagcctaggctgtgatgttcagaaagttagatatattaaatgcattcttgacttaatgatatttccaacttgcgatgtgtttattgagacataaccccattgtaaactgaggagcgtgtcgactgtgtactgtttctcaccgtgggtgtatagtagaatcacctgaggaatttttaaatgcacctgcccaggtccttcccacacagatgagctgaatcggaatctctgagggtggggggacctggcaggagtagaatttaaagctccccaaatgattcaaatgtacagccaggtcagaaaccgctgccacttacagccttccctctgaagtcctgagaacgtggggcagaaacccggctcgtggaaaaatgtctaagtttacccaggcatggcccatttctcccgtcccatctcagccaggagccctgcctggggttgcctcagaaataggggaagacaaagaagagagctgggaaagtagggttttattacaaggcagaactgccagataaaatacaggacacccagttaaattagaatttcaaatacacagtgaggatcgcctgatcctaagagttcgagaccagcctgggcaaggtggtgagaccctggttttgcaaaaactttaaaaattagctgggcatggtggtgcatgcctgtagtcccagctacttggaggttgaggtgggaggatcccttgagcccaggatgtcaagagggcagtgagccatgattgcgcgactgcactccaggctgggctgcaaagtgagacaccatctctttttttttttttttaagtacacaatgaacactgtttacaataagtgtactgttatcactacatgggacatagttatactaaacatgtatatgttgtttatctgaaattcatacttaaccaagcatcctgtatttttattttctaaatctgaaaaccctattgcaaatacttctacctaatcaaaataagactataaaaaagcagctcaacctgcctccctcacctgagaaagaggagaaacgtccaattgggacattccaggaaaatctgtttcctgatctctttttctagctgccatgattaagtttgtgtctgtgaaaaaaagctatctcactctctctcttctccatctcagccaatcaatgtcctcaaatccgattaactaaatagtcatattgattacttgtaaattagtcattaaatatttttccttgcactgaaaggaataaagatagctgagagagagtgcatgagctttagaatgtgccccgaaattataatgttctttccccattccttccctccaaaatctatacattatgtttcttttctcttgacaaataaaaatcgtatatttttatcgtgtacaacatgatgttttgaaatacactgtatgtttcagtgacccagaaccaaaaaatttgcctgtctagtgccactgcactgcagcctgggtgatagagtgaggctctgttaaaaaaataagtaaataaataaataaaaatgtgattgtaggaaacccatgtagataaactgtaacctaaattataattttattcgttagatagttactaccgtttcagccagaaactaaaaataattaaagccaggagcgccaccttatggaaagaatgatcactacactggctgttccccaagacttttgggagatgcctgggctggagggagctgggtatgacaattgcctgtcggcatttttttttttttttttttttttaaatcttggtgttccttggcagttcagagagtctgagctcaaaattaatctccagggcctgtcgagtactccttatgaatatctgggagctgggactgagccctctctagcccccggctgtctggagaaatgctgtctgacttcccccgtgtggtccagagaagcatgtcctagcaatgctacctgaaaataggcttccaccgcccaacacttttgggagaaaatgctagtatattgtatttccttcctgaagagtcacagtaagcattagcatgtgaggtgggactaaattatacaggaaataaacctgtgtgactttagccagcattccactaaagcagtggttctcaaactcaggagtgcttcaccatcacctgcagggcttgtgaaaacacaagcaggtggccagatgtagtgccttgtgcccataatcccagcacttgggaaggctgaggcaggaggattgcttgagcccaggaattcaagaccagcttgggcaacacagggagacccaatctctacaaaaaaaaaaaaaaaaaaaaaattaaataactgactgtggtggtgtgcacctgtagtcttagctactcaggaggctgaggtgaggatgagcctgggtggtcaaggctgcaatgagccattattgtaccactgtactccagcctgggcaacagagtaagacccatctcaaaacaaaacaaaacaaaacccaccacatgatcagtctgaggagaggccagaaattgacatctgtaaccatttccctggtgatgctgatgcccctgatctggagtcacattttgagaaccactaacctaaatgaagccaagcacaaaaacttcttttcgaagttacagcttgtaatttcccccaaataaccagggttccatgaaacacacttcaagaattgtgccatatcctgttcccactcgatacctactacgatctggcccccgagggcctgtggcccagtcttctctgggatgctcagaccctggccagttataatactctcttttccaaatagccctgtttcagctctcaaataatcattcctcactttcttttgcttttctgccaggagttacagaagggaaaaaaaaaaatgaaaacctcaattttccaaacctccttggcaataaaatgttttccccaagcaaaactaaaggaaagctgtattgattcaggtaaaactagatctccagtaccacttgaagaacagtaacgctgtctcacttccaagagcagaactggtcaaaatcagtctcaatatcaagttcactgttgacttccttgtgaacaatggagagcactctttctctggttttaacctaattatggttaaaatagctactatttattgggcagcttacatacattaaatctgtgtcttcctcccagctgtgctgtcaccaggagattgggataacaaggtgagaataaggtcaaattcttgggatgttaagttgagcaggtggtgggatcagcctctccaacctgccgcaactcagcccttggtgccacagtgaaaaccgtcagtggctgcagagcccagaggtgaagcacgtggactctgaaatctgactgccagagtctgtgcccactggctctgccatcttgggcaagttatttaacttccaggaaaatgggggtggggagaggggggactcagtttgttcatctataaaatggggactgtagtggcccctttctcattgacttattgtgaaacataaatgaaataaaaatgtaaagctgttggtatcctactgggcaaatagcaggagcacaagtactggctattaatgttataacgttttcatagccctgaggtttgccatattgtttcggaagttggccaaggtgactaaggaagggagctggcttgagatagctggtgggaaggacatcgaactgcagtgtaagcccgggcttagcctgtccacatggctgccacctgaccccaggaataagtcgtgtgagacaccccttggttgggggtggacttcagggcaaatgttttagctgcaccagctcagctaggggtcgtaaagtttctcctcactctgcttagatatctgcatgagggacagacagacagaaaggaggccatggcccagagatgaaggctgaaagaaaatgtcagaatttcaagctcctctgccagcaacgctgtataccctcaactctccaacgtgtgggaatgtgaaagttcccttcagccccacccagaattccaccacagctccccatgcccattctcagagctacccattttggtctcttccaggtagaagattctggaataggccttcagagacaggcagcatgaaaggatgatcacgtcctggctgggtgtgagaggcgcttacggggctttttgtcttccttgtgtgccagaggaattttcagggtcagggaagaactagggccactgttctaagagatatggtctaacagacattcctgggctagagcaagggctgtaaatcaaagaattgctttgaagttaaaaaataacgaaagttgtgttaccatagaagagatggattcagttcctatccttcaattcacttgcaaacagtggagttcaggcacctgaaataaacacacatgtgtacacacacacatgctcagtgcagcccactctcatgtttcgacctgggctgcctccgaacttgctgtcagcttatgaaaatccaactatccaccaagtgtaaaaatcataccacagaccagtagagtaaaatgctgtacatttacattttaggtagtctaatttttattctgtatattcctatagaaattagacatttatgcatatgttcatatatacataagtgtccagggctatattcagaaaaaaaaaccctatatgctgtgttttatgggcaatttcagggacattcaacgataaatttcattgcatgtaatcttgacccaggcagattttagcccctataatcattataaacagtataccataatcattataatctctgttcattactatctgtatggattttcatatcaaaatccccacctccacccccaactcagcttgcttctaccaccagcatcctctgacaactttaaataagtctttaaattagcacactccagtcaaaggtatgctggtcttcctaaatcaaagaagccaatctgccttcctcatatagattgaaaaaaatagaagaattagtgaaaagtatgaaatacaaactattcttaatggaacagagattcattcatttaattatatgtaatagctcaaaccaggctaacaaaataatcatcgaaaagagatttttagaaggcctgctttaatgaagaaataaaaattagtgttttaaggaatgtgagtgggtgcttctaatatatttcttttctgaaatagtcactgtctgcttgacaattgggtttttggtatttacttgctccgtgtggctgtttttattctttaggatcaataagttttagctcagcctttatctaaattaaataatggaatcccagttaaggagatagcaataatggtataaatccagtattggctttattttttaaattttatagttttataattacccagacttttacccatttccctgaaaacaggctatgatggatatttacacattaaaaatacctttatgataatagcagttaatattcattgagcacatatattaggccaagtactatgctaagcacattacatgcattatctcctttacagcaaacccgtgatggggtactattattatccctattttacagatgtaccaggaactgaggcgtaaagaggttgttcaagatgtagtacaagctccaggcagtctgattcaggttagctcctctgctgggtcaggagagtttgagtaaagcataagttttgatgatacagaagacattctttgtctgcctgtatcgtgaaggccctggccctatacttaagccaggtgagaaagttcttcactgaagaccagttagtctggcatcaaattcagttgctggtggtatgggccagctccagaactaccacaggcctctaaaaccaagaccaggtgggaggatagaaataactctcccaactcagttccattcatcatcaaatgcctgcgaatttttaagaattaagagaaactattttatcctattttattgttaaactggcactgtttttctttttctttctttggtatttttatcgatatatcatagttgtgcatatttttggttatactagtgatattttgattcatgtatacaatgtgtaataatcaaatcacggtaagtgggatacccaacacctcaaacatttatcttttct

SEQ ID NO: 13731 - DNA, 21309 bp, Human
  misc_feature (1)...(21309): n = A,T,C or G
ttgaactcctggcttcatgccatcctcttacctgagcttcccaaattgctgagattataggtgtgagttactgtgcccctactggactgatgcactttatcaaccacacactgtaagctctacacaaatgtaaactagtatcttcccctttccttccactagaagtgtctctgttggcatgtccaaagtctcagagtctttcaaggttaaactcagccctctgcaactctggcagcttccagatggcaggacaggcaggggacttttttttctggattcttggggcactcaccacaaaatcagtaccatgtaatgccctggcctgccctgggctgttgtaagttcttttgtctatgttcttgccaagcacctgtttgaccctctgagcagtgaagcaatagctgttttcccctcaacctctcttacccttatttctctcatttgcaaaatgggaatgatggtagctatgttggccttacccatgagtgtcttcccagtcccaccttgggcatgttgtgggcagaagtagtgctgccctagtgcagcggttctcaaagtgtgatctggagagcccctcggggatctgagacaaccttcttttctaactacatacctgtgtgaggctgggttttcttcatatagttgaatcaacacattacaacagcttgaacacagaaacagatatgagaatacagctgttttctattaagccagatattaaagcgtttgcaaaaatataaaataatgccactgttctcactatttgttttagataattaaaaaatataatgtcaacatgtaataggttattattttatgaattaataaacatttaaaacattctcagttttaatttgttttttgttgttgttgttgttgttgttttttagagacagggcctcactctgttgcccaggccggaatgcagtggctattcacaggtacaatcccactagtgatcagcagcggctcagttttaatttctaatacaataattatcaatacatataatccacacaaacaaaagctcttggaaatcctcaataattttcaagaatgtagaggtactgagacccaaagtttgagaacccctcgaggaaagaatagagttccagatctagatttttcaggtacctcatggtctaagccctctcctgtgcctcattttaactctaatacaataatactcattcttgttgccatgagtggctcttggtttcttccttttcctaatgtttagatcttgctttatgtgtgtatatagtgatggtctttggaaggatacacaattaactggtacagcggttgaggggagttcggaaactgggagaaagtggcaccataaacctttctgctctgtttgatttttaaaatacagtacatcgtgcatgtagtgcctgaattaataatgaacaattaaaagtaaaattacatttttaatgcataggaatgcatgagaaactcaagtctgctcaagtaaagtggtgttaaccgacaatgacaaacaataagaagaaagttttccttgtccgccttcaccaggctcacaaacacttagctcgcgctccctctggctcttctcccgctcgctggggttaagccactctcttcctcagccctgcccctcgtccccgcccccttcaacaacttcagccacgcccctcactgcctcgccccgccccgcggcgacgtcacctccggccgaccagcttccccaactccctctggctcccgccttcgcccgcttccggtcgtcgtcgtcgccgctgctgccgctgctgttgctcctgaggctgctggctgaggccggaggatcgagcggcggcggcggcggcggctgagagggcggcggcgggagcggagcgggacgagggaacgggaggaagcgagcgaggagcgcgcagagcgcgcttttccgtccgcctgaggagccgaagcagccccggccccgccgccgccgcctgcccgccggacaaagccgagagcccgcgcccacagccatgtcctcgtcagccggcagcggccaccagcccagccagagccgcgccatccccacccgcaccgtggccatcagcgacgccgcgcagctacctcatgactattgcaccacgcccggggggacgctcttctccaccacaccgggaggtgagcgccggccagccgtccgccgcgcccggtgtcccgccgcggtcctctaactcctcggcgcctcggtgcccggccgcttcgcccccgcccccagctccaccgaagccccggggacgctgcccttgggcccgcccgagcgttcgggaccctttacttcgtgttcgctcttgcccgcagctcgagtcggcgcgcgccccactcgggaatgtggctgtcctgtcgcgaaaaagagctcttgtttccgcttcgtggcaggcttacgcattcgacccagttctctctctcctctctgcctccttcccgggcggatttggctccacttggccttgcattacagtctgcattgcctgtcgtagattgtgcaaattaatgcttgattttggagctggctccggggctttttaaaaaagaactttgggagaggaattcggccctggcatcctgcgatggcttgtttttgctgcttttagaacaccgggaggaggctggaatgcggagtctggaagcctcgcccagcgttatcccgctttgacagcattgtttactttgctggacgaggccccacgggtgaggggagtccccaggccgggaggagagcgtgataaaataaagctcaagtaatagccaagggaaagtaggtgggggtggtagggtgctgacagccttaaggtagggtgtctttcggcagcgacgcctttggaaatggattgaaggacctttgtcaaggacaccccagttgggtggggtggttgcttgatcctgtggaaggggctagagagaggcaatccagagagagggtggttccctggcattgcttttcaaagcatgaccaggaactgtttacaaataagtaatactggggtagaggtgaagcttggtcacgggaagagagctcaaaggttgtctgtgccctaactgggctgtcctccagagggaggagcctggaaagcgattttgaggagccttattgaagggaacggggcctcctttttaacttcagaactttgtcttcttttggtgctggggtggcctcttgctagagggtggggacttcgcagctcctgcggtctagaggattgctagccttgttcctgtgggcagggctcaggagctgtactacaaccaatccgatgcagttaggcctggaccatccttaaatcagttgcacaatagcaaggcctgtggagtaaggagaccttcttgccaacaccaagggataaaatctaggagggagctttacagagaaattcagccaggccgctctgggggctgggcgggctgccttgaaaggctttttaaatgacccaggcagaagttcagtaatatatatggagagctgggtttaaggaaatgttaactttgcagaatagtggagttcttaggtggcttaactcatggaagaaatctccccccgatatgatcagttcaagaccaactcgtgtttgagcatggtacagggtctcactctgtcgcccaggctggagtacagtggcacgacctcggctcactgcactctctacttcctgggctcaagcgatcctcccacctcagcctcctgagtagctggaccacaggcacgtgccaccacgcctggctaatttttttgtattttggtagagtctgggtttctccatgttgcccaggctcgtcctgggctcaagttattcgccccgtcagcctcccaaagtgctgggattacaggcgtgagccactgcacccggccaagatcttgctttttaatcctgaaaaattttggcagaccagaatctgctccatataagagttgtcttgaacttgaactgatagcttttaagaaatagatgctgttttccgaggtgatggaaagggatttataacttcttccagaattctttgtggtattgctcagtaaatgcctgtgcttccagaagttcagaacacgtcatagtgacaactgcactcagctataatgtatttggaaagggaactaaactttcagctatatattaatcccctgagggaagagccacctagacacgtttttggcttatgtcaaatagtcaagctaccatacttttaaaaataagggcatagtctttaagcgttgcttcaaagatagaagcctgtctcatagcctggattagttcttaaagtgcttgcaaagagtctgccagaaatactaattcattacccctcctcctaacaacactcaatcactgttttctcaaatatcacttaacttcccccgacattgtttctacacacagtttcttgttttggatttaaatacttgtgatcttggctcttctttactgttgagcttgtatttattgggagagcccatcataatctttggatttatttgtttatttatttatttatttttggagacggagtttcgctctgtagcctaggctggagtgcagtggcgcgatctcggctcactgcaagctctgcctcctgggttcacgccattctcctgcctcagcctcccgagtagctggggctacaggcgtccaccaccacgcccagctaattttttgtatttttagtagagatagggtttcaccatgttagccaggatggtcttttttttttttttgttgttgatcattcttgggtgtttctcgcagagggggatttggcagggtcacaggacaatagtggagggaaggtcagcagataaacaagtgaacaaaggtctctggttttcctaggcagaggaccctgtggccttccgcagtgtttgtgtcccatgggtacttgagattagggagtggtgatgactcttaacgagcacgctgccttcaagcatctgtttaacaaagcacatcttgcaccacccttaatccattcaaccctgagtggacacagcacatgtttcagagagcacagggttgggggtaaggtcacagatcaacaggatcccaaggcagaagaatttttcgttagtacagaacaaaatgcaaaagtctcccatgtccacctctttctacacagtacacggcaaccatccgatttctcaatcttttccccacctttcccccctttctattccacaaaaccgccgttgtcatcatggcccgttctcaatgagctgttgagtacacctcccagatggggtggtggccgggcagaggggctcctcacttcccagtaggagcggccgggcagaggcgccgctcacctcccgggcggggggctgaccccccccccacctccctcccagacggggcggctggccgggcagaaggggctcctcacttcccagtgaggggcggccgggcagaggcacccctcacctcccagatggggcggcctggccgggcggggggcgtgaccccccacctccctcccggatggaggcggctggccgggcagaggggctcctcacttcccagcaggagcggccgggcagaggcgcccctcacctcccggacggggcggctggccgggcggggggctgacccccccacctccttcctggacggggcggctggccgggcagagggctcctcacttcccagtaggggcggccgggcagagcgcccctcacctcccggacggggcggctggccaggcggggggctgaccccccccacctccctcccggacggggcggctggccgggcggggggctgacccccccacctccttcctggacggggcggctggccgggcacagggtctcctcacttcccagtaggggcggccgggcagaggcgcccctcacctcccggacggggcggcttagccaggatggtcttaatcttctgacctcgtgatctgcccgcctcggcctcccaaagtgctgggagtacaggcgtcagccactgcgcctggctgtaatcagtggatttttaacatgagggcttatttaatatctttataaggacatggtgccgttgcagttggatttaatcactattacagcaatgaatactgtttaggtgttctttacttactgatttaacttccccctctgacggtttgtgtatctctaatgctacattcatcttcctctcatcatgtaattttatttccctcaaccagggtgcaatagtttgttatctggccacctccagactcctggattaatatggttaggtatcgttagtaaattttgtgtgcccaggggagtggttcgcacaaaaggggacaacagacaaaagtaggaaatacagtccttggtctgaacaggtttaaattcttgatttgggggtaggggcagacagataagatttttagttctgaaagagtagagtcaagtgctaacatatatttcagacttgaaaacatttagaaaaatgagtgataggcttgtattggaaatctctatttagtggtaagggaggggattaacatttcctgcctcaaacttctagaaatcttctggagggtcacatacatgtcagagcattccagcataacaacagttgatggaccgaatgccctaaatgatcagactgagcagggacattcacagcatagcaaacttagagtttctcccccttgaagagttctttattcattggggatcacaggagatacagcttacccttgagctttctcaaaattgtctttctgtggtttgggaagtgagaagtgggtgaaaacacacttgctgtaacctcttggatttctcatattgctggaagagtaccctttctccttatgaaggaagaggaaactttttgttgggcaaattccaggccaaaaaaaaagctcttggattttatttttttttctatctgcctgtggaggagtggggatgatatttggttcttccattgagaagctacctctgccctcaaaggaaggtaaagttactatagttggctccacttttaataacactagtgacctagaagaaacctaatgctttcattttattattgagagaaattgggacccagagaagttaagtaacttgttagtattaaacagctaattattgtccgtgagtccctcaaatttagtatcctgatcactattccagttttttcctctactgttttgagatgcttatcttactaggaaaggaagtttgcaaacatttaaagagacttttctacctctggaatgctagctaatatgattctttccgctaccttatttcctttctaggtgctgaactgcccccttttagaagagttgttttgctctgcggaatgagcagaaacagagacacctcttttaccctttctctttgcctttcttttccttcacagagttctcatcagccatggaaaagtatgctgttaccataacaagggcagcagaggggaactaactgtgatggtctgaaattttgtctgggttgtagctcttctgcctcttggatagttgatatgattggttcattgggacagaatttcataaaggtcattggatgggtttggaaaaaaggagaaagcaggaagaagggaaaataatccactgggagtgaaagtgaactataccaaaataaagagtattgggggtgaagggagctgcttttttttttctttctttctttgagacagagtttcactcttgttgcccaggctggagtgcaatggcgccatcttggctcaccgcaacctccgcctcctgggttcaagtgattctcctgcctcagcctcctgagtagctgggattacgggcgcccaccaccacgcgtggctgatttttgtatttttagtagagatggggttttaccatgttggccaggctggtctcgaactcctgacctcaagtgatccgcccacctcggcctcccagagtgctgggattgaaccaccatgcccagccctgtttcttttgttaagataaaaattgtctttgttggtttattagcacttcagagatttgatggttgtgcacagtgaatgtggtttggccaccacctgtctccctgaagaatacagagttaggcagcttttagtttcctctgggttatttgccatagagcttttcaggagtctgtctcttcatccagagtctccatgaagaacagatgtttaaaactgaagttcattcatgaatgttctataactcagtcaataaaacatagaccttgttctaccttcctaagttgaaagaataaaaagcagagaaaacactttctttgttaagtcctttctgttttttcctttcttattttcccttatgggggtgggagagagaaagacaggcttagacttcttttctgagtgcattagaagcacttgctgcttgttcatcttgtatctgtttctcatcttttggtgggcccttatgtgagacatagctggagaattgtcaagaattcctagtagaaattgaagttacatgccaaatgctttgtttctttttttaattcaatgtctaggcttgaaggataccttcctcctcgtggtccctgctgccctagcagtgttggtttgtatgtatgtatttataagatattttgtaagcatcttttttcttagttccttataatggttttttaatacactatctcttgatgttttaaacatacataacaaaaatttccattttagtcatttttaattgtacagctcagtgggattaaatatattcaccttgttttgcaaccatcaccaccatccatcttcagaacgtttttcatcttcctaaactgaaacctcataccaattaaacaataacttcccattaagcagtaccaccgcagcctccggcagctaatcatcctactttgtgtcttcatgaatttgactactctaggaatctcagttaaatggaaccacgtagtaattgtcctttcgtaaatgaacattcatcagtgttcatgctttttttcttgccattttgctttttttttttattattattacatttttttaatacctatgaaagcaacaaagttgtaaaagtcatatagtcttactggccacacaacaaaaagcaacattccgatgccccgttccttcatctccatttccactctcagagaaaccattttaaactcatttagctaatgtgcactgcagccttgacctcctgggctcagcctcctgggatcataggagtgccaccaagcacggctaatttttaaaatttttgtaaagatgatttctcaccatgtttcccaagctggtcttaaactcctgggctcagatgaccctcttgcctcagcctcccaaagtgctgtgattataggtgtgagcccctatgcccagcctatttcttagtttgggatattaattcattttctgctatggaagatgaggatttagttgttatatacacccttctcccaatgtatatacttctgtctcctatcctcttaatttaacttttttttaccctttttggtcaaactaatatgtatgtaatctttactaaattttggtaaatattgaatgcagatgtggctgacattgttggtttcctgctcaatagctattccctcttcttgcttgctgccagattccctcattttttaaatggcaaggtgctaaaccccaggatatagactgtgacagctcttaagtcagtcatagtttccccagtgtttggtctggtgggcatctgaaccagttctggacaaatgagatgtaaaggaagtctgctgatggcttctgagattttcccctccaacggagaaagtcccaggaggaaagccctgtttgacttcatgttctcctttcctgcttggaactctattttatgagggtgtgggtccatctcagcctttttggagggcttgtgggcaagttacttaatgtttcgttctccaggctgtctatttgcgtgagtaaatggttaattctaattctggaagcagacttagttaaacagaattttatgatggcggccggggggtgggggtgggggctccctgtaaaaatatagttaacaactaccctgtaagttaaccatgttatagtggactttctctgtgtggtttaatttcagcttacataatttcttaactatatagcttaatgcatggattatttatcatttaaactaaggtacttggtattgaaagaggccgttacgcttgaatgaccttgtttctatactagccatcttggcaagcataactttgggctttattcattgaccttcttgttgttttctgcagtttgagaatcactggtttttagattcaaaggtagatagggtttttcccccctctctgtcaaagggactcagttttactctcatatttccctagtaatgttaaatctagaaagtcctggatgaaagtattagatttatcctaatatctggtcactaagggatgaaaaatttataaatagctaatgttaacctagatctaaagcttcctattctgaaatccaaacatgaagactaagaaaaatatgtacattttgaaacaaagcagaaaaatgaaacttcaacaatgtaaaagagggtaaaatgccagtagacagccactttcagcagtttctgtttacagtgcttttgctggctaccattgttgctgtaaataatatatgtatactgtgatttctttaacattagacaatactgttaactccccattatgaaagatgaggaatctaagatacttttattactttctgtctcttgtttctcatcctctctccatttactaatttctgtaaattgtattatcatttttggctcctctagtagttatctttaaagctctaaataatatgtgtctcaacctgtcaactttagctctccactgtataaaagtacaccattcacctgtcctcctgcctttactttgctggtatgtaacctcattatgtttataatatcagggtttgtgggcaggcttggtggcgtacacctataatcccaacactttgtgaggccaaggcaggagaatcgcttgagcccaggagtttgagaccagtcagggcaacgtaatgagaccccatctctacaaaatataaaattagttggactgtagtcccagctacttgggaggctaaggtgggaggatcacctgagcccaggaggtcaaggttgcagtaagccgtgatcatgccactgcactcaagcctgggtgatagagcaagaccctgactctcaaaaaaaaaaaaaaaaaaaaaagaaatcagagtttgtaacatttacgtactgttccttaactgttaattcttctatgcttttactatagtttgattataaacgttgaaaatcaaacagcatatacaatattgtgattttttttcataactttccaatataagactaaggagcatgattattttcatagagaaggaatggaaaattgttttttaatttttgtaacactccatcaattgatcacaatcatgccccattttaatactgtgttatatgagctatggatttcttgtgtagtctgttttccttcttcagtagcttaaggttaacttgtttctagttacttatggctgcattggttgacattaaattgagctgacatagcgttggagggagtctgggtgaaatgtgaattgctaggaagtccttgcttcagaaaatgtacatctgtgcatgcatatgtataagaaaccttaaatattttagattttttaatagattgtcttggaattgatgtaagtttatagtaaacataatattcaataaaggaaataaagggttttttcctgccattttatccatggttgaatcttaattttttttctttgaataattttggttttttaaaaggtcagtttcttttgaattacaccctaaaatcattagtgattaacaagctgattctgtatttttgctttatacccactacaattaaattttttttagcttgcagagattactaaaattcaaaaacttataaatactatactttcatagtcatatttttcctggctatatttgagaacattacagcattaagacgctagttcttcagtgtgtcttgttgtctgaattatttactgtgttggcattcaaaatcaaacatatcttaggaatgcattaaaaaaactattagaaataataggtgagtttgccaaggttgcaagataaaagagccatatagaaaaacctgtttttggcccagcacagtggctcatgcctgtaatcctagcactttgggaggccaaggcttgcagatcacttgaggtcaggagttcgagaccagcctggccaacatggtgaaaccccatctctactaaaaatacaaaaattagctgggcatggtagcgcatacctgtaatcccagctatttgggaggctgaggcagaagaatcacttgaacccagagggtggaggttgcagtgagctgagatcacaccctgcactcccgcctgggcagcagagggaaaatccatctcaaaagcaaaaacaaagaaaactggtcacgcttgttatcccatcattttggaaggctgaggtgggcagatggcttgagcccaggagttcaagaccagcctgggcaacatggtgaaaccccgtctctacaaaaaatacaaaaattatttttttctgggtgacatgtgcctgtagtcccaactgctagggaggctgaggcaggaggaccgcttgagcccaggaggtgtaggttgcagtgagccaagattgcacttctgccctctagcttggacgacagagcaagaccctctctcgaaaaaaaaaaaaaagaaaagaaaaagaaagcaatcccatttacaatagcatgaaaacaatttgataggaataactttagtcacaaagcataaaacttttactctggaaactacaaaacattgttgaaagaaattaaagaagacccaaataagtggaaagacatttggtggccatggatcagaagacttaatattgttaagatggtagtactccacaaattgaccttcacattcagcacagtccctatcataatctcagctggcttctttgacaagctgacaaaattcatatggaactttaagggacctaaaatatccagaacaatcttgaaaaagaaaaactaagttggaggacttacactttgtggtttcaaaacttattacaagtcaagacagtggggtactagcatatggatatacatatagatcaatggaataaaattgagagtccagaaataaacccagcaataatggcccattgatcttcaacaagggtgccaagacaattctgtggaaaaagaacagttttcaacagatagtgctgatacaactggatatgcacacagaaaaactgaaggtggaccagatggctcaaagacctaaatgtcagagcaaaagctattaatgtacaacctttagaagaagacagaggcaaatctttatgaccttggattaggcagtggcctgagatatgactccaaaagcacaaacaaaagaaaaaaaaaaaaacatacattggacatcatgaaaattaagaacttttgtgcttcgaagatcatgaagaaaatgaaaagataacccacagaataggagactatatttgcagtcacataagagatttatatccagaataaagaactatcataatttagtaataaagacaaatcattgaaaaatgggtaaaggttctgaatagacagtttcttcaaaagaagatatgtggtggaatggcctgttaagtacatgaaaacagcatgttcaacataattagccatcagggaaatgcaaattaagatcaaaccacagtgagaaaccacttcatatctgctaatgttggctacaatatataaaaattagaactcttacacactgctgatgggaatgtaaaatagtacaaccactttgaaaaacaggcagttctggccgggcgcggtggctcacgcctgtaatcctaacactttgggaggccgagctgggcagatcacgaggtcaagagatcaagaccatcctagccgacatggtgaaaccctgtctctactagaaatacaaaaattagccgggcatggtagcatgcacctgtagtcccaggtactgggaggctgaggcaggagaatcgcttgaacccaggaggcggannnnnnnnnnnnnnnnnnnnnnnnnnnnnnnnnnnnnccagcctggtgacatagcgagactctgtctcaaaaaaaaaaaaaaaaaaccaggcaatttttcaaagggttaaaggtagagttaccatatgacccagtagttctaccttaattttttaattttttttttttttttttgagacagggtctcactctgtcatctaagctgagtgcagtggtgcaatcatggctcactgtaacctccatctcctgggcttaagtgatcctcccacctcagcctccccagcagctgggactataggcatgcaacaccacgcctggctaatttttgtatttttttttaagagacgggattttgccatgttgcccaggctggtcttgaacttgtgaggtcaagtaatacacgttggcctcccaaagtgctgggattacaggtgtgagccatgcctggctaattccacttttttagtttggtatatacccaagagaatggaaatgtgttcacatgaaaacttgtacgtgaatgttattcataatagacaaaaagtggaaacaacccatttatcagttgatggacttgtttttatcgacttaccagtccatcaactgataaattgataaggtgcgatatatacatacaatgaaatatttggtaatgaaaaagaaatgaagtactgataaatgctacaacataaatgaactttgaagacattatgaaagtgaaagaagcagtcacaaaagactgtattgtatgattccatttatatgaaatggccagagtaggtaaaactatatagagacagaaagtagattagtggttgcctagggtcagagggtgtggggagatcaggtggcatctaaggggttgggggaggttatgggggtaatgaaagggttctaaaattgattatggtgatgattgtacagtcctgcgaatcaactaaaactattgaattatacactgtaagtggatcaattgtaaatgaatgctatttcaataaacttgtaaaataccgtatcttatcagctctttaaggtcatagaggttcttcagagtttctcttatacctcacacatttaggcagaatctccactacctatatcctagttggtttaattgcaattctttaatgtatgcgttgttgctgatacataatttagaaagcttgcttctgtgctgtgcttttttcaccacctcatctccacaatttccaagcttgatgtactacagaagtaagaataatcttgttccagtttgcaagttgactcatctgacagtgaaacctcacccttctgaaatctcatcatgaacaaaagtggggtaactcaaacagataggcaaagtccattgttaaagctccttccctttgttcattggaaggccatcagaccccctttcagcctatttgcccttattttacatagcatgctaataagcaagttgctgatttccaaacccaccagactagaaacaccaagttagaaagggtgttaagggtgtgctatacagattgaattgtgtctccccaaaattcttatgttgaaaccttaattcccaacatgatagtattaggaggtggtgcctttgggagttaattaggctgagttgaggtcataaaggtgggaccctcatgatgggatttgtgcccttataagatggaacaccacagagttgaggcccccttacccccatgtaagggacacaaagagaaggcagctacctacaagccaggaagagagccctcaccagaaaccatccatgctggcatcttagtgttggacttctagcctccagaactatgagacaatttctgttgtttaagttgtgcagtctgtggtattttgttatggcagcctaagctgactgagtcatagtagtagcctggaaaaaaggtagctcttagtctaaggggacaagggcactgtgggggaggggtgcaccagcacaactttgaccatccgaactctgtatagtgatgttcagctgtacagagcaccaacttgatagggcttagagacttcttaggtcacaacatagtataataaacaattttcataatactgtgattcatcaagagggttgaatcattttctgttgaaggccataaagggatttaaatctgtattagaagtattttcattcaagataattgaaattgtttaccctttgaaagttgaactaagttttgtgctacccagaatgcctcgttcctcataatttctagatgcctttttgagtgctactctagtttttgtttttcaaagcaaagaggttgaaggtaagtttctactttccttgtcctaaaattatatttgatttacattttgaggcaggatcttgctctgttgcccaggctggagtgcagtggtgcagtcatagctcactgtagcctcgaactcctggactcaagctattctcctggctcaacccccgagtagtagggacttcagaccaacagcacctcacttggctctttttaaaataatttttttagagacagggtctcactatgtggcccagactagactcagactcctgggctcaagcagtcctcctgccttggactcccaaactgttggaattacaggcatgagccaccatgcccaggctctcttgtctttttgataatagccatcctaagagatgtgaagtgatatctcattgtcgttttgatttgcatttccttgatgattagtgatgtcgagcaccttttaatgtacctgttgaccatttgtaagcagcacgtttccataactgtttatcagttaaagtgtactcttcaaaactattgtttttaaaacattcaggtagcacttaactggtaagcagattgttttgtagaatagagaggggctgccagtttcagctttgactatagctgtgagaagaatgttagtctcagtccttctttggaaagcctttaaaaggggctgtttattttttctcatacttgtttattctttcatttaaaactttttttttcttaaagatgttaatgttagggcctaggtcacatataaataagacatagccctgacataagaaactcagagtctataaagagagacagatggataaacaggagtcctgtaatacatgatgtgtgtaagatggagaggaagaaccttttaaaaaagtgaggggtgggggtggcttcataaaggaagtgatggttggagctgagtcttgaaggatcaacaggagtgtccctggcagaagagaaagggcattccagatggcagaagagcctgtttacaggcagagaggttagagattatgctttcaacttgaattgtaaaatccttaaaagttaggattacatgggatttaaattaaattcctgggtggtattatatgttgataaccccttaaattgtttcaaactctttttaaccctgttttccaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggtaagagaatggcgatgttggagacctagagcgtggctcttggaatttgaatgtctgtttgctgtaggttgagaagctattgattcttcagttttgttttttgttttttgttttttttgagacacagtctcattctgtcactgaggctggagtgcagtggcacaatctcagcacactgcaacctccgcctcctgggttcaagcgtttctcctgcctcagcctcccgagtagcggggattacaggcgcctgccaccacgcctggcaaatttttgtattttttagtagagacggggtttcgccatgttgcttaggctgttcttgaactcctgacctcaggtgatccacctgcctcagcctcccaaagtgctaggattacaggtgtgagccactgtgcctggccaattcttcagttaataactaatgttcagttatatgtctctaaggtttccctcctcccccaaaggtttcttgaaatactctgaaaaccctgaattctaaatcataaatctgatgtagttggtgggagaaaagaatccagaatcaggatgataaaccccaaaaatgactctttgaaccatgccttaaggacttcctggcctaggcttcattggactaaggataacacacacagaaaacaaaacaatttcatagcccccatttccatcaccctcaggcaaatagaccttgtttcttttgttttgttttgttttttgagacggagtcttgctctgttgcccaggctggagtgcagtggcacgatctcggctcactgcaagctctggttcccgggttcacgccattctcctgcctcagcctcccaagtagctggggctacaggcgcctgccaccacgcccggctaattttttgtattttttagtagagacggggtttcaccatgttagccaggatggtctcgatctcctgacctcgtgatccgcccgcctcagcctcccaaagtgctgagattacaggtgtgagccactgcgcctggccgaccttgtttcttatatgagtttcttttatatggtgtgaggaaaagcggtatggtttatttcctctattttccagaactgcgtttaaggtttacctaaattacccctcctccaacacattctttttttctttatcactgtagaagcagaatggtgcggtaggagtggccagctcctgaaatattcctcagggactgcacttggtgacccctagatgggggccagcattccgctttgtcatatttcagatgagttttttaatggacaaagtgttagtttggagcagggccaaagtccaaagcctccagaagaatgtgctcccctgagagatggcaaagagctccccaagagctgctgtttagtcatcctgaagacaaagggacaatggggatgttttcacttgtgtccttttccccaaaacttctccccatgggtgatgggactgccattcttatttttcagattaagaccagccaaagcaaagcagagtaattgttttaaggcagcagagagtgggacaatttgaattactttttgtctctcatttagagggaatgacagttaaaactgttatgcttctttgtgtacgtgctaaactcttcattttatttgtcctaactaggggatgatgctcagttcgagatggacatctgactctcctgcaaggattagaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagttgtttttttattgagagccaccctcataccctgtaattttgtcccaaatcaaatatcaacctaccaacaactgcctggctgggaagtctggggaagggatacagagcttggtgggcctaacaccattcatattccttaccctctgtctctcctccctgtatcccacctatggttcagtgttgcaagagtctgggcttggggtctttaaaaccagcagggggaaatgataaaaagagagctgctttcccttttaccttgaggtattcgtccctcgggacagagcacagcttgtgcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctannnnnnnnnnnnnnnnnnnnnnnnatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcatccatcccctcatagttaagtagccactggtgtcctgggaatttctggttggatttggtgccctgaacttttttattaagaaatcagatcccagggtgagagtaacaggccatttggccaagaaagaaacctgtttgtttttcttttgaactatgaaaagaccctgtttgtgaatatattttagaaagagaggaaggatgtctgcagaactttgttctgttttctgccacaaaaatgtgaatagttcagagtgaaaaccttttgtgatggttgatg

SEQ ID NO: 13732 - DNA, 55851 bp, Human
  misc_feature (1)...(55851): n = A,T,C or G
ccagcctgggcgacagagcaagactccatcttggaaaaaaaaaaatgctatctctcttaagtggagtttcacaagatgtatcagaaacccttaaatagatttatatcctttacttcaatttgaaatctatgggttattcctaaagaaacaattggctagatatataaagattaatgaacaagaatgcagccttgcttataaaagtgaaatacaggaagcaaccctaatgtccagtatttaggattagttaagtcaggtgtggcctattcatataatagaatattgtgaagctattaaaattatactacctgtatttttaatttggggaaattatgatatagtgtaaatatatgatattatcatgaatttatttgatatttacagttaaatattggtgactgtctgccaaagagagtaatttttattttgtcattatgaaaattgagtcttcctttcttgtaattgaaagatactggaaccatttgtctcttgagactactcccagttttttttaagcatataaaatgatatttacctcccatttgctatggccaaaaagcaatatctaattcatgtaaaagtatcattataccattaaaatataaattaaaaaaaagactgagatacatttctattttgtactacttaatagttatctgggcttcttgattctggttgtggtattagatttcagaattttcaggaactttaaaatctggggacttctactgagcttttactgtcacagctcccagagggctgctcagtccctctgccgactgaatctctggttctccagggaataagctgcagcctcattctcagtgagggagcagatggtcattcttccaagaagctagaaccctgaccctaagcccaatcttcttccgtaggaccgttcatggctgtggccagaccactgtgaggcagaacacttggttttccccaccacgtgtagacagatgggcatccgtggggcttctgcccagcccttccttggccaagatccctcgcttttgggattcaagagatcttttactgagaggattagtgtcttccctgtctgcctgatatcccagtttggggtcttctttcagacaagtgtctgaagaacatgccctcacttaatagatatgttctcacatccacattgagttggagatctgccccaattccaaatctcagtcttgcctgtggaagcccgatcctcctccacctgccgtgttgaggaatgctggaaaatccagtgagcaggttcacattggtacagtttgggttaggagactataaggaagaagtgaacaaaaggtaaggaagggagatattgggaccaaagtctccatccctgcatcatatacctaatatgtgaatatcagagttgtttgttgaaaccaaaagatggcaaaaggaggatcaggagtggaatcagaagtcatagaaaactggtctcttggggtatctgtttggttatgtgaatggtaattcaactcctattatcttgggaagaatgtacctgaaattaccaacctgccgttgattaatgaacatatccataaataactaatgaactgggagccaggaggaggcattaacataatgtgttgtcattgtgttaccagtgcagagtggatattgcagggctcagcacatttgccctgttgatgcctccatgagaattcattcattcattcagccagccagccaacctaccaataattacccaccatgaggcagacagagcaactgaatcctagggttgtaatggtgaacaaaatagagatacaccctcctaacctgagcggcctagcctgggaaacaaacaattaaaatgtgcgctaaatgctgtggtaggaggtcaggggctatgtcctggaccaaaggacatttgcactgagacctgacacttcaggtcttcaactcccttgatgggagttagccagaacgggcttagaaacagcaattgatggcttagtgactgattttacaaatgatatttgtttcttctttaaatttctttctaggatgttcacttctccacaatgaatgagtgtcactatgacaagcacatggactttttttataataggagcaacactgatactgtcgatgactggacaggaacaaagcttgtgattgttttgtgtgttgggacgtttttctgcctgtttatttttttttctaattctctggtcatcgcggcagtgatcaaaaacagaaaatttcatttccccttctactacctgttggctaatttagctgctgccgatttcttcgctggaattgcctatgtattcctgatgtttaacacaggcccagtttcaaaaactttgactgtcaaccgctggtttctccgtcaggggcttctggacagtagcttgactgcttccctcaccaacttgctggttatcgccgtggagaggcacatgtcaatcatgaggatgcgggtccatagcaacctgaccaaaaagagggtgacactgctcattttgcttgtctgggccatcgccatttttatgggggcggtccccacactgggctggaattgcctctgcaacatctctgcctgctcttccctggcccccatttacagcaggagttaccttgttttctggacagtgtccaacctcatggccttcctcatcatggttgtggtgtacctgcggatctacgtgtacgtcaagaggaaaaccaacgtcttgtctccgcatacaagtgggtccatcagccgccggaggacacccatgaagctaatgaagacggtgatgactgtcttaggtaggtaagaggacccaagcaagccatcattcccattcattcagcaaatctttacggagcatctgtggtgtaccaggcacttactaggcagtaagaatgcagcagtgaacaagaacggacataaatcgccacccacctggagcttacactctaataaggaaagataaaataagtattctaatgggggtaaacaaattaagtgaaataagatgagtctcctgtggaaaaatcaatcagggaaggaaggaaaaataaagcagggaagggagctggagagtgctaagctaagcaggtatcgtttgcactttaaaaaagtgttgtgagggatgcctggaagatgacttttgagcagaggtgtgaaggcagtcagggagtgaaccatactggtgtctggggaagggtgttccaggtgggagaagcggtaagcacaggagccctgaccagccaggaagccactatggctgcatggatcgagcagagggagtaggagaagatgaggtcagggagctggtggggtaggggatgggctactcagataatgtagggtcatgtggttataaggacttcagcttttcatttttttttcttttttctttttttgccggagcctcactcactctgtcacccaggctggagtgcagtggtgccgtctcagctcactgcaacctccacctcccgagttcaagcaattctcctgcctcagcgtcccaagttgctgggattacaggcagcgcaccaccatgcccagctaatttttgtatttttagtagagatggggtttctccatgttggctgggccagtctcaagtgagatgagaagctatgggaaggttttaaacaggggagtgacatgatctgacttatattttaatggtatctctctggctactgttttaagacactgctgtaatgaggcaatagcaaaaacaggaaaattgtttaacctatttatgcctagtgttccattattggaatgctaagcttgtgggagttatttatatcctactgctcaaggtcattgacaagttctgatttttcacaaaagaaatttgcaacccctggcataaatgggttaatagagtatttcagtactcgggagagatcaccatggccagatggtagttgaaggtgatggtcagattctgtttttttgttttttgtttttttttttttgagacaggacctggctctgtcatctaggctatagtgcagtggtgcaatctcagctcactgcaacctccacctcctggcctcaagtgatccttctacctcagcctcccaagtagctgggattacaggcctgtgccaccaggcccggctaatttttgtaatttttttagagacagggtttcaccatgttgcccaggctactctcgaactcctgagctgaagccatccgcctgcctcggcctcccacagtactgggattacaggtgtgagccactgcacctggccagattccagatattttttaaaggatttactgatgggtaaggtagaggggaagatgagaggtggaggagaaggtggggaatgtcattaaccaagatgaggaagactgaagaggaggaggttttgggggaagatttggttttggacaagctaaatttaggaacctattagacatccaaggggtgtggcaattttattgagtggacagttggatgtttgactcaggaattcaagatttaggtctgggctggagatgtacatttgagagtcctggggggaaactggtattttaaatcacaggactgcgtgagctcaccatgaacgtgaatgtggatatgaaggagaggaggaccaaggatggagccgtagggcaggccctccagtgtaaggaggtcaggaggtaaggggcagccagcaaaggagccctagaagggatggaaaacccaggagactctggggaactagaagaaagagaagaaggcaatcgaggagaggaagcattagcagtgttggtacccctgagaggtggtgtaagaccaggtgttgctggccttaccaaagtggtggacttgtgctgatcttgagatcatcacatttggtatagccaagagcctgattggagtaaaattgagaaagaaaggaagagcctgggcaacatggtgaaaccccatctctatgaaaaatactaaaattagctggccatggtggtgcatacctgtagtcccagctacttgggtggctgaggtgggagaaccgcttgaacccgggaggttgaggttgagtgagctgtgatcacaccacggcactccagcctgaacaacagagtaagagcctgtcttaagaaacaaaaacaaaaccaaaaaaaaaaaaagggaggagagaaaggttgtgagccctgtaccaagaagacatgtggtttcgtagaattttccctttgttttattttctctgaagtaggtggcctattgccccacctccccagttctaattctgggttacaggtagaatttgtaatgtgtgggcagacaagaacttttgtggtttcacagaacttgtcttgtaaggcagagaggccgtttctcactgtgtgtgtggctgcagcaatggggactgttgctgagagagattcaggagtacatttctgtctactccttatgagaaggaattataaaatgaattatcaggtagcagttcatagtggaggatacagtatgtgtggtgtggtatagaaaccctcacaatgcctctaggtcctgaaactgctagtaagatttgggggtcagcagacacagagtgtgattgttaaaataatttcaaactgaggatttatttaacaaatatttatatagtgcttaatatgtgccaagcattgtcctaagtgtttttacaaacattaacttatttaattctcatggaaaccctgtgagataggtgctactattatacccatttaccagatggagaaactgagagtttaagcagtgtgtccagtcactcagctgttaaccaagactcactgtgcagctggcctctagagttcacatatttaccaccatactctgtggctacttgtgatttatctggactttttacgctcatctttttgtcctgtcttctgctttgacaccgttgacacattgataagaaaatggacaagaacaagaaaaagagggttcacattaatcggcatttcccctcgagctggagaagatattgatgtttttgataaagaatgaactttggtatttacagatagtgtcaatgaactgtgctgctgtccctgcttaacttgtaggcataatcatttgcttggctatgtgtcttgagaaattacccgcctgcttaaaaagaaaactttcttttctcatcatattataatatagtatacagcatgatagagacaaggattccaaaatcctaggtggagagaacaggaccctttgtgagacagtcatggtcacaaacttcagttttgtatgtaattttgtctgcaacagttacggaaggggttaaaagaaaggagctgggaggttttggcaggtgtggtattgactaagagaaaaaccagaatgaacaattaaatttccaagtaggataagagaagtcatgcaattgagataagacaacattggggaattggttaatggaagaaagacagtttggtgtcaaggacctcagaagttccttaatggtaagacagaggaacctggtggaagacaggaagttcagggacgagggaaatgaaactcaagagctaggtggtgtaaggctgaagacttccagctcctgatttctctagataacagaaagatttgggttttacccccaattctttcattttctacaagggtgatctgcagcacatcagctcatcttttcttggttagattccctcatcaggtggcatagaccatctttaagttctttacaagttacaaagttcaattatcctttatgacagttagtaaccaaaggtgggaatgaaaaggaagagtggagagagagagagggagagagagattgagagagagaatatgaatcttgtggggcagcaccaaacagttctgtggatccaagcacagagcctctttccttgacagcagcacctaccacagtatcttcctagggagaaagcccccagttccctacatactacatgtaagaattcaattgcctgaaacaagcatctcccaaatgatagtatattagaaaaatcaacagtgctggcattaaccatcatctaatcactggttctgattatgtggagatgaatagcttaatactcatgtttttaataattgcaggatttaaatgtctttatgataaaatgctaaacatttccatttactccttgatacatattttgtaggaaagattcatttaagattaaatccatccaggtgtggtggctcacgcctataattctagcactctgggaggccgaggcgggcggatcacttgaggtcaggagtttgagaccatcctggccaacatggtgaaaccccgtctctactaaaaatacaaaaattagctgggtttgatggtaggcacctgtaattccagctactcaggaggctgaggcaggagaattggttgaacccaggaggtggaggttgcagtgagccaagatggcgcccccgcactccagcctgggtgacagtgagactccgtatcaaaaaaaaaaaaaaaaaaaaaaaattaaatcctaaagtttcttacgaaccctcttcttttacatattagaaagtcagtctctaagtacatattaactgtctattaaacagtatctaagaggtacatggttgcatgaattcagtgagcttaatcttatttcagaagaggaaaggatggacaggggctgttgagtgtggagacggcttcttaatgggctgggatgtaatctggaaggataggtgggatttgcatgggctggaggaagacacattctaagagggagaaatggcatactcagaagtgtgatgatagaaacatttaaagcttgtgcattaccatgaggaaggccccacagagtacaaatacttgctgtggtgcggtggaaaaatagctcacctgtgaaccagcaaagtttagttggctatcctctttggaaggagagtagaccagatgacctttgtgttcctttccagctttgggattttggttgaacacaaaagctaacagcatggggattcagactctttccttgagggtagtggtggtagtgatgatggtgatgtgagttttcaatctgtgtgtgcatgattggaaaggcatcaaggcatcatgttcccgtttcagcagccctgaggcaaaatgcttgctcacttctgggttagaatgtgtgatggggcctttatgtgaaaaaagttgcttattgaatgttctcattgaaaagacatcggagacatacgatcctgctttccaaagagcaccaaggccctgcctaagaaagggttttgaaatcttacttgtcaacaagcctaatcagctacagcaaccaaacacacaagaaaccccacatggaaacgtctaatttattgtcaaacaacacaccatgtgaactgtgcacacagaaatgttttgttatttcccagaaaatgggctggactttgctttattttgcagtgtcttaaaatacaagagaaaagaaagagggaagggacttgcaaaccattcttttgaagtcttccatgaaccctcctgtcctttagtgatgtttttcaaactgtaagttttgatgcactgatgagattgtaagcaacactttttaaaatgacataaaaagaagagaaaatgtcagagtgtgttgcatttaacaggtatcaatattgttttataacctttctttgcgtgcctgtgtgtgtgctgggttgtgatataaaatgtatttcctatcatgagttatcgtcaagaacgtttgaaaaaccatgatcttgagggtcaaggtttatttttctgccagaaagcactgaactcttttaaaatatgaaacattatcgttgttaagggacttagggcttgtggtaattaaaacagggagctggttgtttttcttctcacttcttcctccctcctctccacttagattgatgctaaatcatcctcttttgtctcttaggggagagaggaagaaggcaaagtagcagtaagcaacgaaacgatagctcaagttctcatgctaggaggaaatgggtgaaaattaagtaccataaagagccttgccagagtactaataataatcacacatgatgtttctgcagtactgtgtctttttcagttttaatacactgttctctttggtctcatggaaatcctgccaagcaagtagttaaggtattattatccgattttcctgcaactcccctagatgtatcctatactcaagctataatgaattatttgcgcttcccccattttgtctctttaagcctttgcagatgttgggatacctttcccctagttctgcctgggaaactcccattcaccttgtaagacctaactcaaaggtctatcttctttgaatcttcctttgccctactggagtaaatctgattactgcctcccttgggctgcctgtcagtcttgtccatacaacaatcaacgtacttaattgtttacatgcctttattttgcactagagtatacacccttcgaagtcagggactgtaccttatttatctgtctctacatatctaacagctagtactctcagctagcaccctatctggcacacacttgttgagatgtactacaatgaataaatgaggaaattgaggctgaggggaaggtaagtggcttttcaaatgctggagctaaaagcagaacccaggtttcctcacttccatcttggccttagatgggctctggctgagacatgcctgtcaggtagacaagggagggaaataggtaagaatcgtgttttttaggtttttttttttttttttttgagacagtctcgccctgtcgcccaaggctggagtttcagtggtgtgatctccgctcactgcaacctccgcctcctgggttcaagtgattcttgtgcctcagcctcctgaatagttgggattataggcatgtggcaccatgcccagctacttttcttatgtttttagtagagatagagtttcgccatgttgcccaggctggtctgaaactcctggcctcaagtgatctgcccatctcggcctcccaaagtgctgggattgcaggcatgaaccaccatgcccggcccttgttttatcttataattttataatatgagaagccgaggtctctgaaggttaagcgatagtattatcttgggaaggagaaaagaaatgagcattttttgaatgcttcttatgatgaggtcagcgtgttccaggcttttaggattttatttcacttaaccctcataacaactctatgcagatctgtttttaagacaaggagattcgagtggacttagcctcttgcccacacacccgtattgataaaattattaatagttaatattcattgtggggtatacatggttctgagtaacttatatgttttatttcatttagcattcatgacaacccttgagggaagttctgttattaccagatgaggaaactgaggcccgaaaaggttcaatgtcttgctcaaggttagtagcagagctgagattccaaccccaggagactggctccatactctacttttcagagtcagttaatagtctcttggaagtgagggggctggaacgattggacccaagtcatgaagtttataacttgtatctcccttggtttctataaagttcatttctgtaaagtcacatgctctttcaacatttagctcgcccttgatccaaatgttttgcagcatgctagtgacagctatgaaaacatctcctggaaaatgacagctctatactcttcaaactttatgcttattaaaatcattggtaagaataggggctttggagtcggcggggggaactggatttaaatcctagctttgtcaattccaagttgtgtgaccttgagcaattcatctcacctgtctgtgccttagttttttcatctgtaagaaagggataatagtatctttggcatggtgaggtgttgaggattcaatgagttaatacacataaagcacctagcataatgtttggtacatagtaagtactaagtaaatattagctactcttagaccttagtttgattctaaagagccatgccctgtattcaagcagaatgcccttttatgtccagttctatcaccaagtaacctggacacagggactagaagcctactgttggtgccatcatgatggcagattttataaaatggacaagtagccaagaggaagctgaccgggtgtgctttgcagaggctgccttgacagatggcaaatggtaccagctctgttactggagacccaggacagtctgaacacatggtcaccacagaactgaaaagctctgtgcttacattgctagtccctataaaccaccctctcccctacgaaattctgttaatgattcctgtctctgacagatgatctttccattaataattcatttcacttttgcaacatttatgaataaaacattataaatgagaccctggccacaaagcattagcttgacaagagtcctgtgatacagcaccaacatcttgtgtatagagctctattataggatggtcctcataagaaactgtccccctcttgctaacaaatccttcgagagtagctagttcgtcagctgctattatcacctttgctaggattggaaagtttgccctgtgactgaaaagagttgggaccaaaacacaggccttttggtattattcataagcttcatcgatgaactgtccttactccattaaaaaagagagagagagaaaaaaaaagtacatgtgcctaagttcgtgaggaattctgaaacatttgttttcagcttctgtggccttgtagttgcttctgcaacacagaagcctgctttcaatgtttactgcctgcatgccttagtaatcaaatatctgttaaaatagaaaaaaagaaaacagttaaagctttgccttaagaaatgctgagtgaaatgaacagattgttggcacacaggggctctcttgttgctgtgcagagagtcatatcagaaggagggtgattcttttcagagtcaagccatccaggcaccagtactcagtacattgagtccgggggtgttcgtacttttgtcttgaaatggctagtcccaggagcacctttgtcacagatgattttcctgtgtgcttcatggcattgctacagaggcctatgggagggaggcattgttttcagggcaggccgtcaatcggtgggtgcaaaaatgcagttgccactcagttgctgcccctacgctgctgtttgacacatcccttcctgttctgacggggaacgtggggactgagatgacctcagtgtctgatgctggaaggaagacagcttcaaattaaaaaagaaaatccctcatatggcactccatcccacttgttcaaatgccatcttgacacctcttccaacaccacatttccaggagtctgtcttctttcttctgtctctgccatatgtagccatttgttacctcaagtctggctcttggttctttcttttccccccacgccactgtttcagacacctcccttggcagtcagtttagaagtgcttttcccaaatcagtgttcttgtttccaatgtaaccactgccctgccctcttacttcttccatttcctctggtccagaccccttcagttccattacaccaaatgcactcagcttcttttattcccctctcatgcccccttcttcagaacttctggcttttcttctttttagaaaactgaaaccttcctcttaagctgaaacaaacaattattgaatattttctgagtgcaaggtggagaaacatttctcaaatttgacctctttgaaaagaaggtatagggagaggttccagtacccaactacatccaaccctcctgccaacacccagcctcctggaaggtttcatgttccagaactcaggaacaccctctcttagggctttgatttctgccaaaggagaaatgtggtcatcgtctgtgactcaggcgtcatatcactgggctaattcaacatctggaatagtatggtgtgtgctggccaatggtagaattttatcaaattccatgttaacattgtacttcgaaaatttcagctggggactactatgttcattgtgtatctatggcaaacatgttgggtgggaactgggagtaaagggtgtttgctggaattatgccctgtcgtggacctagggatcaacacagaagctgggataaggggtaagggaaccaagagttattggcaggagtcatcttccctcctgcactgacagttgtccctccagcccagccacctgctctccctcaccaccagattgttgttaactctgcagagtatgtggcggaaagatcccattacctcaaagaatcaatactgttgagagatttgaccaagttcactttgtaaattactgcagcattgtggctgcagctctggaccttctagttcctgcttcttctagtgggtcccaacttcttgccttggcaaaatatacctgtccttggatgcctgagtgacagtgaatcacaacaggggttgttttcatcaagtcagagaatttactgctcagtggtgaacctattttattctttatgtttttttctgcattttatattttctcatcataaacatttattgactaccttgctaggttttaggcagtgtactaactatgagacatggcctctaccctgaaggcactgtgaatctgtgcttgctctagtggtttatggttgtcaggaaatgaccaagatttatgagtcaacggttgtgtcacatgagagatagatgacatggaggcagacctgttctgtgtggcttttcctgtgtgtgactaatagagaaccctatttccaggcttatttgaggaaatgagaaatgtactcaaaaaagataactgaaggcacaaagaaatatacataagggctgaatgagggggcctaggctgaaaaaatgctgtgggcttggatggtccatggaggcctctttgagaaggtagaatataagcctgatttcagtgtaacaggtggagaggaaaggggaaggcattgcagataggaggaaaggcagggtgggagacaggtatacatatgtctagggaggccatgccagggccgtgggtagaaaggggagactgggcagactgatttctggaataaggagtttgaatagtaatgacaatctggtttgagagacataagggagccagagactggaaggccttggatcctagggtcctgtggacttcattgtcagatatctaagagagactaggcagataacatgggtatatgaattgggtctggagtggatataaggaaatagggaggggtggtgcctgtggctaactagacagatcatgccctgtgtaaagacaatcagtttcattttttgttaaaagaccatgcaggcccaattaaataggcctgtggccagtcttcagcccacagctgaactgcctcatctggcaagaaagagcccatgtaggatcttgagtgttgagaaggtgggagttgcaaaatgcaaagcagggttttagaaagatgagaggtgggttggagagggagagatcacttaggagacaataggagagtccccaggatctggggatgggaggtagctcagatgccagagagaggcagagctggtccatcatggtagatgttgtaggaaggcacatttgtcagcagcagctagaaggcccatcggggctgcaggggaggagaagagaagcaggccagtggggcgtgagcttatggaaatctggcaggaggcagagagagaagaagcaggaagagggatccatcatgggaactaaaattcagaggcagggtcaggcaagagcaacacttaatcaagccttgccactttccccaaggtctttgagctttgccctgtctcattccccagctgacctcccaatctttgctttcttcatctggcatgaactcccttaatttcccttccttcatatctgagtccacctgcacaggtcacatccttaccatcctagcttttcactagggctcattccttccagccaggagctgggggatccacgagcctactcttgtccttattcttgctttcctatgagcttgatcgttcaaaaatgtaagccctgaccttaactccccttctaactactgctctgtctctccctcccttcactaccagacttttgttcttggttttttttttttttcttttcttttcttatttagagatggggtctccctatgttgcccaggctggtctcaaactcctgagctcaagcgatccttctgcctcagtctcccaaagtactgggattataggcacgagccagtgtgccccgctgatttttttactcttgtttattttcttttcttaatacttcaaaccgtagtaagctagcttcttcctatactactctaatactactgtgtttgattaagccaccattgtcttcctagttgccagatttagtgatctaccttgaccttcctgttatgtgcctgcttgcttcatgctccctttgatagtgtcttcctccttctgttccttctctgctgcttgtccagtctctcccatttctgaccatctctgaaatgccctttgttccttctcctttgggtccccaagttctttccaggtgattttactcctgcagcttgaaccaacccctccatgtgaacgtctctcaaagcagcctctccatcctcagcctttcaggagatcccaatctctgtttccagctgctgtcacgtgcacacctggatgtcctggaggcaccacaagcttcagctgccctgcagacctgctctacctgttaaataggatctctgcaatgggtttcatctgccttgccttccaagctggaagtcttggtagtaccatctctctcaccacctataaccaattaatcaccaaatctaaaattattcaccaaattggctgggtatagtggctcatgcctgtaatcccagcactttgggaggccgaggagggcagatcacgaggtcaagagatcgagaccatcctggccaacatggtgaaaccccatctactaaaaatacaaaaattagccaggcgtggtggtgcacacctgtagtcccaactactcgggaggctgaggcaggaaaatcgcttgggcccgggaggctgaggcaggaaaatcgcttgggcccaggaggcagaagttgcagtgagctgggattgcaccactgcattccaccctggtgacagagcgagactccaactcaaaaaaaaaaaaaaaaaattagtcaccaaatctacttcagtggtgtctcagatcctactacacgcctttagtccaagacttgctgtgtgttgctaacggtcatctccgtctggattccctcctccagcattttcttgctccaggccttcccccaccaccagctgaggcattttcctaaaaagcacagttagctctgatcttttcttgtctactcttccaaactggataaagcccaaattagttgggattacaaggctgctttcccagtcctgttcccagcctccttttctatgcactcccctcacacagcccctgcttctgtcatgccaagcttctcactgtcctgcacatgtgcagtgactgcctgaggctcctcgaagttttctgtagcatggcaaactcctgtccatctttcaagatccgactcaagagtctgccttctctatgatattttctctgactccccaaggcagagttgattatccagtgcttctgtagtatactatttatatattaaaagaattaactcataaaagtaacccactctattaaaatttatttgctaagtgcctctcttacccgactgtgagcttctcagggacaggactgtgtgtgtgtgttttcacttgtacagtgcctggcacacagtaggcactcagtaaatgtttatataatgagccaacaaacatgcttattgggtgggacctggggtgggaactggcagttagtggagggtctggtcacaagaacaaaggtaagagggactgggaaggagaacgtggaagagaatcgacattgatgaagcactttgaattgtcaggcatttttatggataattgtctcatttctaataacagctcatttctaataacaactctatggagaaaaaagggatttttaaaaattgaccacaactttgtgccaggcatttatacatactctgtttaatcctcttagaaggtgatgctgccattattttaaatctgaggaaatggaggcccagagagatggaaacctgccccaggtcatatatcaagttgtggtaaaggctccccctgccccagggcataccctcctcccagtgctgggagccaccatctcaccagcccacagcgggtgggagaggcagcctgggtgacagtggttctgggctggtccacccagactggctcagcctgggtccttgtgctgatcgtaactacaagaactcgttctatgtcacctgggacccctcttactaactctgcgcatcagccatgaattgcttcctggaatgcaggcctcctgtgtcctggttctaaccagtggttatcttggcctgagccggggggatctgtggtacagagttagcctgggtctggaattgacttctgtgagtgacccaaaggcatgaaagatttctttggttagggttgggactagaggttgggggatctctagagtccctggtgattgttagttttgtttcttttttccctttcaaggcaacatctggctctgtcaccgaggctggagtgcagtagtgcaatctcggctcactgcaacctttgcccctaccaggttcaagcgatcctcccacctcagcctcctgagtagatgggagtacaggcgcacaccaccatgtccagctattttttttctttttctttttcttttttttttttttttttttttttgtagagacagagtttcaccatgttgcccaggctggtctcagtctcctggtctcaagcgattctcccacgtcagcctcccaaagtgctggggtgcaggcgtgagccagtgctcccagcttgattgttagtctttaactccctcctttgtgcggtggctggttacatgggagggggttccatcaggactgctgacagcctgctacataatttgtgggtcttttgttcaaaaggcaggggagatgtgccactgaaggtactaaaatataaagctctctcccttcttccgcctgtctcctctgctcatcctcatgctcctctggctcccttacaaaatacaagttcaaagagaaaattgttgaagatttcaagaacgtgacagcagagctgtcaaccaagtgcaggcccttctgagcacagatctgcgtgatcacacagggccgcccatccgagaggccggccctggaatgcttggccttagctagcctaggaccaaccctactatgatccagggagcttcaggagacttagatgtcattaaattagctctcctgggatcatgagggttagagggttagctgtgtaccttgcctctgatcagcctccttggttttgagaagtattttcgttgaggcctctttgtcttttctagggctggtatctttccccagggtgagactccttatcaccaggctcgagcactagcaggagggacactggtgctacgtggcagagaccttcttccagttatcttagcaactggtggatcccagggactccccttagagtttctacattattgggctttcagaactggactcaccaatgagtcagggagacagtgttcctgctctctatctgtgctgagtctgcctatctgggcccatgacaaggcttatgataaaagtgttatatccagaacagtcttcctcatgactcagtttacagcctcagaatcctataaataggccccagaccaaagttcaggacttttctttctttcttttttttttttttttttttttgagatgagtctcactctgtcaccaggctagagtgcagtggcgcaatctcggcttactgcaacctctgcctcccaggttcaagcgattctcctgcctcagcctcccgagtagctgggactacaggtgcccaccaccacgcccggctaatttttgtatttttagtagagacggagttttaccatgttggccaggatggtctggatctcttgacctcgtgatccgcccgcctcagcctcccaaagtgctatgattataggcgtgagccactgtgcccagccagaactttttatacaagttaaataactcttcccttggaaggtcagtgttttcctccccaggatatgttccaagctccttggttctagggcatcttacagttaggcctgatgttctattgagggatctctagacatcgtactgttctgttgaaagatgctccagagacgtactgagtttacttctgagggtccatatgttgcaaaacatgtagcagagttcctaggatctgcgtgactgcttagacatccctctgtgactcctgacatgtggcaaacttaacgaatgctgtctcacagtggagctctgtgccttctgctgggactgggagaactagtgaagatgctgaggtgacacagcagacccaggttgttctggaggctctacctgagtttgcatgcagcttagaaactaaaactgtgtcttctcagttgcatggagtggactctcagaaggacatagagattgtcttacaagaggttaatgctcatttatggggtgttaactggacccttcttcatttgttccaacttggaaaggaaatattgtgtctctggtctaaggcaacttgcagctcagggagggtagcttttgggtgagcctggagaatattttggcttctcaattcttctttgctggcctctgcatgacaagggatcacacagggcctcctggctcagggaggctctgtgaatgtggtccacagggacagtgctaagaaccgaccactggattctgtacttctgttatttgggagggaaagtggccagcctcagggcccagcaggggcattctggggttcttaagttgaaggctttcttggcgggacctgcatttaaggtgaaggaagctatataagatggtggctggccacatccagatggacaacacttgtcccttccaacagccactatctgagctctgcagtgggtggaaggcttaggtgactggcaggctgtggccaggcttgttggacagttcagtagagggaaggaactggctagatctgggcagactcacaaaggcccatgcctgctgttcaacgtggtgttaagggagtgctgcagacagaccagtgttaagtggcagctcctagatgacagggcaaaactgcagttcccacaaaaacctgggccctagaatagtgcccaggagccaacaaggaaggggtgggacctaggcaggagattcggggaccacagatgctacttcctttagcaatcaggtgcttaaatccactttgggccctgtagttagaagtcagcgtcagggaaacctggcagcagttaatgaggcctggccatggctgtaggccaggttgggaatcaggaagggtagatgcatcctctggagtgatggtaagtccctgaaagactgacaggagttgaggaggaccctggcatcagcagagctagagtaccattcaggctaccctggagaccccaagtagtggagctaggatataaaacagacacccaggtcccaatcagcaggcacagctgaggacaggggggtcttcagattccctgataggagctggacttgcttcctgggcttgttgatggactccaactggctccaggcacttgggtttggaagtttgccagaacagggctggcccagacaattcttcatagaaatgtggtttcaggaggtggtgtggtgctttgtgtcaacatcaccagggcaacgtgcccagcgtatgcatgagctctccctccactcccacacacacatgctggtttctaatccagtgatccactagtacagccctgacatccctgttttgaagaaacaactgaggtattctgaaggcccttaccccaggcacaaacatttcagaagcaagagttactatgaaagcagtgaaaaaacaaaaggaagaatggatttaaaatacattaaaatgatagaaacttcaggaggtagtgacacattgagcccgaggggagtagcaaaaggatgaatccagcttcagtgttttaaatttggatgactaaaagaacaaagaagatggtgggtcagaaatggaggaaactcagtgaaatagaaaagtccaaagtggaatctctgatattcccagggaacataagatataatttcttgtaaaacctttgggaaatacctcataccctcccatttctaggagaataaactacagggtagccccctccaaaatttccagatagcacattaaaactcttgtaggacctatttaaaaaatacatttcttctcttctgcttgtatgtcttaaaaagactttacaattttttgtcattgtcttgttcttctagttattagaaataaactattttattaggttgaaattatccagtttgaatttgaatgagatcttatttgctctgacacaaataacccctttgtgggtaatgaaagcaatttaatggtgtgatctaaaggagaaaacaatattactcaagctattaacaccaggagacttctcactgacctcttacagtgacctgcaaactgtgcttccaatattactgcactcttgaggaagcatggaatgaagttttgcccaaaaatattttagagaatgcttcatgtggaaagtcataaagaaaagcagagaaatataagtagctataaatgagaggggagaagggacttgtaaaattagcctgatgacaaggtttactagtttcaagcagcatgtcaccaatctgaattggacacaggagcctatcactatagcattacgaaaataaaaaattgtatgcagttctgcaatattgtgttttgagactctctaataagactggaactttcaaggaaacacaaattagagcatttctaaccttaattggagcaatgtgattcgtagttctctactatccctttatgtagctgaaacatctttaaaatggctttttttaacatgagaatttgtctggaaagtctttttgacatattttatgatcagtaaacttacaatcttgaatttatttattttcttactggacctgtggtaccgggaaattgattgtattttgtaatatcagaccaaaatttgcttacttgaagctgagggaattggagcctacccaccttatttagaaatgagccctcttatatgaggctttgctaagagtaatgacttaggattgtggctgtgtggaattggtggaacgtgtcctgtcgctgtgtttgtgtaccttgtttgtatatattgctagtattcctgtaacaagcaaactcacagaaacttcccagtggataaagtatacttttcacagcttggtgaattcacttgcccctacttttttctaaaaatctcatttttcctcaagtaaatacatgttgagtttatcaaagcctgcattttcttttctttttataaaaccttgaatatatattctggagaggttttcctaaactgttctgatttctaatttggagtgcataaaaaggtttgagcgtaattaaaaagattaattggttttggtaatgatggaccaacacagtgcaggataagaaacatacaattttttcactgcagttttcttttctagttcaaaaggtgcttattactgctcctgactataatcctagtccctttcatgtttgacagatttatagtttacagggcctttatacctacctgctctgagtagtgtgggagatggaagaggaataaagtgtgggataaagtctgagtgtttgattctagttctgctttccaagaaagaaattcgttttctctacacctcagtttcctcatctgtaaaagtcgtaacacaaatccctcctagagtgtattcttatgagtcaatgaaatacaggtagaatgctaacaagaagcttaaacaatgtatataatggccacttggaattaatttagtgatttaaaaatgcttttcaatgttcttcccattgattttatttagccatccaataaccctaagcagtagaaggaaaagcatttttagcctcattttatggatcaggaataaataaagcctggaggagttaccagatttgttaatgtgaacattgggcccagagctcagaatttaaatagttttataaatattgaagtgctttggcactagaatttaaatgaagtttaaaatcttaattgtttttgttattgtggatgtaatttgcttgtttctaaaatgtacacattgtagaatatatgatttagaaagtggaagtcccccttagttctctctttagagattttagaaccactgttaacaggttaatatgctggcttgcagacactttccctgcaaataataaaagactgtggcggggtcggggttgtatgtgtgtatagtactcacagagtaatgatttttgtacagaaatgtgttcttaatagtcataatagttccccatctttttatgcttgacaacatacgaatattttttcatgtctgtataaacatatgtctaattctcttcagtggctatataaggctacattgtattacatactgattgatgatattttatgagctatttctaattttttgccattaaaatatccctgcaatgagggtcgttttatatacatctccaagcattcctgggtctatttttgtgaattgtatttattcaagaattagtaggtcaggaaaatgcatgtttaaaattttgttaagctatctctaaattgtccttcaacagattgcatcaatctccactcccacaaacagtgcagtaaatctttctccttatgctttccatcaacatcaggtttttataattcacacacatctaaatgaaacatttctgctgcagcacaagacatttgaaaagaccagaactatctagctgtctgtcagtgcctgtcagcaaaccaagggcaggaagcatagaagagtaaattaaagctgacagggcagtgagcacatgttaagctagaaattgagatatttggccaccattcttattcattcattcatataacatttgctgaggtctgcaatgggccaggccctgtttaggccctgggaacacagtgatgagcaagacaaagtccctggcttcataagcttacattctagtgcaggtgatccatcaacaaataaattagaacagaatgtcaagaattgttaagacctctggtaagaaagtggggagagagataagggtggtaggatgcaggtagggaggctgctttagactgggtggtcatggacttcttaaacagaaacccagatgcagggtagactgagcccactggccacctgggagagcccatccaggtagagctggcaacagcagatgcaaaaggcctgagaaaggagccagcttgatgggttccaggaatagccccaaagctgcactgacttttgatttaccggagaggataattgggctacttactttctttatagaatgccatgtttgggcaaatgaacttgtgaagcacttagatctctttagaaaagtgatgttattagcatagggtagtattttaaccagtaaaatccatcagcgagtctctgccaacacccagcaggtgtggcgtttcacgcaacccctctccctagctcaagactgtccttgttgaaacttataccagtgcagaatagacccactgcacctccagcttggaaaagtctagaccaacacactttcatgactggcaagtccttcttctgctgctttgccttgtaagaacccagttcattaaatgtgttttaataccattggagagaagaaatcacagttgaaaaaagaggtttgttggaaggtggtcacaaagagaaactttcacttaccaagcctgggaagtttcttggatgtctaagaatagtacactactaccccctactcaggattccagtattggcctgagagcaggagatgaggcatagctgtgtggagggcaaaagaggacaggaacaaaagaagaaatggagttttaaatgtgaaggtgaagacaggagttagattttctgcaggccagagcctccacaggcgttgcacttgtggctcagccctgtccccaccccaggcttgattgacttttaagcagcatgaagaccaaggcggaagctcactttctcttcagtacttggtcctccccctctcagacctcatcttttaaggggaggattgaaattgccttgacggaatgcttacagggactgaagcactgcttattgggtggctttcatttcctgcaatctaattcttccatgtctcaacatgtagggaatctttttttttcttctttgctctcctccaagagtcttatgcaagagagctcaaacaagaaaaacctccttgtgaacaaaacagcacccctggaagactttgaaatccatgccaaatgtgatcttgaacttgaaattcaaacataggactgttatgattatcttctacttctgaaaagaactcccaagtctacccttatttgcctacataaagaaaaaatgtgcttacttgtaagtactttagcagataaattttttcagaagacaatttttaagagtgctatgaataagcagactgatgaagtttataatttgcactaatactttttattttatcaaaatgaaaactaatctacttaagtgcatttcttttaaaacatcttttcaaacctataacttatggagctaaaggcaatgtaaggaaaatgatttctgctcattcatttgcatgattaaaattcagcttgcataaccatacgttataggtttgtttcaaaccctggaaaccttttggcttttgaccagtgactgaatttcttttgtttgggactctagaactatagcaaatgattgatccgatagtggtggttatgacttatctggaaggaactgtgtgtttcaatttcttgccctatacttaaatgtagaagtccattcaatgtattaactatacttctgattgcaaaaacaagaaccaactcacgtcagcttaagtgaaaaaggagaggaacactagtgtctcatacaacccaagggtgtggagattaccatgcctaaggaacatcctggaactaggtgttggaaagccctgtgttattcaggaaattctttctcttcacttctcatctgagtttctctccatgtgctaattttattcttcccctacaaacttttttttttctgtcctgcttcttctgcttatgttgtaccgaacatggcagccagtagctcctaagtgtgtatatcaaggtctctctttctttcttttgcaaattttctgggaatggactctgctgctccagactggaatcatatgccaacccttatatcattcaagtctggccagagctggggtccagggaaggacttatgagcagaccactctgcctcaggtgctttgaagctaacaattttggtcaggagtgaaatcacatttgtcaggagcctcacctgtgttaccgtatgaatggaggatatgtgtttgtgtagccacacacgggagtttgattgagaggggtgtgcaggtagaagcagttaccatagaagagggaatctttgacttgtagatgtctattttggttatttatttattttagtttttctggtataacattgaatagaaggtgtcgattttaatctcaaaacatgaagttgtaacattaaatgacctgaaagtatagacatagaagcttggagactgacaggaaccactgagaatttcctagactctcatgggggtttcattcacttttcttttcctccaaaggacaaactccacagcctaatccagggactgtccagatttttagttgtaatgggtttttttgtttcaaaatgtttttaataatgagtaaagcaaaccttaattgtcataaggggccgtcggttgtccttgtaaacctcttaagtaaatacaaattttcatgattatgctgtgttttaagtaggatttaatatgtatcacaaaaatgggaaatggagtttcgggaattcatttttgatctgtgatctagaaagaaaggatccctcagtgaatacttattattttcattgccaaagcctggataactgttgaaaactgaaggactggttaccacttgaggtaaaaggtctggtaactgtttcacaaggaaattccagtgagcctttcaatatgttgtagacatgaggatcaaggctttggcttgctcagaagaaggtctacagtgaataaaacttttctgtgtttctgtatcttctttggtaaaaaccggccactgttttcaggaaatggggtttctattccagtaatctttgagcaaaagactgtgtccctgacaagggatgcaatacttaattacactacaaaatcctggcacaatgttggctcctttgattatatcttttcttaaacacaattattgttttaaagaggcatcagcttcactttgaagaatatacaacttaatcccctgtcaaagtctgaggatgcagttttttttcaatgtcaatgactaaattgttcagaaaagtttcctcataaaatggcatttctttggtcctaaacattctcaaaatctgaggaaacatttccttgtaactttattataaatttggtccttatgcataaaagtttattgtttgtataagtaagtgggctctgactgatacttctggattgtttcctcttcagggtttgcaaggagccaactcattcatctgccattgttggtttttgttattgttaaaagtcttctataagattttttaaaggaatccttaagctagatatttgatgctttgtaacaaattttggggtgatgatatttaattctaggaccagcacatatttgacaattgtcactttatcttggtcagttcctcttgcctgtgaaattgcgttaatgatactcatttagtcttacaagtgcttttggtttcttcattaacactaatgctaataaaagcaagcactggtcaggcatggcggctcatacatgtaattccaacacttttgggaggccaaggcaggagaactgcctgagcccaggagtttgaaaccagctgggcaacatagtgagacccccatctctacaaataaataaataaataagccaggtgtggtggcacacacctgtggtcccagctaattgggaggctgaggtgggaggagtgcctgagcccaggagttcaaggctgcagtgagctgtgattttgccactgggcagcctgggcgacagagtgacaccctgtttaaaaatagaagcaagcacttatataattgtatttgccaggagcttaaataagcactctatggatatttacttatttaatttttatatgaagtatgtattatcaccattcctattgtaagcagagaagttaaataagttaccccaggtcacacagtaattggaagagctaagatttgagtgcactttggtcctgggatgtgtacctaacccttgcatcatattgcacagtgttgtcatcatttattttattttattttattttacgtatttatttatttagagacagggtcctgctctgtcatccaggctggagtgcagtgatcctagctcactgtaaccttgaactactgggctcaagtgatcctcccacctcaacttctcaagtagctaggactacagatgtgcaccatgcccaactaattgtttctactttttgcagagacaggtctcattatgtttcccaggctggtcttgaatccctggcctcaagtaatcctccacctttggcttcacaaagtgctgggattacagccatgagctactgtacccagtccacatttattaactcagcaaacacttattgaacttaatctagggaaccataaaaaatcagacatgtcttttcccttaagaacctacagtctgtggtgcaaaaaattgggaaaacagatcattatgaaaacacataattctaacttttataataaacactgggagttctgggagcacatagaagatgcatatgatccagacttgaagatcattcacttggtttctacaccaaatgctatctaaatggtgccagtttcttaatctatgaaaagagaccatgataatacctacctcggagggttgatgtgagggttaaatggcagaatgcataaaaatggtttgaatggaaccctgcacaataagtgtaagttaccattttcatgaaacagagcactgaaacctgtggtggtgtctgaggatctggattgtggacctgtaaggcatgttgaaggcaaaggtagctgcagggacaaagcccggaaatgaaagatggcagggccagtccggggcactgcaaatgacaagacaggaacaaggggttaaaagagaggttagtcagaggagcagagaggtgggcgggtcagtcggggagaagtcatgaacacctgcctgtccggctgtgtcctttggcccttatctggaagactttgaagcaaggagatagtcctgtcagacttaccttatatttaatataaagacgattgaccacactatggagaatgaattagagaggttgagactggaggcaagaaggccatttggctattaaactaattcagactctagatgatagtggtctgatgtaatcaccatcagagggatagaatagttagaaagaaatggatggattagggagataactgaggaggcagagtcaatggtacttactgatttttcacatgttgggatggggagagggaagtcaaggatgacacccaaatttctatcctggacaactgggtgtacagtgatactgttcactgtaactcaaagcatgtagcccatatatgagcgcagtctgtaatctttgagaatgggaccatgagaagatggtggagtataccatgcaagagggtgatctgtgaaagaatccaccatggatccccgtgtcaatgctggctggcacagttttcttagcattcatgcacagaggctagtggctagagtattggcacagggctgttggcaacagtgatcctcaccgtcagataccttttgccgcaaggatcccctgcttgtccccaactcccaaggactacttttgtgggaggtgagtacagcttgtatctccaggagctggcctgtgctctttatgccccaatacatgctagaactgtgttttgcagagctctagtgttctaaggagatgttttaatcacatcaccttatactagtaggaaccataggagccatctagttaaacaaccccaggatgtttcacaagtagatgtcctagaaatgaattatgtataatctaaggataccatttctgaattgtatcatttttcttctagctccaaataacagataccctggttttgtgcaaataggaacatacatttcttttcagagatggaaaccatatgccctttgattttgcagtggtccagaaaagaagtggtatataaaagaaagtgaagtttgattacaacctgcagaaactcttctagccttactgcccttctgtttctttatctcattaccaccattattagcatttcagactttcttttcagtgtcaacaaacttacgaatattatttgtgtgtaggtgtaataacatatataataaagacttcgctaatgcactgtatttccatgttttataatgagaaacttctgccttaagtttggcagtgtatacactcctctgttgactctctcagaggtgatgttgtcttgttttttttctatagtgggaaaagactccaaattcttgctggcgccagactggctcagaacctgcagggaagcatacctgctggctatgtgggattagcctaggggaattttctttctttaaatagttaaagtgtgatatttatatcaagtgtggtttttaaaaattaaagtagccaggagcggtggcttacgcctgtaatcacagcactttgggaggctgaggtgagtggatcacaaggttgggagatcgagaccaccctggctaacatggtgaaaccctgtctctactaaaaatgcaaaaaactagctgggtgtggtggcacgtgcctgtagtcccagctactcaggaggctaaggcaggagaatcacttgaatgcaggaggtggaggttgcagtgagccattgcaccattgcacttcagcctgggcaacagagcgagactccgtctcaaaaaaaaaaaaaaaaaattgataaagtaaggttttttcctttagtgatagaattatttttttcttaagaatataaggcttttgggtatactaactacactgattggatcattatacaatgtatatatgtatcaaaacatccaattgtaaatagtaaatgtgtacaattcaatgtatccatttaaaacaaaaataaataatatagggcttttaatttgcaggataagagtagctttcattatattatttgctaatatttacttagccttagtcttctcatctataaaataaggcaagtagaaaggacagaaataactgttaaatttgagaactgtcatttcgttttgttttggtcttcctgaaaggccatctcagcttcagagagaactatgattttaagattttgttctaattttctaaattaaattccaaataagttattctaattgattgaaaatgaaatgttattatccttccccaggacatagtgtatgtatatttgagaagaaaggaacatgtcagttttaaacagtagaactttaaatttcattttctaaccacattcagaagattggaaatattttatacatgagtggttttatattagacatgaatttatattggttaactattttaatgtttgatgacagattgatgacagatgctcagcaaaattgcagaatgggtttttttttttttttttttttaaagacaggatctcattgtatcgcccaggctggagtgcagtgttacgatgatgactcactgaggccatgacttcctgggctcaagcaatcctcccagctcagcctcctgagtagctggaactacaggcatgtgccaccatgcccagccaatttttatatttttttgtagagacagagttttgccatgttgcccaggttggtcttgaactcctgggctcaagcagtttgcccgccttggcctcccaaagtgctgggattacaggtgtgagccaccacacccagccatgtagaatgggtttctaagtaaaaaaaaaaaaaaaaaaaaaaaaaaaggccggggttgggggggcattcatattcatacaaaccaggtaaattaaacaaattaactcagtttacatttcgtgataaggttgctagttaaataaagaaaatgctctagaaagtatgtagtatatggatgtccagaaggcctttgataattggacacaatattctgttgaccaagaagtgtgggcagggtgctagaacagttaggagattcatcaataactgaacagttacacctgaagtttggtgattaagacaagattgacgtcaatctagcaagaatctcaaggagtgccagagaaatttgtacttggtctatattttttgagcaaaatagtaatattggacttgtagaagatattttaaaaattgcttgtaagtggcaaaatatgtgggaagaatagctaataggttaagtaggaggttccagatctaaatagccatcaacagagtcaaatgttatgccaaaacaagcaagaacagcattttaagagactagatatgctcattgtttagataaaacacacacacgtacacacacgtacacacacgtacacacatttgcgaatcacaactccacaaagatgagtaagaccttcttgataacagtgcatgttcaaggaaaacaaaagacttaagggtttctatgaaccagaaatgctgtggggtagattacatcatgcccacgtggttctccaaaaagggacatgcagttgcaggcacgttaatcaaaggtgtagaatccagagttggagaacaaattgttttgctttctttggaaacagatcagtccacggtgcatcttaaggccaattctggccatcacattttaagaggaatttagtcagtgtagtaagcacctgtaggaaggtaactggagttttgaaggatccagaacagatgaaggaattgggggagtgtcaccagagaagaaatgacatagcaattctcttaaaacattttaagaattgttacctggaaaaggaattttatttcagaggtctggaagttaaaactaggaccaagtagaagttacagaaagaatattttaactcattgtcaaaagacttttctaaaaatcggagctcctctgcagtggacctggcagcctggtgcagtgaggtgaagtccttgtgggaagtgttaagtagatgttgatgacccttgtgtgtagtgccatttaggggattccttcatagagtgggaggatagataggcaccctgtaagaattcttgcaagtctcagagtctgtgattctaccaaaaaacagtttatgagatttattgctaagactttgtataagaatgggctgatgacctgatctcattttagctaggcacaaacattaaatacttcaattacatgggtatgtgttatgaatcatcttgtacacacatacaaagaaaaggaaagcagtcttgccaaaggccccatgaaatacatttgctttggctggactaactagaattgccaagcaaacaaggtgattcataataaaacctctgttcagtaaaatggacccataggaacagtaaagttgattttccaggtatagtaacatcacttctgctcatctatcttctcatttgctatcgtctccaacctggttacctaagggtcaaattctactcttattagtatttaaaggtcttcttgcacttggggaaatagctacctgtatcttcagattgttcatttatgcactcatttgatcatttactcattaataaatattgattaaatgcctgccttatgacaggcactgtgctacatactggaagtatgaaagtaaatggtaccaatatatagtcccaatccctgatacctatatgatctagttgagaaagtggacatgaaaatttttaaaaaatatttgcagcatggctaggctttaatagagacacactgcatggctcagtctcagcacactacttctaccacgcaggtctttttcacttaactccatctggacagctttgttctaaatgactaaatttattttttgaaaagtcaacacccctccagaattagttagaaaagaatagctagtttctgcatctcacttagctctcgtgtctaagcattttttccagctcttcccagactcttgagtttgagtttgaccatctttaaagctggagagcagtgtcaacagcaagaatggctgacagatagaggcttactctgcaccaagcactgttctggacactttaggtatcataagccatttagcccttacagccacccctgcagctgggtgttcttattatccccgtgtgacagataaggtaatgaggtacaggtgggctaacaggttaaatacaccttgcctaaggttacctataaggaagtgatagatttgggatttgaatccagcggtctggctctagaagccacgctgctaaaacactgtgccatttgcccctctgaccgatgctgttctaggttttcaaatatcagaccccacgaggcctttcctggagtaataaagcaagctaatgatcatgacggtgacccaatgctggagggcttatatccattctctcgctcagtccttaccaatcccaggagggggatttattgtctctgttttacagatgaggaaacaaggcttagggagtattacccaagtttacctaactagtaaatctttcagtttgtctatatcattaggtaaaaatgccaaatgagtcattgtttacaataataaacacatttgtttcaggaaaataaaaaggaatattttgaaacaggaagttttaatgtttttcctagggggcagcaggaaagtctaaaggacatgaatgtgagctttttgttatttgagtgtcatgatatctttagttccacagtttaagagagatggtataccacgttcccattactgaacttagggtgtttgatttctcctgtatcctgaaccaaagcagacgatctctaattcaaagaaagaaccatttaagcgttaatctttcttagcctttatatttatgtggtttagaagtttcttcactgattaacaatttacaaaatatttatttttgtttacacattttgacttactcatctcatttgactactaaaatagtacaagtaactttttaaatagaggattctttcaaactgtgacataatgtggtttcaatatatctgatgtacccaaatgtggaaacccatggcctgtaagaagagcctcacactcttctgttctaggttataataaaacgttcaaaattagaggagaacccctagctgcccagccacctgtgataacagtttctttgggtgtgaaacgtgcactggaaggtgacccagcttgttgttactacggcaccaagggatggtgcctgatctcgaaggtgtttggtgtatttatatgttacatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaggagtattctcaatttgtccctctacccctctggccaaatatgtaacatataaatacaccaaacaccttcgagatcaggcaccatcccttggtgccgtagtaacaacaagctgggtcaccttccagtgcacgtttcacccaaagaaactgttatcacaggtggctgggcagctaggggttctcctctaattttgaacgttttattataacctagaacagaagagtgtgaggctcttcttacaggccatgggtttccacatttgggtacatcagatatattgaaaccacattatgtcacagtttgaaagaatcctctatttaaaaagttacttgtactattttagtagtcaaatgagatgagtaagtcaaaatgtgtaaacaaaaataaatattttgtaaattgttatatgatatatatgatatatgatgatatatatataatgcaatgtaaagagggtagttatatgttttaagatttaatttggcttattttatttttttagagatggagtcctgctatgtcacccacatgggaatgcagtggcacaatcatagctccttacagcttcaaactcctgggctcaagccatcctctcacctcagcctcctaagtagctaggactacggtgtgagccactgcaccaggccagcttattttcaaatacggaggtgtaagagatatcaggagtggtgggaaggactgaggggtcttgaagaaataaccaaaaaaccaaagacagaccagttctactccttgcaggaactggcagggtctcacacaaggtgaggttcactgtttgagaggagacttttggaacttcttctaaacattagcaagggtaaaaaaggtttaactggccaagaatttttttttaaactacaaattaaattgttctaagtctggaattgcctataaagtaatcaactatatataggtgaaataggctttcctaagtgccctatgagccacatgtatcagtgtgctcatgatagtgtcttttgaattccaaacaatcagcttgcaaagcttgggaacagaattggctattgagtaaatccataaagtgggtctcctgtggtgctgtagcctcgcatttgcccgggggtaaggtaaaggtgatcagggttgattgcttgagaaatgttccgtctgaaaacagtagaatggagtgagccattctacatgaaatcctggcagggagcacatttaattttccattccattacctctgtgtttcctctctgacatttcagctttcctttgctgcctctctgaaagttgaacacctactaagcgtctggtctgatcaggtgtcgaaaatccaagctgaaaatggcagtgtttctgcccttgaggtgctctcagtctagctggccagatggataatccactgatggtatctgatttgacaataagtgtgtaagagtgtgctgtggaatgggaaacgttggactcaacctagaggagagtgactggggaaagattcgcacacaggtgacaagtgagctggctttcaaagaatgaggaggaggtcaccaggcattaacagtggcaggaggaagaatatgaatgagggatggaagtcccagctaatttgcctctttccctcctccctttggcttgccctgtctctgggtagtctgtttatgtatctaattaactggaatgggggcgtgtttatttggacagaggaagtataattaccaaggagttcagatactcaatacttggcaagtccagttacaaacaggttgccttttgaagagaatcagaacgagagagaactagcagaactagctacgagaacaggttgaccttgaccaagaacttttctccctgggaattgcatagggtccttctagacatccctggctccggtgacattctttcttctgagatgtcattgccttcagtcagatttcagtaaaggttttacaggtgtgggactacaatatctctgtatggtgactttggttgagggcttaactcaaagagcagcctttcttctctcttcgggtttttatgggataccttaatggcatcgccctgtactgcttgccctgtctgtccttgctttccttcccttgctgtctcttatacatgttctatttatgtcctctgccttacttggccgctttctgctttcctccttactctactcccattccctcatattccttctgtcaaactttgaaagtttgctcagtgcaaattaagaaaacatttccaaagagtgtttctttttctttttctggatgcatattttcgtcattatagtacattattaaccaaattgtgccttaccattttttttttcttgagcatgagcctgactgacgtgatcttttgtaagttcctataggcccatgccattcattattaccaagtgacatttcccaagagcctccagagtgtatcacagttgaagatcttttccttcctagcagaaggatcccacagtgggatggaagcagatatggtcatcaaacttttggattggcagatgagttagagatctgggtttgtataaactccagcacctcccactttcacctgagcatgggagtccctcagagaatttggtagacattcaaattcttgggccccattccagactcatggaatcagaatctctagaggggaactagacagcaccttatacatggaagttacctctagatgaattaaatgggcaaagttcccactttcaagtttactttccaactagggtaatgacaaaaagcaaatcaatccatccaccaatcaaccaataagcaaaaaaaaaaaaaaaaaaaaaaaaattgcagagagggatacaaggaaatcaagcagaataatattttagggaatggctgctgggctgggtattaatttacatggcacaaagaaaaacctctccaaagatatccccttggagctgagacctaaactatgaaaaggagctgaggaagtcaggtgctagggaagagctcatgtccatcttgtttacctgtgtcctgagtattagcactaacgttggctcctggtgggggcttaataaatacttgttggattatgcatgaagtccttggacagcaatgtcgtacccataatctgaacaatggaatcaatggagtgttcttgaagttcaaaggggttactaaattaagagaggttgctatcacaaatagaatatttacagaatatctgaggaaattctgcaagaagcagaattcctgaggaaaaagagaaaatgaagaaaagtgtataaagaagaacatgtgagaaaagaggcctggagggggtggccatgggacagccaaggagcttaggaacaaggagaggaagaaaacaagtccatgctcgcacctctggccttatgacctgccagttcaaagggtaaaaagtaattattgccatattcttgggattgagcactgtgctcttactaacattgctttgtatattacaaagtaaacttttaaaaagcctttagaaaacaaagacagtgttatattacatcactttgaagaaaattagaataaataccaattctaacaagcttagggaaaagttagatatgatcagaagtcacaagtggaagatatttcaatagaatttgaatgctgctctgaatcagactgctgccaatttaaaactataaatgattgccattcgaattttttcccctcctggcagcaaaaagcataaaaaagcaaaatgcagtattggagaagctgactatttaagaattatcagggtacactcacagcagcatatctctacatctgtgtgtgtgtccatcgctcacttagcctgcttttagtgagggcctgcaatagaaaaaaaagagagagagagagagatgaatgtgttttcccggtagtgtccagatctcagatgaaactttgtaactgagctataaatacttgctaaataattatttctccctcctcccctccaccccctcttcttcttttggtttagctgttttttgtttgtttgattttcagtagtcacaatggtggagtattgtccatctttcatgagaaagaatgaattcttaaaattagcccatgtggatatgaactgtgtgttcttggtgtccctggacttatttaatctataaaacaatcttttagcacctacacccatggtagaaaatgtcctctgaacacaaatagttgtctctaagcctttcaatgtgctttattcatgatgtcattcttcagagctctgttgactttatttagttgcagttcttaccagatgcggtcatctgctttctaagtcaactgtaaattagcaaactgaatggtcagcagtgcctgttaggggcacagggaccacgggtatggctgcatcatgagggcacaagtgaagggcagctctccagtcatatcgcccactctgggggtgacatgctcatggtggtgacagttggtcaagaaaagacagaggtgtgagcagtaggctccacttctcaaggaagggagggtatgcttctattttaaaggtttttaagctttggttatctggaagatggagtcattgaccttcatcctctgataataaatgaaagaatttaacaacccctacccccataatacataatctgtagtgacttccatctcccccagcccctgttttccaatggggaccagccagagttgtgctcttggagagaaggggaaaatgatcatttgtgacttttggctcagtgtatagtacaatatgtttccctgtgctttttgtgatttaatatacaactaatagaacaaattttaaattaatactgcaataacaaggcacacattgtacacaattgatttttattggttccacttcaaagattatgttgtggttttaccgttgaatgactccctcatacaaaatgcattgcggtgcatttttctatttagtaaactgtagataaaattaagtgaaactgccattaaaagattaattgggaaagtcagtcatgactttagagtttcttaacttgtatcaatcttatagtgtttcttgccgtagaaatctagtgcatgcaaaggtatttgttcccaaaatggcaacaggagtagttttagtgaagatgtattacttaaaagaaagacatgcttatggcaaaaaattaagagaacaataaaagatgtaaggaagaggtaaaaatcatttgaatcatgttgcctatagattatatgtgctaggattttgggatatttgtttcaggatcttttttaagcacacatatgcacagatgcctgcttaatttatcaatcagtttatttagtgaattaatgtagtcagaatggaatcatactatgcatagtgttttgtaacctgttttttttttggttaaaaacaataaataataaacatctttcatatcaatattattattttcaatagctgtatagtatgtcactgtttggatgaatcatgattttcaggggtgttagctgcattataaaattcctagatatagctgagtttactaaatgtaaagacttaaagtttttatggtttactaaatttaagattaaaaaaataagttctgtcaaccattcaaagaaaatgtcagctagaaaggaaaaataatcttgaaaacctatagtattcccagagtatttgtgacctaaaagctgaaagttcttgttgaatttttctgatatgatttcatcaaaaatgacaaatactagcatgatgaaatgagtgaaattcttcagactatctgtaaaaatcagatttattctttttttaagatatagctgttgagcactatatatgtatatatatacatataatatgtatatattatatgttgctattatacataattcaaaaatatatgtaaaataactcgagctctagagtagtgatgtagtgacgtttcttcacattgcacaactccgcaaagcaccgttatcattatattctctagtgcacacccagcaagaccttacactcaggaaagtcatgtccatatggagtttttatactggttttcacatcacttaaatagcctgaagggttctattactacttagtgtgattgctctgtaactttggaatattgtttatacatttgttcttttattcattatcagattttctgagtacccacagtaagcggggattgagatcctcagggtttgcgcaccgtactgatgaccaaggcaggatagtaggcccggcctcctgggcctttctctgtttgagataggaacctcagcgtcatcatcaaacctggcaacatttttaaacagaggtgcatttttaaacagagggagcttataaacatagtgtagcaatcatggatttgtgactagaatagaagatcagagagataaagtacagtactggagacctggagaaggagcggatgttcagtgagcccctttgcatcgcctcctataatgcccaaccagagagattcttaacattcctgtccatttaaaaacacagaacatggtggccttgcagagaacattaaattcagcccttgtgaagacagttaggcagcgtgcccttacatcatcttgggtatatcttgcctggaatcatttactcctctgtctccttatcttgctattcccagtgatgagccacagtgcctgacacttaacaaatgcccattgcatgttagatattgaatatctgagagcattcctgtactccatcaagatcccagtttttgctggagtcaggtgacatgcgtcttaaattttaccatgagattctctcacattgcacaatgcagagcatccatgtttgtctttctcctcagttcctagcactgcatgttggctgtgactaaaggaagctacgagagaaccccacaaccatcaaatgtaacagcagacaggacccttacagggcattctcatccaatcccagtgacatatagatggagatactgggagcagagaaatagaatggccttttaaaactcacactctagtccaggatctgaacttgaatcaagactccttgctccttcattcagcaaacatttattaaacaccactaggtgtatagcatttggctaagcactgggtaatctaagttgaataaggcacaaaagagatctcccctgagggtgtcagtctagcaggacagccagatggatacagaaacagggcagagtgtgagaaattgtgtgcgcacacatgtgtgggcacacagcagcaactgaaatactctcccagatctgcttataagttgcctaagaaggacagcagaggaagtaaccaacactatctgggtagtcacaactaatattctctgagtgctttctgtgttggacactttccacatattatctcattccattttcacaaaaatcctgttgggtcatatcatcatgctccttccatagctaagaaatggaggcccaggaaggtgatctgatttgcccttagtcataaccaggatttcaactcagggtctgcttgatttcaagcctatgctcattttactataatggggataagtaggtttcatttcaaggctgattctatttgattgccagagactgcttggagcattgtgctgcaagagattctaggtcatatctgagcccagaaacaaatagtgtcatggtttcttaatcatgagtggaggatggaaagtggtatcctgtgtcaggaccatgtcattcctgaactgtaccatgctatagttcttccaggcccatctctctgtaaggcagcatggtttcaaccgctaccccagtgcctgccacttcattcatactcctttcctctgagctcagaatgatattttatgccatctgttatgtccagaatgttgtgtcctaggtaggtcaagtttcttgtgcaatgcccaatgctgtagtcctttcaaaatgtttcaaccccattagagacatctcttatacattcctccagggcactgttctatgctcatgacagtttatgtgattaaatattacatgcccacagcctaatatgttagcatttctaggtaagttgcaacagaggacttctgaatccaaaggagtgacttcagcaggaagaatgtccaatccttgggaaggttagttgggatctgtcattctttaagattataccaggcaaatagctgctactctgtcagtacacacagctgatctcacaccttttctctgtagctctgccacagagcccttgatataatagctagtgaagtattgaggcattgctgtttagtacacataacacttaaagtggaatctggaggtggagatggtgttttcttacatggtttataacttccagctgttgcctgtagttaaacactagaattaggtctaggcagtggttctagctggtatgcctctgctttaaattttatcttttattgcccttggtatcaagattttcagtttttcaaagctggaaagctggccacaagtttaaaacaagtatctaaaaccagttgttagagtcaaaatacccaacactagtaacgatagtgttaaatgaatcatttatggaatgtttaactgctcatcatctatttgaagcatcttggtgtccttttttctacagtaaaaatataaatcagatttactaaaggtgtatattttcattcctttcacatcggtgacaatctattttctgagttattggacttctgaaatgctaaatgaatatgaatttgactgcataccacatctgaaagtgttaatttttaaattgttaaacaaattctttaatgtcgtaagagcattttcacttaaatattctgttaatgtgtgacttacacattataatgcttctaaccaaaagtagatgcttactttgaaattctactttaaaaattccttttcaaataagaagaatgcctccctaggttgaggtccacaaacctgacttttatgtagagttataattttctattttagtaaatcagatggccctgcggcttactaggttagtattattgcttgtgccctgctgctttttcctggactaaaaacaaagattaagacagtgaacagatttaaaatatatcctcccttgtgatgaaattagtagtccatgtggcaaagtgagagtattctacgtgattgtttttatcattatggatgttttatttgtgtgccactcatatgtcaacgttctttgattaattgcatgtgtgaatttttaaacagatggaaatatggctgcaagtctaaatagaaggaatagaaaagtttgaatgttgaacaggccttgtgtaaactgagaccttatccatcaccaaaaccccaggaatgctgaaccatcttaaatacgttccagtgaagggtgcttctccagatgggagggtgttctcccttcttatttcctataatgtggagatgaggtattcaccaaggtactatttgaggtattttgtaaacttccaaatttgggtgtgggggttgttatcgagtatgtaaacaataatgttgactaggtactttgcaagatcttttacttcgcttgtcaccaatataattgtaccttccaaagtgttagacattccttaatttgatgtttctgattaccttaaattgcagtcattaagatatcatctcagtgctgtaattgaatattctagcatgctattcacttaactttaaaaattaacattgaactcacgttattgatttttgagtacaactctcaaactagtttatttaattactagaggaaagcttatttatagtctaattgaactattagtgagtctcttaaacaggtactgaaggaatgtagaacatcattaaaataaaaaaaaattgcttcttatcaatataactgacctgtcacttggccacagaaggaaataggtttgttatacaaactgagtcctcataaaggcattcactagcacatggtaggtaattgcttagtaaatatttattaatagaaggacatttgcctcagttaccacctactgctgatgactcccaaatcagcatttcaatttggagctctcagagttctgacccatgctcctggctgccttctacacatctccaactggagaagccacagacactctaagtgcctgatgcctaaaactgaacactgtctcctcttaaacctgtccctcctgtctccctgcttagttatcatagccacatgctacccactcaccctggagtctttcctcccctcacttcctagatccaaatattcatcaggtctcacatttccttcccccttacagcttctctgaccatctccacaaccactgcttttttcagatcctgatagtttcacctggattttagctagtcttcagatgaatctccctttgcaggccagcagtactcaaattttaccacgcaaaagcattccctagggagatggctaacatggagatgcctagatcacaccttcctcactttctcatttggcaggactaggttttaagaaatcagaatattaagcaggcagcccagatgattttgatgcagactggagttgacttctagttccacaaatacctctagtccgtcctgagcacttagataaaaatttactctaaaatataagatttgttcacatccctgattaaaaatcttcgaagaactaccattcaataacagtatttttaaagtagtggtcagtagagttgccaagagtccctcagaggggcctcagtgtgtggacgtgtatggggagagggtgtttggagtatgaagatgagagcccattctgctacatagggctttagttaacaccccctctcctccgtctctttctttagtcagagcagctctgattttgaagtttaacgagatatttcctttgggaaaagtattcctctacttaaaaaaaaaagaaatggtttgaaaaccactgatctattgaagtggatttcaaactttaaaaaaaaaaaaaaagcagtacccacagtaagaaatagtgtacattttgtatcacagcccagttcacacacttatttttctgtgtaattgaaacaagttttatggaacatgcccttactattacttgatgcactctgatgttttctgtttctatttcattttttttaaaaaatcgctggttgcaactcactaaattgatttcacaacccactgaattgctactgtgtctggaaaaactttgatctagcaattctcagtggggttcctttatgaaccaaggaacatagaaagattttcttaatcttttcaagggtggtacataactcacaccattctagatgcttagaagagaagttagttcattacatacaatgggtgcctaagggcattcagacttaattttctgcatgaactcctggttaaaaaaggcttattagtgtctgatctgtaataaatccaaactcttgattattgcacacagggcccttctcaatctagccctgtgttcacctctcagactttaccttacttcctcaatcatcttcctgggttaaaaccatcctgaaccacttggaattacccagatgcttcacgctatttctcacctgtgcacagtcattcttgcccttcagcaccagctcaactgagtgtcacttcgactgagaccctcattgacaggagttagagtcgtcaggtccaggttctgtccctgtcaatccctgaagtgattaataaatttcagtcacattcacctggctcatctcctgtgctactgagtgtgggctagatacttagttctaagaatacaaacacatgaggcacagcatacctgcttagggagcttagaacacacctgagacacaagacgtatgtattaaaaactacctctagtatagctcaatgctcaagagtttgcatggggaagtcaggcctgagttcaaatgataacttctattttttggcttgtgcacctaggacaaactgttgagctactctaaacttcaaatttattgtatgttagtctaggataataataaaagtagcaactttgtaaggctgtgagttttacaggggaagtgcatgtaaagccctgagcacactgcctgacccagagttctcaggaaatgctagagaggaattaagcaggtaatgtgcccagtgccacgtgaatgctataggtagaaagtgctacaggagttgagaggaggaaatggacactgtggtggaagagatgggagagctccagtggagaaggcagagtatgcactaagcttagaaagaaaagcagacctcagattaggaggtgagaaggcattcctggcacggcgagccaaagagcagcagaggaggactgtggatgccttgcctgtagactacttttgctgccactctttgtatatttatttttgcgtatgtgctcaaacattttcccaaatgcaaattgaagatattcatctctagagatgcttattttctcatttgaaaaaactgtgctccctctctcttttccatggctttttgctaagtctatatggcatctataattttgcttatggagtcagcttgattaaaccattttgggtcagcatggagaaataggttacaaaactggctgtgcatcatgatcacccagggaactttttagtcctgcagatttctgtgtcccacccgagattctgactattgggtctgatgtgggaccagagaatatgcattattttaaaagttcctttaattttcatttggcttggtcaaaagtttgaaaaacactggtaatctttaaggccccacccagctccagtgatctgtatttcccataacagtaacatttttattctctctgctattctcaagagagggttactgtgttgtcaagagagaaaaactaaacaagccagacatcaaaagctatagctaccaactttgatgtgaagagtcctttctatatgaaattgtataattccaaaaaatccaggtgggagtgttccaaggtccttatgctgacgggaaggaaggacaaacactggccaactttatactttgttaaacatgtaagtcgagatttaatagagtctacaacttccaaaccagtggaagggggaaaatgaaaccaaaggaaatgaaaaaataaaagatctcaatacgaaaaaagagagggggaaaaaagcgaaacatagaaaaaaatgaaacaaagaacaaaataagatgctagaagtgaattccaatatattgataactaaaatcagtgcaaatcacggtacagttaaaaaacagatcaatctaaacaatatgatgtctaacattacatccgtatattggaaaaccatgagaaaaagcaagaagatgattagcccaaaatgtatgatacgtttatctcaacaggagagagggctcctggggtgggcacccaggaagctctaaagatacgatagtgttctttgaagtttctttaagttctttaagttgggtggtaagtagacaggtattcttattttttttattcttttaagcattattttttaaagttcactatattttttgtagttttgtttgaataatataatacacccccctggcatgcgtgcatcgcacacacactcaaaaaaggataaaaataaattgccaatgttttcctaaagccccactctcatattattagatgtgaatttttaatgtgattttttgttctttaatgacgtgatttttttgtcatgaaagttttctccccagcacaaaactctgttttgaattaatcttgtgacccaacactccaaacaagtcttcacattgatgctttttgtcataatacgataattcctatatagtttcccttttcgttgaattacataaaataattcattcaattaaaaccttataagctttttattgagcaatgatcttgtgtcagatgctgttttaatcattgtatatgaattaatccatttaatttttataaaaacccttgggaatggtactaatcctgccctcattttaagcctgaggtaactacagcacagagaagttaggtgatgtggtcaaaggcacacagccgatcagtggaagagccaggattggaacccaggcagcctggcaccagagccatgttcctgactttgtgctaggctgctcagctgtggcccgtaaagcatcttactactgaagagagtgaaggaggagtaggagggtacctctggacttcaagggcccctccatagtatgtcatgtctgaccataaagctacatatatcacaattacatcattctttggttgttaaaggaaagatttttttttttttttttggccaggaaaggaagaaagggagggagagatggaaggagggaaggaatccaaaggaatccaacaaaaatattggctgattggctggccgtggtgtcagaagagaaataaaaatctgctgatctcatctttatgctgtttccaatgaacaacaaaaggcaaatgttcttcgacagaacagcacaaacatactaggtggctaaactagagaacaggtacttcagagatgttgccttaagcagatgctccccggcagtgaccctgggaaacagctgttccaagcctcctccacctggaggccaagatctctctccaaacacatctcagaagagatgcacagtttatctaacagttcatactttgagggggtttgctctatgttagcagttaaacataagtcctccccacgcacctccacaccctaggctctgtagtcttggagaattcatagagaatgtggagatgtcaggaacattcaaacaggtaactggactaattcttaaaagtgaggggtgtgtgtgtgtgtgtgtgtgtgtgtgtgtgatagatcctggaaaatatttatcacttagttgcctaccaatctacataaatccagaagaaaaaaactaaaaggaatgtcttttgagtatttagcctcaatgctcagactatgactgctgggaaccagcagggttcaaagaagagtttgtgtgatgcccagattactttaaaaaaaaaattctcagcattaacaaatatgaatgagtgtccagaggtacgcatctgggaactagtagataaaattcaatatgtgtctcctggagaaaaggctaaagaaagacagaaagcgttaactgtcttcaaaaacctgaagggcatcacatagagaaagcacagacttttcctgggctattgcagaggatcacacaaaacaaatggaagagtacaacaggcagagtttggatgcaagccttcttttcaagtaaatgaagatatttatatatttttttgctttttacttttttggagatggagtcttgctctattgcccaggctggagtgcagtggcacaatctcggttcactgcaacttcgcctcctgggttcaaacaatcctcctgcctcagtcttccaagcagctgggactacaggtgcctgccaccatgcccagctaattttttgcattttagtagagacagggtttcaccatgttggccaggctggtctcgaactcctgacctgggtgatccacccacctcagcctcccaaagtgctggaattatagatgtgagccaccacgcccagcctaaatgaagttatttaagagaagaaaccattgttcagcagttgaagagcctcccttgaccagggcatttcctttgcctggattgttctgagatgtacaaagggaaggcctttttcctatgaatgaaagatcaggctaagcggcttctgaactcttttccaagtaggaaactgccgaattctgtgaaactgtggcttttaactctccataaaactcaaacaaatttgacttgtttgtttctcagacacaattatcgggtggtatggctaaaaacttactaatatgaattctcaagttggtagttgcaaacttggctgcccatccagttccttcacttgtttcaaaccagtctgaataaaacaaaaaaccagtctgaatctgtcacattgattgcacacccactaacaagttctgacccaccactagaaaaactcagacctagcctaaagtcagtcctcagtttacagctgaggaagctgagcccagcgcaatgacatgggtctcccagagttgtacagtaagtgaagaattagaacccaaatctctgatctcttatctccaagtccagttctttattcacatatatcagccagaccgaaaataataatacaaggtggagaaaaaagggaaccactgctgaaccgtaattatgaaataaggaattcaacccccctgctagctactaaacatatagatattttttgtggaaacagagcacctcatgataactgctgctcagtgaacccaccacagtgttgggtaccactttccatgacctctgatcctcacaactaccacctcacatagttgggtttattaactttattgtataaaggagggaatggaggctgagaaaagtgaagtaattcccataattcgggtcactcataggttgagctgtgcatacatgtctgaccccaaagttcgtggctcttccctgccttacactgcctctttataatccttgtctttccctgcttggtattatatctcttagaagtaagataaagcaacaagagaaatactatgcagaactaattctaacaagtagagtagttggtgatatcatctatagacttgcttgtttgtcgtcttctctgttagtattttagctccctgagtgcgtggccttcacctcactcactgtctagtacagctcctggcacattgttagcttcagatgaatatttatgagtggacaagcaagtgcatttagaaatgacaaggacattcgccgaaagcaaccacatcatactacagaggcgggtcatatagtggcccagggcacagcctgtggagaaagacggcctctgttcaaaatcgtgtctcttaagagttatttgatcataggcaagttacttaacttctcttgtgcctcggtttcctggggataataataatgccaatgtcatagtgtggtcctgtgagttaatcaaggaaagcgtttgcaccagtgcctcgcttatagtaagtgctgtataaagatgagtcgttattgctatctgaggttatgataatagtagggaaatagtggacccatgtcttaatgggagaaaaatatcatgaaatttagagataaggtaagtatgatgctgtggctagagactcagaagagactacggttcatattcaattgcagagtctgaaaagtagatttttaactatctcatcatgaaagatttatttctgaccaaaaaatctaaatgtagagcagatgattatgcagatggcccgtgaatatgtcaaaaagaatatagtgcttactaagcatccacatgaatttatgaagaatgaaatttatgagcaggtgatttggttaaactactagaagaatgccgtagactcattgtgtcttattttcaagagcacatttagaaaatctgatttctgtaacagcagaatgtagggtgaagtatgggagccctggagtcagagagttctcctctcatctccccctagaattgggccttggttttcttatctgtccaatgtggataatgagtgcaacaaagcctcccagtgtggttcagagaactaacggagatcatgcatgtgcactgcctcctaagcagaatgtaaatgtgagtctctcataatcacaagacctgggtaagcagaaaagaaagtgaaatgaaatgtgattgatagtcaaggaggttcccacctatttgcctgtaccaagcgtaggtctcaaatgctcagatggtaggtggaagtttgccttgcagttgtcaaaacaaatcatgagggccccttgatgccactggctaaaggctgggagagaagaaaacctgaataagtcccctaaggtctgagcatctgttgcctcctcttctctccttgcaggggcgtttgtggtatgctggaccccgggcctggtggttctgctcctcgacggcctgaactgcaggcagtgtggcgtgcagcatgtgaaaaggtggttcctgctgctggcgctgctcaactccgtcgtgaaccccatcatctactcctacaaggacgaggacatgtatggcaccatgaagaagatgatctgctgcttctctcaggagaacccagagaggcgtccctctcgcatcccctccacagtcctcagcaggagtgacacaggcagccagtacatagaggatagtattagccaaggtgcagtctgcaataaaagcacttcctaaactctggatgcctctcggcccacccaggcctcctctgggaaaagagctgttaagaatgattacctgtctctaacaaagcccatgtacagtgttatttgaggtctccattaatcactgctagatttctttaaaaaattttttttcatagtttaaaagcatgggcagtaaagagaggacctgctgcatttagagaaagcacagaaacgggagaggttcggcgggtccctgcttgtcctatgaactgctcagagctcctgtcagtccagctgggccttctgggttctggcaccatttcgtagccattctctttgtattttaaaaggacgttatgaaagggcttagaccaaaataaatcataatgttacttgagccaccttatatagctgcttggagagtctatgtagttctttctgcatgcattaaaaatgtttagaaatgcttcagcaatggtatttttttcctcaaagaaaccatggccagtagctaggtgttcagtaggaatcaaagaaaaatcagtaagagctccagattaaacctgatttttaactgaaggaacattctgaggaaaaatacttacttaaaagtaaaaaaggtcaatgtgaaaaccctttttgacctgaaaaaggccttagtatggtcctccatgcatgtgtgtgtatatgcatgtgtgtgtgtgtgtgtgtgtgtgtctatatatatatatatatatatatatatatatattcctgtttttactgatttttattgattttgttcaaagatatctggggattggattggggaatgcttaatctgactattgaaagaaacatggatccctggagtatttcagatacggggttaccgccccagactgcctcccgccagcccacattagttctcattttccctcatgatggtgaaaaacagtggagagctagtaaagggtttatgcagaaaacaaggagaagagaatgtgaagtttgaagtgcctatggaacatccagctgataatcttgcctagtaagagcaaaagaagccaagagaacaccaacgtttaaggagcaggtagagaaaacccagcaaaaggacagaggaataagaggaccaaagaacaatgttaagaatcaaggagagaggtcaggcacgctggctcatgcctgtaatcccagcactttgggaggctgaggcaggtggatcacttgaggccaggagtatgagaccagcctgggcaatgtggtgaaattgcatctttactaaaaatacaaaaactagccaggcatggtggcacatgcctgtaataccaggtacttgggaagctgaggcataagaatcacttgaacccgggaggtggaggttgcagagtgagccaagatcgcagcactgcactctagtctgggtgacagagcaagactctgtctcaaaaaaaaaaaaaaaaaaaaagactagagaatgtcagggaacacatgtgtatatttaaacaacttcactttgcatttaaaaactcgaaggacagcgaaggtgaaatcaattcacgggccacctagactttccagtctaggactagagctgtagcaatgatctgttgtgctgtacaagaaaagagaaagaggtgttcatttgagaacagatgtttttatacatcagagtaaaagctgtattgaagagcaggctgaatcccttccatatagaatgaaatatgagcttgaccccagtccttatcttcagttacctccataccaactggtggcatgttggatttagcatgtagaataatttcccatctcttatttttcccaaggttaatggcatccttctggtacctggcttacatgtgaactgaattttgatctgggttctattttgaatttttctccttcagagacctaagtaggcaacatgaaagacaagtagttaagaaagaaaaaatgatgtttcatacacacaggctaccaacgagagttttctatgtaaaacatttagagtgtattctgatttaaaatgagaataacttcaaggtagatattatagtatttatgtagtttgcaaa

SEQ ID NO: 13733 - DNA, 162841 bp, Human
gagacctagaattcaaaattatgttaaagtgccaaattatgcacacaaccacttttattattaaagaggatttatttaaaaaggtatacatttaaaactcatcccaatgacagtagtatgaatattctgataccagaaagattccctctagaatacataatatcaaaagttgtctttaatttggtatatatgtggttcagtgctattcattgaactttctatgtatgtggggcaaaatattacatccacaacacagaaccaaacgtggtgatgacactgttgtgacactgttgcatgctgacacaaaacctcacagcatctagtccaaatctttgcttcactatttttattttatttgaattaactgaaacccagaaaacaatataatacatttccttgggacgtatactcactatgcgtctatctcttcaactcaatgggatttcaaatggagagaaagcaatttaccacaacatccacaagtttttgtcaacattatagacaaaggatcagactttggagcccaattgccagggttcaaatcctgcttccaccagataatagctgtgtaaccttgggtaagtcacttctttgtgccttaatttgctcctaaaatgatgacagtaaaaccacatctctcatagggttcttatgaggagcaaatgagttactgcttgtatagaagttgtaatgcagtatacattactaatagaattggcaataataggaagtgtactaagaatctttttatcgctccatcttttgtcagtaatgaaaaattttttaaaagtctgagaaatttcaagtcaacaggtattcataaaacacctactatgcctggtgccttgggaacatagaataaattgggaagttacagtctattttgaatttggaataaatggaaaacacagagcaaagttcaatggaacatgcaacaacaaaaatgctagagtgccacataatttacctaagtaaagctaacagcaaaatcaagtactctaagatttatattaataaaaacgcaactaacaattggtaatgtatttattttcagatctacacagaagttgctaaatacaatgctgtacatcaacagaagttctgcagaaatagtaaaattttcctttatctccacctgggaagtctgaaaacatcatagggcttgtgactggggcctaataaccccgaggacaacgtggtgggctgagcgaatacctcaatgtgcgagagaacgaaaagctcgaaccacgaccgtgcctagggaccaggcttttcctgtggccgatgcggggcagatgcagacccagaggccacccttgcgcgcgatctccaacccgacggtgcggctcctctcggacctggagctgtggggagaaggcagccttttagtgaggagccgccgcgtggcgggacgcaaggaaaaccacccgagccgctgaacagtattccgcgactgcactccagggcaccgggaccgccagggtgaggagggactctgcgttctgcaaagctagcggttcccactccacctcccactatctcagcgatgggcacgcgagcgccagcccgggcgaccgcgggggaagaagcggtccacgccacctcaggcccccgccccaggctctgccagctgggggtccaccgcccgcccccggggtcccgggcctgcgcgtcacttccggcgcgcgcgcccgcctgcgaagatacagtcgggccagggcctggcctgggcgcgcggctgcccgggggcgcgcagagagggcggaccgcgcgaagggggagtgtctgcccgccgccgccactgctgctgccaccgccgtcgccgccgccgccgccgccgccgctgctgctgccggtgctaaggagttcgctggagccctttcctcagacccggcccggtcttcgcgcccggactcctggcgccagcgctaggcgcactcaccgctctgacgggtgcagacgcgggagttgtcccagactgtggagtggcgggcacggccccagccccccttcccttccctgaccccttcttgccatcgccccagacatggggaacgcggcgaccgccaagaaaggcagcgaggtggagagcggtgagttgaaggccgggtctgggtatccgctgggcgggccggcgcggggcaccgagcgccctccgggtcgcagcttctgaggccgcgggcacgggccaggcctagcagcggccgccgggagtcgttctggggggccgggagaccagctgcctttctcctccattccgaccccccagctccgcgttgagagctgaacgcgaagggccggatgtggggatcctgggaagagcgttccctgggattccctttctcactctagcgaggaggacttgcacacgttctggaacacttccccaaatatggtccgaggaaagaagtccctagtgccatcccacccctgctttcccccctcgccgactctttgggagctacaggtagtgctgtgggtaaggttggctcttctccctccatcacttgggtccgacccaaccttatcacaaggcgggggctgctagtctggctctacgcaagtgaggctaatcctgagtggacaaccctgccttagagatccttcatctcttcagattaggaatggaaaacataatgagacccaacagcaactttatccattagagaaaaaagccaggcaggtttgccttttctctagacattcaaggatctgctaccaatgcctgtaaaacttaaaggtcattcggagttgaagtgcttccagaacacggttaatttcttctgagagcggaaggtgcgggtactccacactttacatcaaacagtaaaaaatcatgaaaatggaatttctgtatggcgataaggtgtgtgtgtgtctgtgtgtttgtgtgtgcatgtatacacatgcatatatatgtgtgtatatatgtgtcagaatggttgtgaaataaaagttggtttgcctttgtaaagttcatatatttttataattcagaatgtccaaataacagatggtatttgttatatcaccaggagtgaatgacatgttagcacttaaagtgggcctggtgattttagtttgtgtaaatattacttgtaatgttttcatggttgtaacataagaattaggctaattttataactttgcatgaagaaaatagcttttttctgtattaataaagtagaattcatttagaaggatttagtcattcattttgtttaacataaatatatcagattatgtggtttatgtttcatcagtaaggttttggtattcattttcaggagcttcagaaaagtttgatgagctattatataagccaagaacacacagcatgttatacggagatttaaagaagccaatgtagaggtagaatgtatgttattttattattattttttgagatggagtttcgttcttgtcgcccaggctggagtgcaatggtgcaatcttggctcactgcaacctctgcctcccaggttcaagggattctcctgcctcagcctcctgagtagctgggattacaggtgcccaccaccacacccggctaatttttgtatttttagtagagacagagtttcaccatgttggtcaggctggtctcgaactcctgacctcaggtaatccacccacctcggcctcccaaagtgctgggattacaggcgtgagctaccgtgcgtgacctatgttgtctttttaaaattgcacaaatatagtaactaactgtgcaggaagtataaagaatgcaaaaagtataaagaattatttttacctgatatgttgtcattttttgtgttaatttaaagctctattaacttaaaacatgctaattgtgttacaaaagagtgtgcttggagaatgattatattagtagttttcattagcaagtgctgacctgtataatgtttatattttggataatgataatagactcttctgtgacctgtatattttttattaagttaccaaaacaattctcccttagtattaatttgcaactcatagctgtgaaataaccttggaatatttactgaaaacagaatggaaactttaaatgtttatctgaacatatttaaattatttctatggataaattcttttctatgttttaagtgttaatgacaatctagttcttaagtatgttagtcagctttttgtgtaactttatttatggaaactgaaggtcattatagtagtttaaaaagctgttgtgaagtgaccaaaaaaaatagcatgttatgtgtcatagggaaaattatttgaaatgtcacgtgttgattaatgtttgtaatttcatttggagcagtgttatcaggtatatgttgctgttctgtagtgaacaaagaaattgtattttaaacttaatgaaagaactcatcattacgtacctaaatgttctgtgtattttttaaagaattattcttgaaaatttgtttttcaaaacttttagaaatatatgatgttagagatcagcctgtacaatcattccctttcaaagatcctgacctccgaagaagctggagttgagatcatactgttagtaataacagagtaaggaatagagtctgatgcctggactccattcagcatcaataaataatcagttaatatgtttattttcaaaatattcaccaaatgttttagtttcaattaaagactataagtaaaagctgaaaaatgttactgtctaatgggaaagaaaatatgtatatataagagttacctgaaaggcaaaaatacaagtgctaacattatggaaagtggaattagaactctgaaaattgctgtatgaaaatgtttgatttgaaaagttgattaaaaatatcaagtcagttaagatttcaggttcagttagcaccaagcttcagaaaggcaggtgattccagagcttatttctaaaaatattccagaagaatgaagttaggcataaagataatttagaagggtcttggttaactttaactatctggtgcctgtattgtactctactgaaccttttccctctattagaattaacattttctggggtaagacctaaaagctaggtgagattccatcttcatctccacaggttttggagataacattaacttaggtacctgttgttctgctgtagtgaattaggaaattgtattgatgtatctcaaaacttaatgaaagaataactggtactattacatacctaactgctctgtgtgtgtttttaaaattactcttgaagatatattccttttaaaatttgggcgtagttatttaaacgtcagctaatacagagaaacataaacttttagaaatatgataaaattctcagagaagttttaaactcttgtcagttaagtttgttttacttatccagtctcttccttttacaccagccccagtcaccaacacaccaaaaaaacacgctacttcttttaacctgggaggggtttttatttatttcattttaaaaaaatactatacctccaggttgcctatggggctttgtgttatacattcattgcaaaaatgttgaggcccatgggtgaaaagtgttggtagaggtttgaatgtagattctttcatgactgcaagtcgtaaagttaccatgtgacctagtgttcgcatatgatctttgaatgttttccagagtatctctctgtcctgtggatttgaaagtcagtaggaattaatcaaagaaagccaccagtagactaggttcaacaaaaatgcaagtttcttaacaactaacattttttgaggactaatacgtgccaggttctctaatgctttccgtgtataaacttttacttactcttttaaactgtaaagcacttgagttattccttcatttatggatgaggaaatgaaggctcagagagcctaagtgacttgcttaaggttgcatagctagtaagtcaagaagcaacatttaagttgaggcaactgtaacctcagaacctgaaattctaaccactttgctgaacagcctctgtatccaatagaatagccgatgctaagacacacagaatagcttagacaattatagcacatttcagttttcaaacatgactttatttggtatattaaaatcttaagtgaaaaagattatttttttcttgtaccattctctggatttttatcatcattatcttttcagattcaatatagtagaatttcaaattaaaccacataaaactaattttatgtacttaaagccttaattactacagtacttatatttgttttttcccatttgtaaatgtatacttttcccttcttgcccaatagttgataaaaaaaattattatttgaacttgtattaccattttaaaagtattggcaaattctcatttcaccatgattagagtagcgctgtccagtcaaacattctgtgataatggaagtgatctccacctatgctgtccactgtagtagctactagccacatgtctgttgagcactggaaatgtgactagtaccactgagaaactgaatctttaacttacatgtggctaattagtgtttggtatattggacaacacaggtttagaacatagttgtttttgcatttaatagaaatgccaacccatctttctgtcatcttggttatttgtggatccttacaagtgagtgtagatgaacggaatgctggatttattttttctcatttaagaattaacttatttcctcagaataagcatttataaacttagtgagcaaattattatagttcaataatttgtgtttaatttattaactacaaagttaaattatttttggggctgtactagaaataaaattttgtgatttttagtaatctcagtgaatatcttctattgaaaaatttctgtagatttaaatgcaatatagtgatttcttataccttacttaggtctttacacctttcaattatcaaaggaaaatcagtagcagatatttgttccaattctgtagaatgcagaggtactggggaagtctttcttgggtgtaagacaaaaaaatcaaagcaatcagttatgcaattttgatgataaatacatatgatctcatcgagttccatgattctgtgattctgtttgtgcagattgtgtactgtatcaaattatctcatgttcaggaaccatttttcttattctcctcctcttattctcctcagtgtccttcacttaggctgtagacagattgttgctttttcattgccagcagcaggataattagaggcatgaaagccagcttagaaaagtaagccatggctgagtgacagaagcagcacgtgagaaggtcctagataagccaggatagctattaagatcctgtcagataattaatagttgaccataattcattttgacattccattaaattaatttttaaaaattagtacaacttatgaagttctatatctaggtgataaatgtttgtatacgtgggtgatcaaatttcctcagattaataaatcctaaattcttagtgaataacattgtgttaaatagaaaagtgtgaaatttatgaaaggtaaatatgcttaggtcactatcattttgggtatttaatcttacttttaaatgtattccttcaagaatgtcctgtatagttctttgttcattgcttcattcattcctttattcagtacacataattgagctcctaaaatgtgacagactctacacaagactatgggaataaagattgaataggacagagtacctgctcagggtgcccatattccagaagggggaagatagacatgtcagcaaacacatgaaacctgccacaaatcctttcattaaagttcagctggggaaccaagggaaagaatggtcatttccactgggatggggaggaagaggttcaaaaaggacttcaaagaggagttgaaccatgacttgagcattgaaaatgataaatgttcatcagatggattataggaggaagggtgttctgagtagacagagcattgataagtgaagatgcagaggagtgaaaccatgtaacatattcaggataaggaagtaagttgcccattatgattaaatgatggaatgtggggttggtgataggaagaggggacattgtataatgatagatgaaactgaagaaatggacagagggccacataatggagagagtttgaattttatcttttagacactagggagccatcgtgcacttggaaataagagagaaacatgatacaatttgggtttaaaagaggttactttggtggtgatgtgaagataaatcattatggagcaagtggaatagaggcaagatcaattataagactcctatgataatttgggtgagggattttgagggtctgaaccaaggtggtagaggttgggatggagaaaaggatctgaaatgggagaaatttgaaaaattgagcagaatgtattgtactgattgcatgtgggaaatgaggaaaaggaggattggggatgacacgttaagtttaagcttcaatgccatggtagatgggttgtaacgccagtaatagagtcaggaaatgaatacagagggcaggagtacattgggggttggggtggggacttactgaactcgggatacccgtggcatttctgataaatgatagctgattggttattgtatgtgtggattgtcttttatctcccagccatgggggaaaatgcccttggatggtcaagggaccttttctacattttatcctcattttactcttttcaaagacaactgtttagaaactatggaaactataacatctggcataacttacataagttaagaattctatatactaaaagtttagcctttttgttttgaaaagaggaaagccaaagtactgatgagaacaatgtaacttttaaggaaacaaagtaatttaaaatcataaaatattacttttataatttaagtgtgcgtcctctaagctattcggttttgtagttatacaggatagtggaaagaacatgtaaaatatagcaccaacatctattatgtactgagtaaatgtcagttttattcccctggagtcctttaacatagatgtttaaaagttcagatgtaatttagtagtaaaatcataaacttgagagtaagaaaaatctaaattgtcttttttctaatacattctaatatctcactttggacaaatgttttaaaatctccaagtgacggtataaaatcaagagggatggattggataatgacactgtgatctcttcttccagctttataatccaatgcttctattatatttattaaaagaaaaaatacacaggaagcagcaagatgagggaataaatcataaaaagtgctcacaaaatgtgtgggcagagaagtggcaaatgatcctcaattgagcaaataaatatatggtaatgtatttagggaaaacttttgatctacatttaaggaatgatagtaaaggacaggagtgcccttgtcaggcagggagggctgggctgtgcatccctctgcttgcgctgcagggaaatgtctcagtgacttttcctgaggaggttcctggcctcagtcgtctccaggaagccctctcaggatcggtggccacctctcacttctggagccctgcagaccccacagtgcagtcctggtggcctggctgtaacacccaactcagcccagaccatatacaccaccagcatctcctcaatgaccattaatatccaggatggacctgactttcaagaccaacagtgagacgccagtgcttgtggatttccacgcacagtggtgtggaccctgcaagatcctggggctgaggttagagaagatggtggtcaagcaacataggaaagtgctgatggccaaggtgtatattgatgaccacacagacctcgccattgagtatgaggtgttggtggtgcccactgtgctggccatgaagaatggggatgtggtggacaagtttgtgggcatcaaagatgaggatcagctggaggccttcctgaagaagctgattggctgacaagcaaggacaagtcctggttcccttgcccccatgggaccccagtagaacttggcccttcctgctgcctccctcctgtctggcccctggggcccaggctccagccatgagtgcttctgagctggcggactgcccaggggccatcagaagatggtgctgctgctgatccggggactgccttcttccctcccacatgcctttcgtcccctccctctagggcctgtggcagttctctcaagatgcatagagagagcccaggccagcccacagcactcctggtcaggcagccacaccttggtcctcatctctggtcccttccgatctgaagcctcgtgcctggctcttctgccacctgcatttctctttcttgctgctgttttgtaaaaagaaaaagaaaaaagaagcccaaactagtgagaataatttataactctctcggtttttgtaggtctgtaataaagaacttagtcatcccacctcctactgtgaagagcagaccctgggtcccacactcaaatcccctgtagttgcccatcctcacccctcagggagccccctcccagctagcctcccgggcagggggcacagaaaatgagtggtgggctggggagccctggagagccttgactctgtaaggctcgaggcacctcctttgccccttaactggcctgttggtcctctgagcagggggcttaactgtgaacaaatcagacaataaagcaagggtctgcacctaaaaagacaaatttatgaatcactgtactgatctttgaagatattttcatgttctactacaagtaaaggagccatcaaaatgttcgccatcagggcagagtcttggaaataaaacatgaaacattctattcttatgtgaaaccattaatgtgctatgtgtagttgtggtgttttgtgtatagcagaaccagagaaagtttagatcagggcagctaacaggagtaagagcatgggaagtctattctgtgtgaataaactgtatatatacatatttcatttaatctagaaaaattaaagttacatgattaaagtgtataaaatcaagtggcatagacagaaaatctgggattgctcacctaaacttgaaacactagaactcatggactattcttccaaacttataaaagctagctgtagaacaagtaaaatgaattatcgtaaaaccttgatatagactgggcttagacaataaatgtatttaactgattagtcatttatgtttaaaggtgaaacatgtgtttacaaattcaggtagtatttttagcaatttcaaaagctagataatgcttttttactctttaaaataattttttatttttatttatttattttgaaacagagttttactgtgttgcccaggctggactcaaactcctgggctcaggcagtcctgcgtagctgggactgcaggtgtgtaccatcgaggcttgtttttttactcttgataggttttataatctctctagcccccagcactttccaaaagaatcatcagtatttataagataagtcttcttcttgctaatactaaggtttactactattatgcaaataaattgtttccccgatatggtggtatagcttaaattgcttttagtggatttctttattttaattggctataattaatttattcatttagttcatttttattccctagccagtgaaatagggagtaaagagttgtcttcatgtagcttatagtctggtaaaagatttagacaagtaaaagcacaattatgagaatgttgtaggaagtggattataggacgtgtttttttgtaatgtgaattagattcagtaatgctatgtatctatgcagaaaattttccgaatcaaattcgggattcttataagttaaattgatacactagcataattggtattagttctgccttcgaaaatccaatgtagatgccatattttttatctggcctgatgtaacaaggtataaagtcccaggctctatggccatagtttaatgttatattcactgttgtcttctattcatatgttaacttttcagggacatctgaaacttgttttgttgtaagataactgtggaatctaaacctttaggtctctgacaagcctgttttctcgatctggactttgtccttagaaaattaaagagactattcttgtgatcatattagtttagagtcctgtttagtaaaatgaatattccatttctatactgtattcttcttaagtagatgaccatatagcatcagcaggccattgttatatgtgagccacaaacttgagagaacatgttggtatagatattacttcttttacaggggctagctctactggtaacttagctctttcaatcttagctcagctccctctgagtaggagccatgacaggttaaactgtggaagaatatgagcctcactttaggctgtagtctttaggtcatgaataagccatagttcaattcatagaatgacaggcaaaacattcacttatttgtctttcattcattcttaatcagtacttattgagcgcctactttaaaccaggcactatgctagtctgtagatgcaaataaaaataagacttggttcctgtccttaaattgggagacagatacagatatttatagtaaggcatacaatgatacataggtgcctgagattaatactagggtgaaaatgtagcataggagtttatagaggagtagtatagaatttctgagatcatcttgggaaatagactgaaactgactgaaatggaaacttcctttgagtccattttggaaatatttacatctataattgtagcacttgtactacattgctttttcaactcttatacccactacagtgtgatctggcaaagcagtgtctatgttgtttagtgttttaatctctggaatgtggcacagttcttggctcatgtcatggtggaagctaaaatcatggatagttaaatggatcaaaaattcaaacctcctgtagaagcgtacatcctcctccctttcctccattggcaggaactttgtcagtaatgtattgactatttggggataatagttgattaatgtgataagagggtacctctttcccccctttttatggtatatagtaacttctttgacatttacatatcaaaattatatcacagttggtatggggagattggtctcaggcaggtaggaagaagacactggactaggaaaaactagagtattatgctcccaaccttttgaaaaatttgttattcaaggcatgtatcattcaactgtgccactgtgtttctcatccttgttgctgtcatttaccagtctcttgcttacttcttattcatcaaatattttggcatctggcccacaatgtttctctatactctaagctctgcattcatcctggatggtttcaaattctatgttaatgactcatctatcatcactgcacctctgttctttgaccatgttatctcctattccccttttgttcattcagatgtctagtcttgccaaagaccttgtaatattcattaactgctcaagaatcaccaatgtgtgtgattctttgatcacaatttcctctcctttttgcttgctttttaaatattcccattatgatcattcttcatcagaacctctcatccatttatccatcagtcctctcactttcattttttcttcttaaccattctagattacttggtcccaaaattcctttgcacatctgcctctttatcaaatctctctaacaaaaatgtaactcatgataaactcagctatgtgctttctcagtgctttcagtcaagagctaagcactgctagagaaagctgcacagaagaacactagaaatttactatcatcaacctcaaatgagctgtcaacatgactttacagttttaccacatttctctgatcaactctgtctctcattcttcacaagttctatttcatttctctctctttatacctctgacttctccattatctctctcattctaagtcatgatattatgtcatattttacaaggaaaataaaagctatcagacaggaacccctttaacttcttcctattaaatgttcacacctactgtattttaacttgaccatcttattctgttataatagaggagttgtctgttatatttatctattgttccatcatgcaggactcctaaatttagcagcttaaagagtgacaacatttattttacttatgaaagtaagtaatttgggcagagctcagctatgcactctatatgacatcagctatcttagctctgctaataaatcactgctatggtttatggggactagaaacacatgaagccttgctcatttacatgtttccctgttgatgctggctgtacaggtaatttgaaccttacctgggactgtcagctgaagcacctacacatgacctctacatgtggcttgggccccatatcatgtggctaagttccaagaaggagggagagagccaggtataagctgtatcaccttttatgacctagcctccaaagtcaagcagtgtcacttcagctgcattctgtttgttaagtgagtcacttaaatgagtctgtatcaagggaagttgaattagattctgcactttgacggaaggagttagaaaaatttggggacatgtagaaatcacattgtacatctttctctgcaagcccaatcactccactattactttggatcccaacccctcctgctttcccaggagtctttgtattcttatcttttatatgtataataatatgtcttctcatttatttaaaaaacgtgtaccccttttcccttcactttcagttttctctttgaccctactttctctttccctttctcatcgctcacctactaaagtgaactggcctgtgatttacagtatgtgtgatcaaatcagttgactttggtgcccaggcaggtaattttaatgtgtcttgggtaaaacctgagacgagaagaaagaagaaagagaaaaatgttctttttctgctcttgctgtattatagttacttacaatcaggttacagagaacttaatcagcttttagaatataacatgtttgaatgttgtggtctgcatattaatatttaagtattaacttgaagttatatgaagtatgtaacaacataaaaaatgtcaaactgggttacatgcacaacctggtttaatatataagaacctaatttctaaatacctttagaatctttgacctaacaatttcttggttctttatgattagatttaactttcttgtttttttggtttttgttgttgttgttgttttgagacagggtcttgctgtgttgcccaggctggagtgcagtggtgtgatcatgagtccctgcaactgctgcctcctgatctcaggtgatccctcccgccttagcctcctgagtagctgggactacaggtgtgtgccgccctgcctggctaattttcgtatttttggtagagatggggttttgccatgttgcccggcctggtcttgaactcctgggttcaagcgatccacccacctcagccttccaaagtgctgggattacaggcgtaagccaccacaaccttcttgttctattactcacacaagtttagcatgagaaataaacacgttaatgacttcttatctttaatctttattgtactcagggacatcagtgacccaaaaatcttcaaatgttttttcgcagtgatatctgtaacaataacagtgggagccatagtggaggtagagtgggcagaaggaaacttttttggtttttgttatgattggtttttgtcgtaatctactttataatattctgtgtagtagaattgagaaactatgttacagtagtactattttcaagtaaaaatttaattgaagtataccatacatttcaaaagtattcaaatcctaatttataggctaatgaatttgataaagtgaacacccatgtgaattttcacccataccaagaaatagaatattactgaaaccccagaaacttccctcctgcctgtacccaatcattgctagatttaaaatgtggaatactgcatcatgttttcctttgtgactgccttctttcacttatgtatttgtgacacttatccatgtttttgtcatagcagtgatttattaattttcacagatatatatcattgtataagtatagcaaaacatattttttctatggttgatgtaaatttgggttgtttccagtttggagctcttataaataatgctttgaacacacttgtacatgatttttgataaatatatgtatgttttggtgaatatgtatttgatgaatatgtgttatgtatacactcatacatacatgcatatatacatgcatatgtgtctttgtgtgtgcgtgagagagaatgatgttgaattaattgctggatttctgggtcacagatcatgtggttctggtaaataccaccaaataaattttcagattggttgaacctgtttctaaccagcagtgcttagggttttagtcgctccacatccttcccaaacttgatgtttttcatatttctaattatacctattctggtaaacatttcctggttataatttgtacatcccttatgactgatagtgttgatcactttttcatgttggtattggtcatttggatatcctctttttataaaatgtttttttttttttcaggtatttccccatccctttttttgtggtattctgttgtatttttcaaaaaaattgatttgtagagttatttaacatgggtacaggattttccccccagacgtatgtactacaaatgtctttttccgtttcatagcttgccttttcactttcttaacgatgtctccttcatactgtttaataattttcaaacgtacaaataatttacaaatcatttcctttatgatttgtgttttgtttggccttcctcggtcttctttaagaagttctcactaccctagggtcatagatattttcctatgttaggtttagaagctttcttttgcctttcatatttagaactacagtctgtctggaatcaagtgtgtgcatctctctctctctctctctctctgtgtatgcgcttctgtgtgtgtgtggtgaggtaggagtcatttgttaatatcagtatttatttgacacatcaccatttaaaaggaaaaagaaattgtcccttccccaaagcactgtaatgacatctttgttatcaaaggctgaatatatctggtttccttcttttctgttccattggttttgtctattttagtgtcagtacaaaactgcatgaattcatataactttataatagaagtcatcataatcagtagtataaatcctaaaacttcatattttacaaaaattttgaatattctttatttttaaatcagcttgtcaattttcacatacataattatatacacgaaccttataggaatcttgagattgcattgaatatatagtagtttgagaagaattttcatctttatgatattgaatttttaagtccatttatttagatctactttaacttcttttagtaatctttgtaatattctgtaacttcttttagtagtgctttgtaatatgctgtttaaattttaaatataattttaaaaattacatttattcttagtttcacatgcttttttgttactataaagggtatcagtgtcaaagttttatcttctaatttttcattgtgagtatataagcatagggttagaaattttatgctgacctatctagtgatcttgctaattttattaactgtaagttatttatagatacatttagattttacatatacacaaatcacttttttgcttaattttgacagtgtaagttttttccttttagtccttatacattttttttgccttattgcactgattaggacttgcaatacagtagtacatagaaatcatgataacagccacacttgtcatattcctggtgtcactggaaagctttcaatattttggaaccaggcagaaaatttttaagatatcctgttatctgtttaaggaaggtttcttctattcctggtttgctaattatttttcctttgagaatgggtatttaattttatcaaatgttatttctgcgtctatgagttttgaatcttaaattaatattgcatacctggaataaacccattctggttgcaatatattgtccatttcatatccttttttaatgtaatagtgaatttggtttgctaaaatgtctcagtgtgttttctttttatcattattccattgttttttctttgactaatggctacattggttagttttcaaatatttgggggtttttagcttagtttcactgtgttcagagaacatgtttggaatgatttcagttctttgaagtttgttgatacttgccttatgggtcacctttatagccatatacagtagtcatttgtaaatgttccaatgacttttgaagagactgtctattctgctttcgttgcctacatgtactctctctcacacacacatacacatacacacactaagacaattaattcacactgaattcaaggtattctgtatcatgttatatttctttagagaggacttattttacttctggtgtgattcaatattatttttactaattgcagtcatgtggtatgtaacaacatttcagtcaaaaacatactgaatatacaatcatggttccaaaaattatactacttcatttttaatgtactttttatatgtttagatacacaaataccattgtattacaactgcctacagaattcagttagtaacatgcagtataggattgtagcctaggagcaataggctatccatatagcttagatatgtagtaagctatacgatctaggtttatgtaagtgcactctatgatgttcgtacagtgacgagattgcctaatgacacatttctcagaatgtatccctggcattaagtgacacatgactgtatttaacactccatcatgcattattattattgttcagggccctcaatatttatatttatcccatatttgctgtttttttttttttttgcgcttattccttcatgcattctctggtctaagttacttgtgccataaataagtcttgtgtaaaggtgtcctagtgatgaattatgtcagtttttatttatctggatttgtgtattttttaccttcactttttcaggatatattttataagtatggaattttaggttgagaattactttctttgaacactttgaagatgtttcatcatgttttgttttccattgttttgttgagaaatcagctgttagtctcagtgttgctttatgaaggtagtatatctttttttttctttggttgctttgagattttctctttgcctttggttttcagcagtttcacaatatgcctaggtgattttattccccctactttctgtttgcaactttttagaatcatggctcaaaatgtttcatttatttaagacagttttcaataagcatatcttaatatgttgcctctatcccgtcttttctttcctattcttctgagataccaattacatgtatatgtaaaatttctgatatataatttcaattattatatttttaatctctagattttccagttgatttttgagtttctacttgtaaatttttctactcatttatatttttgtacaaattaatcatagctatattaaagttcatgtctgaatttacaatttttattaccagtgtgtttttctatggtatgtttgttctcttatttttggttatttggtcttatcttttggcatgcctaggaatctttaattgaatgtattttgtatcatgttatatttcttaagagaggacttattttggctgatggttagagttgggtcagattgtgttgatccatcaacaattaagatgacttgttggctgttctcagtctttgtgaggcttggtctatttcctattcttactcctatcgatggagcctttcagtggttttgactgaaggcctggtggtgtttatcagggccctacctcatgctagccctgaacttcaatttttctttcctcactgtgagattactgaaatatttgcttagttttctaatctcctaaaaaggtgcttctcactatctgttctttagtgtcatgccttaggtatcttaaacatctgaatgcttcaagaagaaaaagtagtacagaatgttgggatttttatttctggtttcttggccctaaagtctctgaattccatttttttcccttgtcagccaagtgtaatgttgaatatttgagccttagctttttgcatgtcctttctaccaattgaggaaatgccctgagggcaaaagctgtaaagaatcttgatctctaatcatttcccatcttttcaggaccttggtgttcctcaaaacctgctgactcctttgctaatactttcaaacaactcttaccccattcctaccaatatttatgttattttaacaagagttttttttatatatcactttattgaagcagaaatcccttgatagtattttttctttttgtaaatctgtgcaatgaatcatagtataaagtgtgcacatttttaagcttatagattgaagagggtttacaaatgaattcctcatataatcgtgactagatcaatatatgcaaattaacagcattctagaaggttcccttgtccctccagagtcaataagcatgcttccctcagatgtaaccactattcttatttctgtcaccatatattagtttcgcctgtttttgagctttacttaagtagaataacaattatactgttttatatctgggattttaatttcaacattgtttgcaaaatttagtcctgttgctgaaggtagggttctttactttttgttaatgtatagtgttccatggtgtgaatacacaatttattttttctttctacatttgatggtaattgggttgttttccagtttgggactattatgactagaacttctgtgaacattgttgaccatttttgtgcattttcatacacacctatactcatttctgttaggtatatacctataaatggaatactgtcataaagtatatgtatctgtagatacattagtagatagtatctacattagtagatactatcaaactgttttcgaaagaggttataccaatttgcactcacagtagcagtgtaggagagtttccattgccccacatcttcaccatccttggtattgacaggtattgttttgttttagccattttggtgtgtgtattaataagggttctccagagaaacagaaccaataggaggggtgtgtgtggggagaaagattatttctataataaatctcctcttacatacatatatacttattatggaaattgactcatgattatggaggctgataagtcatataatcaagttggggaaccaggaaacctggtgctgtaacttagtctaagtccaaagacctgaggaaaggggagagaaaatggtttaagtcctgggctgagtctgaagaccaaagaaccaggagcactgacgtccaatagcaggagaaggtagatattccagtcttaaaagaaaagaaaaaacaaaaacaaaaacaaaacgtgcgaatttgccctttctccacctttttgttatattcaggccctcaatacattggataatgctcatccacattattaaggtcggtcttctttattcagcctgctgattcaaatgctaatctcttacagaaacattctcacaaacacgcccagaaataatgtttaccagctatctgggcatcccttagtctagtcaagttgacacataaaattaaccaccatagtgggtgtatatcaggatataattatgcttttaatttttgtttccctgatgattaatcatgttgaacacgtttttatatgcttattgggttattcagatatccttttttagatgtaatgcctattaccttaaattaaatcttttgcctatttttctactgggaaaagaaaataggagttattattttgcagaaatgttatacgtacgcatagtttatgaatataaataaaaatattttctccaagtctatgggttgcattttattctcttagttatatattttgatgaacacagcttttaatctcaatatactgagagtactaactttttacatagcccattttgtttcccttttaacaaatctttgcctactccaagttcatgaagatagtttcttttgttcttctaaaagacctattatctttgtcacatttaggtctgcttgcatgtctcagagcagtagaaagcaatattatcagttgtgaggaagaattatgggaaaagtgttggaagtttggtaaagaggagaaggtataaaagtcatctagaagagtgggagattggatggactaggggagtacaatatgattgccagataacagtaaatatactcttgaggtttctggttatgaacttcaaatcataaaaagttaagagtagtttgtttttctccagtcttacccagctgcacaagtgcaggcacagtgtaggtatagagatttcaccagggttctggttttgccaagcaagtatagacaaaacgagagagaggcaagtggctgaaaatgtatgctggaagtgattataatgctcggctttggaatttgtgcattttaaggaggaaaaaagataatatttggggtatcaaggatcctgaaaaggattagagatcctggtaaggtttaaagattgttgaagttgagatcttaaaagagagtgagctaaaaagatagaacatggttagagagaaagggtagaatgaaatgggctaagggtatgatctttggagtcaatggctaagacagggtagggtgggaatgtacatattaaatgaatttagatattgtattagaaaggttagaggatatacatattcgatgaatgtgtatatcttcaattaactacaaataatccaattttatttgtagtgttaagtatagtaagaaatataagtacaatacctgtttaaaaattttacaaaatattttagcaaagtactttttaaaactttaatttttaacttaatgtaattttcaggtaaaaggataatatattcagtgcattttaatggcatgagtttttaattaatgttgtatagtcgaagacatagtagtatgttagtttatatattttctagaataacatatttcagtttaaatatgtatttatttttgaatttaaaatattcatgtttgaatggttaaatgagaatgtacccttatttctgtggaaatatagcttttattaacagcaaatataaatatatctaattgagaaagtaattgaattgttccccccccttttttaattaaatgaatatcctttgagaatttaggagctagctacttaggggaccagaagctacttacctgggcacttaatattattaacctggtatatggatcacattgacatccagaaagtaaaaaatattctcaaagaagcaataatagacataacagaggatttgtatcataattcacgcagttactttcagatttttctcttttgcaaaatagaaatagtttctagttgtgaggtttagaaatcctatgtaatgtattactcttggtaccgagaagatgctcaataaatagtagctattgtttttaagggaaatccttaagcatggtctatatagattaggctcattttaacaagttatttgaattgtcagtctgtggacaactagaaacaacaaattcatccactgggagtaattttatattagattgtagggaactttatatttgtccattttcacactgctgtaaagatacgagactgggtaattaataaaggaaagaggttttattgactcacagttccacatggccagagaggcctcaggaaacttacattcatggtagaagggaaagcagacatcttcttcacaaggtgacaggagagagtgtgagcacatgaaggaagaactgtcaaacacttataaaactgtcagatctcgtgagaactcagtcactgttatgagaacagcatggggaaaacctctcccatgatccaatcacttcccactgggtccctccctcaacacgtggggattatggcaatacaattcaagacaagatttgagtggggacacagccagaccatatcaaatatatttatattcatatcctcaggatcatcaagaataaaaagatataaaagtgaatggggacattttagaaagttattcaccaaaactttaataattataaaaagtggcttatatctcagaataaccctatgtagtaagaatactgaggcttagagaagataagatcacacatttaatggcagaattttgaatgatgcaaactccatcagtctgattctaggccctctgctcataagcaccatattataccatttccctaacacagtgaggaaaattttcttttaaaaattatgtacttaaaactcatcaaatctgaaggaccttagaagatctatctacctacctatcaagtttgtagagtattacatagctttttctatgtgtcaggcactgttatcaatcctataacaactcatttaatctttacaactctttgaggtgggaaccatgattgttcttattttatacaagaggtaactgaggcatagattaagtaacttgtccaaagccacacagttaaaaagtaggcaagctaggacttgaacccaaacagtgactctagagtgttgttaaccgtgccatattgactgcctttctaaaaatttgtgaagtttttacttcatttagttttctccttattataatcttttcaatgataagaaactcattacgctgtaaggctatgtgccagtcagagttacaccagagaaacagaaccagtaggatatatcggaagagatatattgcaagaaattgacttattgattgtggtggctggctaggtaagtctaaaatctatagggcaatctgcaatgaagggcaagctggacctctcaatcacaggctgaagctgtactttacaggctgagtttcttcttctgggaagcttcagttctgctcttaagggctttcaactgattgagtcagatccacccaaattatctatggtaatctcctttacttgaagtaaactgactgtggactttagtcacatctacaaaataccttcacagcaacacctagatcagtgttgaataactaacgactataccctagccaagttgacacataaaaatgtcctgtaggcatattttttccttaagccctgacaggtttgggggttggtggttcattttcccaagccagaaatggaacttcctactttctttttaacttacatttattactcattcttatcacctcctcatctcccattaccacagccaaaaaagatttcaggtgtttttcaatagaaggcatatataacctttaaagcaaaattataaatacaagagccttgaaatcaaaggcaagaagatggttgaaccaataaaccgatgttgaagctagttactgtatttgagcataaaatttagcactacatggtgaggatacagtataaagccactttcctagtgccaaattgtaacaggaatttaatctatctaaatacagggagcagtgatttacataataaatgagataattattatttaataaagatttagagaattctctagattcctgtgttcaagaaggagggcctcaaagctgcctgcagttatatttttatgataattatttattactatctcatgacttaaaaattttcttaacaagtaaaataactaccttttaaaaaatactgtaagaccctttgctatgacctcagataatttaaagtgatgtctcacagacctttatttagactgaaaggcttataaaaattttgtgtgtgcctgtaatcccagcactttgggaggccgaggtgggcagatcacgaggtcaggagttcaagaccagcctggccaatgtggtgaaaccccatctctactaaaaaaaaaaaaaaatacaaaactacaaaaattagctgggcgtggtgttgggcacctgtagtcccagctgcttgggaggctaaggtaggagaatcgcttgaatctgggaggcggaggttgtagtcaaccgagattgcgccactgcactccagcctaggcgacagagcgagactccatctcaaaaaaaataaaaaatgaaaacaaaaatgcaaaaagagaatcttgtgtgtggctcacgttactctaaattagacagttggggtttttagaaatcttaaggacttgtcccatagcagtcttatgtgaggcccaaggtagagaaagccctctccaaagggaatgtggatgtggctttttgtctcttggaatatattagaatttgataatatgagaaacccacagagttttaaaagaaattgtattaatgttgattgaaagggtcagagataattaataaggaaaaaagtgtacgggccctcacctactgtggaaaggaagcaggctgaaaagctactcacctcttcacataggccatttcatgtgaaagaatgattgagagagggcagccaagaagccagagagtacagctaagagacaaggagaactactctcaggactaatcaaggaatgagtgacatgtgcccaactggactttagaattgctattgatgagggagtgtttatacctcttgttttccctctttttgaatgggagtatccattgcaatttctattcctatctcaccatcgtgtattgggcagataacttgtctctttagttcacaagtctttagattaagagaaactaagtatgaggagttgcactcaggaaactggatctgagaggcctcatctatacctgcatttgatttagattacatcctggaccttaggataaggcttcttggggtcttggaaggagtaaagtatattttgaaaatggaggagtattctgtgacaaagtgaagatggctacaaattcttaaccacccttttcatctagaagcatagcatatttcttcattccactgaatctgggctgggtttctcattgctttaaccagtataatatggtggatgtgatgctagatccgttacagggttgaggctctgtcctcttttaagcgaactgctatgcaagaagtctgactattctgagaccaacatgctgttcaaagcccaactagccacttagagagaaagagacagagagatggggtgtgggggtggggggtagagaaagaaagagagagattggtagcactagataaggtgaattatttcatgggccttttagtcagcccagccttcagctgaagacagatgagagagtgactcagcaaacagtgtgaagtgagccagcagacctatgacctcatttgggctgttccagcttctcgcagctgttgagccacccagcttagaccccagacattgtggtatagagatgaacagttcctactgtgtgttgcccaaattcttgacccagaaaattgtgagcaaaatatggtgattgtttgaaaactaagtttgttacataacacagataactgaaacacaagtagaaaaattctatcacctgcccaacctcacagagccagtaagaactagtgttctccccttcccttttatttttagttgacacataataattgtacatatttataggatacagagtaatattttgatacatatgtaatgtgtaatgatcaaatcagggtaattagtatttccttaccataaacatttatcatttctttgtgttaggaacatttaaatcctctcttgtacttgaaaatgtacagtaaattattgtaaattatagtcaccatacagtgctatggagcactagaccttacttttcctatctagctgtgattttttatcagttaacctctctctaatctgtagtaacccacaattatctaattctcttcccaacttttaataaccacaattctcctatctacttgtatgagctccacttttaaaagctccctcatatgggtgagaacatatggtatttttctttctgtacctgactgatttcacttaacataacatcctctaggctcatccatgttgccacaaataacaggatttcattctttgttatgtctaaatagtaggtcattgtttatatacatatatatacactttctttttctgttaatctgttgatagatgtttaggttgattccatatcttgattattgtgaatagtgctgcaataaacatggggtgcagatgtctcttcaatatactgatttccttccgtttgcattaatagccagcattgggattgctggattatatcttctatttttagttttttgaggaagcttccatactgttccataatggctgtactaatttacattctcactaaaagtatatgagagttccctttctctgcatccaaaaagactattgtctttttaacaatagtcattcaaaccgaggtgagatggctttcatttgcatctccctcatgattagtgatgttgagcattttttcatatacctgtggccatttgtatgtagaaccaatgcttttaatcacatgtcaaactgcctatgtcccagtcctttccagagagccctctggaaccctttttctattgtaaacaaatttatttaaacctacaggttttccatggaatagaagtttattcctcagtaccttgcatctactagttgggcagttatggtgagcatatctttttgacttaattctagagtaattatataattggagataaagctgggaaccattctttacttaaaaagtctcaagtgggactctccttggagtgttctctaaaaacaaaacaaaaaaaatcgttttcttaaaggcatttagttagcagagcacagctgactgaaaatttcttaaatacaattcaggatagtttgtataaataaccaaaaggtaaataaccaatgtagtcctcatgagacattaaaattttttttcaactgaatctctcactgcactgttaattggaagtcttctttcttgaccattctctagaacagaatacaactgcggtcactcctctcttctggatgtttttttctggaccatccaattcatttccacccccttgttatgcagagaaactttcctctttcatggaaaagtcattctgacatcgaggcaccacgacttttgacctagagtaagcatatcaaactatttttctcaactcaataatttacagaaaaatattaagaaggtgaaaattttccattcatcattacctacatgtaagaaaaaaagaaaagaagaaaaatctaccagaatcctagcatttacagataaccactgttagcatttatttatttatttatttatttatttactgagacagggtctccttctgtcacccaggctggagtgcagtggtacgatcacagctcactgcaacctccacctcccggattcaagtgattctcctgcctcagcctcttgagtagctgggattacaggtgcacgccaccacagcccagctaatttttgttctttttaggagagatgggattttgacgtattggtcaggctgatctcgaactcctgacctcaggagatccacctgcctgggcctcccaaagtgctgggattataggtgtaagccactacacccagcttgttagcattttttgaatactgttggctttctatatccacagattcaaacaatcaaggattcaaccagccatgaatcaaaaatgttgaatcaacaaaacaataataaaaaataaagtagaaataataacaataactatttacattacagtataataggtattataagtaatctagagattatttaaagtatacaggaagatgtgcataggctatatacaaatactatgccatttgacataagggacttgagcattcatgtattttgatatccagaggcgccctggaaccaatctcccatggataccaaggggtgattgtatatcctgtttaaaagtatatgggtgagtttcctcctagtcaacatagtgttggaagtcctggccagaacaatcaggcaagagaaagataaaaggcattcaaataggaagaggggaagtcacattatccctgtttgcagatgacatgattctatatctagaaaactccatagtctgcccagaagctccctgatctgatacacaacttcaacgaagtttcaggatacaaataaatatacaaaagtcagtagcattgctatacactaacagcacccaagctgagagccgaatcaggaatataatctcattcccaattcccacaaaaaaggttaaaatagctaggaatacagctaaccaaggtcaaagagctctacaatgaaaattacagaacactgctgaaagaaatcagagatgacacagacaagtggaagagcactccatgctcttagataggaagaatcaatatggttaaaatggccatactgcctaaagcaatttacagattcaatgctatttctatcaaactaccaattacattcttcacagaactagaaaatactattctaccattcatatgaaaccaaaaaagagcccaaatagccaaggcaatcctaagcaaaaagaacaaagctggaagaatcacattgcctgacttcaaactgtactataaggctacagtaaccaaaacagcatagtactggtataaaaacagacacatggaccaatggaacagaatagagagcccagaaatgaagccacacacccaggaggagggagaggttcagaagagaaagataaaaaggaaaacaaatgaacaaacaaaaaaaccaaacctgttgagtagtatgcttagtacctgggtgacaaaataatctgtacaccacacccccaagtcacaagtttacctatataacaaacctacagatatgcccccgaacctaaaataaaagttaaaatatattttaaaacatatataaaatggatatatgtgtcagttttaaccaactgatgtttgacaaggctgattaaacaagcaatggagaaaggactccctgttcaataaatggttctgggataattggctagctgtatgcagaagactgaaactggaccccttccttataccatatgcaaaaatcaacccaaaatgaattaaagacctaaatggagaacctaaaactgtaaagcccatggaagataacctaggaaataccattttggacataagaacgggcaaaaatttcataacgaaaatggcacaagcaatttcaacaatagcaaaagttgacagatgggacctgtttaaagagcttttgcatagcaaaagaaactatcaacagaataaacaaacaacctacaaaaatatttgcaaactatgcatctgactaatgtatagttagtctgggtctaatatccagaatctacagggaacttaaacaaatgtacaaacaaaaagcaaacagccctattaaaatgtgcacaatggacatgagcagacacttttcaaaagaagacatacatgcggccaacaaacatgaaaaaaatgctcaatatgactaatcattagagaaatgcaaatcaaaaccacaagataccatctcacaccagtcagaatggctattattaaagagtaaaaaaataacatgctgacaagcttgcagagaaaagggagcacttacacagctggtggagtgtaaattagttcaaccattgtggaaagcagtgtggaaattcctcaaagatctaaaaacagacctaccattggacccagcaatcccaccaggtatatatcctgaggaatagaaatcattctaccataaagacacattcacttgtttattcattgcagcactattcacaatagcacagacatggagtcaacctaaatgtccatcaatggtagactggataaagaaaatgtacatatacaccatggaatactatgcagtcatgaaaaagagtgagatcctgtcctttgcgggaacatgggtggaactggaggccattaactctagtaaactaacaaaggagcagaaaaccaactatcacatgttctcacttataagtgggagctaaataatgaaaacacatggacagaaagatgggaacaatagacactaggatatacttgagggtggaaggcgggaggagggacaggttcagaagaaaaagaagaaaagaaaaagaaaaactattgggtatacctgggtgatgaaaaaatctgtatgccaaacccctgagtcacaagtttccctatataaccaacttgcacatgtacccctgaacctaaaataaaaattaaaatactaaaaaaaagtgagttttaacaaattgagattataataataatatagtgcttattatataccagacaccattataagtgctttaatctgtttatttaattcacccgaagaccctccaataaggagtgtacttttattaacctcatttgcagatgagaaactgatgcccatagttgttaagtaatgtgcccaagatcacataactgggattcacattcagatagtcttgatttaagaacctgccctagtaaccattattctaacctgctatccatattatatattctgacaaaatttgcttttttcatttttgaatttttctttgcatttggataatcttctgtaaggaatttgtcgtacagtcagtatgttaaatgtattaaaaaataagtgtatggaactaattttttatttccccaattcaagggtaaccattctctctactttgacaggattgattacatttgcctcttttataaatgtaatcacacaacatgtactcaataagtactcttttgtccctggtttctttttgcctgacaatttgtttgtgggattcattcctcttgttaggtatagttggaaattgttcattttctttgctgtataatgttccattgtgtgaatatgtcacagtttaaatgttctactattgatgggatgtgatgtttcctttttgggcctactgtaaataatgctactataaacattccagtacacacattttggcgaacatatgtatgcatttctattgagtatatatatctaggagtaggcattcagctttagtagatactgtcaaatatttttctaaaatggttgtatgaatttgcactactagcattgcatgagggttctcattatttcacattctcatcaacttttggtttttcctttcacttttgctttagccattctgatgaatgttagagtagcatttttatgactatatagtgttctattatatgcatatgtactgtcttttatagacgggagtccctattgttgtgcatttagattgtttccaatctttctttgaaaaaatacaaacagtatttacactaataggtttgtagacgtactttaagtcttgtgatagatgttcccatacacgattgaaaaataacaagtgtgtttccctgaaacattatgaaaatgagttacaatttttgcaacttcatccagttactaagcaaaagatagcctctcatatttttactttaaattttttttatttccagagaaagttgagcattatgtttattgctaatttttatattggtaatttgtatatatttaataaatcacctagtctcattttatgctcatatttctattgaagtatatgtgaatatcttagacccttttattaacccttttctgattatatatgttataaactttccttatttgtctttcaattttataaaaaattaactttttatatagtcaagtatatgttttatggcttttgcctttggtatcatgctttaaaaggcctactcatactttcagctttttcattctgctctgttcttccccaaagtgcatgtgtatgtgtatgtgtgcatatatacatgtatgtctattcagattttcccataaaaacatgatacagatagccctccatatccttggattcaaacaaccaagagaattcaaccagccatgtatcaaaaatattaaaacaacaaaacagtaaaagataacaatacaacaatatgaaataatacaaataaaaaacaatacagtataacaactatttacatagcatttacagtgtattaggtattataaataatctagagatgatttaaagtatatgggaagatgtgcataggctatatgtgtgacagtgtatgtatgtttacatatatatatatgtaagtatatatatatacttgagtttttcccataatgttcaatttcctctggaaagaaaatgtaaacttgcttcctctatgctgtatcatcatcttattctcaaattcccttcaaaaccaaactttttaattagtagggtaacacactgcttccattttcttactttgtgtttacgcctcaaatcctctgaggctgatatctattccttcctgccgtggcaaaagtcatcaataatttgttgtgagttttttcccttactctatagtagagtttccctaatctatagtgttttccccaagtgacttattcactaattacttcatgttctgtcagttccaattactttctatctttgtgacaacatatatctcttctgtgctctgagtgtaatttttgctggatatgaaccctgcaaagtcaaattggggaaattatcgtttcctgaatctgcacttcctattttggtgaaaatgatgcacctctttagtcatataagccagaattttgggtgtcatcttagattctttaattttccttgtcttctacctctccttgttgactgagtcttaggaatttgtcccttcatttctaatttcactgattctagcttagttcaggtctttatcaccctttttgaggatatctacaacagtttcttagccattctccctgccttcaatttccctagtcgatcttccaaatctaatctaactccctgcttaaaattatctttatggtgctccattgcatataagataaaatctattcttagcctgacatataagatgatttggcccctttatcttgtttcattttttccctatcacttcttaaagtactttttaaggcacaataagactttgttattactatgattgcaccaacattgctactgacttcaacacccaaaatttttgtatacagaagcgtgccccaaacacaaaatgagtctttctgtactgctagctaatgtttactaagatcttacaaattacttcttttattagtttggaaaaaatatggggttagttcaatgctaaatcaaaattgttcctctcttttctgcttaagataatctatagtaataccttatattagtatggattattaaagatttactgtacataatccttccattatttgattttatagaaacatctcaaaggaattaacccaagggtaaaatactacccatacataatttccaacattttgatcagattctactgggtaagtatatgtatattttaagctataattcctataatctgtgcaacaaacccccgtgacacaagtttacctatattacaaacctgcacatgtacccctgaacttaaaagttaaaaaaaaaagtatatgtccatgccatagaagacaaagaaacaccgtagaaattttctaggttaaaggcagagtaaaagacataacaactaaatgcaagacctgatatatatatatgactgcaaaagcatctctactgaccccagagaatggtgtggcaactattgtttacaatttttatttagtatttatttctaatataagattgggaaaatagcatcaaaatacagctgcttagtagtcaagaagactaattatgtccctggaaataattacaactgtgtacttcaccttcaggccagagtttacttattatattaataagaaaccaatactgcaattgagtcttgtgagcctaactcaaagacacaagattaaatgattagttttacagaatgagaatatagtgatgcagtaatgtatatccattggtgacattgccattagcattggaggcaagtgtccatttcataatagatggtgtcctaagttggactgcttctttttttttttttttttttttgtttgatacggaatctcactctgtctcccaggccggagtgcagtggtgcaatctcagctcactgcaacctccacttcctgggttcaagcaattctgctgcctcagcctcccaagtagctaggattacaggcatgcaccacaacacctggctgatttttgtatttcttttcagtagagatgggatttcaccatgttggccaggctggtctcgaactcctgaccacaagtgatccacctgcctcggcctcccaaagtgctaggattacaggcgtgagccaacatacctggccgtactttttaactatgtcttgcctcatttggttcctggctaaatctggcttttcagtcttctcatccattccatatgtactcaatctaataaattcattttctgcttaaattgactagcatcaatttttaatttacatttttgcaactgacaacccagactagtacaggtcctaaaggggactctaattcacatgtcctcccaagaaaggcaggtagcaaggtatcttatttgtatgtgtctgatagggctcccaagaaaccagtggaaggtactcttaggattgatagttaaagtcttaggcacagtaatcaaggaacctaagaccgagtgacagaggaatgtttttacatgggagaactctgagatacagtgttagaaattccctaaggaggttagtaggaaatattttccaagaataaaactgacagaggattaatatccagaataaagagcattttataagtcaacataaagagactaaaaatgaaatagaaaaacatagcaaaggatataaatggataaattactaaatatgaaatttagatgatcaattaacatatgaaaatattttatttcactagtgatcagtgaaatatgatttaaaatgaggtaccttttttaattcaccagattagcaaagatgaacaagtcacgtagtatcacatatgacaagcatgtcaaatgtaaattgggatagccattcctgagacaatttggttgtatcagttaaaatgaaaatgggcataaactgtgacccaggaattccactgttaagtatcttctgagtagaaacacttatacatgttcaaaaggaagtatgtatcaaaaaaagacatactggtgaggatgcaaaggcatgggagccctcagacattgctggtggaaatataaaatggtacaggtgctttggaaacagtttttcagtttcttaaaatgttaagcatcagattgccatacccagcaatgtgcacttctagaaaaatagccaagagagctaaaaacactcctccacacaataatttgtacttgaatattcatagcatcattattcttagttgctatacagtggcaacaattggtgagtaaagagaatattgtttatccatacaattcaatactattcaacaataaaaaagaacaaggaatcaatacatgctgcaacatgataaaccgcaaaaacatgctaatgaaagaggtgagacacaaaagaccacacattgtgtgatttcatttatatgaaaaggaaaggcaaatctgtagatacagaaagtagactgatgcttgctcagggataggggtgagaatggaaaatgaccacaaatgggactgaggctccttttttgggatgatgagaaaaatgatacagtattaaattatggcaaccatttcacaacttattaaaaatcaccgaattttacatttaaaactggcgaaatttgtggtacataagttatctcaagaaaactgttaaaatgattaatagctagggactttataaacattactgtaacctgggatggtagaccaacacttgtaggaaggatagctggaagaaatcaggcatgtcatgttaggagaaacaaaatggaaacagaaagaaacagacatgaacatgatgtccattattgaattatttgtaatactggaaactagaaataacctaaaagcccatcagtaaagaaacaggtaaaatatagtacatttgaaaaaagtaattttcaaaatatgtagagcatgataccatccaggcaaattagaaaagtaaagctgtatatgttttccacataaacatgtatgtaaaagtataaaaaagacatttgaaggttataagcaatttcagaacagtggttgtttctaagggcagagaaggagaatcaggatgtggatagtaatcaggagggcctttagtgttatttgtagtgttcttttttttttatttttacaaatgtatggtgtaacatgaattttattacatgtatgtaatttatagtgatgaagttagggtatttagagtgtcagtcacccaagtacaatatacttttgcttacttaccctattctgctatcaaacattgaatatattccattttactgtatggttgtaccctttaattcacttctcttcagcctcaccgtccccctccctgctccgtcctagtcagccttcccagtctctgctatctatctttccattctcttccttcatgggatcaaatattttagctcccacatataaatgagaacatgtgatatttgtctttttgtgtctggcttatttcagtttaaataatgacctccagttctagccatattgctgcaaatgacaagatttcatttttttatggccaagtaatattgcattctgcatatataccacatattctttatccatttataaactggtgaacatttagtttgattccatatctttgctattgcgaatagtgctgcagtaaacacacaagtgcagatattctttgatacactgtcttcttttcctttgggtagatactcagtagtgggattgctggatcatatgatagttctgattttaggttttcgagaaatctccataccattttccatagtggcagtactaatttacattcttacaaaaatgtataagaattcccttttctccacatccttgccaatatctgctactttttttttttttaatgatagccattctgactggagtaaggtgttacctagttaaggttttgatttgaatttctctgatgattagtgatgttgagcatttttcataaacctgttggctgtcttcttttgcaaaatgtctactcatgtcatttacctgctttttaatgggattatgtttttcctattaagttttttgagtttcttgtatatgctggatattagtcccctgttgcatgagtagcatgcaggtattttctcctattcaaaaggttgtctcttcaccctgttgattattttttttttctgtgcagaagctttttagtttaattaagtttcatttgtctattggtgtttttgttgcctgtatttttgaggtcttagttgtaaattctttgcctaggccaggtgcggtggctcacgcctataatctcagcactttgggaggccaaggtgggcagatcacctgaggttgggagttcaagaccagcctgaccaacatggagaaaccctgtctctactaaaaatataaaattagctgggcgtggtggtgcatgcctgtaatcctagctacttgagaggctgaggcaggacaatctcttgaacccaggaggtggaggttgtggtgagccgagatcgtgccattgcactccagcctgggcaacaagagagaaaaaactcttgtctccaaaaaaaaaaaaaaaaaaaaaaaaaaaaaaattctttgcctagagcaatgtccaggagagtttttcctaggttttcttctagtatttttataatttgtggtcttacatagtctgtaatccattttgagttgatgtttctatgtggggagaaatagggttctagtttcattctgcatgtggctattcagttttcccaggaccatttattgaagagagtgtcttttccccagtggaagctcttgtcaggtttgtcaaagatcaattggctgtaaatatgtggctttatttctaggttctctatttagttccattatgtgtctttttttataccaatactgtgctgtttgggttattatagccttctaatatactttgaaatcaggtaatgtgatgcctccagcttcgttctttttgctcagagttgctttggctatttgggctccttttaggttgcacatgaattttagaattattttttctaattctgtgaagaatgatgttagtattttgatatgattatgttgagtctgtagattgctttgggaagtatggtcatttttaacagtactaattctaattcatgagcatggacttttttcatcttcaatttcttttatttgtgctttatagttttaaatgcagagctctttcaccttcttggataaatttattcctaggtattctttttgtagctattttaaatatgattggctttatttctttctcagctagatcattattggtgtatagaaatgctactgatttctgtatgttgattttgtctcctgcaactctactgaattcatccatcaaatcagggagtttttggtgaagtctttggtttttctaggtataagatcatatcatcagcaaagagggacaatttgacttcctcttctccaatttcgatgccttttatttctttctcttgcctgtttcctctggctaggacttcctgcactgtgtcgaataatagtagttaaagtgggcatcctggtcttgttctatttcttagaggaaaggttttcaacttttccccatttagtatgttgttagctgtgggtttggcatgtatggcctttattattttgagatatgttccttttatgcctagtttgttgagttttgttatgaagggatgttgagttttttttttcagatgtcttttctgcatccattgagataataatgattttttctgttgatgtggtgcatcccatttattgatttgcatatgttgaaccattcttgcattcccggaatgaatcccacttgattgtagcttattatctttttgatgtgctattggatttggtttagtagtattttgttgaggatttttgtgtctgttcagcagggatgttgacctgtagttttctttttttgttctttgtcaggttttggtatcagattggtgctgaccttgtagaatgagttagggagaattccttcctctttgatcttttggaatagcttcaggaagattggtattagttatccttagtacatttggtagaattcggctgtaaatccatccagcctttgtcttttctttattgagatactttttattactgattcaatctctctgcttgttattgaactattcagattttctatttcttcctgatttcatgttagtaagttgtatgtttccaggaatttatccattttctctagcttttccagtttgtcagcatttagttgttcataatagtctctgatgatcttttgtatttttgtgatatcagttgtaatgtctgctttttcatttctgattttatttgcatcttcgcttttcttggttagtatagctagcagtttatcaattttgtttgtcttttcaaagaactaaacttttgttgatcgtttatgttgtttttaaagcctctatttcatttaattctgctctgactttgtttcttttcttcagctaatttggagtttaatttgttcttgcttttctattttcttgaagtatattgttatatgttaatttgtaatctttctacttttttgataatgagcatttattgctgcaaaacttcccatgatgactgtgctcccaaaatggcaccttgctgcagctgttcatgcttaggtggagtgagtgagccagcatgaattccttgtctgatgcaatgccttcacacaatctccaagtcaccaaccatgctagtttcagcattcctgttggtaaaggagttctactgaggtttagttcacagcagtccatggtagagatgtgaactgctaaagttctgtcacttatgctgtccctgtaatatggagcccttctaggctcccacccaatcttgaccaagcgggccacttgcttccttttccttctgtgcctcaaatgttccctgtgtgttctccattgtactctagtgttctttcctagatgttctatttatagtatgattatctattcataattgtggttcttctttctggagagagcaggtgtctcacatctctagtcagccatcttgtaccaaaatcccattatttgtaattttctaaatagataatagataatatattcaaaatgtatacattttaacattacagacagaaatatggacttgaagcaaatattccaaaatatcaataatagtatttctgggtgctgggaataagagtgacaaaagaaaaaatctaagaaacaaatataaaacagccatcattctctttggttacctaatataaagcttaaagtgaagaagaaagcctggaaaatggcattgcagacctgagaacagcagaaagagtgaaataacagctccccaccaaggacactgacctttgaaacacagcatcagtgactacagtaggaaaacctaggactctgcttggaaacagaggggacttaaggatcacttataataatatttacttcttcagttgaggaaggtgggaagtcatttctgttgttacctagcagctcttagagatgagtttatataccaaaagtagttgacatatgtatcaaaagtaggataatctaagaaatactcttgtttttggaatatatatttaatgagtttcagttgcaagaagcagagaccctattcaaactgattgaaacagaaaggaaataattttttaaggtaacttcaaagttcaagtggtgaaacagcatttaggcattgcagtatccaggacctcaaatgatgtcattagatttatatatttttctccctctttctgtgtttgtctctctgcctctgccatgtctttctctgtcttacagtatgaatatgatttttttcattgttcagaagctggagctggaagtgactgaaatacttctgagaaatcttatttccatgaccatgcttgtcatcagaaatacatattcaaatatcatagaagagcatctagtggggagaactttatttttatccaaaactttaagaacaaggagtccaggaaatatattttatagctttccaacctgtccaactattaaagaaggagaatggaagggacattgaatgaaccaatttacaatatccagcatggtccactcttttggctgttcatcacctatttatacccttctactgatgctttcaaagaatggcaattacactattctacagctaacttaatgctactgtccttcatataaatgaaaacactcaacttctacccaaaaagagagatctaaaaatccatcagcccgtatatcaatttctagatgatattcactcatatcatttagccataatatcaccttgactttccacagccctagtactaaattataaagttaatgaccacgccttatgtaaaattcctggggaaaggcaagaaggaaattgatgtgtttatatgtacacacatacataggcacacatatagcatagcaaggtggcatttatgagtagctgctatagtccttgttctgtttgaaagttgctataaatttcccactgcagcatataagtgtagaagggattctttttcagggtagtagtttagaccatcattcttgaatcattgagaccttggtagtgtttcctatattggaatactgaagtcttctctgtttttatactcaatatgcaaattacaagaaagtaccccacctccatctataacacaactttatgtctcagtaataaccaggattaatcactcaaacagaagtaactttccttttcggcctgtatttttcagtgaaatgtgaccagaatgcccagctggcactctaaacttctggttcaagggattaattgttacaggtactccccatacttgaagagtacttctaaattcatatttcttgaagagtacttccaagggtattaaaatgtctcaactgttaaagagtccaaagttacagagacaagaagtagaaaattttcaaatgggtaacttatcatactatagttcattaattttgacatacatacttttgtctcacattttagtgtattcgaaattaggatgcttcctaaaatgatgacatcagtcaggcaattcttgtgatgtgcttgttattgtctatacatgcacaaacatgaaaatgcgtatcagcaggttggaagaaaatataggagatggtagtagagcgcctcaaaaaatactgtatcaatatttttgatataaagaacaataattgtgtaaaaacacacaataatgactgtgcatcaaaaaatagtctggaagagtcagactatgaatatgaaagcattttaggaatttcttaacaagtttaaaatttttttcacttcatatgtttacaagagtgatattaaaaagttatgtctaaataaatcaaaaatagttctctcttaatagggaaaaaatttataactgacaaagtatctcatagtttaattgctgtacatttttcttttttttcttagtggtacatgatataatggtgatttttataattgatagtcatagattcagtgaaatagggtggtgatatctaccactcccacctccaccttctggttcccagatacttgttttttatggttgaagaaacaccaggtaatggtccctgagaagtttcttttgtgtatgagctacaagatttcaagacttttcaaatcttgatcttaggtaatttttgaagtaacaataatcactaatagtttgtctttaatgttcttgtactagctatcacgagttttatgtatctttgttattgttactattttgtgtcaattgccaagagacttaaacatcttttctaacatgttcatattctcttgattaattacattatgaaacaacatgcctattcattatttttatttggaatttttccttttttcatgatttagtgtatttgttacaaaaaataacttgaattcacttttctatataggaacatttttattgattttatgtctcctctttataatctctttcatatttcattatgtttcttctaaatttatcttgtttttttaatacataaatttgaagatgaaaaaggaggtactcctcatatacattcatgtattatacatatatattcatatacatatatatgtacacattcaaatcacaagtctgtcatttttaactttttaattgaaaaatccccaaacttcttgccaatcgtagctaaaactgtacattacccctaaactttcccttattcagatctctaaaatgcctggtgccactccattagcacctgacataatggaaagtgtgaagaaggggaagttggagagaaaagagacagcaatctcaaccaattgctattaaaatatcttacttttgcaagtcttacaaaagcatgtgtccttgtgaacacaatgctagaatctctcccagggtattagaagggttgcctgcacttgagaggtcctgaaatttaatctctgttagcttcacagtaaacctgctgtggccctcagatttcagttctctttgtgagagaagccctctcctctggctggcaatttatgattcccttgcacacactctcttttctggggtctataggacataaatgtattttccctgctattccaagttgagccccctctcaacataattcttttcactctgccactgagcagaggtggttttatctaccatttagtacctttacattttgtacatttggtgagtccccccaaaacagtccctaactcttataaatcctagcagatagggtacatgttaagtctctgagtggtttccttgaagcccctcagttgatttgaggtaagggtgacctcctgccctgaatgtgttgcatacctcataactgctccaaaacaattctctccagcactcttcagcctctccctctgatgtaaattggctaatgttggcagatctggctttaaaatctagtttctgtgggtggttttatttttcatttgggaaggctggtcacctgatagaaaaataaaaataaccatgttaagacaaattggtgttttagctgtctgcttaattgcttttggccttcagttttctctttgaaatcttatactcaattgagcaaatgtttctcagttgagggtttatgtgttctaagtcctgtgataggtaccaggaatgcagagataaacagatccattgtaaacagtcaaatgtaatagaagaatcatatggctaatctgccatatattaagtcatagtgtctaaattgcattaaaccagctcaatataagaacaactgttttcttaaaagttatatgagattttataaaagattttaccttgccattatatagtaattatgattgaacttaccaaattaaatgtaatgtgacgtttactagtatttttccattaaattgttagtgaattaaaaggacgttttggaattatatgggggatctttggaagacttaattttttcatgggttgtataaatagatttatgagagggaaaatggatattagtttctgatatggtagtttatgtgagaattttatagtttgatttgtataaataaaataatgttattgcatatttctggtacattacacttttatttgtataataacctaaacttgtgtttatcttatattgctaaaatttaaggtaatgacaataaaagatttttctggtatgtatgtgaagcctaaatggccccattctgccaccttctggctgactccgtagcttataatattgtgaggtaagtgtcatctaaccgttctgccatggttggcagcagaccatatatttggggcctgggtgatttaaaacagggtcagtttaagcaataatgtagttctagtgcctcaggctcacctttatttcatagttctaaaatgtgttagaatttattggaatagaataccacatagtgatgtatgagattgtttctcccagggtatggagttgtagttaattttgacttttctgcaatactaaagtttcttcagatattacttgataattaaaactgtatcaacatggtaagctatttatcagaatcatcataagaaagttacttggagagtgatatagaaatgaaagttactgaaatcagcaccaattccttatagagaaactaatgggttcagtaatcacttactagagttctaaaataaaaggagaaaccatatgtacaacaacaaagtactaacaaaatcttagtaatttaaacctctagttttgtgacacttctatatattgccatttattaaaaaaaagaatttgggaaggcttaaaacttttggaaatgtaattcatttaaaattggtttgataaactttttggagagggatagagaaaataaagtagaacgctataaaatgttgcaatttgtgaccttttgcagcacacttaacctctttgtcactctggaaaatgggataataatatccaatataaaggtagattgttgtgaggaataaatgctttatttacttcatgtgaaacacttagaatgatatctgacatataataagttagcattgttatagtcaatcttacaacatttagaatatgttacatagtctaatataaatggattccaaaatattctaggcagtaagctttgtattttcttaacatttttacactcaataatattaaattaaaagagagaaattgaagactggaaatgcatagctccctaaagtagtgtagaaatatatgtgatatattggggcctaataaagggcctttatttctgtctgtgactcatcttttagatacctaaagctatctcataaaaaagctatggtatcttgaagaaattaatcaatttaaaaacatttattgagtgtatactgtgtgatcatcagtgtgttagattctggtaagaaatgatatgagaaactcacaaaaagaagtataaacatgcaattactacaatgtggtcagtacagtaacgtgggtgttaatatattttaggaactagaagagaagaaataacattgaactacactttgattaacaagtaggaattagctaggagaaagtcgtcttacataaatggaacttctatgcatgatttttgactactggtttacctgaagtttcttacattttgtattagtataactttacagcctttcatatccagaatgcttttacacacattatctgaagagtgaggttttcaggttattatctgaatggtgaaaattgggtttctatcgtagtaattatgggtgaaggggaaatatgtgttttttaaaactggacatttgtaatgttgctgtctgagcctatagccccctaccttcacctctttatgctgtggagtcaggcaactacactagcagtcaaatgcctgaggttcgcagtttgccctatcagtgctcttgagggttctcatgtgagtgaaaggagtgactatcccatgccctgcaccatttctgtggtggtagtggtggttgagggaagaagtttcatcttcacatttcaggtatttagaaagcccatctggagatttagttatgggactacctggctatagtcttggctagggcgttagtagatcaatgaaattttctcatcaacacgaagggctctaagtgttaaagggagacagtgcccacatcaaccatgactaggagtttcacatgtccatatttcatacattttagtactctggaaatagaatcccactttcctcatccccatcaccttattacatttaagtcttgtgttaattttctattattgctataactaaatagtggcttaaatagtggcttaaaataacacccatttattatctcactgttctgtaggtcagaattctggcaggctcttatctggagtttctggggaagaatttacttccaagctgatccatacttctggcagaatccagtaccttatggttataggactagggtctctgtttcttggttgactgtcatctagggggctcccttagctcttagagccctctctctggtgcttctacataggctgtaatatctcagagccagtaatggtgtgctgatcattctcacacgtgaaatttcatgacatgttgccatggctctcttctgctcctagctggacaaggttctctgctttcaagagcaaatttttttagatcgggcccacctaagtaatccagaggaatctatttagtcactaattagtagccttaattacatccgcagagtccagttaggcatatattgaaacatatccacagtttccaggcagtagatggaattaatagggggagcattctgcttatcagaaatccatcgggagtttagaaagaagaggaagtacagagagcctacgacctttggtatgcatttcaagactcagtcacaattaagaggaggatctacttaatagttaaagaaaatttaaaccatctttcttccctaatacaaccagaagtataaactagttgttaacagatatgcatatgattaaaataaaatttagaaggcagtgatgtgtttcagactcatattcagctatctttttgaaatctccatttgtatgtctagtaagcatctcaaatttaatatgtccaatagaattttttattacaacacccctccagccccttccttcagaaatgggatagttcccttgaccccttcgcgggactcacaaagggattgacttgtttactcagctcgcagctctcatcccctcacgggacggggagcatgcaggtgagtgggtacagggactgggacaagtgcttctgggcatccgcaggagtagaatcctgtgcagtccagtggaagcttcctggggggtgggggggaggggaggggaacctgtgacctccggagtcctagagggcatgtgttacagtgtgctcatttagctttgccatccacagacaacttaagtgtttaacagatcagtggagggtcagggtgacagccttttgcacccgccctcttggtacccgagtacttgtctggcatccaggaagaataaggtcatatgaatgaattgaagggtggtgaatgtggaggattttactgagcagtagaagtggctcttggcaggatggggagctggaaagcggatggagtgggaaggtggtcttctcctggagttcagccgtcccctgtggaactcttctgcgaagtcctgctgtcaagctgttcctctgaagtcaagctgcttctctttgatgtccttctgctgcctctcttctctcctctgccactctgccactctgctggtggggcttggggtttttatgggtacaggatggggaggtggggacagccaacatggttttggaaaaggcaaatttgggcaggaaaacaggaatgcatgttctcactttggactgcaggtccaggcttgagagtgtggccctcgttggggtctgccctcttctacccagtatttccctgcctcctgtctatatcacttcctcacccttccccagcttaataataactggcatcactacttattcacatgctcaagccaaaaaaagtaggaattatcttttattacttttattaattttctgggttcaatgaatcatcaaatctccttgtttttcaaaaatatatatgaaatctgtctgtttttctttcccaccacaacctcagttcaggtatccatcatctcttgcctggacttttgcagtagtccttaactatttttcatgtttccattcttaccttccacctacacagaagattcctgaatccattctcttcctagtagtcatactctttttgccttattcctctatctgggtctttaattcccagcttcatctgcatggcatactcttcttccatctttctgtaagttcctcttttctttgtacttcaggtcttgacagctgtgtatgttacctgaaacacattatagaaaatgtacatttgtacatgagatgaagataaatagggaggaagaccaaagagtagaattatctgctaagttgaacaattacaaaatagtaatctatcaaataaaatcttaaaatagctgtatgtaatttaagcttatcattaataagcatcctaattttcccctgctccttaaaattacctatacgacattgagctaaagcatttctttgttggaaagaaaaaaaattgaaaacaaaaatgcttgtgtattcagctctgcaggagggatattcaactgtatcagtattaaaaatctatctttccagaaaagaagtatgaagttaatttacctgctggtattactaatagtttaattaggtaaacagcatgagttcaaaacaattaatcatctgccataaaagtctaattattcctggcacattactgagctatttttactgtgtctgtgagataaatatgaattttgcgggttttttttctttttcttatatttgatagctatagacaataaatttagttcttattttctgttggactctgacttttgaaatgttattttgctaacacattcaattgactatatttactgttttcctaacttgattactactttattttacttctagtgaatatattttatgttttgaagaaaatataatatttcctatacttaaatcataaaattattttaaggataaatatgtacttagtgggaattttttgtttaaagtaagccaatttgccaaattttacattgtgtaaaaaataaagaggctttgctcaggattcctcagattccagtctattctttgttagaattatttcttttctttttttttcttttttttttttttttttgagacagagtttcactcttgtcacccaggctggagtgcaatggtgtgatctcggctcactgcaaccttcacctcccaggtccaagcaattctcctgcctcagcttcctgagtagctggaattacaggcgcccaccaccacgcccagctaatttttgtctttttagtggagactgggttccaccatgttggttagaattatttctgtaatgtatgtaccttagctgcaaaaaagcaaaattaaaaaaaaaagatgttttagcatacaagatttttagacagtataggacacatagaactgacagctttcatgttgaagaacaatattgtcttgatttcactggaattgttcatttgggtctatagcattctgtccaaattgcagaaattgattgttatggcatacccacgattttcatgctcatatgttataacagaatagtttttaaaaatcttgtttgaacagtttggttgtttgcatgcttccagtgtttagacttttaaaaaacgatttgaaaaaatatgatattgaagtgtactttgattttctttaatttaaataaataatagtcatatatttattaatcagatgtattaatgtaatacagtttacaaagaaattttatgtatattctcttagttgagccatacacaaaactagtgatatagtcagggaagttattaatgatctcgttcagcagaagaggaaaccaaagattatagaggtaactgattagtttaaaaagtggcatatctgtcagcattatgtgtgttcctattgcccagttttgcccatgtaattttctgtgattatggaaatgtttgatgttggcactgtctacacatgtagccatttagctacatgtggctgttgagcacttgaaatcatggctcatgtgactgaggaactaaatttttaattttatttaattttaatttacgtaaccatgtgtcactagtgactataatattggacagtgtaccctagactcaaacatatgaataaaagcaatttgaattcctggaagaaaaattagagaatacttacctttcaatgtacagcatatgttttgagcaattgaatattcttacattagaattgtgagattaaataaatttccatatctctttttatgttgaatagtaagatcattgtttttgcatattgtattaacttactgcttaatattcagcacaattataaacttttttagtttactatactttgagatatatattactattataattttaggtattctggtgagttcaaggataaaaaacatggagtgtaattgtgaaaatttgtttatgtatttgaaaatatatcagtttgccaagagtgaatcaatttcatattaataatgacaccatacttgatagtagtaatcatgaaattttgtataaaaattacattttttaaagaaatgtatgcatgtaactttttgtctcataaagtactgtgacaaaagtactacaactttactgtggatttactcagaaaaatgtatgtcaatttcacactgagattaaggtgaagcatgttgaaagtaaaacttttatcttttacattttttatttctaaatctattattaaattattaaaatcagaagtgatgagattagcttctagttccaattaagatggagtaagtaaatgcacatcactctattcctcccactgattatgcctaaaaaagattctgaacagaatacataaagtagctgtagaaagactttgaaaagtaaatatagcaggaagattggaaagggaaatcaaaacttgaaaagagacaaatacagtagtgaatttcctgcttttagcaatttcttcctacatcctccagcttagactcaaggcagtcagaattccagaactgtacagtggattcagacagaaaatgctgtggctcacgcctgtaatcccagcactttgggaggcccaggcaggcagatcacgaggtcaggagatggagaccatcctggctaacagggtgaaaccccatctctactaaaaatacaaacaattagctgggtgtggtggcgggcacctgtagtcccagctgctggggaggctgatggcatgaacctgggaggcggagcttgcagtgagccaagatcgtgccattgcactccagcctaggcaacagagcgagactccgtctcaaaaaaaaaaaaaaaaaaaaaaaaagagaaactctctttctctaatgagagaccctgtaaggaaatccctggtgacaaggaaaaaaatcaatgaaattccatttgtttgtttgttttctggtcctgctttgagacaagatatactcctaaaactgcactcctgtgtcagtggcagtagcaacaatgaccaaacaagtacctcaaattatgagaaagagtggagacaacccagaaaagagtcagtgaattagaacagaagatcaggagaaattgtctattgtaaacaacaggaaaacatttgtttaataaagggaaaagagccttaagaatctgtaaaacaatataaaaatgtctaaccctacaggtctttgaaatcacagtagaagaggaaagagattgctgcagaaatttctaaaaaaattgaatatgtaatggctgaaaacttctcaaatttcgcaactgacataaatttacagattgaagaagcttagtgaatgccaagaaaacaacatccaaagatataaccaaattactggaaaccaaagagataattcatcaacagcaatgctgctttaaaagaaatgctaaggaaagttatttaaacagaaaataagtgataccagagagaaacttggaacttcatgaaggaaaggaaagcaacaaaaataataaatatctggataaatataataaattgttttttctcctcttaagttcattaagatatgtataatggtagaaataaaaagttaacaatattgtctgttggggtttccaatgtgtataggtcggaaacaactaataatatgaaggagaagactttaaagagaaccaaatgtctgtaaggtttataagttacccatgaagtgataaaattttaattctagctgggtgcggtggctcacgcctgtaaacccagcattttgggaggctgaggcagggggatcacctgaggtcaggagtttgagaacagcctcaccaacatggagagacctccctctctactaaaaatacaaaattaggtagtcgtggtggcgcgtgcctgaaatcccagctactcaggagaatcggttgaacctgggaggcaggggttgcaatgagccgagatggcaccactgcactccagcctgggcaataagagcaaaactccatctcaaaaaaaaaaaaaattaattctaagtagactttgaaaaatgaagtacatatactgaaatctctagaacaacatcaaaaaaagggaaaaaagcaactctgcaaatttgcagatgttcaagtaattcaaaagaaggcagagaatgagaaatggaagtgaaaaacagagagaagagactccattttcagcagtgacatgtaaagaacctagaatctaccactagcattcttacaagataaagctaaaaaattgagaatcagtgttttgttgttttcttccccccatcagagaactgagattgcagggcaaccactagcctgaaatctggagagaaaagcaaatccagagactcatggccgagatctgcttacttagagccaaagccactggagccataaattggtgggaacatttaaatgatagttttgacaaactgctggaggctgagtgtggactaacatgggagtgtgacacctctgggagcagcagtcttagggaggcccccacactttcatgggttttgcttctatgtattttatcaggtacttcatattctgatgaagatcctggaaaaggtcccctcgtagttcttgcagagagagggagggtaatcattatgaaatatacccagagtattctccaacaaaggtctactctgtaggggaaaatatattattagacccctatcctggtttggggagggcatttctcccacttcagctcactctagccttcctgtgtcggtttcagtgggggaaaatgtataccactggagaaaagcccatgaaggtcacagctcagagaaaataggcaaagtaaaaaataaaggtttaatcctaaaattatagactgtatttcattccccataccttactaccataccaacagagctctggtataataacaatgcatttcagctggaagagttgcaagaatggactcttttctgaggaatagtactgagataagctcaaagtcaatggatgagacaaacataaggatactagaggaacttgaagtttctgacatctatagcaaacattaaacacagcttacctcctggccagattaacaaatccacatcatatgtttacctttgttcttattactcaatgcaacatggtgaactttcaacaaaaaaaattagaaggcacacctaaaggcaagaaaaaacagtctgtagagataaagcaggaatcagaaccagactcagatgttacagatatgcgaattatcagctaaggaatataaaaaaaccatgattaatatgttaagggccataatggaaaaaatagacatcatgtaagagcacaggagatacataaagcagagagacactaagaaaagatcaaaaggaaatgctaggcataaaaaacactataacagaaatgaagaatgccattgataggcttatcaatagaatgggcactgctggggaaagaatcagtgaggcaaaaataggtcaataggaactccctaaagtgaaatataaagagaaaaaataatgagaaaacaaaaacagagcatccaagaatggtgggacattttaaaaaggtatatgatttatctatcattggaataccagaagaagaaggaagaaaaaagaagaaatatgtgaagtaataatggccaagaatgttacaaaatcaatgacagactttaaaatatagatccaggaacctcagaaaatatcaagcagaatgaatgataaagtaagtaaaccgtgcacattatatttaaaaactgcagaaaaccaaaaactaagagaaaatcttggaagaagcaagagcttggaggggaaaataaaaacttacctatagaagaacagaataagaattatggcagacttctcatcaccatgcaagcaagaaaagagtagagtaaaatattttaaaagttgaaagaaaaaaaataccaactgacctataattatatatctgtgaaattaaccttcaaaactgaaggacaaataaaataaatatcttctcaaacaaatactaaggttattcattgccaacagacctgaaactcagatctacataaagaaaggaaaataatgataaaaggaaaaaaatgaaggtaaaataaggatcttttatttttcttattcctcattgatctaaaagaaactgtataaagtaacagtaggaacaacatgctgggtgataatgaaacaggaagttttccctgatgccttcgtggtggtgggggaattggagtgctggtgctggagctagttggcggctttggccagcttcacttggctttactctgcttcacttggctttactcggcttcactcgctcagatctgctgccctctaccccttgcgggagggggagcacagctgagccagtgcaggagccaagacgagtgcttctgggcactgccaggagccaaactccatgcgggccatggcaacacctagtgagggagtacctgcaacccctcaaagccccagaagtaatgttacagtcagtactcttttagctttgccatccatggatggcttaagtgtttaacagttcagtggaccctttgcctgttcacaagttcagagagtgtgatagccttgtgtatcctgagctcttgtcctgcgtacaggaaagattaggttgcatgaatgaattgaaggacagtaagtgtgggggattttattgctgatggaagtggctctcagcgggaaagggagctggaaagaggatggagtgggaaagtagtctccccttgaagtctctctggctagactcttctccaaagtcccactgtcaagccattcctctgaagtcaagctgcttctctccaacgttcagctgctgtttctcctctccatgtttggctgcttctccttctctgccagctgggtcaggggtttttatgggtataggatttggggcagggcaggccatgggtggttttggaaaaggcaacattcaagtgagaaaacaggaatgtatgttctcactttgggccgtgcttccaggcttgaggatggggccttcgctggggaccctgcccttttctgcctagaatttttctgcctcctgttcctaccaataataccatatggataagggaaatgaatgactgcaatgttaaaagagataggagaaagtatttgggaatactctattacaaagtacctgtactgcaaagaaaacagtgtagtgttatttgaaggtggacttagattagttaaaaatgaatactgcaaactgcgggacaactaaaaaggattctaaagagagatataagtgaaatgttaagagataagattaaatagaatcataaaatgttcatttaaaaccagaagaagaagaaaaataggacggggaagaaagaataaagtcaacagttagaaacagttacaaacaaggtggaatataactatgtcagtagtcactttaaatgtgaatggtgtaaacatccattaaaagacagttcagagtggataaaaaacgaaacttagtttagaaaagcaagacttcctcccatctcttatgacatggcagttattcattttccttgtccatattgaaattatcacccagtatgttgttactattgttactttaaacagtttcctttagatcagtggggaatatgaaaaataaaagattcttattttactttcatcttttcttttatgattttttaaggcaagctatgcattgtctgtaagaaactcactttaaatataaagaataggtaaggtaaaaaggagcgagatggagaaagatataccatataatcactaaccaaaaggaagctgaagtagctgtatacatttcagagaaaacaaacttcagagcaataaacatcagggatttaaaaaggttgggggagcattacatacgtatttggcagtcaattctccaaaaagtcttatcaatcctaaatatatgaacttaacaacaaagtatcaaaatacttgaagcaaaagctgacagaagtgaaatgaaaaacagccaactccactattatagttgaagacttcaacactcttctttcaataattgatatagattaagcaggcagaaaatcagtgtaagtaggtaattgacctgagcagtactatcaatttgatgtaattagcattcattaaatgctccatttaacaagagcaaaatatacatttttttcttcagcttataggagcatttaccaagatagaccacattcttggccataaaccacatttaacaaatcttttaagatagtaatcatgcaaagtatgttcttagactacagtggaattaaactagaaatcagtaacaggaagaaagctggaaattagttaaagaacatatttctaaataacacatgggtcaaagaagcctccagagaaattttaaaatattttaagctaaatgataatcagagtacagtttatcaatttttttttgcaatttagtaaaggcagtgcttaggggaaatttatagccttaaatgcaggttctagaaaagaagaaagatctaaaatcagtaataaaaagttctaccttagaaaactagagaaagaagagcaatttaagcccaatgcaagcaaaagaaaagaaataataaaaattagagcagaaatcattgaaatggaaaacaataaattcaacaaaactaaaagttatttgaaaaaaataaataaaattgataaaattctagccaggataaggaagaataaaagaagatagaaattaccaatatcagaaatgaaagatggatcttcttcactgaagcatccatgggcattaaaaagataataaaggaatactatgaaaaactttatgccccaaaatttgataaatgaaatggaccaattcctacaaactatcaaaacttacacaagtgtaaataaatctgaatgcttctatagcttttaaaaattgaatcgattatttaaaaattataattaataattttcagaaaaagaaagaatcaggaccagatgaattcactggtgaaatatacaaaataaaaatcagttctaagataacaaacaaccctattaaaaagtaggcaaaaatctgaatagccatcttattaaagatatagatgtcaaataagtatatgaaaagatattcaatattatttgtcaaattgcaaattaaaaacaatgagataccactgtacacttactagaacggccaaaaccacacacacacacacacacacacacacactcactctgactgccgattggtgacaaagatgcagagcaacataaactctttttcgttgctggtggtaatgaaaatggcacaaccactttggaagacagtttggcaatttcttgaaaaattaaatatagttttaccacacaatccagcaatcacacttgtaggtatttaaccgatttaaaaacaatatccacacaaaaacctgcacatgaaaactgcacattatagcttccttcataattgccaaaaactgggagcaaccaaaatgtccttcagtaggtgaatggataaactgtgatatatccattgacatggctaggctttgtgtcaccacccaaatctcatcatgaattgtaatccccataatcgccatgtgtcaaagaagaaaccaggtggaggtaattgaatcatggaggtgttttcctccatgctgtactcatgatagtgagttttcacaaaatctgatctttttataaggggctcttcccctttttgcttggcacttcttcctgccaccttgtgaagaaggtgccttggttcctcttcaccttctggggtgattgtaagtttcccgaggcctacccagccatgctgacctgtgagtcaatcaaacccctttcctttataaattacccagcctcaaacagttccttatagcagcatgaaaacagactaatacatccatatgatcaaatattattgaattatataaaagagctataaagccgtaaaaagacatggataaattttaaatacatattactaagtgataaaaacactgaaaagtctgtatactttataattgcaattatatgacattctggaaaaggcaaaactcaccagtggtaaaaaatatcattaggtgccaaggttcagggaaacacaagggattaattagggttgtgaaattattggatacatggcattatgcatttgtccaaatccacagcacttacagcacaaagaacaagtcttaatgtacgcaaactttaaaaaaactcatttagaaggttgatggatctgaggatggaatgcaggaggtgaaaaaataatataactgtagtacaaatgtatgaaacaacctactgaagcaaatggagttgaaatgtgttgacttaagttaccttgaaaataagtggagtccgtaagactggaggcaaaagagtactgtagtctagttgataaagttattttccatgggaataaagttgttaacctacctaccaggttaacaattctgatatttctatatgtatatactgaaattgaacaagtaaataagttgatggtggatggtgggagccaggtttctctctatttgagtaggatttacagataagcaaggggaggcagctagaagaaatcatgtagtaatgcattagagttggaaaccagaatgaactcatgctttgcttatagacacagttacatatggaaatacttatcgataagggaataggcaaatgttagtatacacgtatatttccttgctctcagaaaagagggcctagaagcaacaacaccccagtagatgaatgtacccacttgccagatcttgatttctaagaccattctccagtaaaaggaactaaggctccttggagaaatggatgattctaaaagggctggggcaggaaatacacaaagtgagcatggggcatcttgcagtgctagaaagtaaggatgtgctcaaacacatacacaggtgtacacacatgcacacatacacagtgatggaggtatatcaaagggacataggaggaagttgatggagcttcccatggtcaaaatggaataatttgaccaacaaaataaataatgtaatgttgtataaatgctacaggcattaaaagagtaatgtgtacattagaaacaactttattacacaaagttgacaacttagttgaaatagaccatttcttgaaagatgcaaactactaatattcattcgagatgaaattgataactcagtaatactctgtttattgaagacattgtattagtatttgtaatcttcaaaaaaaatcaaaaacaaaaacgaaaaacaaaacactgtcccagatagttctgggaaattctacaaaacatttaaagaagaaatgataccaattctcacagtttcttctggaaaaatataagacagaatacttctcaacttattttgtgaagccaatcttaacctgctaccaaaatcatgcaaagatggcacatgaaaataaaactaccaagcaatgtatctttatgaacacaaacagaaaaatcctcagtaaaatattagtaagttgaatccagcaatatatacaaggaatattacaccaagaccaaaaggggttcattctgataattcaaagctggttcaatatttgaaaattaatctgtgcaacccaccatattagtagactaaaaggtaaaaaccacatgattttatcaacaaatgctgaaaacacattaggtaaaattcagcatcctcctaagataactcttcactaacccaggaaaaaaaaaggaaactttgttatctcaataaggggcatctacaaaacagtgtctacagctaacattttagtagttaatgatgaaaaactgaatgctttcttcctaagacttggaataaggcaagaatgttcattgtcaccaccttgttcaacattgcactgtaattcttgaccaatgcaataaggcaagacaaataaataaaaggcatacagattagaaataaatagttcctgttgaaagacgacatgactgcctacatagaaaattgcaagaaatctataaaaagaaagtctcctaaaactgagtttagcaacaataatatataaaaataatatatagtagcaatgcacaatgtattagtttggtacaaaagtaatagaggtttttgccattgaaagtaatggtgaaaaccacaattactgtgtacccatctaataaaacatttttaaagaactgtttacaatagctccaatttttaaaatacttaggtataaatctaacaaaattatgtgcaagatctgtgtgttgaaaactgtaaaacactgatgaaagaaattcaaaagacccaagtaaatgaagagacatgctatgattatggattgaaagactcaatatggttaagatgtcatttcttccaataagcataatccaaataaaatcccagcaagattatatttgtagacatagataaactgatcttaaaatttatatggaaaggtgaagaaactgtagtagccaaaacaacttcgaaaaaaaggaaaaagggccgggcactgtggcttacgcctgtaatcccaacactttgggaggctgaggtgggcggatcacgaggtcaggagattgagaccatcctggctaacacggtgaaactttgtctctactaaaaataattaaaaaattagttgggtgtggtggcatgcatctgtagtcccagctacttgggaggctgaggcaggagaatagcttgaacccaggaggcggaggttgcagtgagtcgaaatgacaccactgcactccagcctgggcgacagactgagactccgtctcaagaaaaaaaggaaaaaaaaatagaagatttacactatcagatttcagacttactagaaagctatggtaatcaagacagtatagtattggtgaaagaattgacacatatataggtcagtgaaagagaatagagagtccagaaatagactcacacaaatatggtcaattgatttttgacaaaggtgcaaatgcaattcaacagtaaatggatatataaattgtggtaattccatacaatagaatttagccatataaatgagtgaatattaagatacacaacatagataaatcacaattgccatactatactaaatgaaagaagccaatctgaaaatgttgcatagtctataagtccacttatatataacattctggaaaaagcaacactattaccctaaaacctttatttgaatagcaggagttatagtcatgtcatttgtcctctacatggagcacatacatcatttacacattaaatatgttttcatgtttttcttttatttaacctttaaactctaaagtacatagttctgcttggccccaagatgattgtaagaaacatggacaatgaaattttatggctataggtgaccgtcttaattaaaaccttctcatagcagattttcagacctgggacaatatatccaagaatgaatcttacccaccactattttttcaccccaacttcttcactcttatttggaaaataactgcatttaaaaataaaatgtttacttcatgtggtaatcagtgtcttgcagtacaagaaaccctgatctaggagtttgaagacctaggtgactttgggcaagtcacttaatgtttatttttttgcatcttaaaataaggataataatacctgtgctgcttactttatttgtaaggatctcaggtgcattacagtaatttcacaatggttttacagagtaaatcactttatatgtggtaaagtgcttggtaaatgtgtcatcactattattaaataaaagaaaccaatattttgtggtattttgtggcaattaaagctggttcaactctgaaaatttctataattttaaaaattaatgcagaatgaaggaggaataaaatcaacctcatgaagttgattactctctagttttaaaatcttatttaactacaagataagctattctggtaaattctcggtgcatggcgagacatttagtgcgaattaaagttgtggaaacaccgctaggaagaataacaagcaatatacttcttaaagttaattgcagttatgaaggaattcatagttttagttaaaactgcagttgtttctttctagcagtagatgccagtagagttcttctttttatttttatttcttaatcaaaaatcaaatatccgaagtacttctatagcaatagcttcctggtcacattaccacatatagaaacattgctttaaatattaaatattctattttctggaaggacttgataacaaattgaaacaattttatttttaaaacagtgcagatttaaaatacggtgttttcaagatactcatctagtgaagtttactctttttgctttagtaattttgttttaaagcttatgcattgttttaaataaagtaatcttagtgttctagttaggaatctgcaacttctgtacttgagcaacattgaatataaataaaaaatctggctagatgtgttaaaaatgaatacggtccagctgaaatgttacgattagtttgtgtatttggcaatggaataccatgagtgtaatactttggggaggttaatatgtcagagaggtgaatgattaaagggggtaattggaagcggggaaaacaagaagttaagaagtccacattggcactgagtaaaaatgtaattcaaagaatgaataaaatttagtaacaaatagaaaaaaggagaagttcaatgataacagttctattactcttgtctctatatatgagcaacttggtgcttcttggattatctataaatatggtcccatcataaataaaattcaaacattttcaagtattcggtgattctacttagacctttaaattgttaaaaatgagtgaatacttttttcttttaacatgtttattgagtatgtaatacatgcatttcatttatgaattcaagtaactcacaatttagggtcatataaattcataaacagtaccttttaacataatattatgaggtcagtgaaaacaaagcagcaaagtttgttttcctaggaagtatgtggcagacttcactgaagaggtgacatttgaactaagccttgaagatgattagaatttccttcagtagagcaaatcaagggaattcagtaattttatccacttcttcccttacagaatcagtccatgctctgtagatatttgttgaagactacagacatttaataagtgtctgttttgtgtaaggcactaccagatgttaagaaacaaattattgttatgcacacataatatttatacataaagctacaaatttaagaattttgtcatatagatgctgttgcatatttgtttagattgataaaaattttattacacaaaacaaagtatacagaaatgagctgttacatggcaaaattcattggtcagtgttttgttaactgttattcacacataatatttatacataaagctataaatttaagtttatcttatagatactgttacatacttgtttagattgatatgaattccattacacaaagtatacacaaatgaactgttaaatggcaaaattcactaatcagtgttttcttattggccttttatgtagtcctaatttgattacattattgttcctatttattttacttatcagtattgtttctattttttatgtttgtcaaacagttggcagtaaatctgaagtaagatttttttagatagattgttttagatagacctttttctttctttcctttccttcccttccctcccctcccctctgcttccaaagagaaccacggaaatttcttatcctttagtgtcaaaaaaacaagtactcaaaatttttgttaaatgccacaggttactttctttcctgaaaattgacaaggcaagttttacttacttttaatcaaaagagatgttttggccaggcgcggtggctcacacttgtaatcccagcactttgggaggccaaggcgggcgtatcgcttgaggccaggagtttgagacaactcctggcctggccaacatggagaaaccccatctctactgaaaatacaaaaattagccgggcatggtggtgcgcgcctataatcccagctactcggatgtctgaggggcgagaatcgcttgaacctaggagcggaggtcgcagtgagcagaggtcgcaccactgcactccaatctgggagacagagtgaaacaacgtttaaaaaaaaatagagaggtgtttctaagtgagatcactaaatcaggggtttaggtaagtagtagtcttcagtggtaaggttttaaaattaacatgtctcagccaactagaaggaacttttttctctcaattgaaatttcttgctatggtggattttatataatttaaatcttgtattttgttcttttcaaattttagaatgttttaaaatgtacccctggtaatagacatatgtcagcagattataagtttgataagcaatactgacatactaagtgtatgtagttcctgtatgtattaggcctaaatcaatgaattagaaacattcaattttttaaagtgctatttcacattgttttatttatacgtgttataaatttgttttgcaagagttttttcatacccatttcatactagtttttttttatgaaaagttagctgcttataaggattcataaaatctgtatattagttgatttcctagaaaaaatacaacctgtctttagcatgttgtgtttggaggacagcttggccttcagttgtttgcatagacttgtcatacatgtttaactagttttctttttaaagaatgtttagcctactatatatataaagctttatatttaatgctctcattagcctatatattaatattaaaacacccaaacataaagccttttaggcagatattgcaagtttttaaaatcctcaactctagctgaaaagtgttttgctaagaaaagctcagtaatgtgctgttttatattaacaggaaacagaacagcagtagtggtttgaataccctgcaaacaggaagtttgacacatgcatagctcttagcttctgtgtaagaagttgtgagctccttctggaaacatttgcagttacattaagtaaagtgtaaatgcacatgaatggcagcttatagagaaccaccttgtaaccagtatacaggtacaactacagctcttcagaaattggaaggttttgctagccggttatttcatagacactctaaaggtactgcacatgatcagaaaacagctctggaaaatgacagccttcatttctctgaacatactgccttatgggacagatcaagtaagttttgttttttaaatgatacattataactagcaactaaaatggtaattggagttttacaatcaaacataaagaaccctcttttgtttgttgttttctgattttcacaaggacattttgcaagatgaagttgaaagaattccataaaaacttgattataagttgagctgaatcattcagctttcatcattgtatggttttatttttgactaagttcaatatcagtgacaagattttctataaaattcttacatcatttctaatgtacttttttttgttgttcttacataaaaatgaaatacttaagtttcagaaacaaccatctgtttacttcttaaaatgtcttgtatttataagctttaaactttgaaaggggcaacaagactcttgaatttataattacatttctattgtgtttgccatggttttatttttaaatgcatgtgagaaagttatttcagttttacaaacaggaatttctaaaataaaacataattattctatctaaattcttacacttataacattatggatatcaaaaactttataattatattttatgttatttatacatatgactcaaatgcaggaaaagttggttatgcatgaatcacattctttcaggcatgttaaaatgtttgaacttgcagctttgctaaaatggtgctggggaaccatttttggtgccatacactctaaaagataaattgcacatataaacaatactagtgccgccattctacatctcaccttggaccctcctcaaggtatttctgtgactccaattagaggaacaatagaattacccttgaaacttttgccctctttggtgtgtttgtttgatcatcaaatagcactagcgtttgactctttctgtttatgtatttggtagcagttaaggaagaaaactcagcttaacaaccacaacagcaaaatcaagaatggcttacaaaatttactcctaggtttatacagcaccttgacagtgttatagaagcttatttgaattaattttttactaaatcagaaatttttttacattcttcaaactatttttgggagattgaggaagaacatgtatttgtgcattttttccacttaaaaggttttgggttatttatagtctttactgtatagcaagttgatggatgaggaatatgaatatatatcttcaagttaatgaactgttgaatattaaaatagtggtataatattaaactttaccatgtaacaaaagcttgttaattattgtccttgccctattcttttaaattgcagtcttttaaatccttttggaaattatttttatgcatttcaagtatgttttaatttaaagttaaatgaggaattaagacagaattgaattaatttctgtttcattaatacctgctcttcatatagtgggtgtttagtaaaagtgtctcaaataaatgaatgttaggggtttttaataattaaaagttatgtttgaactagactttcaccactttttaaatgtatgggatctgtgatgctttctaaaacatattttaaaatctagtaatggaaaatagtatcatgagccatgatttctattggataaaatgctgttttgttttttttttattgtgaagtcaaaacaaataggattcttgtacacaaataaaattaggagcaaaccatgtagcgctgcaaataatatgcatgatgtaagaaatacttaaagagtaactgaatgttcattaattaagcattcctctacttgactctcctttttatatccctgaataccataatagagataataattttatgtctaaggatgagtatggtagcatgaagctataatttcctattatgaaatgtattattgtagaggagaaaacactgatagagctgaaatagaggaatccgatcatttcaaaattccaaggtttatttttgtggtgaaaacacaatttttatttatttggcgaatgagttatagaaggagttctgactgtacaaagtttcatatgaaccacattcttcaaagctacttaaagcagtttacttgcatgactcatttgacaagggaatgtaatgtctcctgatgataaacactgaatatgtttgttcctaaagtgtttttataatgaaataaactaagcatagaaactacatcaatttacaaaaaaaattcataaacctttgtataaagatcagttaccaatttaggagacatgaaatgcagcatgcttcaatccaagtttctttcgtgtccagtgacattatgtataggaagaaacacagaacaaaggccacatagtggtctcaggtgtttcatcttttactattaaactaagtaacagaaattcctgtttgattaaataaatatgtaacagctaattgcatgcacatataaatacatgaagttcaaagaaaagcatggaggaattctgctttttgttccaactcagaatgaatgagagcattgacatgcgttaagttctctttctagcaaatttattatagttagctttttaatcttcctttgatcataaatgtgtagagttatacaatgctgacttaatgaaggtctaactacagtattttaagaagcaaataggtcaataccatcaaatactttttctttcccttttcctatgaattgacaggctatttctcttgtaaatacaaatccattttagtaaatcttagatttaaatatattaaacaaatgagcagttttgattatggatgtcctctagcaaaatcataaagtggttacagtagaccacttcagtcagttttacctttgcaaattttatacaatctctcagacagtttacctcctatttgttagcccattgaatctgtatcattttaacttctcagctaaaagactttccacctttgtctttttatcagctttttccacttgaaactattccataagcttcttgataatagtcaatttctactcatttggtaaaacttttttgagtatttactatatcatagtaagtaagcaagtttccaggaaaaataagatctagttcttacccccaaaaagaagagcaaacataatataatattcaaggcataatgaaatagttgctttaaaatgtctaagcttactgtggaagctaagtgtaagaaaaaagttgttactaaagagaaaatgggggacttcaaaaatattaaagaatgaatagaattttgagacctagagaagaaggttattttaagaaaataacatacacaagtatgtgaaaatatgaacatttagaacttacttaaaaggtttagtaagatactgtctagaaaattaggttctggatttaaactttaaaagttttctattagacatccagaattttgtactacgctgtattagtggggagccaatgcagttttttaaagtggaaaataatataatgcaacctttgttaaaagagcctaaagattttaactagcataatacaggataagttaacttactttactacagagaaatgtgtatagctactatacatcttccgtttttgctgggcatttaattagaactaacgcttttgacgtgacagtcagcatggcaatgaatagtcagataatggattccttttacaacagtgcttgttcaagttgctgcttctgtctggaattctctttcttcacttctaccagtggtgagatttgcccatactttaggcatcctctcaggtatcatctctgtaacaaaaccaccaatgtatcctattcatctatccttcatccttcttagagtctgtgctcttccttatgttcttatatcatcttatacttaacttttattgtggtttatttatagtatttatatggtatagtttgtatactatatatattatagtttataatatttaaaatgcattactattaatccttatgtatctgtctctcatgtttgattttgaactccttgaaggcaaataacttgtcagtttatttcagtattactagcataattttcaataaatcttgagttatttgttaaattaacattaaacatcactgcagtattacacaaatgagcttcttactaatttgtgctattgtgatctttgcaatttattttaaaagcccatggccattaaccaaaagcagtcaaatgctgacctggctctagtaaataccaattttcagtgttacctgtgtatttttatcatgatttccaataaaaatttaagtaacaagcagactttatagtaaaactaaaatagttgggatattaaatgatgttgaaatcaggaaatcattccatgagccatttagcaatgcaagtactatatcaactgtactaacataacgagaagcttttacttgcttgtgctttgcaaaaatagccatatgacagagttagaagacagcttgctactcaaagtgtggtccctgtccagcattattagcatctcctgggagcttgttaggaggaagaatcccaggtcccacctagacctacttagtcagaatcagcattttaacaagatttcccagctgatttatatgcacattaaggtgtgagaagcactttttccctaataacattttaatatgatttccaaatgtatatcttcactggagaaaattttgaaactacaggaaaaaacaaaaaggtaaaaaaaagtatacataattctgccaaaaggtaatgactgttaatttttgtatatatactctattttgtgtatagacacacaaatttctaccagctccaattttttttttttaaacagagtcttaccgtgtcacccaggctggagtgcagtggtgggatttcgactcgctgcagcctctgcctcccaggctcaagcgatcctcccatctcagtttcccaagtagctgggactataggcatgtgccaccatacccggctaattttttgtatttttggtagaggtggagtttcaccatgttgcccaggtcgatcttgaactcctgaactcaagtgatctgcctgccttggcctcccaaagtgctgggaatacaggcctgagccactgcacccagcccagctccagaatttggatctttcaaaacataatgtttagttaacatttttctttataaagagttgttctacaatactattttgtattaaatcataaggatatactataatttatttaaccaatcattggccatctaggctgtttttaatgttttgctattaaaaaatgccatgataaacatctttataactaaatatttgtacatatttaggattatttttatattttataggattaatttgaagaagttatgaccattttaaggcttttgcattaaattaattgaatcccagataaacatgcatatctttttggagttaattattataataattattttttcatagattatagcacttgagaatgtgtgaaaataattatatagctactatccttaatgatatttttaaaaacaaatttaaggccaggtgtggtggctcacgcctgtaatcccagcactttgggaggctgaggtgggcagatcccttgcagtcaggagttcaacaacagcctggccaacatggtgaaaccctgtctctactaaaaatgcaaaaattagccaggctccatctacaggtgtggtggcgcacacctgtaatcccagctacttgggaggctgaggcaggagaatcactagaccccaggaagcagaggctgcagtgaggtgagattgcaccactgcagtccagcctgggtgacagagtgagactctatctcaaaataaattaaaataaaataaaataaagaaaacacatttaacattgtaaaatttattctcaaaacagtatattgatatttttaaaaattaaaaatataatggcccattatacttccttctgttacaactaccagggtcatggtaagaacattatatgtttgtcccctccaaatctcatgttggaatgtgatccccagtgttggaggtggggcctaatgggaggcgtttgggtcatgggggaggatctctcatgaatggcttggtgtcctcccaatgggtaatgagctggttcttgctttattagttcatgcaataactggttgtttttttaaaacaaacatggcacttccccctctctcttgctccctctctttgcctgtgacatgcctgctccctctttgccttctgccatcattgaaagcttcctgaggccctcatcagaagcagatgttggcagtatgcttcttctacagtctgcagaaccatgagccaaaataaatctctttataaattattctgccttaggtatttctttatagtaatgccaaaatagaccagtccataacaaaaatctgaatgtgaaaaatatggatttgagaatttaactccattcttaataagttgacactggaaagtttatttcttcctccctccccctcagctttattaaggtatacttgacaaataaaattgcgtatatttataatgtacaacatgatggttcaatataagtatacattgtgaaatgactaaaacaaatgaatatccacctcacatagttactttttcatggcaaaaaatttaagattgaatctcttagcaattttcatgtagtcatacctcagagatactgcaggtccagttccagaccaccacaatacaactaaagtcacagtaaagcaagtcacacattttttggtttcccagtgcatttaagttatgtttactctatagtctattcagtgtgcaataacattatatctttttaaaagtacatatcttaatttgaaattattttattgctaaaaaaatactaatgatcatctcagctttcagcatttcccaatttttttgctggtggagggtcttgcattgatgtttgcctgctgattgatcaaggtgatggtcgctgaaggttgggatggcagtggcaatttcttaaaataagacaacaaagtgacacacttgactgactcttattttcataaaagatttctctgtagcatgtgatgtttttggtagcattttacccacagtagaacttcttttaaaattggagtcagttctctcaaaccttgttactgctttaccaactaagttgatgtaatattctaaattctcaggtgtcatttcaataatcttcacagcatcttcaccagaaatagattccatctcaagaaactactttctttgctcatctgcaagaagcaactcctcactcgttatagttttatcaggagattgcagcaatagagtcacatctccaggctccacttttaattctaattatcttgtaattttttaccacatctgcagtgactttctccactgaaattttaaaccgctcaaacgcatctatgagagttggaaacaacttcttccaaactcctgttgatgttgatattctgacctcctcccataaatcacaatgttcttacggcatctggaatggtaactccttttcagaaggttttcaatttactttgcccagatccatcagaggaatcactatctgtgacacctttagccttataaaatatatttcttaaataataagacctgatccatgcctgcagaatggatgttgtgttatcaggcatgaaaacaacgttcatctccttgtacatcgagctcttgggtgatcaggtgcattgtcaattagcactaatattttaaaaggaatctttttctgagtggttcccaatggtgggcttaaaatagtaaacaatgctgcaaacagatatggtgtcatctagcctttcacattccatttatagagtacaggtagagtagatttagcatagtttttgagggcactaagagtttctaaatggtaaatgaatattggcttcaatttgaagtcaccagatgtattagcccctagcgagagtcagcctgtcctttgaagctttgaagccaggcattgccttctctctagctaggaaagttctagatggcatcttcttccaatagagcactgttaattctgcattgaaaatctgttgtttagtctagccaccttcatcaattattttagctagatcttctggataacctggtgcagcttctccattagcacttgctgcttcaccttgtacttttatgttatagaaagggcttctttcctttaaacctcatgaaccaacctctgctagcttcagacttctgcaacttcctcaccactcttagcctttatagaattgaagagtgtcaaggccttgttcttaattaggctttggcttaaggaaatgctatgactggtttgatctttccagaccacacaactttctctatatcaacaataaggctgttttgccttcttatcattagtgtgttcactggagcagcacttttagtttccttcagtaacttttttcttttgcattctcagcttggctgtatggtgcaagaggcctagcttttggcctgtctcagctttcaacataccatccttactaagcttaatcatttctagcttttgatttgaagtgagagatgtgcaattcttcctttcgtctgaacactaagaggccattgtaaggctattgatcggcgtaatttcagtattgctgtgtcttagggaataggaaggcccaaggagagggagagaaatgggggactagctggtgagtggagcagtcagagcacacacaacccttatcaattaagctcaccattttatttgggtgcagtttgtggtgccctaaaacagttaaaatagtaacatctgaacacagatcgccataacagatataataataatgaaaaaggaaatattgtgaaaattattaaaatgtgacacagagacatgaagtgagcacatgctgtaagaaaaatggcaccaacagatttgcttgacacaaggttgccccaaccctcaatttgtgaaaagtgcaatatctgctgagtgcaataaagcaacacacaataaaatgaggggtgtgcctgtattaatgcattattattaactgcagttaccattctatacgatgaatctccaggacttattcatcctgtctaagtgaaattttgtaccctttagccaacatctcctaaatcttccttccctgaaccctcccatccttcagcccctgacaaccagcattctattctctacttctgcgattttgatgtttttaggttccacatgtgtgacattatgcaatatttgtgtttctgtgtctgccttatttcacttaatataatgtcttccaggttcattcactctatcacaaatgaaagaatttccttctttcttaaggttgatagtgtattccagtgtgtagaataccatacgtcgatgccatatcttgtgaataatgctgtaatgaacatgggagtacagatatctagatatctcttagacatactgatttctttcttttgatacatacttagaagctggatcatatgatagttcatttttaattttttgaggatccttcatatcattttccataatggctgtactaatgtatattctcaccaacagtgtgcaagggttctgttttctccaggtcttaaccagtgcttgttatcttttgtcttttttataatagccattctaacagatgtgaggtagtagctcattgtgattttaattttcattaccctcatgagtagtgatgttgagcatttttcatatacccattgaccatttttatgtctgcttttgagaaatgcctattcaagtcacctgcccattttttaaattgggtatttgttttcttgctattgagttgtttgagttccttatatattttcaatatgaactccttattagatatgtggtttgcaagtattttctctcattctgtaggttgtctcttcactctgtcgactgttttctttttgcacaaaagcttttagtttgatgcaatgaacaaaccaataaggaatatgaagactcttaatcagtaatcaaaaaaaccccaaacaaaataaaacctagtagtatttcatggcttcactggtgaatttctatcatttaacaaagaattaatgccagtccttctcaaactctcccaaaataactgaagaaggggaaatacttccaagctcatttaccagggcagcattgctctgataccaaagccagacaaggatactgcaaaagaaaattataggccaatatccctgatgaacatagatgcaaaaattctcaacaaaatactagcaaattaaattcaacagcacattaaaggatgatacaccacaatcgaggatggttcaacatacacaaatcaacatatgtgatacactattaacagaatgaagggtaaaagttatatataatcatctcagtagatgcagagaaagcatttgagaaactttaacattcttttatgatggaaactttttagttatggaagtgctgtacttcaacataataaaggctacataggataagccctcagctaacatcttaatagcggtgaaaagatgaaagcttttcctgtaagatcatgaacaagggaaaggatgcccactgttaaaacttctactcaatatgatactggaagtcctatccagagcatttaggcaataaataaataaataaatagcatctaaattggaaaggaagaagtaaaatcttttacatgtgcaaatgatattatcttgtatattaaagaccctgaagactctaccaaaaaaactgttaaaactaacaaattcaataaagatgcagcataaaaaattaaaatgcataaatcaatagtgtttctgcatactaacaatgaactatggaaaaaagaaatcaagaaagcacttctttttacaatatcacaaaaaatgcataggaataactttaaccaaagcagtgaaagatttgtacactggaaactgtaaggcatttatgaaaaagtgaagaaaacacagtgaatggagatatctaatgtttatggatctgaagaataaatgttgttaaaatgcttctagtatccaaagcgatctacagattaaatgccatctcttccaaagtttcaatgacaggtttcgcaaaaataggaaaaacaatcctaaaacttgtatagaaacacaaaagaccctaatatcctaagcaatcttgaacgaaaactttttccactgttaaaaattggtcagtgagtaatagcagatgatctgagagacaaagaactttgaaaataagatgtcattcagaaagaagtaataagttgaacaggaagaatgatatgtgtctgagagattgaatattactttcatgtcctgaaaccatggttgctttcagctttggtgtttcattattgttatttaacaagtatggctcacttgagagacaaataagttgtcatcttttaaatattcagtttaatcaccggcacacttatctattcaaattagcaagaattccaaggaggtcttttcttagagtcttcgttcagctgcttcaagtattgctatactcctaggagtttactcattccaaggagactaatttgctctccaaaagttagttgaagaaagagatggagatttttattttttggagacagggtcttgctatgttgcccaggctggagagtagtggtgtgatcatggctcactgcagccttgttctcctgggctcaagctattttcccacctcagcctcccaagtagctgggaatatagatgcatgccactgtgccaggctaattttttttaagtttattttttgtagagatgagatcttgctgtgttgcccgggctgttcttgaactcctggggtcaagcaatctcctgtattggcctcctaaagtgctgggatcacaagcatgaacatataagctagtgatatcacttttagccactgttgattttaccactgctacattgtttcgtgatttaaaagtggccccaacaaattttatgtaccttgtcttgttgatgtgatgccactgatccttgcggagacctcagtggttcttaatgacaggatgattcactcttcagtattatgttcattcaaaggttatgtcaaaggatttcatttccttaatttatactcatatgcttagtcatcttggcttccttgccaagttggatgtgtgagaaggtactttcagcccatccccacactgtaccaaaattagcctttctttcttgaaatctagtccagggatagaaaaccagtggtctgtgagccagatgcaacttgcagatatgttttgtttagttctcatggtatttttaaaaatagttgaattttatatcattatataaaaatataaaataccgtgattttaaatcaagagattcatataaatatctggactttcatattcttgaaccattggagaaactgatttcagtgacctcttattctctcaggagaaaaaatgggttgcactgaataattgtcctctttaatcagatatacactatctgatttgctccagcattcactatttctgttgctttacctgcctggcctctgtagtcacttggatttagcctacaatgtctctacttttcagcctgaatcaccaacccagattatcatttcccctttgataaagcctccttaagcatatattcctacttgtaagccacagacctatcactaaaatctatgaaagagatttttgtaattctgaaccttgaggaggatggagtctaggagttgatccctttcagaattcctgtttcatttttttatgcagatctatttaccttctttactttaattatctctgtttaccacagagtattgagaaggcatggcccttatgaagcctcaaaagattttgttagatcattcccctgaggtaatggatgcctaccagccttacatttgcataattaaattgtccactgaaatgattcttcccacagcaaagatctatttcaagccaactgtttcctcctcggtagagaagcatttgacaactttttttttaattgaggtatgttttcataaccatataaatcactcattataagtgtataattcagtattaattagtaaatttaaggatttgcgcaaccatcagcacaaatcagttttagaacatttaatcacccacaaagttcatttgttacccatatccagtcaatccccactctcacctcaatctcagataaacactgatctgctttctgtctctatagattttcatttctggatgttttatataaattgaattatataatatgttatcttttacttttggcttctttcactagaataatattttttaggttcatccatgttatagaatatattaataattggttccgatttattgttgaattatactatgttgtatggatataatacattttgtttatccattctgcagttgatgcacatgagaattggtttgtttttggccatttggataatgttgctataaatatttgaaaagaagtctgtgtggacatatgtttttatttctcttgggtagatatctagaagtagaatttctaggtcatatggtaaatttatgttttaaagaaattgccaaattgtttcccaaagtggtggtaccattttatgttttcaccagtaaggtaagagggttccagttttttcacatgctcatcaatgcttggtatcatcagtctttctttcttttttttttttcccctcctgaaacaaagtctcactctgtcacccaggctggagtgcagtggcgcaagtgattctcctgtctcagtcttgagtagctggcattacaggcatgcgccatcactcccggctaatctttgtgtttttagtagacatggggttttactatgttggccaggctgggcttgagctcctgacctcaagtgatccgcccgcctcagcctcccaagtgctgagattacaggcatgagccactgcacccgtcttatcagtcattttgattatggccattatgtgagtgtgaatccgttgttcacagttgtttcactttgtattttcctaataactttatgatgttgagcatattttcaagtttttataacccatttgtgtatgtactttggagaaatgtattttcaaatcttttgcccactttcaaaattgagtcgtttttcttcttattatcaattctcaataattctttgtatattctgaactaagttcttttccaaaaatataaatatcaaatatttccttctagtctgtcttatgttgtcatttttaaaaatgatgtatttgaagagcaaaatttgtaattttagtgaagtccaatttatcgttttttcctttttggattgtacttttggtaccagatcttaagaaatttgtatctaacgcaaggtaatgaagattttcaatctgtacttccttctaaaagtctattttttgagttaatttttatatatgttgtgaagtatgaattgaagttcttttttcaacatgtagatccattttttactgcactacttgttaaaaagaatttcctttctctatttaattatcttggcatctttctcaaaaatcagttgaccataaatgaaagggttcacttctgaattctcaattctgtcccagtgaactacatgtctgtcctcattcctatactacactgtcttgattactaaaactttaaggtaagttttgaaatcacatagtgtaagtcctccaactttgttcttcttttatcaaaattgttttgtctattttggggtcctttgcattttcatataaatttctggatcaatttgtcagtttctaaagaaaagctttattagattttcatagagattatatattgagttcatagattaacttgtagagaattgttattttaacaattttgagtcttggaatccatgaacatgaaatgtctctccatttatttacatattctttaatttctttagcgttccagtcttgtaaaaatgatttctaagtgttttatttctgttgatattattgtgaatggataagtcttaatttcacatttggattgtttgttgctagtatatacaaatgttattgatttttatattgatcttatatcatcctatgatgttgctaaactcattttttagttctagtagtttctttatagattccttataattttctacatatagaataatttcatctgcaaataaagacagttttatttcttctttatcctttaatatctattttcttgcctcattgcactggctagatttcccagtacaaagatgcatagaagtggtgaatgccttatgccctatcttaaggggaaagcgttccatctttcatcattaaatatgacataagtatagagtttcccctgccccacatgtcctttatcagtttgaggaagttcctttctagtcctcgttgttgagaggttttctcatggctgttggattttgtggagtgcttcttctgcatatattgagatgattatttggttttatactttattaatataacatagttcgttaattgattttcaatgttgaaccaaccttacctttcatggaataaatcccacatggtcattgtgtatgatcctctgtatatactgctagattaagtttgctggcattttgataaaaggtttttgcatcaatgtttgcaatggatattggtctgtggttttcgtttgatctttgcctaactttggtattaggcctcttagaatgagttgggaagtgttcctgccacttctgaattctgaaagagtttgtgtagggttggtattatctttgaatgtttcatataattaaccagtgaagccatctcgacttgagcttttctttgtgggaaaaattttaattactaattcaatatttgtgttacaggtttatttacattttctatttcttttttagttagtgttggtaatttgtgcctaagagtttttccatttcatctgttgtcttatatgattgggataaggttgtttatagtattcctttataatccttttaatttatctagcatcagtggtgatatcatagtttcattactgatttctataattaatatcttctgttttctttttgttcattttgttttgatatttggtcagtctagtgaaagttttatcataagacttttggtttaattcatttttctctactgcttttctatatattttactgaatatattatatataatataatactataatatataataatatatacaaagcttaagttactgatttggaacttttctattttactctaaatggttaaagctatgaattttttttctaaacctgctttatctacctccaataaatgtagatatgctgtagtttattttcatttacctcaaaatattttctaatttcccttggaatttgtttgtgatttaatatctaaatatttagagatttctaaaatttctttctgtttttatttataacttaattctgctgtgattatagaatatattttgaaagctttggcaaacccttcaaattaattgagacattatattttctagcatttgcttaatatgtagaatatccatgtgtgcttgataagaatgtgtattctgctgatgttaaattctgtattttataaatgtcaagatttttttgatggtgttatttaagttgtttgtctcttttccaatttcctgtctagtttttccatcaattattgagagagaagtatggaaatttccaactattagtattaaatatttttctcctttcaattctgtccgtttttattttagtactgtgggggctcttctgttcaatgcatatgcatttctaattgtcacatttttcagatgtattggccttttataattatgaatgtcccttttgtctcataatttttctagacttaaagtctattttgtctaatattgatataggcattccagctgtcttatggttactgtttgcatgatgaatcttgttttcctgtttttactttagcctatttatatctatgaatctaaaatgtgtctcttatagatgttatatagtttgatcttgatttttatccaatctgataatttctgccttttgatttgtgtttcttccattcatagttaatgtcactattgatatggttggatttgtagcttccattttactgttttctgtctcatagtttttgttgttcctcttttccctttctaccaccttcttttctattacgtatgttttaattatttggttttgatttttaaaaataaaatttaaaaggcattttcttaatatttctttagagattataatacacaagattataatttatcttatcatagtttacttcaggatagtactgacttaattctagtggaatagaactgctttgatccaatatagcttcatttcttttccaaatttgtgttttttcacatatatttatatattttataaacccagcaacataatgttgtaattattgcctcatacaactttaagtctcttaaagaaattaagagagaacagaaaaaatgtgtatttatatagccttttatttatatatttaccatttttagtgctcttcatttctttctgtcaatttgagctgttgtctagtattatttcctctcagctttaaggacttaggtatttctgcttacaacaaatatcctccgttgtttctctgggaatctttcatttcacctttatttttggaggataattttcctggatagagaaatgttggtggatgggtttgctttcttgtttcttttagcacttcatttctctgccttctggccctacttatttctaatgagaagtcattaatcatatttttcccctggacgtgattcatcatttttctcttgctgctttcatgacttttctccttacctttcaacaatttgactatgatatgtctcagtgtggatcttttgggttttattctagttggcattggctgagcttcttggatccataggttactgttttccatcaaattgggacattttcagccattattccttcaaatgttttttcatcaccctttgtctctctcctttttttctaattcccatgagatatatgttggttcccttgatatcccataagtttctcaggctctgtccacttttctcctgtctttttctgtgttcttccgactggatgatttccattgatctatcttccagttcactgatttgatcttttgctcttttaaatctgctgttgggcttactatactgagttttaaaattttggttattatacttttcaaatctgcactttttatttttaaatagtttttctttctatattgaaagtttctatatgttgttcattactgtcgtgttttcctttaggtatttaacacaattttcttttaattattttcatatatgtataatagctattttaaagtctttaaagcctttgtctgctaaattctacacctgggcccattcagggacattttttattgactgctttttttcctcattgtggatcacacaagtttttgtcaaaaatgtgttttttaaaataacatgtggtagtagctctgggttttgattattttttccctgagggttggttttgtttatttttttattaaaaacttcctttgtcttaatctatggaatctgtatccctcatgatatgtgactactgatttctctgcttagttttttcttcttattctaatttttattttttaacctggtttcctagggattgccctgtgtctctgtagcttaattgttatttaatgattgatcagaggttgtactcaaacactgggaccagccagtgctgatggaactgtgtgcaaattgaggagcacatgcagtatttaggcagttcggaagtctgtaccagctttaactttccactgggccctctttcgtgtcctttgtgcttgtcattacctcctagtcagattgcatagcaaggtgggcagactgggtggcctggtgaacttacgtagcctctgtctgtctcatcttcatttaccccatgctatgtttcttgctataccaccaatgtgttgcttagccctaccaaggccatagccttagactgttaatttctttcagcttgcttttttcgttgacaatatcactaatgagttttttggcctccacttcaaatcaaatcagccccctctcatgtcagccccttccagaagtgaagctgctagttttcatgaccagccctaccctggtagaagtactctcctgactgagctataaaggagtgggagcagccccaggcaagaacatctctgactcccactgtttttaggcagagttcagtggttcgtcacaaataaatgtttcttaatttgttgtttatgactgctcgatttccagagccatgaaatcattgtttttgataattctgttcagcttcatagttgtttcttaggaagatttcctgacttacttccacatcaccaaaagtcctgcctcacatggcaactgttaaaatggcaagttcacgtgctgaagttctacttaacaaggaaccattctatagattctttgtaccattttggtacaaattttggatctctggtaatcaaaacaatctgttcaccatgctacccagtcagcccaccttgctatacaatctgtcatcttagtcctgtttcatgtgaggaattttacatttctgcaataattgccagtaacttttttgtgtattattttcttttgaataccacatggatggcatctgacactgtttgtaatgctgaatttaatggaagtttacaaataagttattctatgattctcctttaaaaatgcagatatacatatatgtatataatattattctcttccataacacagaatgtttaaatggttaacatttgtgctgcagtatagctttctggctcatgaaaaatgaaagctatcagcgatctcggcaataagattcatcgccaatagtcactagcaacagcacacagcattttaatatcagtgaggtccacagctagcagtaagagctggtgtaattgaaagacgtttaggtgcaatcattctgctgtttgctccttgccaggttcaacatgggattgtgtgagtatttgaagaaaacagcaattttttcatatctttgaaagatgtaaaaagcgtagattagtgcttaaatttaagaaatctggtaatttataatcatgtggctctaaaataaaaaggtattttatttgtctggtggattaaagctttagaaaagctacgccttggatacaagtgaaccgataattctggtctaatgttgccgtggtaacaactcatgctgatataattgagaacatcttatacatcctggttcgaacattttctccctgccattttgagttgttctagtggtatatgaaggaggctgggataactagcttgaaagaaattcagtctagttatagacatctttggcattaatctgatgtttactagtgatatctcatgctaggcagttatgctttgcttctaggggcttctctttttaaaacaaaagaaagctcttttcgttttctgtgtgctgcatgctccagtgtgtgtgtttacaccatcggttcttctccctctagagattagcataactccctttgctgttggattgttattttgagcaatatgttttggaaaggttggttttcatcatgagtggtaagtatgctctctgagactctgcagctgtttatttaaaaaatatatttataagaggaaaaaatatttttaaagggacagttataaagccacagctactgtgaattatattttgtggtgacgcttttgtacttaggcattatagtaaattgccttcaaaaaccagtaagaactgtaaacaattaatggcactattaataatcaataccaataatcagtttctaattttctttatggttcgatttattgtatttgttgggcactgttattaattgtgttataaattagtaagtagactaaccataagagaggattttcttttagtatctgatcctgaagataattagtttaactttcctttgattagctttgtcattcctaatgctaatttttattagattatttttattagattttttaaatagtaattttgaaaataagatgctgccagaattttgttgatgtcttggttgcttttacctacaatttattgagaaataaggatttaatgatgaaataattagagcattttggttttgtagggtttgttaaaatttttaataaacagtttttgggggaaataattttttagaataagtacacttgtgacaactagtcttttttgttataatgtgatttattttttctaaatatttccaaaactgtttttttgaaaaaatatactacagtatgtactgcagtttatcatagggtaaaagctgtcacttcaagccaaacctgcagctaaaaatagatatcctgttgttagagtgaaaaacatttgcttagagcataattcattagcatcttttgcttaaataagatgcttggaagttaacctttgattcagatatttttaagagaagtagaatatggtttctctgataacataacagtcctataatttgcatttataagatttggaattggaatttagaaactgaaaggtggatttttgctgtataatgatagaattcaaaattgacgaaccttttctttcataactggagatcacctcattataaccaataaatattctttatcctgctacagtacaatataaacctcttaaacactgttatatatttgtttatagaataatattagatattaaagggacattttaacatgcaaaatactaagaattaactggattgttattttcctgttactgaaatagatctgttttaaataatctgctgttttaaatttgaacgaatattacaaaaacaacttaacattccttaggatttctatggatatcaaactgaatatacctggttgtcatacatatatttatttgaatcaggccaatgcatattttctctttgaaaatttggcatataatctagaatctttaggtaaccaccatggtgttctggaggttttacaacaggatggattggatttagctgaaggaaaatgttattgcttcactattgctttatttttctttaaaaagctatgcattgtagatagcatttgatatatttgatcatattggctttcccttctagccattttataccacaaataatcatagtaatcacaactaggtgttctgactttgtcgagaatgcccaatttcaactgattttaatcatgtcataaatggttaagtgtcctagccatttcaacttggaaaattacaagagaagtgtggttttatttgtaaaaataagcaaatgctaggccttttaatctaagtctgtaactacacatgtgatatttatgtgtacatggtacttttctcgttataagactattccttttatcctttgccaattaaatgttggttttctctgagaatctatcttttggccttcttttgatgctacattttctccaaaaaatctcatccatgcctacatcttcagtcattacctgaacgttcagttcaaaagtggattttcttttatcatccctaaatctgctccattttcattgactctgatatctgttaatgatctcactgcccatacaggaagtgaaaacagaaaccttggtcatttctaacttgtttcttaccctcagacatgtactcagtcattaagttctattgattctacatcaaaaatcactcaatattctccagtcttactgacactgggatggcttctagatctcttctcaatcctattataataactgcattactggtctcccagcttccagttttatatccttccaggccattttccacactgaaaattttaaaatgcaaatatgcccattttttaaactaacatgaaaactttcagttactccctattgcctttaaaataaaagttaaactccttattaggtcacatgcaatcaatgacttacctttttggttttgtttgcaaaatctctctcacaaattttgatctagccatactatattacatataattccttgctacctttccatatttatagtctttatcataaaaatttagagaaccagtcattacctccgacactgaccctgtggaattaggtgatttctctgtactcccaaagcaaacttacaaactacaacaattattgtattatattgaaattataaatttgtatgtcactttctaatctctaaatgttgaactcaagtcaaggacagtgccttattcattgtatgtttctagtagtcaccccagtaccccaaacacagcaaggtacccaataaatacttatagaattaatgataaactaaatataattcatttttacatacttgaacagttcccttacattgccagtgaaaaataccagtgtgggttttgactttttttggttcagaaaaatacaataaccatagtatttacttgttcctttatcaactttgtaggatgaagtcatataaaatgcttaagaaactaaattgtaccagtcagtacctttatctttctagtatttaaaaaattggttatatgtgaaaagagccttcactttctaaatgtttttcttactcataactctttttgtgaagtttttgcccttgttaagcaaacaaggtctataaagaaatactaaaggaacttctctgaaaatcagtcaaactattgtaaggcccttatgtttagaggttgtagcaactcactcaaataagcttaagcagaagaagatacaggtattattgggatgcagaggatgtcatggagctcaaaggcaaaagtagagttgagctgttccaaagagtagaattgatttggaaagctgactggaatcataacagtacctttctcagtttttctctctgagatcacatgacgtctttacttttttccttgtatttgctttattatcctcactgtgtagcgaataggtttctctgatgcttgtgcaaaatggagcttagtcatctgaaagcttcaaagtttatgtgctctcctagttcatgtgctttttgatgtaactagcatcattatatcaaaatcctgggtgagaatcctggcccagctgtagttgagggcaaatctctgaagaagaaggcatgaatctgctatgaattacagcaccatacagacttgaataccaacacttcattaatttccctttctagattctgactgaaaatactgtgagaaaaaaaattgggaaagcagtacatcatttctgaaattaaagatggttatttgcccaaatatgtacaggattttgatgatcagactccaaagtctaattaacagttttaacttgagtagcttttctttatggaaaagaaagaaataatagtttcaccctcactaactgggagggatgaggaaaataagtggaagatccaacactgctcattactttcattctaaaacagctatagtgggacaaccaagaatgtattaggccttttcaagttgaaaagtggcctctctttaaatatagaaggctctttcctgacatagaaggcatcactaccagcaaggaatcctatagtcctggccacattcccatttatgaaggtcactggattacttacctgataatgtaaatatgtgtacgctaaatgatgtgaagagtttagtctaacagcatctaaacaggaaatgagaagggccaaagaaaaaccacttaccttatttggggcatttgtaaagttttgaaaagcttgtaattgttcttgaatgaataaaaaagaaaagcaacaatgtggaacctataaaagaggttatacaccataaaacgataaagttacagtctccaagaggtagagaatgaacttatatttagaaaatatttgtgcaggagagtataaacacaaaaaattatagatgccatctgtgttaattcttaaaatttcaagtgagcatggagttagtgaactaagacatgaaacaaagataaaacaagaacctagaatgaaaagattactggctgagaggcaggaatggaaaagaagcataatgttgtgataggaaaaagttgtaagaaataaacctggcatttttagaatataaagctgcattagaggcaataaaaaccagaataatcattgcagaaaagtaaattaataatgtgaagatctctccagatagaccctaatagaatgtagaggaaatggacaagataaaaattataagatggaaagtatgttaaataaaagcaggacaagaaattataaaagaaaataaaaggacattttacaaattgaatggatagcattccacagaacagagcagatatgatttatagaacagaaaagcagtaatcaaaaatatgattcaggaaaacttgttagttgaagaaaaacttgaatctttaaattgaaagacctcattttgttttgacaagattaacaaagatgccaatgcctaaatatatcctggtgagcatttggaatttccagcataaaaaaatgaaatccataaacattctgatgtctttgcatcttacaatctaacatgaagcttgtcctataaagaaaaaaatgcaaaattggagactagataacttaaaaatcttttgagggcagaaattatttaagatcaacagcaccttgaaatgctgaataaactgtaacaagtgcccctttaaatgaatacctgaatttaccctttaagtgaattctaatttaattaaaattaaataaattcccaaagtgcaaaaattgaagtggtaaatgagaaccagagctgtaaggggaagcatacttcaactgccctgaggacatttttagaccttggtggggctttcgtttaaaatggcctaacagagatggatgataggttgtttaatgcatacagtttaggatttcttagccccctgtataaagccaggatcctgcaaggatcataacctcagtgaaagcatagatgagaaaataaaacctctccactgacaaaaggagaaaataaggaagcttgtgtttcttggcttgggttcctgggaacaggggagggatgtgtgtgcatgtgtaggatgcctctcctgagaatttttaatcaagtgcctcctctcaagcaggtttcagtttttaatctgtattaattgtgtggtctaggaacaaccaataaaacacattatcagaagagttgtaggcttgtaacatatactctacaccagctaatacaaaatcctatactgggacacattctcagaccaagacctgcaggtttctcgcagataaagccccaatgaactttgtgttcacaatccaaaaacaaaatacacacacacttacacacatactgcaaatgatatttagatacaacaggattagaacctgccaataatgtcactagacatagtaaaattatcacatatgactactatattaaattagtgacataaaaataaatatgaggaaaaaatgtatgtaattctaacagagccttaaaatatacaaaacaaaattgacctatgtaggagaaattttatagatatagatagagaattcttacccagtaattgaagaatacataggaatatgtagaacacttacaaaattaataatatgactaaatgtattcaacaaatttcaaatgattgatatacaggctacagtatatcaattcttaattacttaactaccacaaggcaattaagttcaatcagtaataaaaagctttaaaaaaatcacacaaatgtatacatttggagatttaaacattttaaataacttaccaaataattaactcgtaaatttaaggtgtaactatgtatcagaacttgtggggtgcagcaaaagtggatatagagttaaattttaagtgctcaaattaggaaaaagaaagacattcatgatataagaaaacaagtttaaaaagccacatggttaatcaaaagaagaaagaaactgataaagacgagcaaagatcagtgggtggaatagaaaataaagatacatgagaatcaaaggttagtttatgggaaaatattttaaagtactaaatagaactatacctgttttaaaaattgaatcacagaatctttatgcagaacttaacaaaattaggactggagagttttacatacaagttttaggaaaccttcaaagaacaaaaacttcaatcttgtatggaattttccagagcattgaaaaagagaaaatactcttaaatgcatttactgattctagaatagttttacaagtcaagtataggaaaagaaaattagatacattttctctgaagttgggaataggaaaaggatgtccactgccattgtttctgtacatcattgtactgttagtcataacctgagcagtaaaacaagaaaaacgtggagagaaccaaattgtcattattcacaaatgatttgtgattggttacatagaagactcaagtgaatctaccaatgtgatttcagaattgataacagaatctggcaagattgccagatattaaaaaaatcaatatataaacatcgactatgttctatacatcagcaacaaacaaaaaaggtaatttttaaaaatctcccttttacaatagcaaccaaagtgctaaagaacctaggtataaatctaataaaagtgtaataagacctttaagggaaaaagtataaaattctaccgagggatatttacctaatctttaacaatcagacatgattttttatactcattagattagcaaaaaatggaaagtccaacattaacaaattttgttgaggatatagagcatcaaggatatggtgggacaataaattgatgctaccatttactgagtcatttgttactgccgaagttgatactgtgcattccttatcatctaggaatccattcttaactccatattgtcgggaaacaagacaaaatatttgaattcaggcctttctggaaaatccttgacatatgattgtagtagatataatactgctacaggaaaaagcctcattgaacaattaaggaagtaaaatatacttcaaggagcatttcaaagattgcctgggtcattagttttatgactataaatttactttgagttttcattacaaaattatgtaggaaacatcacgagtcaaacatggcatggatggcctacaaaatccatagcatccccagatggagagctgttgggagagaaggcatgtacatatgattagttgtgaatgaatacactgtgtgaattcatagtgtatccatctatccatgtagatgctagtcaaataagttaatgtatttctttctagaatgattatttaaatatatgtctcattaaaagtgtttatatttttccatataaaactatagtaaaaatttttatttttcacagttcagtgagtcagtcaattatgctgttcacttgtaactaagacttgatgaaaaattaacaagtaataaaacacagagaggaaagaagagtaaaataaattttgtaataggaagtgtaactttcattgcctattaaacttccaaatactcatatatatgtggctttagtctttatagaaagactaattaatcatcttagaaatcaaaggtaggcatagtccaatccaataaactgtacaattacaactgaagtattaaagttgttttttatactcgctatcatttttaaggttatagtgaatttagtttgaatcagtatgtttaatatgatgaggcaagtgccccttcagcaaagtgaacacaattattcttcagtttcaaaggacagaagatgataatttattaacatatttccagagaagagttttggttggttaaaaaaaaaggatatccaaagaatttcttgtaatccttatataatacatttttggtatgtatgttcaattgttttatcattctatttctatgtgcagtacagtagtgaacatgtatagatgggtaacttcttgtaggtatgttattttatgtgttatttaatctctgtttattctttttgatcaagcacgcaaatcatcagatgcatctggtaggaaaacccctttttttacagaataattctgttactttgattatcgtaagctaaatttttatgagatattttgtggcaattagaatattttgtgttgagtttttacaattctgtttactgaaaatatttttagtgtgtgtgtatgtggggagggggagagtatttttagaaataccaaataaagctctaaagaggtagatatttgaataggggtggaagaagatggactaatgcattcccctagatttacactttccagagatttttctgctgttatttaatgatagaacttggtattttcataggtaacttaccttagtttccatcctcttttgttctttctggcatgcactaaataattcttaaatagaataatgcttttattaaggtaaaagagggagatgaaactaatgacaaagtagaaggagcatgaattattatcttttcagtaacaaatttttaaactgttattacaaaaatgacactattaaaaacattattgcttgtggttcctaatattttatctttctctaatagaaaatttttaatagccctgttccttattccctacaaaaatagccatcaacatctaacatattgagacgtctaatcctcatcatccctcattattttatcctattcccctctcccttagcaaaagatcttgccttctggttcccggaagaaatagaatctagcaactgtgaactaactcagtttacttctgtttctacccatgcgttgaaaagcatcactatgccaaaaaatgcctccctgattcggcatctgcttgcctgtgcacttcatctcccactgatgttttacatgtccccgatgctgcagttattacaagtcagttgctgtttcctggataaaccatgctcttcttccatgccatttatgtaagatcgtctcagcctaggaggtctttttccccaactttatctgccagaggaattcttatctttcaagattcagcacaaatgctgtattctctattatgccttaccttactgtccaagaatttccccctcccagctctcacagcaccttataattgcctttgttgtagtctttgtcccattccattatgatgattcatgtaagcttctcatttccttaacagtggaaatatgtttattctttgtagtattcagagtctagctcagaatctgacaccactaaatggtgctcaataaatactgttgaaaagattgttaaaccagcactgaggaagtggaatgactgaaaaatactaaagtttttcaaaaggaagaaaccaggtgttataatgcgtaatgtctttcctacagtagattttgactgaataacagaactccagagatggtattgcaatagttacaggatatgtatgtcaatatttgcttcttaatattgttatgaggactattgttgtgagaacttaaagtttttgttagttgttgttttaaggaaaataagaaggttattgattttggcactaaacaatagttacttatttctttaccatttaatttgaagataacttatttgaatacatacaatcaaataattgaatttctacattaacattttatttctgtatatagtattctgaaaaaatgcgtattggtgacttcatgctaatatgttattcatataatttaatcattgtctaatttattttttggacacaagcttgctcctcttcagaaatatctggtaggcaattactttttaataaaacaaatattacctttaaaattttttatttattgtttgcaagtttttattttccttataaagttatatatttttaagtatatcaagttaatgaaatattttcattgatgaaggaaatagtttgtttagttttgttgggttttatctatataaatgatttatattgtaatttcttgtgtggtattttagaaagaataactgtagcaccatgaaacagtagatgtacaaagtagtagaagaaagattaatacagtaaaagaaagataaataagtagaagaaagatttataaactcttaatacaaaatatgaatgatattcttttaagaattggataatggtatactgtgactaacaacatactctttttatcataagcagtaacctagtttatcttacacagcagtcaaaaatatctaataaatacatttgttaaatgttaatagtgaaacattcttatagtggaattacctgaattatatgggatgaagttatgctgtgcctgaattttcagtcagttttcctaatgtttaaaataaactttaaaatctgatttttaaactatgttctatgtataaatacattgaaaaatttgaggggggataagaagtaagttgtgtttttatgaacttgtgaaaatgcataaaaattgtctctcttttttttttcatctcttgaatgtgggtgaatgttcctgcaaacaaatcttgggtgaacatgtagattcctttggtatgctcatttcctttagaatgcaatgtgatagactatttaaatcatacaaacagaaaaaatatataattgaaaatgtatacttttgggaataaattaattttttgtgtgtcctcttttttgtagtatctactttgttcaattatttaccagtagagaataaaatgtgtttcagaaaaatcattctttgaaggatttttttcttaagaagagttactaatcactgttagatgctttggagataggtacctatggtcacacagctaggaagtattagagctaatattctaactcagatgttccaagctctgaaaccatcataataatttaagtggttaaatgtagatatggcttatatattagaacacaataagtaaactaaataattgagaacttcaaactatatgctttatagggaattctgggttgaatgtggagcagtatttgaatctggctgtctctgtcacatcttattttattaattatctgccaacactttatttcagtggatagaaattttttaaataaccagagaagagaaaggcatttagaagttacatccaccaatatctaaacataataaaattcaaagcaaatgcatgtggttctagattgcttattgttttagggttacacataatccaatatattgtgaaatattttatttttggtagatttgttattaaaagatgtatattttgattaacttatatttttacaaataattatgtttatctttgcatctacatagtacacataaaaactagagatttcatatgtgtagatatttttatatgaaaaaaaatgtttcaggaacaggttttcctcatagaactatttaataacatcatacttagtgcccatcctttaatgtactcgaaaagaaaatccctttatattttgaagtaattcacaaaatataataatatatttgattaatactcatttctgataattttcacataagacctttataaaaacttttccctacttttacagtattatttgacagtaaactcaggaatattgatgagtacagagagtattttaaagaatttcttgcatattctattagtgaataaaattaaataatgccggaaatttttcttttagcttatcaccaggcagggaaaaggaatttttttcaacttaccatctttgacaaatactgtcagtccttcctttgatcagttacttttttcttaactccagatccacttagcataaagtgacaggagaagctgaaacaggatgttaaagttgttttttttaccttcccttactcttttctttgtctctaaattatttatactcatataggcatctggagagtttatattgcaacttgatgtgcaagttctataaataaaagataactaaaaatatttttcagaagaaacaaggggtatattttgggaatcacaagttgttttttcttaaatgccacagtgcatgttgcaataaattatgtttttaatttaatttatagccatcatgtccaagtgaatgccatgtgcagatatgtctgctccatgcaaaaaaagaaaatcttacctataaaattactctttttctgttgtaactagcacattcatttttagaagcaaggatgacttgaaccatcctaaattccaagaaaaaataacaatttggccggacacagtggctcacacctctaatcctagcactttgggaggctgagccagaaagttcacttgagctcaaaagttcaggacaagcctgggcagcacagttagaccctcatctctacaaaaagtaagaaaattagccagacttggtggtgcacatctgtagtcccagctactcaggaggctgaggcagacggattgcttgagcctagtagtctgaggctctagtggactgtgatcatgacactgcactccagcctgagtgacagagcaagacccagtcttaaaaaaagtaatagaaagaaaagagaaaatgtaagaatttgccacccttaatccacccctcaggaagaattagattatatttggatgattaggtaaaattctttgattcattgttttagtgcatgagattttcctacaatgggaaaattctaagtttaaaaattctttttctcagtttttctaaaaaaggcattctgagagtattttacagtaaaatacaaaggacagtttatagaaagtactaaaataatgtcttcagagattcatactctaatgttacttaaaaactaatgtctgctcttggtgcctgtcatcatcattttgaaatctcaaaacatttaaaatgccaaaagcctttttggttagtaacagtattttcccaaaggtatgacattggtatgacatttataaaggaggaaaaataaagtatgttttaaaataggtacctatctcacttcaatactactgtatcattgagaatcttaaagaatttgtgagcccttcactagtatagtcaggttttattcttatacctaaagatatgaacaacaatacattttgttaatgctattttatctctttggaatatttttcctatttgtttttaaacatctgaagttgttttctaagatagcttttgaaaatggggaaagttttaactggttcatcatttaatttacaaatttaaaacttcaaaccatagctctataaaataatgtggctattttatacccacattattaatcaatatacaaacacttggttttgaattgctttactttagtgcattttaaattgggtattcagacatttagtttatgctgcaaatttagaatgagattgttaaactggattttttgttgtcgatgttttgttctgtttttaagtctttgttggtgtcctttatgtgctagtctttgcttttattttttccctttgccattagtaaagagaacacaaatctaatacataacataaatccttacacctgaaaacagctctttatcaagatcaactatttttgaaattccacgaatcagtaggttaatgttctccacatgttttcaattcttgtatctaaaggctccgttaatattactgatggcctttttacagtcactattttgtcctaaattaatttctgactttcttacattactttctagtatgttttcaggaacagaatttttgttatgacatttgaaattatcaaagtggtttctttatagaacaatattagagaatcttagagatttgagaaggttcttagagatactaaatagctctttaatgtatcatggtgataaatatacattttatcacaatagatgacatgtctttttttaagtgagaaaaccatatgcaatataaatattcttatacagaatataaatattcttacaagataaatttgtttttatatgtatattttcagtgaaagagtttctagccaaagccaaagaagactttttgaaaaaatgggagaatccaactcaggtaaggaatatttagatttttctaaaattaaaaatcttgtattaataaaatcaggattcttgcctaagaaatttattactttagaaattttaattttcatgtggtgttagtaaacagaagcttaaaatgggaattttgccatagttatactttgatgtattaattaataatcttaatgtatgcctaaattgcaggaaataatttccagtataatacctaattataaatttgatactgattccagttgctataaaatcttaatattttcaaatatattaattttgaattatgcctttgatagcatacttataatttttattaattacaaaaataagagtccttacgtacagtttaaaattctcagtcatagagaatttggctatcaacaacatccctgatacacaggcatcttttttatcatcattttgatgggttatgttctatataattaaagtattttagatcttaactaggatctaaaaactgtatataaaaaaccatctatactttacaaaaataatatttttggagttataaataatgaatgaattttaatagtaaattaaattttgttatacttcaagttctgggttgcatgtgcagaatgtgcaggtttgttacataggtataaatatgccatggtggttgctgcatccatcaacccgtcatctacattaggtatttctcctaatgctatccctcccctagccccccaccccgcgacaggccccggtgtgtgatgttcccctccctgtgtccatgtgttctcattgttcaactcccacttatgagtgagaacataaagaccaaaaaaaaaaaaaaaaagaggtcgttatttgaaaaagatacttgcacacgcatgcttatagtagcacaattcacaattgcaaaatagtggaaccaatgcaaatgcccatcaatcaacgaatggataaagaaactgtgatatatatatatatatatatatatatatatatatatatatatatatgtatgatggagtactatgcagccataaaaaagaatgaattaacacatttgcagtgacctagatgagattggagactattattcaaagtgaagtgaaagtaactcaggaatggaaaaccaaacatcatatgttctcactgatatgtgggagctaagctatgaggacacaaaggcataagaatgatataatggacttttggcacttggtgggggagaatgggagggaggcaagggataaaagactacaaatatggtgcagtgtatactgctcaagtaatggatgcaccaaaatttcacaaatcatcattaaagagcttactcatgtaaccaaataccacctgtaccccaataacttatggaaaataaaagaaaaataaaagatattataaccaaaaaaattaaattttgaaagtcttttctgcctagctcaaaagtttttatttcaagtattttctcactaaagaattctaagtaaatgtttcttaaagatgccattactatcaagatttagagtatgacctataagttaaaacatagccacaaagattaaacattgtgattacaaaatgttagacattgtgtaacatgaaacaataagagaggtaaggaagataacatatttttataatacaaagaaaagcaatgaaaaaagcataaagagcagaaacacatattctgttgtctattaataaagtttgttttcattatttggttggtactatggtaaacattttaatccatccatgttgataaaacctaagattaaatattaattaaattaattcagtcagaattataagagctttctgtgttgataaaaaaatcttatgactacttaaaattattttaaattttaagctgtgaaatcaaactatgatgaaaacaagctataagtaaaacagaattgcctgctgtctgtaatgatccaacagaaagctaaaatgggtctcaaaaggcaaggtttgatttgcaatacagataaaatccaactacagtgaactgtaatacctatacaaattcctcactggacaaagaatcatactgcatcacattttttcaagctaaacactacatactgggccttcagaatatttttctgatattttcatggagttctttgcaatgaaacctattaaacaaatgggtcagcaattactacttcttgccatttaacacataatttgtccctaataattttcattttgttgtggcaggaacaaatttaatagattgatgcctccaattatttgcttctgtgctgtagtcaaagccaaacaaagatgtttccttataacaaaacatctattcaagaaaaaaagagtctgattattgttctgggattctggcttttggttctttgtagaatgaggaactcttctttccttattgttgttgttttagataatactgtgtttttataatataaagagagaaagccactaggctctctcatgctgctactatctagttctataagcttatataaagacagaaatgaagcaagactgatttcttcacaggtaactttagtgaaagagctctgatccctcagtttatctattcattacagttatttgcaagtgcattaagtctgtatggcttctatgactctttgtcagtatgcctctggtcagtttgtaattattaaaatatgaaactaatttattggaagttcagtagtaagattaaagtccaatactaggaatgcatactggaatataatctttaatatttcagctgaggctcttatttcctcctattactattatgctctgttttccaatacattctctcctcagatattaaatactttcttattcaaagggaaaaatagaaccaataaactggaatctcaatagcttttttgtattgcatttaaatggatagttataaatgggattatccattatgattatgtattattaaagcatttataattcccatagtgtttttacgagaattttaaattttatttatgtatttacatatagaataatgccggacttgaagattttgaaaggaaaaaaacccttggaacaggttcatttggaagagtcatgttggtaaaacacaaagccactgaacagtattatgccatgaagatcttagataagcagaaggtgagtgtatttgttgttatttaccttcagggtaaactttagttttatcagctagactattaaacagattcagtataatgacttaccattgacagcttcaaataattttattattaaatttaatttttattgtaactaaatttttattgtaactatattatacatagttagtatacagtcagcccttccatatctatgggttccacgtccatggatttaaccaatcacagattgaagatatttgggaaaaaaattacatctatacctaacatgtacagacttttgtttcttgttattattccctaaacaatacagtgtaacaactatttacatagcatttacaatatatcaggtattataagtaatctagagatgatttaaagtatatggacagtgtgtataggctttatgcaaagcctctgtcattttatataagggacttgagcacctgggcattttggtttctgctgtaggtcctggaaccaacccccagggatactgatggacaactataatttattgtgacaattatggactaatttgttttgtaactattacagaagttaaaatgtgtacagtagtgatccaaccacttcatgttacaaattttgaaaacctgaggcccaaagatttgaaatcatctcaagtcagaaagttagttaaataaaaggcctagattaaaacacaaatctgactcctactcaatttatttgctcaatattatcagtatactcctaattttatatattaatacctggctggtatctttaattacttttgttatttatatttaacttcttgacttctgtgactatcctcacattgaccattagactccagcaagaaagaatgccaccttctaatgatttacacatatacaagaaaattatttatatgtcttgctaaagtcaccacttcttaaattcaaaatagaatcacatatggaatagaatcacagtcttcgtgaagtcaagataaattactttccccttctattaaatagaaaatctagaggaagcttaagtctaaatgacctaggatacaaagatagtttttgttataaagatagttttttccccaatattttgtgtgtcctcttctatggcaatataaaataaatttttagaatttatacctatatttatttagatattataaaatgaaaattgttcatttttactcactatttttcagttatggactttctcttcatttttaattttcttattcatcttctgaagtatttaaaatcactatctacttattgcagagatttgagccagcttttatagaggactttaagtcattaggaccttagtattttcacattcatttttaaattaccttaagtaattatatatttatttaagcataattgacataactaatttttaaagtaatttcttatgagtttgtttcttattcctacttagctctcacttcttaattgaaaccataattgaccttcctaagaccaagttttaaatcctctattaggttttcatttgaatcctattattaaaagtaatggcaaaaaccgcaattacttatgcaccaacctaaaagttggtaattgttattatcttccttatccaattctaacaattttgcttatccaagtttattactatatggaaaacatttttttaaatgataactttttaattttgcttaaatacattaagagatatttatctctcaattacaggttgttaaactgaagcaaatagagcatactttgaatgagaaaagaatattacaggcagtgaattttcctttccttgttcgactggagtatgcttttaaggtaaattttagtaatatctaaataagatattttcaacctaaattttttttaagatgaaactataaatggattctaaaccagatgataagcctgaagaatatgaataaacaaaacgaatacctctagagtttgtgtaattaaatcctattgtgcttataacttaggtaacgtttgaaaaggttttgattctccctggggaaattgttcaaaggtgatactcatgagatggtattacaaaaagaaatatttcaatttatcaaaaaccatagggatatcttaataacaattcttatgcaaattcatacacccaacacattttctactttgattaagccctttttgccactatctcatcttcttttacttagtaatttgagttctagtcttttcacttatacaaagcaaaatttttgttccactattcaaatgtctgaaaaattgtaccacatttattatttaaattggtcacttttgagctctttggaatgatactggcatctctctgcaatattgaatcatatgaaacattttaatcttttttctcctttattctttaaattaaatgaagacctatgtatttaaaatattaaaaccattaatcttttatacataaaatgtaaatattcttattaactttttaaattgttttttacctttgttattcttttgcatatattataacgttacttcattgcctgagtatttaattgtttgagaactagatgttctctgcaagaaaaggaagagcaaaagtcccagactagtttgtggcaaaaataactaggaggggaaaaatatgagtgtctctgtatagaaaagctagagcatgttccatttattctttatttctcaaggttattaatctgtcagagagattttaaatttttctaattcagcattatataatattaaaataattttgacctaagttgaataattgtatttcctttttatttgttcataggataattctaatttatacatggttatggaatatgtccctgggggtgaaatgttttcacatctaagaagaattggaaggttcaggtaactaatggttttgctttcttcaaatctttatatgcttgtgttgtttaaccagatttttaagttgatgccaatgccaaaaacttattttgtttgattaatattttggccatatgaagcattaggtggaaacaaagaggccacatcatacacaagttttaatataaagaatataaaaatttaatataaaaaaaggactttgaagccaatttaaatgttatactactgctagatattgtgagggtccactacttgaagagttttcagaaaatggaaaaattaattgaattttaaaatatcaatatttattaaacaaagattaataatacaactccaggacagaggattgttttaaggatgaagatggaaaataaatatatagagaaataataataatagtattatggtaataagattataaaagtttgtttttcacaaatttaattctccttaaagttcttgctaagtttagtttttaaaatatacacataatttaacgggagtttgtacctcatcaggttatgactaataagatctcagagttattaaaataggttatagaatctgatggttttacctgtacttaatagtttataagcttctaccgttcattaataatcactaatagaataaagctaaaataaaaaacaggtacagcttcattcagtatagtgtgttgaagtcaaaataaaaatgtagagacaaatctctaaattcaacattttattgaggaagcaagaattgcagtttgaggcatatacacagactaggtggtcttcaatgtgtctagaaaacaaagaaaaggttggaggttttataaaaagaaattttatgtttatttgttttgaaacaaagtttactagcactagttaagttttggggagctggcaagctctgattggtgagtgatggtggtgggtcagactcgtctaagagtcgcagtaggttgtctcagtagctgttagagaaaactggtttcaggttacaataggcagtttcagcaactagacttgtggaaaatataatttttttgtttgtttttggtttttttttgagactgagtctccctctgttgcccaggctggagtacagcggcaccatttcgacttactgcaacctctgcctcctgggttccagtgattctcttgcctcagccacccgagtagctgggactagaggtgtccgccaccacatccggctaatttttctatttttggtagacacaggttttcaccgtgttggccaggctggtctcgaactcctgatctcaagtgatccaccctccttggcctcccaaagtgctgggattacaggtgtgagctaccacacctggccttaattcttggagcaggtgctgtgtgccctgagtgcgttattccctggcccctcgactctgatttagttaggtatgatgagaatgactaatttgtataatcagctttcacatttttcccttttgatcaagatctttctctgaaagcattgcttgtcaaccatcttgaagttaggcttaattattccttggtgctcggatggacttgttctggttgtctctgtcccacatatgagagaagttatctgttggggggtgtctatgtagggacctgggccacattcaagtaacgaggaggccagaaggaaaatttttctcaaagtagatttttgtctggagtccagccagcatcgagttcccacttatcacttccataggtattagcagtcatctttaagtgttgggctaacgttattctgttgggacagctgcctttacaaagattagataggcactaagaacaaagcttacaaatgatagtacaaaaaaattaacaatatagtaaaatgtatttgtgcagtgcttttgaactaaagcccaggcctaagggcaaaaaactaaagaaatcaaaggaccaggggaaactggtgagacctgctatagccattgactaacattttatgactgggttgaactaaagcagagaatgccaaactttgcaagagggaccaccagcacaaattaaacaaaaaattgtgttaaggatattgtcgatgttgtgactagatgaactgaaagaatttcttaagtcaggctttgtcaatggctttagcaggtctcaccagtacctatagcagttactgattgtgaattttaaattacaatattatttggttaagtgaaaaagcaggcattaagaggggtaagagtttcattacaatatggagtcttgttctagtgttttgagaaaagctgttcacaccatggaaaacatcaactttcttggctttgtttacagtgtaaatgtctctggctatggctttgggcagtttgatgaactttctgtgtggcccatacatcaggcatgagacttgtttcttaaaatttatatagtttcagctaacaggacttcaggaacagagcggttctcattttagtaattttatggaagaaagttcgattggaggaacctagaagaatttaggaccttgtctagtctataggtagataacaagactcaaaaataatgtacagacttacagtctaataacaggtatattatagttattctttagaaaaaacttttttctctacattgattacataggaatcttggatttaaaaacctcttgaggcaaggaagccgaaccaaggcagtcttagattttccttacagtcttgaggttcctggtcctgccaggaagtaacagtttttatttactcattgtaatgctgagaaacccttgaagtcaggcattttatgcactttttaaatacgatagttcagttagagccttagtaatataatcagtgttttcatattctgctataaagagagagcagatttttactggacctgtgcaaatagtcatattcccataaaagtacttacaactaatttttgaattaaggagaaaaaaagcaaatgcttttatctttttttacaaaaatatactttaccaaattgctataaattataaatagctaaagagataagtttttttaaatctggaaaccaaaatatttaagaactaacaatgtaacaatgttttaaatgaaagttatgaaaacattatttttatcaattatttaatttcatgtaatttttgttctgcttgatcttaattagtattttcatatactcatctttttttattagggttctggaaatttttatttagtctattgatcttaaagttattaaaaacctgtatttaagggtacttgttggggtcttttctatgaatctgattgtaaataattttgagaattcaaaatattaactctggatgacaaaaatctagaatagccatgggtaaaaatctgatgaaagtttacaattaacaagtaaaattagttatttctattttatctagcattttaagacaataaccagaattatgaataacgttaatttctctgaatttatataatttttgaaacattcatatgaacaacatagccataaatgcaactaaaagatctagtatcacatcatttatacaatctcttatataatttaaaaataaatctaattatttaatacgtctacaagatgagatctgtgtcttcaaatgttttccaagggcccagctggaaaatcccaaagctaattctagattaagaacatttaatttaggatttgatttttgggaagtttgttaaacatcttaaaagacttaaaacccttggtcaaaacggagtaacaggtcactgtaaaataatagtcatttatttaaccagagtgataatcaaaagacatcagatgtaatacagaaagttatatgaatgtgaaaacttttattatttttaaagctcagtttttctgagtaatgaaaaacctgataaagacaacataggatattatcttgataaaatataaaatctagttttttagacaaatcaccaaaatggtaaagaaaaatcttctgcagtatgctcattatttctttttcccatttagagctttccattaaaaaaattaccaatcatctgaaagttgattgagtacttgaatttaatcagacacaggaagaatgtgtccagggttattgagtgtacactgtgttatagaaaaatatgaacaagaagaggactatcttgagcagggaaatacatggctctcagtaacagcatgagaaatttcctggttacatgaaataatacagacataccaagaagagccaagaatacagattcaaattatactgaaagaaaacttcgtttttctaggcctttaagataaacgtttctgcatcaggccataacaaagttcaaactgaaaaaaaaaaaaaagttctaggagttgaggaaaaaggttgaaggagggagttatcaacccagccaagcaaaaagatatacctttcaagaaagagaaggggatgtatgaccttcaaatcatgtgtagtgtgacacagcaaaagccgaacttctgaaatataaatttcaaaaggaaaactttacctcaagaaatggaattactatttttaatgaagaggacagcatttcaaacctaaaactagggaaattaattagatctcaggaagaaatgtggcagaaatagaaattgcactttggaagatggctgtcaaagaaacagattttataattaaaaatcacaaccttttgcagtattattgagagcagatcaatacttcaagaaagttttgtttaaatatagagagcaagattctggtcctttgtcagtgcacccttgacaccaatcattaatttttagaaaaatatgtaaacaattttcctttccaatttctttccctaactatttacacataaaacttttttcataaggtccatcctttcatttttccaaacccccagtcttaatcttataatttttcttttcttcttcctccgtttttggaacagccaatcattttactttaggaaaaatatttaccacctaatatacttttcatacaacatatttttttcttacattcatattttgactactagacctcaatatacttaaactttttatagaacttaagaacccaataagggatttatatttatttagcaatttgttttagtttttaaacttatttgttatggcccagacatctaataagtatcttattatttaatttaatataacataactgtaagactttaaattacatgagacattgatttataaatgtttatttaattaacattcacctaatttattcatttttattaattatccctggattacttatgaaaattgagatattaggcagagtcgttattttaagttatttttattagccaattttatagcctgttaatatcaaatgtttacctaaataagaacttaaagttagatacatgaatattctttcaataactcagaagatacacgtttattaaatcagtaatattaaatcttatttatcaaataatagcatatacaaagatcattttgttttagtctgggtttatagcttcatgaccttaagaaatttatcagaggcaaatataaaactctctgaccaggaaatctaggcaaaaatctgtgttgacaattttgaagacatttctcattttattttgttagtaactttttagtatagttaagtcttgttgaattgaacccttgatctttatgtaatgcccttctttgtctttcctgatcatttaagttctgttttattgtatgtaagaatagactcctattcttttttgttttccatttccatggtagttctttctccatccctttactttgagcttgtgagtgtccttataggtgagatgggtctcttgaagatagcagacagttgggacttttctttttatccagctgccttttaagtgggtcatttagaccatttacattcagggttagtagtgatatgtgagattttgatcctgttattatgttaccagctgattgctttgcagacttgattgtgtaattgctttatattgtctgtgggctatgagcttaagtgtgtttttgtggtagcagatattgatctttcatttccatgtttaggactcccttaaggaccacttgtaaggctgatctggtgataatgaaattcctttagtgtttgcttggtgtctgagaaagattttatttctccttcacttgtgcagcttaatttagtgggatattaaattcttagatggaattttttttctttgaggatgctgaaaataggcccccatctcttttggattgtaaggtataagctgagaggtcccctgctgatgcacctgatggaattccctctgtaagtgacctgacatttctctgaagctgccttcaagttaaatgtggtatatatacaccatggaatagtatgcatccataaaaagaatgaaatcatgtcctttgcagcaacatagaagctgctggaggtcattatcctaagtgaattaacacaggaacaaaaatccaaatacttcatgtttttacttttaagtgggagctaaacgttgagtgtacgtggacataaagatggaaacagtagacactagggactactagagaggagagggagggaggagaatatgggctgaaaaattacccagtgggtgctatgctcaccacctggatgataggaacattcataccccaaacctcaggatcatccaatatgcccatgtagcaaacctgcacatgtactctctgaatctaaaatataaattttaaaaaataaataattaaaaaaccaattaatttatcaaagatgtacttaagtcatgtgaactaaaatattttatataagcacccatttatccaaatagaattctttaagggatttctagacaactatgtcagatattattatatagacacagcatacaatatatgtacatatgcataaaagcatctaaacacctatactaatgtataaataaaaatattacagcttttattttagaactttaatcatgagatagtaaaacaataagcacatcagtttataaaaagagttagatccaaattatttttctaacaaaatgggatgaggctaaactttaagctttttttaataggtaatattatgaagtatgtgaactaaattataggtagagtagtttgagtcagttagcaatatactggaatagacaaagaactgttaactgagaaaatgtgaatgaattatgtgaggagacccaaatgataggagttattctaattaggtctgtacaatattttcttgtctcaattctttgtccctgaaggtaagattgttgccatttcttttagtatagggacagtgtcctttacattggaattttatcttaaaaacaaaacagcatgaaaatcacaatgattttcttttttatctgatgattttcaagtgtttttaattaaataatatgccaaaatagctgaggatttttgggaaaaaagagtttagtctagattaggataaagaagaggaattgtaaacgtggagggaaaagctccagaagggaacttgtctccgctagctttgagacagtattttgtaacaaggcaatctctgagtcctgaaatttttattagccttaagatatcagttgagatatgagtcttatttggagtatatgattttgtcaccatggtcttttagttttgttgtaagaacaacagactgtttgaatgattcctataacgtttgaacatgttaccagctggagtctcagaaaatatcttggcatgccttcaaactttgagagcctatttttaactaaatgtatttaggtgattcggtttaatgccaaatacataagagccaactaaacacaggtgctgaatacacaaggccaaataaacacaagcaccaacagaaaataaagtatgtccttaccaggaagaacaataagccttctccaaatgaaggggaaagtctcctcatccaaacctcaaaactgaggtctaaaccttacacctgaagtcaacagggggaaaataaccctccccaacaggagatcagttaaccaggaggcaaaagacgcctctcaaacaggagtgggaaagagaaagaccccttcccagccaaatcccaaataaaacagaactcaaccaaaattaagagtttagtccaaaagagactcactaaggggaaaagaggggactccccagaagcagcgggactgaaagggctccaatgggggtacttcatgctgtagttcccagggccagtgattctccctgaagtatgtcagctttaggatcccacttctgacaccaagtatatcaaagtcaaaataaaaatatagagatgaatctctagatttgatattttatttgggaagcaagaattacaatgcaaggtatccacacagaccaggtggtctttggtgtgactgaagaataaaaagaaggttgaaagttttataaaaaggagaagttttacgttttgggacaaagttcattggcactagcaaagttttggggagctggcaagctgtgattggtgagtgatggtggtgggttcaaactagtcttagagtcacagcaggttgtttcagtagctattagataaaactggcttcaggttacagcaggaagctttagcagctaggcatgtggaaaatttaattcttggagcaggtgctgggtgctctgagtgctttattgccctggcccatcaactctgatttagttgggtatgacaaaaatgacccaacttacacaattaactttcataattaaatactggcataactaaaacacaagtatgaactgaaacaggactgatgatggtaatttgattcataaaatgatggtggcagactcagaatatcacaagatgatatcaagtaatgagcaaacattggagtcattttaattacccgaggcctaagccaagattcatttattgacttactatgcacagggcaactaatataattaatatagtgtcaggcactgtgcaaagtagcttctgcttatctttgagaattttctttcctctcctatcgtcctctctctcctactgccccttgttcaagcagaatcctcatattgccttatggttatttaaagtttacactaaagtaccacacctgaacctgttctcaaaaaagtttttgttaactttatataattggtaacttcttttctttgcaactcctcacagtcttagtactctttgatattgactctttaatacttgacttggtactaaaaggatagcaagttgattgaaggaattcacactgagacacttgccttatctcatctttcacaagtactacatatacacttgaacaattgccagtgtccatcttagaagttttgaggcaataggaatatgagttattgtttagcatggctttaatcagaatcaaatgaggcattataattctctacttaaagctgtctggacttaaaactgctacagcattagcccttaccattgtcttcctacattcaattaaatattaagtagaaatacccaataacactttgcacttggaacattttactttcacctttcaagaattcgattataggttgagcacagtggctcatgtaagcctgtaatcccaggacttttggaggctcaggcaggtggatcacttgagctcaggaattcaaaaccagcctgggcaacatggcaaaccaaaccctccacacacacacacatacaaatacaaaaaattagctgggcatggtggtgtgcaactgtagtcccagctactcggtagactgaggtgggaagattgcatgagcccaagagtttgaggctgcagtgatcatgctacagcactccagcctggtgacagagtaagaaaaaaaaagaattttattatagatctatgtaatgtatgtgttcctccaattaaacaccagcatatggaaattaatattttataagtaaaaagtaatcatattaatgacattttacatttacagatgcatgtaaacgtgcattttatgtttacagatgcatggataaagtaagaggggacctcccaggtcagatgtttcccagtttaagcataaatgttgcaatgaccagaatgattattttaatctctgcttacaatgttctcctcattccttgtcatttggcatacaatgtggattgacagtgttgggatgaagctgaaactggaagggtattataaaattttgctccccaaaagcatttttctttacatatgcattctttcaacaaatatttactgagcacttgggaaatgcagtgacaagcaaaaaaaggcagcacataaagtcttttgttggaatttgtatttctcttgctaccagatcaaattcataccaaccatcttgagggaaatcctattcatagttaaggttgttcactgaggaaacaaatctgaaagtcattgttatttatcaggcagattagtagaattcaagtaatacattagaagataaattagaaactcagaaaattggtacatccttttggatttttcagattctgacatcaaaattacactgatctattaatctaatatatacataaaagaactagctgggtgcggtggctgactcctgtaatcccagcactttgggaggctgaggcgggtggatcatttgaggtcaggtattcgagaccagcctggccaacatggtgaaaccccgtctctactgaaaatacaaaaattagccgggcatggtggtgggcgcttgtaatcccagctactcaggaagctgaggcagaagaatcgcttgaacccaggaggcggagtttgcagtgagccaagattgtgccactgcactccagcctgggcaacagagcaagactgtgtctcaaaaaaaaaaaaaagaactgtacgtatttacactaacatagagattatacttatgtctgtgaatctatgtaaacaagcatagtaaaagatttggaaattctgatgccaagattgtatctatggtttctgaataggattatgagtattcattattcttcatcaatattttatgatatttttccataacgagcatatgtcatttttgtaacaggaactattacaaaatgggtaaaatggcattaatctgcagataaatgcagctaaagagcttctacatagggaaattctataaacacttgaaatttgtgagaaaagtagatggagcctgttaactatagcagtggccccgatagacactccatttggcacatttgctttccaattattctcaagatcagacataattagaaagacatcaatatatttaaatatgggcaataatgattcacaatgagctaactattttaggtttatatttttcctcaacatatgcttccccataaatttatcagagcgttatttgaacaaaatatagagatttaataaatatttgaaaagtaacaaggttctttacatactttttaaaaaaatactttttgttcccaaagtacctctacttcatattagtttttatgcataatctactaattagaatgtattaactcatttttacagaaaatcaatggttttatttctttgcagtgagccccatgcacggttctatgcagctcagatagtgctaacattcgagtacctccattcactagacctcatctacagagatctaaaacctgaaaatctcttaattgaccatcaaggctatatccaggtatgactttaacacattatgtgtactgtatatgagaaaatactaggcaagacattgtatgtatgtaaccccaacttggaattttttttgaagaagacactttctcctaatagtttaagtagagctcagagttttgctgctattacagagaagcaaaaatcctgttatgaaaggaacttgtttatatctccattaatctatagttgtgaactgagtatagcctcttgcataaggagatattaatagctaaatctatgagcagttattagtgccaggcatattccacttgttttacatgtattatttctttaatcctgataaacctatgaagtggaaataccattgttatcttcattttaagattaacaaaactaagacatagcaaggtcatttagccaataaatggtagagtcagaatttgaacctaggcagtctgatcccagagtccatgccctttacgactacaatataactgccaaagaatccctgactaccaatactgaactcgtagcaacgttttctttccacttctactactaataaagtgggagcatttctttttacacaattattgatagattctcccattgacgtttttacacttctgatggtgcaactaatggcagaggacacattggggtaaggcagacatttagcattgtttcatttttattaatgctatttatttttaccttttattttcacttttttattccttgggtctaggatcttataataatgactgaaaagagttttgttgttattaatttgttccttttctttgagttgaggaaggatttccaacttggattgtttaaactttcattcactagatattcatgaatgaatttcaattacgtggacttaattttttttccatttctttcatagtttcaatttgaattttaaactttcaacgtaggtgcaataaatacatttattgtgaggtaatacattttcactagtattctttttttcttttataggtcacagactttgggtttgccaaaagagttaaaggcagaacttggacattatgtggaactccagagtatttggctccagaaataattctcagcaaggtatattcataatatcaacacataagaagtagaaatatgagacatgcatccctatggacttttgtaaaaacagtttattgatctaattttacatttttaatttgatctaagttatgaatttaaatctatttgtgcatgattactaaagaattattatttagcatctaccactaatcctgtaacctctgtcaattttaactctgggtcttagagatataatatgaataaatatgacctctagatccatgttttgcaaccaaaaacatagtcttttcttaattattcctagtaacggaagggtagagaagacttgctctggattataccaagaggtaaatctagagatgatatgtactagttgtccattctttctttgtttcaaatttaccagttaaataaaaggaatgtatgagaagtgtttttaaattttaaataggactattaacagcaattgaatagttttagtcttattgaaggcagctctgcttttctaaatagtgaaacgtggtgagagaaactgtacctatatccaaaagaatggttaacttttcctctgccatcacttggtggagaaatctagaaaggagaacctaacaataaccaggcacaaataggagagaggaaaaggaaggggataagacacatgcttcactggttcccaaatggaatcattgaaatatggctaacttatagaagtgttaaaataaaagatttctttcaacttttctctcattatctttcataatttaaataatatgtaacttcttgatattttataatctaaatatcattgtagttaacacatttctttaaatacagttaacaaataatgggacaacaaaatgagcactaaaacttttacaaatgtgtatatattgtaaaagtaatactcattatacaaaatttagaaaatacagaaaaacataaacaaacaaccaaaaaaaaacctatatgtaatcccaccaacctagacgcagcctttttaaaaacattcatatatgtatgtacatatatgtatatatgtgtatatgtgtatatatatacaccacatatatgtgtatatatgtgtatatatatacacatatgtgtggtgtgtgtgtatatatgtatatgtgtatatatacatatatatgcatatatatgtgtatacgcatatatgtatatatgtatatgtgtatatatacatatatgcgtatatatacacatatatacgcatatgtatgcatatatatatgcgtatatatgcatatatgtatatatatgcatatatatatatatacacacacacattttagctttattttagctttcattttaggttcagggatacatgtgaaggttggttacagacgtaaactcatgtcatgggggtttgttatacagattatttcatcactcaggaattaagcccagtacccatagttatcttttcttatcctctccctcctccctacctccaccctcaagtagaatccagtatctgttttttccttctttgtcttcataaattctcatcatttagctcccacttacaagtgaaaacatgtggtatttggttttctgttctgcattagtttgctgaggatgatagcctccagctccatccatgttcatgcaaaagacatgatctcattcctttttatagctgcatagtattccgtagtgtatatgtaccacattttctttgtctagtctacaattggtggacatgtaggttgattccatgtctttgcttttgtgaatagtgccacaatgaataaacaaatgcatgtgtctttatgatgaaatgatttataatcctctgggtgtatacccagtagtgggattgctgggtcgaatggtagttctgcttttagctctttgaggaatctccatactgctttccacaatggttgaactaatttacactcctaccaacagtgtctaagtgttcacttttctctgcaaccttgccagcatctgttattttttgactatttgtttatttatttatttatttatttattttctggagatggagtcttgctctgtcgcccaggctgcagtgcagtggcgtgatctcggttcactacaacctctgcctcctgagttcaagcgattctcgtgcttcaggctcccaagtagctgggactaccggcatgcactacaacacctggttaatttttgtattttttagtagagacagggtttcaccatattggtcaggctggtcttgaactcccgacctcaagtggtgcaccctccttggcctctcaaagtgctgggattacaggggtgagccactatgcccttccatttttttactttttagtaatagccattctgactggtgtggaatggtatctcattgtggttttgacttgcttgcatttctctaatgatcggtgatattgagcattttttcatatctttgttggccgcatgtatgtcttgttttagaaagtgtcagttcatgtcctttgcccaccttttcatggggttgtttgtttcttgtaaatttgtttaagttcctcatagatgctggatattagacctttggcagatgcatatggtttgcaaatattttctcccattctgtaggttgtctgtttaccgttgatagtttcttttgctgtgcagaatctcttcagtttaattagatcccacttgacagtgtttgcttttgttggaattgcttttggtgtctttgtcatgaaacctttgtccattcttatgtccagggtggcattgcctaggttgtctttcaaggtttttatactccggggttttgcatttaggtctttaatccattttgagttgatttttgtatatggtataaggaagggatctatcttcagtcttttgcatgtggctagccagttatcccagcaccatttattgagtagggaaacttttccccattgcttggttttgtcagctttgtcaaagatcgggtggtcgtaggtgtatggacttatttctgggttgtcatagttgaaatcatagtaaatatatatagtcttgtctctgacttttttcacttttataataacaagcatgcaaacatcattctaatggcttgtttgtaaatgtaccataaaatatgtagccactcttctatcgttgagtgttcaggttttatttttgatttttttattattataaataactatgataaacatccttatacataaaagttttttccttattttacattatttccttagcatatattcccagaagtagaattactgggtcaaggaataggaacatttttaaggcttttgatacatattgccaaattgctttccaaagttattatgccattttacacttctaccattagtgtattatagtgcctatttcataacactatcactgggtatactcatttttaaaatatttactgatttcataggcaataaattgtatctcattgttttaattctcatgttttttatttatttttcaaatggttaatagccatttggtatttctttatgtgtctgtaaattattagttcatttccttggcccatttatctattgtaatttaacatttttcttattgatgtgttttgatttctataccttgggtattaacttgtgtctgacatatttactataaacattagcacacaatttaaacatatgaatcaaaaagttaaagagagttaatgcctatttctattaaaaaacaaagtgctattcctgttataccactccttcccttaaaaagatatacacagtatcaggaaaaaaaagagaaaaagaaaatctctatagcgctaaagtattatatttttgctagaattttgaaaactaagtagtttgtaaagctaaaattttgacaaaagggtggaatgtggtgagtcgtgatggtagagggtacctctgagggcagagcaatagatctgggtagaattcagcttatttctcttcatgacaggtttttggggttgttaaaaaatctcttgtgtcagttgatactgaccatagttaataaactatattagcatgttaatatgaagatgttattcttatttattttcttatgaatacttacaaattttaattttagtaagcttaatatgaaaaaaacaaacataacctgtgatttttacatttggtttgcaaagcactttttacacacgttactccctttcatttgatacagtcctcacaaaactctgtgaattcatttttttcctgcatatcttttagatataggaagcaagacagtagatagcagaagtaaagtatacctaaatatttacatgaattgaattttacattaaactttttgctttcacaaaatcctatgaagcagatgggattatccctagcacattcaccctcctaactccaaaaatatagagtattttgaagtcaacttcattatttactatgtagtccagtttctattattttctttgaaaacttttgatctttctaggcatgctgtggaaaatctgtttcataagattatggacctagagtgggccttaagaagtaatgtggtctaactgccttcctgttattgagcaagaactaaattataccagtgaaataaagaaaatttcattgtctataatattcttaataattttaggaagaagatttaatactctttcctaatatccaatttcagtatctggaaatcctctcctttgtttaatttaaatctgacctgatacatttggttcatttttaaattctgtcctgaatagctgctcagcaattgctttaaaaaaatttttatatgcttccagatcattttgaaattatctttgacttcattctcttttgagtaacttaagtaacaattgacattggtgttggtttatctcagggctacaataaggcagtggattggtgggcattaggagtgctaatctatgaaatggcagctggctatcccccattctttgcagaccaaccaattcagatttatgaaaagattgtttctggaaaggtaagtaaaacattttattattcctctcttattactgtatatgaattttaagcttcatgaattgaaactatattgtgtcataattattattctacattgggaaaaatatagaaaaatctacagttgctgctcttactatcataagaattgaatcatttcagtctcttaagaaaaaaagggcagttttataaagaaattaacaaaacagtaaagcaatttctgtatttagtatttttatcacaaagaacaggatcatagccataattctcgatattccttcaaataaataaaaatagtttattatttcatgtgtctatcttcatggagaaaagttttaggggctgttttatatgcccttccattttcaggagagacttcttgttttaattatgtccaatactataacattggaagtaaaagtaaatataaaatgaataagcctttttcagatggaaatttatagaattgattttaacagaattgttcatatagattgtgattatacttgtcattggtttttagcaaacatggaaataacattaatttttcttcaacatgagtagacttactgtgttgtagtattttacattttgtaaatttcttcataaaccttccttcttttgcacttataacctctaatttgctttcaagagtgttttgtttagggtcagtcatttgctgttgccttagctcagacctcggatctttttttaaaagaccattgtcaattcaatagaaatgagcttgaatttcctaccatgcagcaatgaaagaataggcttttaaacattcccagaaggagaccttctatacattaatgacaaaatatatgggaagggatattttgcttattttcccttctttctatttctacatgtggtactgctttgtcttttcttttctttcccacatagtcccatttagaatatgatcaggaaatagagcatcaatctttatcacattagcctgagatgttatagagttgaggtttttttgttttattttttatttgtttgctttgtattttgtgaccttcttaggcagagataagccggaaggagatagtagagggaaggtctttatttctttgtatctcagccatattcaagctctacatttagtgtgaaagcttacccttggcatctatcaacttacaatttccattgttaactattcacaaggtaccctgaatgtctctaatgtggtaatttattttttttgccaacactcaaatttaaatcatagatgctgcacagctgggctgtagcaacaagacatttgccaatagaattagtctatccaatcacctagaacatacatttcagcacagtattgttccctatctcatagtacatatgcactctacctgggtcatgagattttcccttgtattttgccacgttttatgtagaaagttttatttattatcagtattcacaaattaggagactgactaaagaatttatactccaactatgtcaaaggtaaaaaaataaatacctcttacagataaataaacctagctaggtgttgaatgctgtgcactgataaaggcaatacagaaaagcagaatgcagtacttatttaaacaagtatcagtatcactgctgttcttcttacatttgtagatctctggcttcagacttcttatctttgtaattgttttctcccagcagaacttttgatatgaacaaaacaaaactttgagaaaaattaacagacaaggcagtgatttatttttgaagaatttgagaagtgtagactctcaagaggactaaaggtcatatgaagaatgatgagagaaccaaaatacattaaaatcacaaatggaagaagaatattttactaatacaaaaactaagaatgtaaatgttataataattgtttcaaatcatttaattgacagtaattataaagttcttgaatctttactatattacttttatttatattcatataagaaatccaattttctaacaaggatactgtcataactaaatttacatttattaagaaaaactgctttagttaaaattaatgtgtcttcatttttatgcattggcctcgatttgccaatcattctctattggttaaattttatattcagctgtttatgaatatatattcattttatatcaaactttaaaattttgtatctaataatcagcatatattctaaaatcataacagtctaaatcctgggcaccttagaagaatgacaccagaaaaccttattatatcacaatattctgttttccccttcatttatttagaaatatgacaggatatttggtgtacttttgttttttaactaaaagtaccagattatctctccccatgtgggatataaaattatccccatctcttactccctttactcatctaaagtagaagtcatgaaagtggaatttttgccattaaaaggctctgtattatgtgaagttagattgtattaaccatttcccaataaatcatctgtttcaaaactcaaattcaaactagaatgtgtctctattcacattgcaaaaatattattgtctctctggttagtggctaaaagccaaattggaaactaactagttttttaaattttttaaattgtgcaaattattaaaaatccaatttggtcttatatttgtggatccttatatttatatttgcatttgaacttttaatggttttaatgatatatcatttaagaatatgcttttcattcagaattgtttttgttgattttagaagcatattattttatgaaacagcatcttatattgattatatccaccattctgaagtcacgttataaagattataggtatcaatgacttatcaaagttaaatttattaattaagtgataaattcactaaagtacatatatatgaatattagattgtaaaatactttctctattacaatattttaactcaagctggtatttttaaatgcacacaaagatgatcaatcaacttgttagattctctcctacacatattttgcctttaaaaaaacagaggaggtggtatttaaatgtcacattattcatgcaatgttaaggtttgagtctacaaattcatagttgaaagaaaagatttatgattcctgcattaactatgcctcatcctaacaatacatatgctgagtttctgtatgtagtctttaaatttcatgtctcagtgtcatgtactccatgacaagaatcagttatggtctctatagcacctttgtctggctgcgttacccatggaaatatagaaagtttatattgcagtcaaaaattatacttgcaaataaggtactcaagtaacagctactatggaaaccataactttagagcccttggcttatgtaatttaaaaaaattcttagcttcaacatatctaatgtaaatattgttccactcctaatgagtaacaatatataaggagacatgcaacatagagaagtataaacataagtatatactgaatgatcaaagagttggttaatttttcctgaagggaaattcaatatttacatgaagggtaattgattatcagcccaattgctattcctttctgtctcaggagtccccaagactgtctccaggtttgatgattcaccaggaggactcaacaagattcagcatacagtggtacttgaggctaagatttattacaacaaaagggtacaaagtgaagatagcaaaagtccagaagacaccaggcacaagctttcaagagtcctctcccagggcattcacaagggatgcacataattccttcagcaacaagctgtgacaagcgtgaaattttatctaccagcaacactcattaaatactcaatgcccaaagttttcattgggggttggtcacatatgcaccctctgcctagcacatgccaaaatcccagcctcccagaacaaaagtagttgttcagaataaactatgttgtttgtaccaacagtgtaggcacagtgagccactctaatcctttagggaaagtttcatgttggtataagggcactggtactattcaagttgccagacatctctcaagggccaaacttgtaagcagttctttctaagggtagcagtctcaggcctactatgttaagtcttttctacacacattcggtttcctaaataacatacacatatgcagatattccactatactttttctaagatactattgttaatgcttttggggaaattacaatgtcatttactattttgctatggccatagttaaagagacttagaagtattcagaaatcattttcataaaacacaaaagcagttttactcttttcataaaacccagggccagttttaaacacttcactgtggctatttaaaattcttattaataccttctttctgacagctcttgtggtcctatgagcaaataattgcaaaactggcttcttatgtgagagcagggggagggagaatggggtggatcataatcctctgcaaccttgtagactcattatatctaccactgtttctgcataggtaagggaacagattagagagcccacagatgcagtaccaatatttataaatatttttaatgtcttagctctttcttttcacatatagaatccaggctgattaaagatgcccaggtcttatgaggtagtgtggaactcggcaccatatctataacatgcctagcgtatgaaaagttattatgcctgttgaaaaattgtctaatgtgtatgttcatttttgatcaatcaattctttactgggattgcagatattttgagaacttactgtacctaatttataaataatttgttaaaatttatctcaacatgctcgtagccagtagttagtagattattgcttcttggctgtatataaacccttttgagtcatgtaagcctaataattttatcctgattcataaaagataatgttactagttaaatgatcatttctcctgccaataattgcagaatagcagtaagatttttccctcctttcgaatatcaactttgtaatttctgtgattaagcttagtgtaaacaaatttgatttggctttattttatttcattttcttcttattcatttttattttttacttttttgagatggaatcttgctctgttgaccaggctgaagtgcagtggcacaatcttggcccgctgcagcctctgcctcctgggttcaagtgattctcctgcctcagcctcctgagtagctgggactacaggcatgtgccaccacgcccggctaatttttgtgtttttagtagggacagggtttcaccatgttggccaggctggttttgaaatcctgacctcaagtgatccacctgtcttggcgtctcaaattactgggagtagtaatttgaagtcagtaaactagatagtgagtttaaatcactcagtatggataccatgaacaacatgaatggatttactttttggttgtaacttcatcttgaacttttagaagataatagttatttctaaaactcaaatgtacaagactttataatcagtgctgaaagcagaaaaaatattctgttgagtttgctcaattcagagtgaattttatagttcgtttaacatattacataatgtaatttgacagtagtttaggatatcagccatattgacaatggtgtctttataaaacaaatttatagtaagacattttctccctcactttatcaaacttaggaccttaagaaaagatgaaagtgtttattctataaattaacaggtggagcctgagacaagatgaaaggaggaacttcctatactttcccaatgacttttctagcacagactgtccttggcgcatctgtaaaaataatgatagatatggctgtcttctacgttctttctttaattcaaaaattcagtttcagatcattaaaatagtattctaatgggaaggcttaaaaaataaaaactgtgttgaattaatgtctacagaatactaggcataatacaaggcagtttcatgttaagtcacataatttcttttcatacctgccagatgagatatactctcattgttttataaatgaggaaactgagactcagaaaagttttccctagattgcagagcatgtatgtaagtagagttgggattggaacccaggaattctttctactaaagaaatagcttggtagaattttttaggtggcaaggatgttcacttttatttcatttaactctctagtcctatatgtaggtaaatcaaaactcagaattacccaaagacaaaaggtagtttgtggcaaagcaggaaatagaagaatctagttcagtgattcatttgttattccttcacttggcttcagtgactttgtatcactaatcattccctctcaatctccttggcttgatccccttctcttctttctatgcacttcctcaatgggtggtttcatccagtctcatgactcaggacaattcccaaactcatttttccagtccatacctgattcccaaattccatactcttgtatctagtttctaacttgaaatcttcacttggatatctgatacctcaaattcaacctgtctaaaactgacaagtttttgtcctctttcctacactccacccacccccctccacgaagccttccccatctaaactgatggcaactccaccctttcagttggtcaggccaagacaccttcgagtcctcacttcatatctaatgcacagggaaaccatttttgctttgtctttagaatttacagaattcagccacttcttaccacatccactgctgtcactcttaagtgagtcactagagtggttccttaaaaatgttaaataatatcctattattcttttcaaaaccttgcaaggattccccgttttcttcagagtaaaagtcgaagaccttactatgcaaagtttcatgaaaaagataggataacattgttaaaggatcactcggttgctaagttttaattgtcttcctcactagaatgtaaactccatgaaggcagaaatcttcatcttattttgtttacttatataatccaagcacaaattcctgagatatattagtaagcacatagtacttgcttaattcaagcataacacatagtagaggttcaatcaatatttgttgaatttcaattcatgcattcattaaatatttatgaagctcctagtatgtgccagaccagttctacatgctggatacagcaagtcagttgtggtctctgccttcatgaagctttcatgaagtgtactctatctttggtatctctccagagacatactgactcaagaggccttctgtggattcaaaactttttttaagtatcacaagtgattctgataaacaccatgtgttgagagcttgttttgtgtatctgtacctcactggggaattagatttattctcaagaaaatataattagaaaaatcagaagtaatatggtctctaatggttggaaaacaatcctaaacaataaataatattgaagaaaaaatattaaagaaaacacgttgggaagtgtatatatcacaaacacctcttttatgttgtacaaacacctcttccatgttaaatgatgccagtttcccataaccttatctctcagacctaatggcttaatgattttagactttctcttttcaatatctgactctttacatttactttcacattatttgcctatcttggactggcagaaagctcataggtatatgtcaggaagattaggttattttcccaataattctactaacggagttggtagcctcacaggagctcagattccttatctttaaaatgagagtttagactcaattaaactaagctccctctagctccaatattagaagattctcatttcactttctatagtagttataattgataatgataaaagtaatacccttttgatatagttttaaaggaaaaattagatagtcgctcttcccatcatagaaatctttagtgtctccaggttgatgtattacaaataaaggttgtacacttaaaacaattttgttgaagttattttctgtttttcactaattccagtttgataaatcaacatgactctttgaaaagttcagtcaacaaggaaattacatttcaggttaaatttcagaataatcatgggaaaaaatactttcacaatgactttcattatttctcccccaaaatactttaaatatgtgatggattcccattattaacatgaaccactatgagagtgtgggctacctatgagaatctctggggaagagggtgtgatatggaggtgaggaggatatgtctatgatttgaaaaggttcccaaatcgttctgatatctgctgtcacaacccaccaccactccactgtcacacacacacacacacacacacacacacacgttcaagaccatcactttatttgcattccaaaataaagaattacattatttagatgattttatttttcatgcattccactgcatattacctgaattccaaagataatttatatgtagtacattactgtctgccatctgaatgtaatgaaagagataactggtacattaccatggaacagttcacacaaatttaatcttaaatatagatgtacttcaaataaattatttctttggaatctaaataaagtttagatttatcactggaaaaatctgagctaatatacccactggaaaaatgtcatgttatttttaaagtagacagtgtgccttttgaaaaccccttattctctagttattacttcatctaggtaaatgaggaaatgtgcagcaaaatatttttaagaaaatttcagtcttttagaaggttcctgataatgactatttttaggttattgaatcatggaaggagaatagataattaaaaataagtaccctgaagtcagtgtacccagtttggaattacacctttactatttattagctctgtaatcttaggcaaaataatttctgtaggtctcaattgcttcacccctacctatgaaatttggataataatcatacctatgttttggattttatgagccagtacagaaagtgtttagcataatgcctagcttctagtaaaccactgtgtcaagaataaaactagagaaggtagaagttcacatatcttattattttagaacataaaactgctcataatctaggataataaagggccttgcaaaaatgagattttgagttgctaatttatatgagttgagcctaaatcctggtcatttattaactattaaccctttaaatagtctttagttgttgatagaatattagttttcctctggtatgataatgatttcaatttacagtactgtattatttacatttaaaatgttatgatcttttactagcatagaaaataaaacctctgcataaagtagtgaacagagttgagaatagtgcttttcaagcttttatgtacatatgaatcccttggagataaaagctcagattttcaggcccaatgcccccatcatctgaggcaagccacaggaatctacatttttatccttttgtctcccagtttattctgatgtgcatgggtcctaggaccagattttgaaaaaatttacttatagactagcacaaaagtggcagtcaaaagctatggttatgaatttaactttactataaaacctatctttgcatgcatgatttaacttctactttgagaacatgagaatgtatgtcaagtaggttgagcttttagaaagtcagaatataaattaaggagtctatatatttgaagacagtgtaataaagagcaaaattcatgaagctacaaatcatgactagattactggtcccaactctgccactttatggcctgatgactggggaagctatacccagtaacattgctgaatcttagtttctccatctttaaattggagttaataccatattcactgaatttgtcctatccaactagaatgtaagttccatgaaatcagagacttgccaggttttgctcactgctatatatccagcacctaaaatagtgcctggcatatagtaggtattcaataaataattgtaaaatggatgaactacagtatttgaaatagtctaataaatactgagaataaaaatggcacaataccttccctcagaagctcagagcctgggggagacagaaatatgcacaaatactatagcatagttgaataaataaatgtattataaagagcaactgaggtaatgtaatgatgcactatgtaagttatgaagtgatggtagtacttgtagtggtagcacttgtagagaaacaaaataagaatgcagagagtttggggatgcgcctcttaaccctttaaagtgttttctacaaagtgctatgatcaatttgtagttgaggctgtaataatccagatatgtatacacatacatgtgtgcatacatatgtatgtatgacagggaagagggtaatgaaagggattgaacacaagctggaaaggatagtggagaggtggtagtgatgacaaaaaagaataaggaggcatagatgcagctattccttcatcctttggtggtacccattttaattttttaggtacccatatcaatgaaacagtaataaccagaagttagattggtatagaggagaagaatgtgtttaaacaaaacaaaatgaaaaatagacttaggtctcctataaatgttactttaaccttatcgattgccaaaaatcttcacttatttgggggttttccatttatttttaaggccagaggccagtctagtaattgtaaagtcttcacaatttagtaggtagaaaaatgcttttaaaccaatctaaatcatttttatactgttgcataataggagaattatttttaaaagccaacttctgataaatgaaaaatgttttcctatactgtgaaaggcagtgtgggtttttacaaccatttttagacttcctttttgatagatctcttttcaaaatgtacatactgatttccttcatatgctggttcttctatttatattacaaagttaaatttatgtatctttgagacacaggtttgtaatgtatgatccaaagagattgctcttaaagataggtgaactttctgatattttgcaaaagttctgtaggtgtgcacatttttctggagactgctccatgttcttaaagacatcataaccaaagcaaggccctaagagaacaggtttagttcattcacccaagtaattctcttctttatggctactgtggggactgtaacatgtagttaaaagtatgtgaaggtcatcgctccatatttttgtttatataatggcttgttgccttgaaaaaaaaactttatgaaatcaaaacagaaatatcatgagtcttagaatgtgtgttttaccaaatggtgtgtttgtgtaggtccgattcccatcccacttcagttcagatctcaaggaccttctacggaacctgctgcaggtggatttgaccaagagatttggaaatctaaagaatggtgtcagtgatataaaaactcacaagtggtttgccacgacagattggattgctatttaccagaggaaggtgagactttcttttttaatttaaaagcttttttaaagttggtgtttaaattatatgtggtggagatattttcaacttaacacatagttttaatttttttaccttttgaattaatcttgtgcaggatctaaagtactttacagcccataacttaaaaatgagtttccccctagaattttttttttttttttttgaggtggagtctcactctgtagtccacgctggagtgcagtggcacaatctctgctcactgcaacctccgccacctcagttcaagtgattctcctgcttcagcctctcgagtagctgggactatgggtgcatgccatcacatctggatgatttttttgtatttttagtagagacagggtttcactatgttggctaggctggtcttgaactcctgacctcaagtgatctgcccacctcggcctcccaaagagctgggattacaggcatgagtcatcacacctggccttacctagcttaaaaagaaagcatatatgctattttgaccatcaacctgaaatgtttcctttgttaaatttttcctatctatgcttgttacgcttcacaaaactgtggaaattatatattagacaatgtcctaagggttttcaaaactgatgtgaagccacattaggaagatatataaataaatgtagttgcccatccagaattggcatgtgccagatatataataacattaaattgctagtttcattccttgttagtcttcattttcaccttcttgtggcatattggtctctctttagagatacagctttcctttatccatttgaaagctaatttgaacataattcatacaaattaggggttttaattcatgcatttttggaaggtcaaagcaaattatctgaagttactacttttttccttttaacaattatttattcacgtaagattttttccaaatagttatcaggtccctgcttgtatgttaggtattctgcaaggtgctgagaatacaatgatgagcaaaaccaacctttattcctgcccatatgaagcttatacttccaggggacagggagattagtcagatggtcgtataaataaatgtaaaagtactatactgtgagaaatgtggaaattcagaataactttgcacctgagtttttgagatttgttttgtttggtcttttgtttgactctttgctcgctaaagggattcttagagttagaaattcaggcaacttgaagacttgaatataagtatagatcaagttaatcgctggcattattataccaccataataaaatagagaagaaaccccagctaaactgtagcatatttaaaagaaactagtattttgttttgttttgttttttgctacacaagttgccagtatgacagttgtggtaacagtactatattaattgatagcagttatcatttcacttttgtaataatttgagacatttaagaaaagattttgctgcactgaattacctttatctctcattttgcttcttacatgcttaaagatgatttgcatgaataaagtgttttcattttgaatatatttaatttttttcttcttttttttcataaaaccaaaacttctaatgttttagagacatgtcatctttaataatgctgtgcaactacatgattgagtttccttaaggaaaaaaaaatttaatgctctaattaagtattaaaagcacagtttttctaatttatatattttacaaatgattacagtaacaagctgggtgccctggctcacacctgaaatcctaacactttgggaggccaaggtgggtggattgcttgagtctcactcaagagtttgagaccagcctggcaaacatggcaaaaccccgtctctacaaaaaatacaaaaattatctgggtatgatggctcatccctgtaatccgagctacttgggagactgaggcaggaagatcacttgagcctgggagattggggctacggtgagctgtgattatgccactgcactccagcctgggtgacagaacaagaccccgtctcaaagaaataaataaataaataaagattacaaaaacaaaacaattaaagaattttaaaatgcagcaaaaagaacatatagccagaccaaaacaatgtgaatgcaatacagcctatctcacaagagggatccagaaactctctgttaagttcatgaatcgtggctgtcagcattattatcgcaaatagatatgttatatagtcaataacaagattgatagcactttaaaatagatttagatctcataaaaaactttattttttatattttttctaaatttgctaacaccaatgcaatactgtataattaataaaagcaactccctataacttctcttttcagtcttcaaaataatcctgtgaaataagtgataccattttccccattttactgatgtggaaatcagctcagagaggttaattaatttaaacataatcatgcagctgctaaataatacctatatttgatcccaggttcttcagattttcaattccaggtcacattatccctttaaagtccttttgacatgattcttaaaatgaaactccaaaccactaaacaataaattgtttcacaagattttcatgaattttacgtgtatcatcttcttaacttttatgctttgagcattttgggagtaggaagactctgtctcaaaaggcagcaaaaaaagagaatgaactgtggtgttaggtagacattgatctgaatccctgatcaaccaatcattagcagtatgatcatgaacaaacgatttaacctctctaaagcatcagttttatcacccttaaaatttgaatttggatagagaatacaaaaggaagagcagtttggtgagaaagattagatggattggcccaggctccattttcctttctggttgagatatgtttcatatacttataaccaggtaatttattaagcaaatgaatttgaaattatcataattccaccatccaaatagaacctagtatttgatatatgtctttttactttttttttccctgtgcccttcatcactgcagttcagtcctatgatctcagtagccaattaaaatctacctcctccaaccctgcactttaccatttccttcagtctcttatctcacagttgctacatactacataattacatctgagtgacttactgccatattatacaattgttttaaaacaggccaggtgcagtggctcacacctgtaatcccatcaatttaggagtccacagtgggaagatcacttgagccaagagttcaagactagatgggcaacatagtgagacatcatctcttcagaaaataaaaaagaattagccaggtgtggtaacacacacttggtcccagctaccctggaggctgaggcaggaggatcacttaagcccaagaggtcaaggctgcagtgagccatgatcatgccactgcactccagcctgggctacagagctgagaccctgtctctgaaagaagaaaaaaaccctactccacaataagtgtatctatcgaacttctattttcttttagtgctttctgaactctaacttattttttgttgttgtaattaaccagttgtcccctccatatttattgaataattcttatttggcctcttatttgaaattctacctttactaatattaaattaatatatacatctgtctatttctcaactttttaaatttttattgctgcatactatttttatatattcatgaagtacatgttatattttaatatatgcgtagtatgtgtagtgatcaaagctgggtatttagcatatccactaccttgatcgtttattgtttctttgtgttgggaacatttcaaattttctgttccagttactttgaaatatataatatattgttgtgaaatatacaatataaccagcctgctgtgctatgaaatgctagaacttattccttctgtctaactgtatgtttgttctcagtaccttagttctcttcatcccttcccccacacacacacatccttctcagcctctggtagctgtcattctatacgttacctctaagagatcaacttttttaggttccacatgtaagtaagaacatgtgatattgtctttctgtgcctggctgatttcactttacagaatgatctgtttctatccatgttgctacaaatgacaagatttcattcttttttttacagccaaatagtattcctatatatattacattttctgtacccattcatgtgttgaaggacacttaggttgattccatatctttgctattatgcatagtgctgcaataaacatgaggattcaggtattgcattgatatactgatttcgtttggattaatggaattgctaaattgtatgatagttctatttttagatttttgaaaaatctctgtactattttccatagtagctgtactaacttacatttttaccaacagtgtataagaattcccttttctccacatcccctccagcacttggtgttttttgcctttttgataatagccattccacctgggtacgatgatatctcactgtggttttgatttgcatttccctgatgattaatggtgttgagcattttttcatgtacctgttggccattgtaaatctggttttgagaaatgtgtacacatatcctttacccattttaattagattgtttatttttggctactgaattattggagttccttgtatattctgcatattagtcccttcttggatgaatagtttgcaaatatttttttctcccattcaacaggttgtctctttactcttttgaatgtctcctttgctctgcaaaagcttttaatttaatatagcccaatgtgcctatttttgtttttgttgcttgtacttttcaggacttagccataaaatcttttttgtttgtttattaggttttttttttttttgagttggagtttcgctcttgttgcccaggctagagtgcaacggtacaatctcggctcgctgcaccctccacctcccaggttcaagtgattcttctgcctcagcctcctgagtagctgggattacaggtgcccacaaccacacccagctaatttttgtatttttagtaaagacagagtttcaccatgttggtcaggctggtctcgaactcctgacctgcctcagcctcccaaagtgctgggattacaggcgtgagccaccatgccccacccataaaatctttgactagaccaatgttctagagcatttcccgtatgttttcttctagtattgttatggtttggggccttatttttaagtacttaattcattttgagtgatttggggatatggtgagagagagggatctagtttcagtcttctgcatatggatatccagtttttccgcaccatgtattgaagagagtgtcctttccccactgtatgttcttgatgcctttgtcaaaaatcacttaggtgtaatatgtggatttatttatgggttctctattctgttccatgggtctctgtgtctgtttttataccactaccatgctgttttagttactatagctttatagtatattttgaagtcaggtagtgtgatgcctccagcattgctctttttgctctggattcctttggctattcaggctcttttgtggttccatacaaattttaggatttttttttctatttctgtgaagactatcattggtattttgataggaattgcattgaatctgtaaatttatttgcatagttgatcattttaatatatttatttttctgattcatgaccatgaccatgggatgtctttccatttgtttctgtcctttttaatttctttcatcagtgttttgtagtttttcttgtagaggtctttcaccttcttggtcaaatttattcctaggtattttatttatttttttgtagctattataaatggaattatattactgatttctttcttagcttgatcattattggtgtatcgaaatgtcactgattttttatgttcattttgtattctgcacctttacttatttttttatgagttctaagaatattctggtggagtctatatgtaagattatgtcatctgaaaggaggggcattgtatttagatgccttgcatttagatgccttgtatttctttctcttccctgattaatctggctaggacttccattactatgttgaataggagtggtgaaagtggacatccttgtcttggtccaattcttagaggaaaggctttcaacttttcctcattcagtatgttagctgtgagtttgtcatatatgacctttattatgttgagtaatgcctcttctatgcctaatttgttgagagtttttgtcaggaggggatgttggcttttatctaatgcttttttctgcatctattgagatgatcatatgatttttgttgttcattctactaaagtgatgtatcgtgttaattgatttgcatatattgacccatccttgcatccctgggataaatcccacttgatcatgttgtattatatatttgttgtgttgttggatttttgttagctagtgttttgttaaaaatttttgtgtctgtatttctcagagatgttggtctgtagtgttctttttttgttgtgtgcttgtctggttttgtatcagagtactgctggcctcgtagaataagttaggaagaattctctcttctttaattttttggaatagtttgagatgaattgatgctagttcttctttataaggttgatagaattgagcagtaaagccatgcagccctgggcttttctttaatgtttgatgggaatctttttattacatattcaatctgttccccattattggtctgttcagattttctgtttctatctggttcagtctttgtaggttgtatgtgtccaagaatttatctatttcctctaggttttccagttagttagcatatagttgttcatgatagtctccagtgatctcctgtattctgtggtgtcagttgtaaaatatttttcttttctgattttgttaacttggatcttctctctttttttcttggttagtctagctagcagtttatcaattttggttattttttttaaaaaaaaacctttcatttttatgatcctttgtatgttttttctctatttcatttagttgtgctctgatttttattatttctttccttctactaattttgtttggtttgttcttgcttttctagttccttgaggtacgttattaggttatttgaaatctttatactttttggtgtttattgctataaacctccccttagcactgcttttcttatattccataggttttggtatattgtgttttcatttttctttgctttaagattgtttttatttctttcttaatttcttcattagcccaatagtcattcgggagcatattgtttcatttccatctatttgtacagtttccaaagtgcttcttgttactgatttctagtttttcccatcaggatctgagaaaatcttgatatgatttcaagtttttaaaatttgttgagacttgttttgtggcctaatataaatggtctatcctggagaatgttccatgtgcttattagaagaatgtgtattctgcaactattggataaaatgttgtgtaaatgtctcctaggtacattttgtctacagtgcagtttatgtccaatttttttggttgattctctctctcaataatctgtacaatgctgagaatggagtgttgaagtcctgaactattattgtattggagtctgtctctctctttagatctaataatatttgctttctatatctgtgtgctctagtattggatgcatatatatccgttatatccttttgctgaattcatccctttatcattatattatgaccttctttgtctcattttactgttttgacttaaagtttcctttatctgatataaatttagatactcctgcttgtttttgttttccatttgtatgaaatctttttctgtctcttcactttcagtctatctgtgtgtttacaggtgaagtgaggttttttgtaagcagcatatagttagatcatgttatgtttatatattcagacagtccatatcttttaagtagatatctgatttatttacatttaaagttattattgataggtgaggacttattcctatcatttaaaaattgttttctggttgctttgtatatccttcattcctttctttctctctaattgtttatcattatagtttggtggttttctgtaatggtaatatttgagtcctttctctttctcatttatgtgtctgccctaccagtgacttttatactttcttgttttcatgatggtaaatatcattgtttcacttccagatgtaggactaccttaagcatttcctgtagggctgctgtaatagtggtaattccctcagtttttgcttatctgggaaagactttttttctccttcatttttgaagaaaggtttcttggttagtctagtagtttatcgttggtggcagggtttgtttttttccttttagcactgtgaatatatcatcccattctctcctggcctgcagggtctcccctgagaaatccacgttagtctgatggaggttcccttatatgtgacttgatgcttttctcttgctgtttttagatgtctgtcttgtctttgacttttgacagtttcagtaaagtgtgtcttggaaaagacctttttggattgtatctatttgatgtttcagcttcctgtatctggatttctaaatctcttaaaagaactaggaagttttcaactattattaaattaaatgagtttttctatgtcattacccatcactttaccttctggaaaaccccaaatttgaatatttcgttgctttaaggtgtcccctatgtcatgtatgctttgttcattaatttttattttttattcttttttggtgggtctgtctgaattatttcagaagacctgtcctcaattcttctccctgatatagtctattgtcaaagctctcagttgtatttttcatttcattcattgaattcttcagttctgggatggatctgtttggttgtttttttttgtttttttttttttttgaaatggtgtctcgctctgtcgcccaggcaagagtgcagtggcgtgatctcaactcactgcaagctccacctcctgggttcacgccattctcctgcctcagcctcctgagtagctgggacgacaggcacccactaccatgccccggctaattttttgtatttttagtagagacagggtttcaccatgttagccaggatggtctcgatctcctgacctcatgatccacccaccttggcctcccaaagtgctgggattacaagcgtgagccaccatgcccggcctgtttggttcttttttatgctatctctctgttgaatttctcactcatatcctgaattgttttcctgatgtctttgtattgtttgtctgtgttctcttatatctcactgagcttctttaatatcattagtttgaattctttttcagacatttcatcattttttgtttaattggaatctgttggtggagaattatgttcttttggaggtgtcatgtttctttgctttttcatgtttcttgtatacttacactgacatctccacatctggtgtaacagtcatttcctccagtttttaggattggcttttgtagggtaagacttttttctgtggatgtatcatcatgttggtttgttgggcagtttagcttttattctgggtgcatgcagtagtgtagtctctatgatttcttcagctgtaattagcctcagtgggtgtctgcgatttcctcagtggcttaggccgcattattggtgtagcctgtggtgaggctttgctggggacagggacaccaggcatcctgatcctcaggccccagtggtggtagcagcaggccaagcatacctgcccctggtggccatacactggcatcaattttagcaggtctgcaagggccaattcttaggcctctatgtggcttgctcaggtaccagcagtggcagtggtaggctgagcatatggatgagaccttagtctcctgtgcagcatgtgtggcataagcgattgtaatagtgatggcaggccaaccctcaggctcccaggcagtacacactgctgctagtgatggtagcaacagattgggcaagccagaccctaaaccctcaggtggcatatgtgggtaagcgccagcagtggtagtggtggcagactgggcaggcccagcctcaggccagtagtgggtggggcagggcaatccccaggccctcagatggcatgcttgagcattggggttgcagtgccaggcagtgcaggcatttactcaggcccctcaatggtgcacgtgggcacaggctgtgttggaccaagtgaggcaatccccagaccctcaaacaatgtgtttgagtgcaggcagtcagtggtttgggtctgttgttagaccccctgatggtgcagtgcatgccagaagcagcaagcagggtggatggatccccaagcctccagacagtgcactcaatcactgtgggaggtgccaccaggcagggaaggcctgtccccaggctcctctgttgtacctgtgggtgcaggctgtggtgaacagggcagtctttgggccactggacagcatattttgatgccagtggctgatagcctgagtctttcgtcatgcttcttgatcatatgtatgtgtacccagagtgatagacagaggggggcactccccaggcctcccaggtggtgtgctagggcactaggaggggtggcacttaaagggacaggcctgtcctcaggcccctattggtgcacacagatacagactctggtaggcagggaaggactattcctaggcccctggataaaatacttgagaggtggtaggcagagtgagtctgtcctcatgcccccaaatagcatccagttgggccagttcccaggtccactgaaggtgctgcaagtacctggcagtcctgttgtgggggctgggcattgctatcagtggcagtggccccaggcaggaggccctcagactctggggagtgtatgctttggcttccggccccagaaacagccttccctagtgtgctgccctgcttgttctttggagtataagacactgtgtgggctcgagtgctggggacccagccgcaccattgggtccagccagcactgtaccactggaacccctttgatagacatggggcactgtcagttgggctccaggtgtatagagatgcatactctctaatggtagttggcttctcaaaatggcactgtgcttcagcttcttgggtcctgggggtgggtgtgggacctggaacaaactccctctctggaacaatgctattgtgtgaactccaggcaggtccctatacttgtctcagaattcacgagggttgtggggatcttacatggctaggattgcaagagtctgtggtggaaatgtggaccactggggatctctcagttaccctttccccatactggagaacctcttgtggctgccagctggtcccagctaggccagctgcttcacttccttttgcttatctgcctcagatgttccctgtcacttccctgctaaatttcagtgttctctcttagaggctttattcaacatgtgattatctactcactgttttggtccttctttgtggaggagagttctgagtcagccatcttgaagccctgacctttattttttaggagttctttttgtctgttcttgtactgtatatgtcactgctttatgtagctttaaaatattttaatattagatgggtccagtttcttcacccttgtttaccctttccaaatgttctgttctcttgccccatatgcattattttagagtcaagttaggtaatttatatttcctagaaaatcatccttatctcctgtatgttttctcttccttttttgattagacttgccaatggtttgtgggttttttgtttttttttttggtctctctaaagatttattgaatttggggattaacagtaaagttgcatattaggagagaacctgaatcttgagaatttaccattatgaacatgttgcttctgcatttactcaaatatctttcgtcattcagtaaagttttagagaaccccccttcctccatataggaaggaatttatgtcttaaaattattgcttaaatttatattttggttgctattattaatgtgtttgctttcccgttatagtaggatatgggcaaaacatcatttttatgtttatattataattgaccatgttactaaattctgttattgatttccacatttttcagtgattcctttggatttttattgacaatcataggagattggcatatcattttgtctgttccttttcagtatttacatctcatttccatttttgttttagtacatatattagaatgtctaaaacaatattttaatgcagtagggcccttgagctttcttgtcttgttcctgctttgaatggaagtgcccaagaatatactttcagggatcatttctataatttgttgcctttcatgttttaccaccaaatataaagttggccatttggctgagataggtattctttatgaggttaacaaaacattgttgatttctaatacactgtattttatcttttttgacatgttagtgtgatgaattatatgagggagacatcctcactttcctggaatgaataccattaatcatggggtattaacattttaatatttgcctgaaatctatttgccaaaattttatttagggtttttacttctgtagtcataagttttattagtctacagtttctgtttttttgaagttgggattatatgggattcataaaatgagtttagaaagtttccaggcttttattctgcagaaaatttaggaacatagagtcatcttatatctattccttataaattttaacagactaattcttgggtattggtctcttcaagtttttactttttgactcaatttaagaaatttatatttccaataaaatcatccatttccctttctaattatcattgcttatattatctttattgttgtatttattgttaattaatgctatttcgaggtatattctttagattgccttgaggcttgtcaactttattagtatgctaaagatttatggtgtatttgaatcttctcatatttatatttagaaataaaatcttctgccaaatagcagtcatttacttatctattcctattatgtgtttaatttttaataattattcctaaaaggggatagaacaggaaggccactactcatttaaagtgtatgtgcttttcagagggcttgacttatcccaggtagtaaacaggtaacctaccaacaagtggcacactgtaacatacagattgtagtaatggacaaattgattgacagccaaatcttgattatcaatgaaacagatgtaaggatccatggacaatttacaaataaaaatagcagagtactttaaccgtttgttttaatatcttctcaagtattataactatgcacagcagtgcaaaaatcatagtaaatatgaatagttttaattgtcttctttattctctgatgcatctccaaatgatcaaggaaaaaaaaaggcagaagaaagaagtagcctgaacaactcaaactgtacaatcattttctacacatgattttcccaataggtttgttattctaaattgctggctggctagacgtgaagcaactgtctgcttagctcattcttctgggtagtgcaaaacagcagtccccaaagcagggcgtgcaaggcaaccagctctcaaacaaaaagataatattagaagtcccattcctacttatttttaccttattctttttcaataccttatttgtgtgtgtatcttataatagtatagtcatacatctaaataaattgtaagtaaataactatatatatgttgattatgtgtactagaaaatgttttaatgaaagggatataaattaaaaacccttggagagctctgggccagaagtggagaatcatgaatatgaaacctgctttagccgcttatcagtcatgtgaatttggtcaatcgactcttttataatctgtaaaatgggagtaagaacaccagtccttccttcctcacagtgttgtactgagaacagaataaagcaactgtaattgtttgtaaattctataaaggctgtgcagattatgatttttttttttagcttttaaaatcttttcctcaaatgtattcagtacccacatttaatctttatagaagaccatattcgaagtagtgggaagacattttacttttaggatcaaaggagaaaaatgtttaaggtttaacaattctctaattctaaaagagttatatttctttccaaactctcagaaagttttgatggccagatattttaaacaaaataaacttgggaattaaaaaaggaaagcaattaaaagtaagtctgagatttagctgtaacttgaggagaaaagaatttttacaagagggataggaaaagataaggtcttaaaaacaaggaactaaaaattaagactgaagttttgtaaccttaggagccaggattttgatgccaacagttaattatcccagaaatttctttttttttttattattatactttacgttttagggtacatgtgcacaatgtgcaggttagttacatatgtatacatgtgccatgctggtgcgctgcacccactaactcgtcatctagcattaggtatatctcccaatgctatccctcccccctccccccaccccgtaacagtccccagagtatgatgttccccttcctgtgtccatgtgttctcattgttcagttcccacctatgagtgagaatatgcagtgtttggttttttgttcttgcgatagtttactgagaatgatgatttccaatttcatccatgtccctacgaaggacatgaactcatcattttttatggctgcatagtattccatggtgtatatgtgccacattttcttaatccagtctgtcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttatttcctgactttttaatgtttgccattctaactggtgtgagatgatatctcattgtggttttgatttgcatttctctgatggccagtgatggtgagcattttttcatgtgttttttggctgcataaatgtcttcttttgagaagtgtctgttcatgtcctttgcccactttttgatggggttgtttatttttttcttgtaaatttgtttgagttcattgtagattctggatattagccctttgtcagatgagtaggttgcaagaattttctcccattttgtaggttgcctgttcactctgatggtagtttcttttgatgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaacccatcttgaattgatttttgtataaggtgtaaggaagggatccagtttcagctttccacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaacatgctgtgttggttactgtagccatgtagtatagtttgaagtcaggtagtgagatgcctccagctttgttcttttggcttaggattgatttggcgatgcgggctcttttttggttccatatgaactttaaagtagtttttccaattctgtgaagaaagtcattggtagcttgatggggatggcattgaatctataaattaccttgggcagtatggccattttcatgatactgattcttcctacccatgagcatggaatgttcttccatttgttggtatcttcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcctgtgatttttgtacattgattttgtatcctgagactttgctgaagttgcttatcagcttaaggagattttgggctgagacaatggggttttctagatatacaatcatgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcgtgttgaattttgtcaaaggccttttctgcatctattgagataatcatgtggttttttctttggttctgtttatatgctggattacatttattgatttccatatattgaaccagccttgcatcccagggatgaagcccacttgatcatggtggataagcttttggatgtgctgctggatttggtttgccagtattttattgaggatttttgcatcaatgttcatcaaggatattggactaaaattctcttttttggttgtgtctctgcctggctttggtatcaggatgatgctggcctcataaaatgagttagggaggattccctctttttctattgattggaatagtttcagaaggaatggtaccaattcatccttgtacctctggtagaattcggctgtgaatccatctggtcctggactctttttggttggtaagctattgattattgccacaatttcagatcctgttattggtctattcagagattcaacttcttcctggtttagtcttcagagagtgtatgtgtcgaggaatttatccatttcttctagattttctagtttatttgcgtagaggtgtttgtagtattctctgatggtagtttgtatttctgtgggattggtggtgatatcccctttatcattttttattgcgtctatttgattcttctctcttttttctttattagtcttgctagcagtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgccataaatttccctccacacactgctttgaatgtgtcccagagattctggtatgttgtgtgtttgctctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaactctgtggtcaatattggaataggtgtggtgtggtgctgaaaaaaatgtatattctgttgatttggggtagagagttctgtagatgtctattaggtccacttggtgcagagctgagttcaattccttgttgactttctgtctcattgatctgtctaatgttgacagtggggtgttaaagtctcccattattaatgtgtgggagtctaagtctttttgtaggtcactcaggacttgctttatgaatctgggtgctcctgtattgggtgcatatatatttaggatagttagctcttcttgttgaattgatccctttaccattatgtaatggccttttttgactcttttgatctttgttggtttaaagtctgttttatcagagactaggattgcaacccctgcctttttttgttttccatttgcttggtagatcttcctccatccttttattttgagcctatgtgtgtctctgcatgtgagatgggtttcctgaatacagcatactgatgggtcttgactctttatccaatttgccaagtctgtgtcttttaattggagaatttagtccatttacatttaaagttaatattgttatgtgtgaatttgatcctgtcattatgatgttagcttgttattttgctcgttagttgatgcagtttcttcatagtctcgatggtctttacattttggcatgattttgcagcaactggtaccggttgttcctttccatgtttagcacttccttcaggagctcttttagggcaggcctggtggtgacaaagtctctcaacatttgcttgtctgtaaagtattttatttctccttcacttatgaagcttagtttggctggatatgagattctgggttgaaaattctcttctttaagaatgttgaatattggcacccactctcttctggcttgtagagtttctgccgagagatccgctgttagtctgatgggcttccctttgagggtaacctgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcgtttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccgtccagctttgttccgttgctggtgaggaactgcgttcctttggaggaggagaggcgctctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtacctggccctatgaggtgtcagtgttcccctgctggggggtgcctcccagttaggctgctcaggggtcaggggtcagggacccacttgaggaagcagtctgcccgttctcagatctccagctgtgtgctgggagaaccactgctctcttcaaagctgtcagacagggacatttaagtctgcagaggttactgctgtctttttgtttgtctgtgccctgcccccagaggtggagcttacagaggcaggcaggcctccttgagctgtggtgggctccacccagttcgagcttcccagctgctttgtttacctaagcaagcctgggcaatggcgggcgcccctcccccagcctcactgccaccttgcagtttgatctcagactgctgtgctagcaatcagcgagactccgtgggcgtaggtccctccaagccaggtgcaggatataatctcctggtgcgccgttttttaagcccgtgggaaaagcgcagtattcgggtgggagtgacctgattttccaggtgccgtctgtcacccctttctttgactaggaaagggaactccctgaccccttgcgcttcctgagtgaggcaatgccttgccctgcttcggctcgcacacggtgcgtgcacccactgacctgcgcccactgtctggcactccctagtgagatgaacccggtacctcagatggaaatgcagaaatcacccgtcttctgtgtccctcacgctgggagctgtagaccgtacctgttcctattcggccatcttggcttctcctcttatcccagaaatttcttaagtattttgttgacctgcatacttccttgaatcaaaatgttgaggttaatagctaacctactgcttgctgcttcttctagcactattatattttaggaacctaatggcatctaaggatttcaccgtgtaataacagtgggaatttatttttcttggtgtttggaaactctcaggaatttttttttcctttttcttatttttctctccctctcaattataggttgaagctccattcataccaaagtttagaggctctggagataccagcaactttgatgactatgaagaagaagatatccgtgtctctataacagaaaaatgtgcaaaagaatttggtgaattttaaagaggaacaagatgacatctgagctcacactcagtgtttgcactctgttgagagataaggtagagctgagaccgtccttgttgaagcagttacctagttccttcattccaacgactgagtgaggtctttattgccatcatcccgtgtgcgcactctgcatccacctatgtaacaaggcaccgctaagcaagcattgtctgtgccataacacagtactagaccactttcttacttctctttgggttgtctttctcctctcctatatccatttcttccttttccaatttcattggttttctctaaacagtgctccattttattttgttggtgtttcagatgggcagtgttatggctacgtgatatttgaagggaaggataagtgttgctttcagtagttattgccaatattgttgttggtcaatggcttgaagataaactttctaataattattatttctttgagtagctcagacttggttttgccaaaactcttggtaatttttgaagatagactgtcttatcaccaaggaaatttatacaaattaagactaactttcttggaattcactattctggcaataaattttggtagactaatacagtacagctagacccagaaatttggaaggctgtagatcagaggttctagttccctttccctccttttatatcctcctctccttgagtaatgaagtgaccagcctgtgtagtgtgacaaacgtgtctcattcagcaggaaaaactaatgatatggatcatcacccagattctctcacttggtaccagcatttctgtaggtattagagaagagttctaagttttctaaaccttaactgttccttaaggattttagccagtattttaatagaacatgattaatgaaagtgacaaattttaaattttctctaatagtcctcatcataaactttttaaaggaaaataagcaaactaaaaagaacattggtttagataaatacttatactttgcaaagtcaaaaatggcttgatttttggaaacaatatagaggtattcatatttaaatgagggtttacatttgttttgttttgtaaccgttaaaaagaagttgtttccagctaattattgtggtgtactatatttgtgagcctagggtaggggcactgctgcaacttctgctttcatcccatgcctcatcaatgaggaaagggaacaaagtgtataaaactgccacaattgtattttaattttgaggtatgatattttcagatatttcataatttctaacctctgttctctcagtaaacagaatgtctgatcgatcatgcagatacaatgttggtatttgagaggttagtttttttcctacacttttttttgccaactgacttaacaacattgctgtcaggtggaaatttcaagcacttttgcacatttagttcagtgtttgttgagaatccatggcttaacccacttgttttgctatttttttctttgcttttaattttccccatctgattttatctctgcgtttcagtgacctaccttaaaacaacacacgagaagagttaaactgggttcattttaatgatcaatttacctgcatataaaatttatttttaatcaagctgatcttaatgtatataatcattctatttgctttattatcggtgcaggtaggtcattaacaccacttcttttcatctgtaccacaccctggtgaaacctttgaagacataaaaaaaacctgtctgagatgttctttctaccaatctatatgtctttcggttatcaagtgtttctgcatggtaatgtcatgtaaatgctgatattgatttcactggtccatctatatttaaaacgtgcaagaaaaaaataaaatactctgctctagcaagttttgtgtaacaaaggcatatcgtcatgttaataaatttaaaacatcattcgtataaaatattttaattttcttgtatttcatttagacccaagaacatgctgaccaatgtgttctatatgtaaactacaaattctatggtagctttgttgtatattattgtaaaattattttaataagtcatggggatgacaatttgattattacaatttagttttcagtaatcaaaaagatttctatgaattctaaaaaatatttttttctatgaaattactagtgcccagctgtagaatctaccttaggtagatgatccctagacatacgttggttttgagggctattcagccattccattttactctctatttaaaggccgtgagcaagcttgtcatgagcaaatatgtcaagggagtcaatttctgaccaatcaagtacactaaattagaatatttttaaagtatgtaacattcccagtttcagccacaatttagccaagaataagataaaaacttgaataagaagtaagtagcataaatcagtatttaacctaaaattacatatttgaaacagaagatattatgttatgctcagtaaataattaagagatggcattgtgtaagaaggagccctagactgaaagtcaagacatctgaatttcaggctggaaaactatcagtatgatctcagcctcagttctcttgtctgtaaaatggaagaactggattaggcagtttgtaagattcctcctaactttcacagtcgatgacaagattgtctttttatctgatattttgaagggtatattgctttgaagtaagtctcaataaggcaatatattttagggcatctttcttcttatctctgacagtgttcttaaaattatttgaatatcataagagccttggtgtctgtcctaattcctttctcactcaccgatgctgaatacccagttgaatcaaactgtcaacctaccaaaaacgatattgtggcttatgggtattgctgtctcattcttggtatattcttgtgttaactgcccattggcctgaaaatactcattgtaagcctgaaaaaaaaaatctttcccactgttttttctgcttgttgtaagaatcaaatgaaataatgtatgtgaaagcaccttgtaaactgtaacctatcaatgtaaaatgttaaggtgtgttgttatttcattaattacttctttgtttagaatggaatttcctatgcactactgtagctaggaaatgctgaaaacaactgtgttttttaattaatcaataactgcaaaattaaagtaccttcaatggataagacaattgattgagtcgtgaattctacttggtgccctcatctcctgatttattttccgctgatacaagagatgcttatagattcctagtttttatgtgtttgggttgatttctgggtggtgggagcagagcacattggggaggaatatatccgccagtctactcacactggatgtttactaagaaactgctagattcatttaatagtttctcaaaagtgtttctacttctttctcatttctcatattggttcagattactgctaacataatgttctaaatattcatatttaaaggatttgattcttcaagagcactcatccttctattgtaacaatgaaatattaatttctaattttttcttcaggagtgtttttgagcttcacattacctcttttcattttagacaggttaattagtgtgtatttccatagttgtcttttacctcaagaaataatcatttctttaggtaattattttaatggcttgccattttgtatgattgttcttgcaaacatttctatttatgcattttataacatggagcttactatttttataccagtgctcgcttcattttatcattatcagggcttaatataaatgcagttttctcatttccttgtaaaactaattacaaaaatctaggtatgtctt

SEQ ID NO: 13734 - DNA, 131254 bp, Human
  misc_feature (1)...(131254): n = A,T,C or G
tgcatatgagatgggtctcctgaatacagcacatcaatgggtcttgactctttattcaatttgccagtccatgtcttttacttggggcatttagcccatttacatttaaggttaatattgttatgtgtgaatttgatcctgtcattatgatgctagctggttgttttgcctgttagttgatgcagtttcttcatagtgtcgatggtctttacaatttggtatgtttttgcagtggctggtactggttgttcctttccatgtttagtgcttcctttaggagctcttgtaaggcaggcctggtgatgacaaaatctctcagcatttgcttgtctgtaaaggattttatttttcctttgtttatcaagctttagtttgactggatatgaaattctgagttgaaaattcttttctttaagaatgttgaatattggcccctactttcttctggcttgtagagtttctgccgagagatccgctgttagtctgatgggcttccctttgtgagtaacccaacctttctctctggctgccttatcattttttccttcatttcagccttggtgaatctgacaattatgtgtcttggggttgtgcttcttgaggagtatctttgtggtgttctctgtatttcctgaatttgaatgttggcctgccttattaggttcaggaagttctcctggataatatcctgaagagtgttttccaacttggttccattctccctgtcactttcaggtgcacaaatcaaacgcaatttggtcttttcacatagtcccatatttcttggaggctttgttcgttccttttcattctgttttctctaatcttcttgctttatttcatcaagttgatcttcaatctctgatatcctttcttccacttgatgagttcagctatcgatacttgtgtatgcttcatgaagttcttgtgctgtgtttttcagctccaccagatcatttatgttcttctctaaactggttattctagttagcaattcatctaaccttttttctaggttcttagcttccttgctttgggttaggacatgctcctttagctcagaatcgtttgttattacccaccttctgaagcctacttctgtctgtcaaactcattctccgtccaattttgttcccttgctggtgaggagttgtgatcctttagaggagaagaggcgttgtgttttttggaattttcagcctttttgtgctggtttctccccatctttgtggatttatctacctttggtctttaatgttggtgacctctggatggggtctttgagtggacatgcgatttctttctgcttgttagttttccttctgacagtcaggcccctatgctgcaggtctgctggagtttgctggaggtccactccagaccctgtttgcctgaatgtcaccaggagaggctgcagaacagtaaagattgctgactgttccttcctctggaagctttgtcccagaggggctctcactagatgccagccagagctctcctgtatgaggtgtctgtcaactcctgctgagagatttctccgagtcaggaggcacgggggtcagggacccacttgaggaggcagtctgtcccttagcagagcttgagcgctgtgttgggagatctgctgttctcttcagacctggcagacaggaacgtttgtttgctgaagttgcacccacagctgccccttcccccaggtggtcccagggagatgggagttgtatctctaagcccctgactggggctgctgcctttatttcagagataccctgcccagagaggtggaatctagagaggaagtctggctatagtggctttgccaagatgaagtgggctccacccagtttgaacttcccagcagctttatttatgctgtgaggggaaaaccgcctactcaagtctcagtaatggcagacaccccttcccccaccaagttggagcatcacaggttgacttcagactgctgtgctggcagcaagaatttcaagccaatggatcccagcttgttgggctccatcagggtgggatccactgagctagaccactgggctccctggcttcaactccctttccagggtagtgaacagttttgtcttgctggtgttccatgtgccactggggtatgaaaagaaactcctgcagctagctcggtgtctgcccaaatggctgcccagttttgtgcttgaaacccaggaccctggtggcgtaggtaccagagggattttcctggtctgcaggttgcaaagactgtgggaaatgcgtactatctgggccgcaatgcaccattcctcacggcacagtccctcatggcttcccttggctaggggagggagttcctcaaccccttgcacttcctgggtgaggagatgccccaccctgcatctgctcgccctctgtgggctggacccactgtctaaccagtcccattgagatgagctgggtacctcagttggaaatacagaaatcactcaccttctgcattgatctctctgggagctgcagaccagagctgttgctattcgaccatcttgccagccactatcaaagagattagttttatattgttgagtgttcttagcacctttgttgaaaatcagttgaccacagatatataggtttatttctcaattctcagttttattccattgatctacatgtctgtctttatgccattaccatgatgttttgattactgtagcttttataatcagttatgcaaccagctatgtgagtcttatactgtttcttttttcctttctattcttttttctttgatttggttattcaatgttcttaaaattctgtatgaattgtaggatcagttttttcatttctgcaaaaaaagtcattgggattttgataggaattgcattgcatttttagtttgctttgggtgatattgccattttcacaatattgtcttccaagtccatgaatgtgaatgtttttccatttagttaggtcttctttactttctttcagcaatgttttgtagttttcattgtcaaagttttgtactgccttgattaagtttattaccaagtattttattatttttgatgccattgtaaattctgttgtaaagatggattatttcatctatatctcccatctcagttctttctcttaagatcccaatgtgcatacacagagaataaaataaattgagtagtagatttagttctaagcatcctgaaaggctggcaaaaaggaaatgagatagggaagcagggtcagtgtatgtgactttctaataaaagagaagaacttttttctggaactcaactctaggagaaaattattatgagaacttttgcattagggacatgaaataacattataaggataattttaatgttttataggaaacatatttttaatattgacaatgaataaaagcccaggggatagggttataatttagctcagtcatatagtataattgttctttaagtgtttatcctttttgttaatttataagctctgtgaaaatagcttttttgtttttttgtttttattttatagagacagggtctctctatgttgcccaggctggtcttgaactcctgagatcaagcgatcctcccacctcggcctcccaaagcactgggattataggcgtgagccactgcaccagccgaaggtagcttttttggagggagactgtgttttgttcttttcacattccctagagcaagtgcctcacaagctgtttacaaaaataatttttttctgaattctgtaattaaatatctgtgaaatttataaactgactttgaaattttagtggttctttaaaatgttatttcttgattcagagaaagaatactgtatctggataatcacttatttttaaggttttggttttttgcttgagtcttgtttgtgatctaactatattgattaagttattatacatacacacacacagcagatctaatatggcatttttttttaaccacgtacttttcttgttcctgttgtggatcaaccattatttctttgtatttagctacataaaaaaaactatcaagaaatatataaaaatgtacttttagaagtattgatttctgctcaccatcatttgtcaactttaatgttagacagctactagttagctggaattcagtgccaaatgaagtcagaggtggataggaatcttttattatgtatattttttttattttccttctccttttatttttcctcctttcctcgctatactttttcccttcaccattttttttccaccctccctgcctgtgcccatctaaagtacatacaaggattgtttagcctgtttgacaggaaaaggaaaagaattaatgtatattggctggattctcttggaattttgtgagatcagggacctgaatctgaatcaggtaacatccatgatagttattccacatccccatttgctatctgattcagattcaggtccctaataacatagcatccatgatagttattccatatccccatgttctatgttatgttgtccagctcttcccttcaggactgaaagatttatttccccagctgctaggaagattgtccactgacaggtctcatcaggaagccctctcataaaattgttgaaatgtctaacgagagcctgtcttggccaggtgccaccgcactcatgcctgtaatcccctcactttgggaggccaaggcggatggatcacttaaggtcaggagttcgtgaccagcctggccaacatggtgaaaccctgtctctactaaaaatacaaaaattagctgggcgtggtggcattcacctgcaattccagctactcgggaggctgaggcacaagaacccaggaggcggaggttgcagtgagccgagatcgcaccagtgcactccagcctgggtgatggagtgacactctatctcaaaataaaataaaataaaaaataataaaataaagctgtctttaaaaagctaatgccctttttctagggcagctcacattaaatgagttgttgatttgatgctgtaaaggcttcaccctctctcaacccaatttaggacaactctgaagggatgtcttagttgcccttttctagttactagactaggatgttttaaaagctgaggatataaacttacctaaatgtttttgtattcttttgctaatgagaaataatctttcactggtgtcatgttttgagatatttgaaagctatccttaggctcatttagctgtcacttaaaatattaagcattacataaggttaaaaaaatggaatagtggcaagagtatgacccagaaagcatgagtgaggctgaaaagaatatgaggatcctttcgatggtaattttggaagatcctatttgaaatagtgaacttaattatgtagaatttcatttccatctctatggctttagtcactgttacaggacatttttgcatcactataaaggaatacctgagactggtaatttataaagaaaagaggtttagttggctcatagttcttcaggctgtacaggaagtgtggtgccagcatctgctcctggcgagtgcctcagtaagcttacaaccatggtggaaggcaaaggcggaggaggtgtgtcatgtggcgagagccagagcaagggttgggggaggtgccatgctcttttaaacaacacaatctttaaaacaacataatcttttaaacaacacagtcatcaccaaggggatgatgctaacccattcatgaaggatccagccccatgatctagtcacctcccagcaggccccaccttcaactttgggaatcacatttcagcatgagatttggagggataaacatccaaaccatatcagtcactctgttttgtttcagagtgaatgatacttacagaatcatagtattgtaaagccctttgatttgccacttttgactagacttacacaacataacacaaatatcaaagcctcaacattgtaaaaaataatataacatgaaagtgagtgagtactaggaagagtaagtgctgtcatgtctttctcccatagagaagacagtcagaagatagcctaaacagaatctgttattcattgtggttgactccaggggatagggacaaagggaagtgtatagttttcattttaagcctttatgtgctgtataaagtttttaaagaagcatatcgtgtgcataatccctaaaaaatcaagcaaccaaaatgtagtggtgatggtgggatgtgtgtgtattgggggagggaaggaggggagaatggcttaaaaattaattcatttaaaatatttcttattttttaacttccatattttgaatcaaatgatttgcaaaaataatggattgttttataaacgcatgtaatatacatatttaagtagcaggtatttcataaataccttgttatagaagtgcacacatttctgtgtttcagaattcaaaagcccctttgaagaaatagtcactatttgacttaccacatacgtaatgacaagaaatttacaagtataattagatttttagtgattaaattgtgcatataataattttaccaacatagtatagcatttcctttagcatttattatattgtaaatgagtgttataagcgagttataacctaaattctttaatgtaacctagttctttaacataatctaaatggtttaacataggcataggcctataatattagtaagaatagatcatatggtttagaattattttaaaatgttgaggattacttcagatcttattactgtaattccctatttgtgatgggtagccgttctgtgacctattaattgttctcttggatatgtagctgtttatgtttcagattggctgcagctgttttgatttgaggcagatggcctgaagaagcagcattcataaattaaatcacaattttttttctatgtatttttaaatcattctcagaaacctgaagtcttttcagtacagagttaatttcaaattcataatattctttgaattttcacataatatattaacttgatttttgtataacaatattcttttcatttttgtgaaatacataattgctaacttattttaacatagacatgagctaaagagaccctaattatatttttacacaaaccttatacaattatttaaattctgacccaaatagcagaatggttattacactgattctttaatcatttcaaaataggaacaattatttccaatggaattctcactttctaacttatttagttctctttttcattcattatggttttggaaagtatctgagacagctacatttattaactacactatagttaaggtaaaaagataatggtctttctcgtcattgttgaaatacccatactaaaatgatactattaaaaaaagagctaacttccttttaaggagtggtctatagcctttctcttttctttcttttttttttttttttgagacagagtttcgctcttttgcccaggctggagtgcagtggcgcagtcttggctcactgcagcttccgccgcctgggttcatgtgattctcatgcttcagcctcccaagtagctgggattacaggtatgtaccaccatgcctgtctaatttttgtctttttagtagattcggggttttgccatgttgctcaggctggtgtcaaactcttggcctcaagtgatgcacctgcctcggcttcccaaagtgctgggattacaagcgtgagccatccacgcctggccaagaactttctatttttgtataaaactttttttttaaacatagattggtacatatgtaaatgaaaagtaatattcatgtagaaagagaagtgaagatcatctagtctggcctttcagtgcttgaatttccttaaacacattaactaaatagtaagctagcttatgcaggtactgatccaatgatgagtaactctatacctctgaagataatacattccatctttggatagcattgactagtgaaaagcaaatagttatactgaatcaaagtcagcttccttgtctttctttttgtttttaacctgttggccctagattctttggggctacacagaacggtttaagcagtcttccttatgacaatcataaaatatttgaggacagcttttatgactccacaatctctcttaccattcctgaagtttcttctctaaataaatacttttggttccttcagccattcttcatatgtcacaaaggccttctctgttattcagaatatactgcagatggtctctactaggagcagaatccatgaataggattcaggaaacccatggattttgatattagtcagggttgtccagaaaaatagaaccaataggaggatatttacacatgcacatcctcctatatcccataaatatatatatatttatttatatatatttaaaatttatatatttatagatttaaaataaatatatcccatatatatatatatgtatctttgtggaagctgagaagtcccaagatctgcatttagcaagctggagaccttggagagccagtagtgtaagttccaatctgaaagctggtcagcttgagacccaagaagagaggatgtttcagtccagttctaaagctggaaaacaccagtgttgtagctcaagctgtcaggcaggaagaattcctcctattcagccttttggttctatttaattgattgaatgaggtccaccagcagtagggaaagcaatctgctttactcagtgtactgcttcaaatgttaatctcatccagaaataccctcctagatacatacagaatagaataatgtttggccaaatgtatgggcaccttgaaactcagtcaagttaacacataaaattaactatcacaaatatgaaaaatttgtatccttatatttactaacttctgaatgagagtttatgattatttcaaatcataaatttgaaaatttatgattgtaagcaacagaccactatagcaaaactgtggcttcacaacagtagaaatcacagataactttatatccactatagttgttgcagatatttggaaatattgacattcattggttcttaatgtgaatattatatataatttcctaattataagaacatatattattgaatcatgtttattttaataatatttataatgtagatatgatataaattttattgactgattggttttctctgttttcttatgcattaaattttatgcttttaagaatattattttgaaaaggatccataggctttactagactgcaaaaggggtccattgttcaagaagtggttaagaacctttggtctatactttttctaaaagtgtaattttagaaaggaatacattttatgggtgtggcccattaacactgacataggagtagagattattatctccctgcatctacataaaataaaccaagatctcattcattttttttaggcagccagactgatcacactagttggaattagtccatcttttgattctagcctggtcttttcagaatcactctgttagtgtgttccctgttctacgtttctgtcatttacaaatacaataggcatgttgtctatatcacagattaccaaacctggctgctcatcagaatcatctgaggagttttaaaaaatagatttttagttcctccctcacatttagtcagaaacattgtgcacctggtgattatgcaagctgcctggcactgttctgtgaattcatatttggaaatcccattttttatataatttatgtcatttatagtaatatttttaaaaatgttatagaagttagaattttgtagtgttgcacttgctaagtctttccaggttgacctgcagcaccctggaggttccaatgattattactttatatcattactgtaattcattcttttctgttttgaatcagtttgtttcaagaaattgagtgcatctacctaatttctctgatacgccatctaataataaatcttggcaaaaaaggaaattgtcactcatttttctagtgagttgatataaacttatactaatcactacctcttcacctgatttgtcataaattattccttaaaacttgtttgtaatcagttgatatcagccgtattgttttggtttaagtttccctaaaagtcaagcatgaaacaaggacagtagtttatttgggaagtgatcccacaaagtgggaataaggaagtggtcaagagtgagacagggaagaaggaaatgccaatataagactatagtattgtagtggtagttttgacagcagaaactagattctgctgtgacatcctgaaaagtgttcagaaagcttcctagactttctatctgaaagataggcaacgagatttatctatcagctcttgttctttattggtcaaagattccctccatcccttaacctgggaaagttaactcacccatatttccaggctgcccttgctaacaggctgagtgggacattgtagtgccagtgaaaatcctgggacagaaagtggaaagatggtgaatgcatctttgaagtggcagtctgttaatgtgaggtaaatcttttcaggaaggttcaccacaagtatgacaaaaagtggactgagggactgtgacatgggttatcagtggtacttgctacactcatcttctgtattctaagaaatctacttttttatttttataaatcaattacatttgtttgtttctaagagtctttaaaggttaccaataacctcatgtgctagttctctcagtatcctgtgactataattcattctgactaagaacttggagtgacttacctgtcttgggctttagttctggcattacaatgtttgttcagaccttttcagtttctgacagagaaaactgggacaatctaggagttaaagagttttactttctctttagtggtattatactatcttctgaaataaggctttgttgttgttgttgttctatcttggtttaatctatcaaagaaaagaaaaagaaagaaaattccttttgttgtctcttgaactttgcaagccataggtaattttgaggtttgggttttttgagttcactggttaaattctttaatttcttttcccagctctcttctaaagttcctccctccttcaagttttatgctatggagtcatggctgtcttttctgtgagaacgttgaaatgttttattaaattttaaggagatccattgaatatatctagactttttctttatttgtggccatcacaaactctgagctgacatggtcactccttgcattttctccttgattctgataagccctggaatccttcatttaggtattacttgtctttgtacaagtcaaaggctactgttattcagtcacttttgtcctcctgccccattcttaatcttttttcttttgccttacccctcttttccacttcttctaaaagttatctagtattctagtataatctgttgacttttgctttctaaactatctactgtttgctctcatttattccattgctttgggatgcttattcagtgaccatagctaaactgataaactacttagtcttcaggtattaaggaatgatagtgtgtggaagtggtaagataacatatttgtgttttgtcaggagtctaggatccctgtttttcccctttgtttccctattcaccatccattggatcataggaaaaattaactgttaatgtaagtgaaaagtaacttagttctttggagggagagatataaaagttttgactcaggtgattttacaattacaagcatattttcagtatagatctttttgagtgccttccatgaaccacatactttattagtcaccgaggataaagaaggccaggaatattgttatcaaagaatctaataaaagagatggagatgtaaacaaatacttgaattttaatgtcgaagttaaattgaatgccctaaatgatggatatatttttttatgaaatatcttctgtaataacatgatgttctgataattcttgggtttataaattgaatcatttggtgtgtgaagttgacatattattctcagatgccaattctgatttctccatgctgaaaattacgatggtaagaatccaatagctttgatttccttaggtaaatattaggctaaacatccagtgctgtatcttcagtattttctaccaggcagaagaattgttatttttatgcctctgtgtttaaatgatagaagtaagatactttaattgaaaagagaataaaaaacaaagtatcccttttagaggatgaaaggggagcaggaactccccaggtttttaaatattttagtacataaaatatacacaacaacttaaaattgttacttttctgggaaaactgaagcacatgcaggagattttaaaaactccacttgatgttagatgattaaatagtgttttgctttggaaattgaaaagcaagacttgttataaaaatagttcattccataccaataaaatcttattggcttgtttatttttattttgtaataagatagagtgaatgtggaagcttgtgttttaagaacttcttgtcctgtttagattatgttaaataacatacaacattttttaaaacagcttttataaacaactaagactttagacaaaggaatatgagtatgtgatgaggcttgacccaattaggtaggcaaaaactttaaaaaatatttcatggcatagagggagaattagttcactttttattaattacttgttcttttctgagttacatgtatatttatgggaattaaatatttaaataattgggtaatttaatgtgataatctaattttaccagccagtttctttagcattttaattttcactgttccttaactctatataaataaacaaatcaagagaactcattattattaatatcaataatactaacaaatcatgctaacatttcttgagatcaatctctagagtaatatgtaagctctcatgtgtattatctcacttgatgtctcaataacctgagtgtgtagatattattattgctatgttataaacgacattacttaaaagaactctgtagtaaatcctttggaaaaataaatagtgttttggaatgtgagcatgcattcctcaatttatctattttatacatatatacttttgtatatgacaacgttttgttaaatatgctatttctagccaggtgcagtggtgggtgcctttagtcccagctactcaggaggctgaggtgggtggatcgcttgagcccaggagttcaagtccagcctgggcaacattgcaaggctccatctcttttaaaacaaacaaacaaacaaaaacagctatttttaggtctcttcatcctttattatttttatgaatgtcgccattatcttttgtgtctgctcagatttgaactctataggctcttttggctttgctccccttcttctctttcatgccctcttcaaaccaggaagttgcacagtcttggaaggacaatctctgtaatatttctcccattatctgttgtactttttgagctcaggactgagattgaaatttttctgaatgagaagaaccaccctcaaccacgattactgaacactgagtgactttggaagttaacttttgctgcagacttgataaatccatcctaaagttacaaggaataacagtttaaatgcaaaaatcatgttatagtaaaagtcattttgatgacaatgaatgttgtttgagtcacaagtaatgtcaagccactgtatatgtcacatcttgtcaaaagttaaaacaagaagttagatgtccattcccacacaaatttatggcagatacattttctagataaaattatagttctagcagcagttttcaaactaaaatacaagttagggattttccgtatttcaaaatctgtttaactgtgcaatcaaggaacttccaggtaactgtcaactggaaatgattatttacagtgtaatgacctgctaaaagtcaggagaagaatctaatagaattttataaataccttgtaagtgaggaatatacttaaataaaataacgtgcctgtggactggtatcaatatttggcagtgcttgtctgcgtgaaaagacattttcaaaaatgaaatatgtaaaatctcattacagatgaacattaacagataaacgttgattttgatgatagagaacaccagctttgagtcccaattaaaatgaaatactctttccccaaaagaattccattcttctcattggaagacccacattacaaaacattatattcacattattatattttgaattttgtcgataaaaactttatggaaatatatttgtattgtactaggtacctacataataaccttgattttgtctcttgggcattaaagtctaaaatatttactatctgacccttatatacaaagtttgctaactgtgagctaaacaattattcattcttttaagtgagctcatacctatcaaacacagagaaataagtctctactggtagagtttcaactattagtgttgaaaaaataattctacatcattcccagaacagactttagatgattatttactccaacttaacccattttacaattattttacaattaagaatccttattttacaattaagaatccaaggtttaatggaagctaaacattggtataactgaaaatggaactgagatattctcattttccatctagtgttctttctagtgaactttatttatatgcaagtgtttctgctggatactaagaatgataaaaaagaaatatgagaaatggtgtctatatcaagatatattataatctagttggggagtgtatcagtcagggtcccagcaagaataatacactccaatggactagttgagggtcatttaatgacagactatttataaaagggtggagagagttttgggaaataggcttttgccatcgaagcctaaagagacaaggggtggctataggagaggcccctcaagaggagctgtggcttttggtggaggaatccaactactgtcaacccacgctgtccagaaaggaggtgataccccacctacaaataccttgacctcattctcctcctgccctttcatctcctgctggtgcctcccgtagtcctaatcctgccaaaagccacatggcaaataacctttggatggagtccaaaaaggttagtctcctaaggaaaactgcgagttagagagtggatctgaagggacaaatggagaatatccacctcagagagcaggattacttgtatggtaatagcacatggtaacatattctaagtgcatgagcaatctggactacatatacttaatagcatactgacacacaagatatcattttaagtgcttttcattttttttttttattatactttaagttttagggtgcatgtgcacattgtgcaggttagttacatatgtatacatgtgccatgctggtgtgctgcacccactaactcgtcatctagcattaggtatatctcccaatggctatccctcccccctccccccaccccaccacagtccccagagtgtgatattccccttcctgtgtccatgtgatctcattgttcaattcccacctatgagtgagaatatgtggtgtttggttttttgctcttgcaatagtttactgagaatgatgatttccagtatcatccatgtccctacaaaggacacgaactcatcattttttatggctgcatagtactccatggtgtatatgtgccacattttcttaatccagtctatcattgttggacatttgggtcggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctctagcacctgctgtttcctgactttttaatgactgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccacttgttgatggggttgtgtgtttttttcttgtaaatttgtttgagttcattgtagattctggatattagccctttttcagatgagtaggttgcgaaaattttctcccattttgtagggtgcctgttcactctgatggtagtttcttttgctgtgcagaagctcttgagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccggtttcagctttctacatatggctagccaattttcccagcaccatttattaaatagggaatcctttccccattgcttgtttttgtcaggtttgtcaaagatcagatagttgtagatatgtggcgttatttctgaggactctgttcttttccattgatctatatctctgatttggtaccagtaccatgctgttttggttagtgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttcttcttgaagaggtccttcacatcccttgtaagttggattcctaggtattttattgtctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacagggacaatccttctcctgcctaattgtcctggccagaacttccaacactatgttgaataggagtggtgagagagggcatccctgtcttgtgccagttttcaaagggaatgcttccagtttttgcccattcagtatgatattggctgtgggtttctcatagatagctcttattattttgagatacgtcccatcaatacctaatttattgagagtttttagcatgaagggttgttgaattttgtcaaaggctttttctgcatctattgagatagtcatgtggtttttgtctttggctctgtttatatgctggattacatttattgatttgcgtatattgaaccagccttgcatcccagggatgaagcccacttgatcatggtggataagctttttgatgtgctgctggattcgttttttccagtattttattgaggatttttgcatcaatgttcgtcaaggatattggtctaaaattctcttttttggttgtgtctctgcccggctttggtatcagaatgatgctggcctcataaaatgagttagggaggattccctctttttctattgactggaatagtttcagaaggaatggtaccagttcctccttgtacctctggtacattttttaaagtacattctttatctgcacaacaagtttaaatctgcaccacattcctttttacactgacatctggaacaaagttcagtctaattgtagttcagtagtagttcagttctaaattggtaggccacttctgctgctgcataaagttgttccactgtctatcagaagtagtttttttttttttttttttgagacagagtcttgctttgtcgcctggttggagtgcagtggcgtggtctcggctcactgaaacctccgcctcctgggttcaagtgattcttctgcctcagcttctagagtagctgggactacaggtgtgtgccaccacgcccagctaatttttgtatttttagtagatacagggtttcaccatgttggcccagatggtctctatcttgtgaccttgtgatctgcccgccttggcctcccaaagtgctgggattacagatgtgagccaccgtgcccggctacagatattgttttaagtggtttagagctcagcttcaggaggaggctaagtagtaagaagcccagaagttaaataatgcattgctattgtttatcagttgaaaattcattattttgagatttttataaactggtcgtttttataggatgaaagagacttacataatagagattctcaacctaaaaataaattgtgagtattgcaatataatattgttgttaaagttatggattttgtagttagagaaaccacagtatgattctggctctgctactgccttgccctgtaagtctgggcaagttgcttagacttgctcagccacagtttatttaaaagtgaggacagccacaaggttgtttcaagttttaagtgagataatggcatatagtaagcccttaatagatgttagctattattagtagtgttcatagattctataaccaaaatttcaaatttataatggaacaagtgatatttataggttaaatcattctacagatatttattaaacaatgattatgtgctgcgtactcactgtgctagatgctataatcaaagtaggaacaaatcagacctcgacctcctggagactgaaggtgcataatttgcatctgatttatattaataattgatgaattagtaaacagttcctgtactgacatatgtgctgccagcctaatgggttacttagttatcctcattgaccatcagcataccaaaaagactaggatagtttaaaattgtttttcttcaaaatcaagtttaatggggttcttatttaatatttcaaagtacataatatattcacatggttcaaaatgcaaaaagtggaaacagtcataagttgacaattctctttcgcattgcttagttctcaacttaccccacaaaagtaaccactgttctcagtgtgtatacatattcttttggaacattaaaaaaattgacatcacagttgtacatatttctgtggtacatgtgatattttaatacttgtatacattgtgtaacaatcaaatcagggtaattgggatatccatcacctccaacatttatcttttctttgtgttgggaacattacagttcttctctctagctattttgaaatatacaataaattgttcttaactgtaattttcctgttatcctatactagaacttattccttctaggatttttttttagttgtcttgtgttcaagaattagcacaatttatcattgtgctagactctttaatcacagtaaaacactagacttgtgtatttgcttcctaataaacgagcagcgctattaatatagaaaaaagaccgttgaattaaaaatagaagtctttaaaaattctagtagtacattcatcattgaaagactttaattatcatctgattttcctttctatgccatttggaattataaatggtaattttttctttgtgtggcactaccaaaaagtgcaatgtttgggaaaataagttatttcacattgaacagtagttagacattgtgctcagtttagataggattacttgaagcttggttttgatttgtcagtttctttagcttatacctgccattttgtagtaacagtcaattcagtattatattattctcagattttattattttatgctattttttacatgaacaattagtatttaatggtcctttgtaaagttttttctcaaaatgtagtgttaatttgtctgcatgtttaaagtttattggaaaagttattttgcctattcagagcgtaaaacttttagtacattttgttttataagtataggataccatgatgatccctggggaatctgattttttttaacagacaagaggttcccagttttcatttttaaatcaagttgctatggggctagcatctttgtttgcttaattttaatcacaattaccatgacaaaacttatttatttagctaatgcctaacagtgtcaaatgtatactgctggaaactggactaatttctatctgactaataaaaatcccaaataaaaatggtacatttttattttaaatggaaaaagattagtttctgaatataaattgagtttttaagtttttctttttggttaattaaagtctactctgatgcttttttgttaattttctttaatatccatatctcctaaatttaatatgcagttctaaaataaagacaagtcagctgggtgtggtggttcatgcctgtaatcccagcactttgggaaactgagcctggcagatcgcttgagcccaggagtttaagaccagtttgggcaacatggtgagaccctgtctctacggattttatactttttttttttttgaaatgggatctcactgtattgcccaggctggttttgaactcctgggctcaaatactcctcctgcctggtactacaggcattcaccaccccacccagctgattttgtacttcttgacaggaaaagaaaaatgaacaagaaattccttaatgcatattttaagtgctgctttaaaattttatcagtacagctttagaacatcacgctagataatagtgttgtactgttatttcctttttaatttattaagaaaaaggaagatgcaggggaatgaatctttattgaactttcctggcctgttcaaggaatagtaaataaaccaacttagctggaggggagtggagagggccttgtaggccattgttaaaaccttaggcttttactcaggttgagatgacaagtcactggagagtgttgaacaaagaagtgacattatgtgacttaagctttaagagggttgctttgctctgttgagaatagattctacctgggcaagaaaggaagcaaagaatatttaggaggctttggtaatgatttgggcaagagagcatgatggcttaggctagagtgggagcaatgaagatatgataaatgtttatattctgtacatattatgaaagtagagataacaggattttccagtgtgatgtgtgagaaagaggggagttatatttttggcctaagccaaggtaatgatgggattcccactaactgagatgagggaagactatggggaggaaggtcagttcagttttggacatgttaagttcaaggtatctattagacagccaactggagatgttgagtaggctattggatatataattcttcagctcagagaagaagatacatatacatttgtgagtcattagcttattgaaggtatttacacccacaaagctaagtgaaatagaaaagagaagaggtccaagggcagtgggggtcacagcaatgttaaaacatcaaaatggtaagtaagactcagagaggagactgagaaatagtgtccagtgaattagaaagaaatctggagaatgtaatactccagaagccaagtgagaaaaataatttcagggaggaaagagtgttagattgtgtcaaatgatgatggatcagaagtatgaagagtgagacttgaccattggttttaacaacattagagacctcatcaagaacagatttaatgaaaaagtgccaaaacctgattagagtcaacttaccagagaatgaaaggagaagaactagaaacaaccaataaagacaactcttttgaagaattttacagagaaatgagatagtggccgggtgaaagtatgatcatgataaaggggtgtgtgtgtgtaatgaatgtgagatgtgagaaactgcagcatgtttataatctaattggaatgatttagtagagaaaaaatgatgatgagagagagaattgctgctgaaatatcttcaggtagggaagagggaatcgaatctactacatttatggaaaagtagctgtaggctggagcacagacagttcatctgttgtgacagaatgaaatgccaggtatatggatacagatattagaaggtaatatgatgatttgataaataaaaacaaggtctaggtagatactttccatttttgaaagaaatgtgttataaaaattattaccattttagcatagtggaaaggaatgaaattggagggagataaacctgggtttagattttagctctgccaattactagctgacatgtggcagaacttagttacaatgcccctgtattatttagggacccagcaagaaataaaattcactaaaaagtggttcaaataaaaacactttaatgaagagtctactttgagagaatgaacagagttaaggaatgggcaagatatggtaaggcaactagaaactagcaattatggaaagctgttacctcacctggggctgaagaggcaagagtggacatggtgtttttagtttagtgattgccaaaggtatgaaggaaggaccagctagtaagagctatagttgtggaggaacacagctgttgccagagacaatggtacataggtaaggaagcagcagagaagaaataaccttgatctctctctactcctcaactctatttttctgctattgacctccattggctaaatgtaagcagaaaccagctgcaaggcttcttaggtgttgcagaatatagggttcactctccctagggtccagagaagggcaaaagatggatgtggagacaaatgctgagtaatcagtagaatcactaagcctcaacttctccatatataaaatgaggctaccgcaaagttgctgtgatgttacatgtactgccaagcactgctacattgctagcatatagtactgtttattaaatgacaaatataagatgctacagcataatggttggtccttaaagctttggaattaggcagatctagatttaagttctgtccgtcacttactaatcatgagattttgggaagtctttgttttgtcatctgtaaaatggggaaataaggcttaccacagagaattctaataaagatgaaaagggacagtgtatattaagtgcctaatatagtgctggtacacagcatgcagtttaagttaccatgaccatcataatattatatgactagaaagaatagtaaatgacatcagtttccaagtaatactagtctcctacccctccccctccccccacactttttttttctgcttctcagtttttctgaatagggttatttctttgttacatagggttcaaggttaatatctttgcactttaaacaattaggaaatatagctttagttagtttaactttttggctattcatttattttgtttttgatttatgttcgctaaacacacacaaagagttaagtggatttttttattaggcctaagttggaaggcatagaaaaagttggaaacactgaattcagtcagtttcattagcatagatttatatatgaagctcaagtaaaatgtcatcaagaaatgggagaatataggatgctgtaacagttaattcagagccgtactataataagtattctttttaaatttcacataaatataacagttctgtaagcttgatttgagggcacatacatgtttttctttttggctacatagagaacaatgaaataaagcctcattgacgtaattgaacctgataacatctcctggttgtactgctgatgtttcactgtggttttggtggttttgtagagctccgtagagcgtgttagacttaaaaacatattcaaacagaaacttttatcaggattcaactttttaaccataaagaaaaaatgaatgtaaataaaggtgcagtcttgggtacacctagatcaacttaaaaatgtttaatagtatatattacttagagaaattactgttccttaattagttttgaacaaataaccacagtatgaaaagaaataataatttctggtattgtattatatattagcacagaaggaaagaggtaaatataataatggaagctcctaaaaacagcaagttaaaattttatgctttcattaaatgatgtcttatagtttgatagaactacatgtttaaaacataccatagcactataactttttgttttaaactgggattaaaaatttaattttatttattttatatatatatttataaaattcttatatttaagttatttacaagatctactttggtattgggtttagatgcctaaaactttgctgacttggaaacaatgtgtatcagagcatttactgtctacttggaagtaaaattttaaaagagctacattttattatataggaggaatgagtgcttgaaccagtatttcttaaaagttttaatatacatgtaccgccaactatgcattccgtatgcgtggtagctacccaccaacttaaggtaaatgtataaaaaagaattaatcacaatttttgaaaactaaaaaattaaaatattttatatcagtgtatatttacaatattaaaggtatctctgtttagctcaatgttgagtaaataggctgcttgttgtaggttcattgtatatcgtcatattcttttctcatctctatttctcttaacttggaaaaatccaaccaaaattataatttatgaggacagtcagcaggggttttttggctgttggttctgaatactcaggttaaacatggactccagaattaagagattgctcactgaagactctttcaaggctgagtcacttgctaagttgatggacattatcatacttgaaagtttaagaaatagaggcttttgcattttattgaaaaaagctctttttgctctttatattttatatttacttttaaatattttatttgctcagtttttccaaagcacactgaaaagatgtatactctgtatccaaaaattgagtgcatttacatttatgctatttctttaacattgaactcagcataatgtattttaaccaccagcctctttctgtgaaaacaaacaaacaaacaaaaaaaaaacagggtatatagatttgcagttagtgtagtactcattgcttagcaaggctttttcttgatgtgcagacaactgattttttctctcaggactgatttcatcacatatttcccagtctatatcatagtttacaaaacaaatattaagtaggaaaaaaaatcatgttttgtagtatgaatttttcagaggtaaacacaaaaacttgtctgctattcttcctcaagtgtattacacatataccaagagctgatttggctttgcacttcagtgcatttatcaagcagtaaagtaaaatatctggtttttctttcagcataatatttatcgtttgtgtggctgagagttttataaatctctcagcaatagtctatcttttttatatgcttttgctaggaggagcacagaatctgaatggtgcctgtgtagtttttgtctcttttaggaacaaaaatcttcagtttcatatatgaaagcattttgtgcttgttctagaaagattctgttcatttaccaaagaggtttttatgttttgtttgaaaactttccatagcttcatgtcattatttgataaagtttcaaagtagacaacatccagaagaatatagggtaaatgaattaccagtcagaaagaaatccagcttttagatagttgctattgtatgtgctagtaaaatttttgtttttatctctttgtgtggtattatcacatgcacagatttatattgtttgcattgaagtcctattcttgatttaggttcaacatttattccgagctatttatgttaccttatttttatcaatatcttaggctttaaaaaccaattttgagccatttatttattgattggggagtataatgcaacacaatgaaaataatgcaaatttaaaagatataaataatattcaaatgatgtgaaaatacttcaggtaagatgatttgttctcttttagaataatgcaggtcttagagaaccttttcagcttttaagaatataagtttttaagataataatgagatttctgcggaaatcaaaattaaccttatagttcacaattatgaaatatatgcaaactaagttgtttcctttttccctctaaatattctgggacaatgaggaacaactagtgattgacagatcataatttgataaataatggctaatattctattacaatttcctagtttaaaattttatgtttttaaaaatatcatatatatatttttttcgtgtatacatatatgtaatctaatattacggagacacttagcagtattttcattaagtatttgctctttgcatatttctcactttattctgtcattagttctcccactgttcaggatcattcctatcaagtacaagcatgctttagaacctaccatgttaaaaaaaaaagtattattcccacatttttttctgatgattgcttcatttcattcttgcctttacagcacagtttttcaaaagagttttctctagtcactttgtctacttccttaccttcctaaattcatcttaacttttactaaagctgaacaaatatttatgaaatatgtgtaaagtacagagactaaagaaacagacaccatcaacccaccattactggtgtttttgaacattaccattaacattgaagttccctgtatgtcactcctggatctggttcacttctttttcttttagagataatcaccatcctgaatttctttacagtttaccataagtatttctaataagcatatcgcaatgtgtatttcatgttaaatgagtgaaggtatactgtatgtatctgtctgtgacttgtttttcttgttcaacattatgtttctgagatccatccatatacgatgtagctgtatgtacttcattcattttcactcctatactccattgtatgaatacatcaaaatttttctattttattgttgatgaacatttgggttgtatctagttttttgctaccctaagctgcacagctatgtgcattcttcctgtctccttctgtcaaactgtagcaaaggaccaagcttttgggtttttccctgatctgttgtggattgatgcttttgtaaaatacactaaaaatgtctcaccattgtcaaattgctataaaaatatataaacctttactctgaatttctgtatttatcttattatggaccacactttgaatactgctctaagatgtgtacctagctgtggaattcctgggtcattcatcttctattacttatggagaaaattgttttctcaaaatcactaatgtgctacttgctcaaattacgcagaaggcagtctgctagctctttgtggctttctgtgtatctgctttcaattcctaatatgaaggggatttcacagtaagacctgctgctttagggtaacatagttttcatcctagagaaagtgactgcaaataagattgggctttgcttaagaattgattcaaagccaatctagcaagcacaagtgagagaaaactatgataatgggataaagggccaggaagagtgaatttattgagggagatggtctgtaatattgtaatactacaatattgtaatgtacaatattgagggagatggtctgcaatattgtaaaaatataatattgaaatattgtaatacaaaatgctacagtagagagatctaaagagaacaagcagagaaaaaagaagcattgtacatagtaagatttttagagacctttaagagtccagttaaaatagggcatacattccttctcatattagcagccttccttctgcataggcagcctttaattgtctaaatgcattagagaactttcacaaaatataagctaagatgagattgctcttataagcaagcagcaggactactttttatcagtgtttctccaccgtattttgattacaactccgaatccagggatatatatatatatatatttatattgtatatacatatgtaaaatatatgtacatatattaaatattatatatacatatattatatatatgtttccataatcatctcccccttcatgtaattttcataccaaagatgtacagtatatctgtttgtatactgtagcctttggagggctacgaaccattttaattttcaagattttttttttttttttgccccaagaaccagctaccacttgcttggaagtgatagcaccactgttgagagtatatcacatgaatacaaacatggctcttggcattagagtacaaatatttaaaaaggtaatgtttatttaatcatgtaggtcaatgaagtggggaaggcagactactcaatgttaagaaaccatcctaatgaaaagtatacttgagttagccagaaatcaacttctacttagagttgtgagtcagggaaataaggtatacaagtatttgtctctgtttgatggtattattgtgggaaaagtgtagaaatgtggatcagatgatagtacagttaaaaaagttagcagaccaagaatgccaattagttcattgatgcctatctcataggtgatttttagtgatatatcgtatggctctgttttcactcctgtctattctagacatctattcgtgaacttaagaaaacatcagatttatagatgttatgataatgggaggaatggagaatagggtagttgacattctcaatctccaaagaagctgacaggctaaaataagggcagaagtaaagtattgcagttgggtctaaaaagccatatttataagaatagcatggaggaaaatggatcataacaatatcatgtataaaagaaacttagggattttaggttatgttaatcttaaggagcattttaggaagctattaacatcttaatttgcaataattagtgtctcttgaatctagattatatgctgattaaatcacaacctgaaataattatatcaggaccacatttaggaccatataaaatactgcttaaatttaatgagtctgttatatatatggtatactttgcatgcagttatatcagagccattttgtgggcactggttcacaagtcttctgagtgattgtactgtgtctgaattttctttgggaagaaatagatttttcctcagtggtaagaaagaaattacgttctgcaaggatattgatgaggagatggtgataatgataattgacagttttttgagtgattaaacatgggtgtattatgtaaaatatgagtcagcaaactgtagtccactgaccaaatgctgccagcagactgtttttgtatcacctttgagctaataattttttttgcattttaaagggttataaaacaaaaacaaaaagcaaagaatatgccatagagaccttatgtagccagcaaagcaccaaataagatcttttgcaaccagaaaacttaagcctgaaggacaaaaaacaacacaaatagttcaatatatagaaattatgagattatattacagattaactgggctcatattcaatacaggttcaaagctatgtacaaaatggctattagaatgaattatttaagcaaaagaagacctatttaactcagtaaatgtcaaagaaatttaggattgatgataggtagcagttatagcttcctaaattaaagttaattttatctccttgggcatagtgactactatattgggttgggaagcagccaaaaagcttgttaggaagaagggcaggaaaaaaactagtctgggactaaagttaccattgataagctaggctatcaaggagacagacaggaaaacaatcactaattatgtgcatatcaaaaggggtatgtgctgcttttgataagtctattcttttatacttaatctaaccccaaggacaacaagcttttcaaaatgtttttgacagaagtaccttattggtaggaaaatagcatcacccatcacccatgatgagcctttggagatggtgggtaggcagagaatatctgatgatatgtaatttttcttttattttttgtgacttaatgtgattatggatttatattttcctttttgtggtagtatttgaaggttaatatggcttgttttagttactttattgtgataattctttattcttttgatttctcaattatagattatattaatgaaatattctgtcgagataatttttattttcaccattccaatatctcttccagattttgagctatattagataattataattgaaaatgctgaattttgtctttacatatacttttttgtttatttttggtttgtaaccaagtgaatttttttttctagatgattctttgggattgggacttaaaacaatggtataagcctcattatcaagtaagtataattaatatctgtgatgaatatctaaataatatctgtgatcactaaataatatctgtgatgcaacttttgacacttaaagttacactcacaatatttctgtgccataagattttctttaactaaactaataagttaactagaaccttcattgaggtagattttttaaaaatatattttaattataagggaaaaagaaaatgataaaaacaaaatttatataaattgttatgaaaaatattgctaatataatctgggctcagaatcaactaatatttctatattaaggataagatttttttcttttctgatgtggaccactgttctataaaggggaaaaaatagatggaaggccatatctgagacaaagcaaagcagttggcaacatattttattagggaagtaaagatatccaactttcattttttggtaaactttttatcaaattataacatacatgcaggaaagtgtacagctcaattttcagaagttaaacatcccatgtaactggtactgatatgaagaaatagaatgtttccagtatctcagaagcctcacatatgcccaattccagtcattacctatatccccaaagataaatcctatccgacttctaataactagttttgctaatttttgaactttatatatacacaaatggaataatatgtgtacttttttaggattaattttttgaacacctaagtaatatatgtttatatcagataaaatgaaaatagaagtatttaatataaggagaaaaaaggaaaatcactcataaaacatcaagcaataactgtgttaacttttgatgtctatctttattgatctttcccattatgctaaatttacttaataattctaatagcttatttgaagattctttgagtcttgacgtacacaaaaatgttatctatgaataaagacagatttatttatttatttcaaaacctatgccttttatttctttttctcatgttattgtactttctaggaccttcaacgcagtgttgaatggaagtggtatgagtaggcagccttgtttttcttcatgaactcagggaaaaaatgttcaacatatcaccactaatgttttttgtagataccctttagcagattaaggaagttttattctaattctagtttactaaggactttttttctcttaagttatgagtgggtatataattttatcagatgctttttctgcatctattcaaatgattcgagatttttttctaattattctactaatgtggtgaattacattgtttatgtttgttaaaccatccctgtattcccagaataaagtaaatttgatcaagatgtattttgtttaaatatttatcactagattctatttgttaatgttttgtttagaaattttgaatttgtgtttatgagagagtgttggcctataaattcttacttttcataatgttcttggcattatattggtatcacggttaccaagaaccttgatatcaagataaaataaggtgagatatttaccctttctattacctcgaaaagtttgggtaagattaaaaattggtattatttcctcctttaatgtttggaagaatgctctggtgaagctatctcaccttgaagaattattttgtggtcaaattttaagttatggattcaatttctttaatagttttagtatcatttagattttccatcttttcttctaacaattgagttacttgtgtttttctaggaattcctttttttgttgttgttccttctggcatttgtgagactgctgaaagccctattttaatttcaaaatagaaatctttttgaggatttctacttggtttatctctctcttagccactgtttataaattggcaaatacctttagaggaaaagcaggtctgaatttaagctcactactttgtttttctcatcactttgggatcttgtttggcaccccctgtcttcatagctctgaactccaatttcggtctcccagccccttgggactatagatctctactctgttttctggcctcttttgtgcttctcatcctctctgctctgtgccagttatgaatcagcagaaaattcctagagggaaaagagtagcacagaatgttggatttcttttaatcttttctcttaattctgggttcttggccttttatgccctggctgtttggttgtgttttgatgccttgaaatgtatgctatttatattttatttcagcttttctagttgttctagacagaagagttggtctgatacaaaccagtccctcttagctggaaaattaggcaagcctcttaagacactctgaacctattccctcacctacaaattgagaataataccagttccctcaaagggctaattaatatgtgcctggtacttaatacaaatgtgggccaatattatataaatttcaatagtaataaatactaatctgaacttgaagtataagacaggaatgagcatttttttctttaaaaggccagagagtaagtattttagcatttgctggaaacatatgaccattgctaccttttgccgtccccagtgcttctcattgcctcctttgtcctcttctccctcccactcctcttctttttcaataaccatttaaaacataaaaactattcttaactttctgttcaacaatcaagattttgctaaatataagtgaatggaaaataggaatttaagttcagcttttaaaattgtggcaaataatttgaatattcaatttgatctgccataagttatcatgtcactctcttgctcatttctctcgtttcacccagtgtaaaagtctttgtcatgtacgtaaaagaacttacacaacatggttccctcccttactctcttgtacttctctgtctttgtcttctactactttctccttcatttactctgttccagctgcactggcctccttgttattccccaaacaagtcagacaggcttctgactcaggtctttgcacttgctagtctctctgcctgggatgcttatttcccacactttgtcatgtctttacataagcatttccttcttagtgaggcataccccaactatcctctctaaaattgcattgcgttctatcacatctttttcccttaacttactttattttctctttttagcagcttgttcaaaatctattatatacgaccctttattactcatattacttagcttggaatccagtgttctcaaaaatttggtcccaacatgtctttccaacctgtttttcattgctttcttatataatctgtacttcaacaatttcatattccctgtatagcattattttaccacttaaaaattgtattttaccacttttatacttttatttatgctgtgtccattttgtgcagtacacttccccaatacatttttgttttgttttattgtaaacaaatataaatataatcctaccaaatttttagggcccagctcaaatgctaccccttccataaaatttctgttaccatccaaatggaaggtttctatatctcttttgaacgctaatgccattttgtctgtatatataatttttttctttttttgagacgaagtttctctcttgttgcccaggctggagtgcagtggcatgatctcggctcaccgcaacctccagctccctggttcaagcgattctcctgcctcagcctccggagtagctgggattacaggcatgtgccaccacacccggctaattttgtatttttagtagagatgggatttctccatgttggtcaggctggtcttgaactcccgacctcaggtgatctgcccacctcggcctcccaaagtgctgggattacaggggtaagagaccacacttggccattttgtctgtatttttatctcttcactttctgttaataataacagtactatctttgcctttagttatatatactatactttatatgctctgcatgtgttaccatatgtaactctctcttttcctccttgctaagtacagttattaagtctggaaataatgtaagaggcaatcaagtgagaactacaaaaaatagaaagaggaaggcagactggctagggaccctagtacaggaaaaacaacacagtgacagagtctcttatgacccacacccaacagcaaacctggtctaggcccccactctcaacctagcaacataaggtgacacaggtaggcttattctttccccagattaaacaagagccctgccaacactaggcaagtctggtggctctagcaagggggaattgatttggaaccactggcaatcagtgaccagggagaagcattctccttccctcctgggcatgagactccccttccccactgacagacactgggtggccagtgtgcctggcaagggggatgtcctcacaaatgcctagcccagaaagtgatctttgatcctgtcacctggagactcctttctctcccctaaaggtaccagatgacccaacctgaggaagctctctttccccctactgtaaggcaccagtgtggactgtggactagtgggaacccaacgggcaccaaatgctagatgacgagttagtgggtgcagcgcaccagcatggcacatgtatacatatgtaactaacctgcacaatgtgcacatgtaccctaaaacttaaagtataattaaaaaataataataataatagtaataataaaaaaaaaagaaaaaaaaattcagacacacctaaatgattgtgaatgctttgaaaattgtcatccaaaccacagcccacaaaagtaggccaggacctgtgtgataaacctaaatggggatatgccttctaatggcaaagatttctgtaggacccagagtcttgtaagttatagtgaaaatattgaggataaaataaaaaatcacccatcataccaaaaccaagaaaatcacaacttgaataagaaaaaggaatgacaacactaagatgaatcagatttggaattatctggcaaggatttttaaagcaaacatcataaaaatgctctaacaaataattacaaagtatcttgaaacaaatggaaaaagaaagaaaatattagcaaaagaaatataaattataaagaagaaacaaatggaaagtatagagctgaaaaatacaataatagaaatttaaaattactggatgggatgaataacagtggagatgacagtaggatagaatctgtgagcttaagcatagatcaatagaatttagccaattttacaacatagaggaaacagaaacaaaatcagcaagccttagggacctattgggcagtaacaaagaaccaacatttgtattgctcgtgtttgagaaggagaaagggggtggcattgaaagagtatctgaagaagtaatggctgaaaacttcccagatttagccaaaaacttaatcctacagattcaagaagctttctgaaccccaaatagtatcaaccccctcaaaatctactctcagacatgtcataattaaacttatgaaagctaaagacaaagaaaatatcttaaaaagcatccagagagaaacaacacataacctataggggaacaccaattcaagtaatagcagatttctcatttaaaaccatgaagcccagaaggaagtggcagaacacttttgaagaggtggaagaaaatggctgtaaagtctatatccagcaaaagtattctttaagaatgaaggggaggaggttccaagatggctgaataggaacagctccagtctacagctcccagcatgagtgatgcagaagatgggtgatttctgcatttccaaatgaggtactgggttcatctctctggggcttgtcagacatggatgcaggacagtaggtgcaacccatggactgtgagccaaagcagggtgaggcatcacctcacctgggaagcgcaaggggtcggggaattctttttcctagccaagggaagccatgacagacggcacctggaaaatcgggcaactcccactgcgcttttccacctaatactgcgcttttccaacggtcttagcaaacggcacaccaggagattatgtcctgtgcctggctcggggggttccacacccacggaacctcgctcattgctagcacagcagtctaagatggaactgcaaagcagcagcgaggctgggggaggggtgcccaccattgctgaggcttgagtaggtaaacaaagcagccctgaagctcaaaatgggtggagcccaccacagctcaaggagtcctgccggcctctgtagactccacctctgggggcagggcatagctgaacgaaaggcagcaaaaacttctgcagacttaaatgtccctgtctgacagcgttgaagagaggagtggttctcccagcacggagtttgagatctaagaatggacagactgcctcctcaagagggtccctgacccccgagtagcctaactgggaggcatctcccagtaggggctgactgacgcctcatacggccgggcgcccctctgagacgaagcttccagaggaacgatcaggcagcaacatttgcctttctgcaatatttgcagttctgcagtctgcactggtgatatccaggcaaagagtgtctggagtggacctccagcaaactccaacagacctgcagctgaggttcctgactgttagaaggaaaactaacaaacagaaagaacattcacaccagaaccccgtctgacgtcaccatcatcaaagaccaaaggtagataaaaccacaaagatggggagaaaccagagcagaaaagctgaaaattctaaaaatcagagtgccccttctcctccaaaggaacgcagctcctcgccagcaatggaacaaagctggacggagaatgactttgacgagttgagagaagaaggcttcagatgattggtaataacaaacttctgtgagctgaaggagaatgttcgaacccatcgcaaagaagccaaaaaccttgaaaaaagattagacgaatggctaacgaaaataaacagtgtatagaagactttaaatgacctgttggagctgaacaccatggcatgagaactgcgtgacacatgcacaagcttcagtagccgattcgatcaagtagaagaaagggtgtcagtgattgaagatcagatgaatgaaatgaagcgagaagagaaatttagagaaaaaagaaagaaatgagcaaagcctccaagaaatatgggactatatgaaaagaccaaatctacgtctgatgggtgtacctgaaagtgacggggagaatggaaccaagttggaaaacactcttcaggatattatccaggagaacttccccaacctagcaaggaaggccaacattcaaattcaggaaatacagagaacaccacaaagatactcctcgagaagagcaactccaaaacacataattgtcagattcaccaaagttgaaataaaggaaaaaatgttaagggcagccagagagaaaggtcgggttacccacaaagggaagcccatcagactaacagcggatctctcggcagaaactctacaagccaggagagagtggggtccaatattcagtactcttcaacaaaagaattttcaacccagaatttcatatccatcccaactaagcttcataagtgaaggagaaataaaatcctttacagacaagcaaatgctgagagattttgtcaccaccaggcctgccttacaagagctcctgaaggaagcactaaacatggaaaggaacaactgctaccagccactgcaaaaacatgccaaattgtaaagaccatcgatgctaggaagaaactgcaccaagtaacaagcaaaataaccagctaacatcataatgacaggatcaaattcacacataacaatattaaccttaaatgtaaatggattaaatgctccaattaaaagacacagactggcaaattggatagagtaaagacccatcagtgtgctgtattcaggagacccatctcacgtgcagagacacgcataggctcaaaataaagggatggaggaagatctaccaagcaaatggaaaaaaaaaaaaaaagcaggggttgcaatcctagtctctgataaaacagactttaaaccaacaaagatcagaagagacaaggccattatataatggtaaagggatcaattcaacaagaagagctaactatcctaaatatatatgcacccaatataggagcacccagattcataaagcaagtccttagagacctacaaagagacttagactcccacacaataataatgggagactttaacaccccactgtcaacattagacagatcagtgagacagaaagttcacaaggatatccaagaagttaactcagctctgcaccaagcgaacctaatagacatctacagaacactccaccccaaatcaacagaatatacattcttctcagcaccacattgcacttattccaaaattgaccacatagttggaagtaaagcactcctcagcaaatgtaaaagaacagaaattataacaaactgtctctcagaccacagtgcagtcaaactggaactcaggattaagaaactcactaaaaaccactcaagtacatggaaactgaacaacctgctcctgagtgactaatgggtaaataacaaaatgaaggcagaaataaagatggtctgtgaaaccaacgagaacaaagacacaacataccagaatctctgggacacatttaaagtagtgtgtagagggaaatttatagcactaaatgcccacaagagaaagcaggaaagatctaaaattgacaccctaatatcacaattaaaagaacaagagaagcaagagcaaacacattcaaaagctagcagaaggcaagaaataactaagatcagagcagaactgaaggagatagagacacaaaaaacccttcaaaaaatcaatgaatccaggagctggttttctgagaagatcaacaaaattgatagactgctagcaagactaataaagaagaaaagagaagaatcaaatagacgtaatgaaaaatgataaaggggatatcaccaccaatcctacagagatacaaactaccatctgagaatactgtaaacacccctaagcaaataaactagaaaatctagaagaaatggataaattcctcgacacatacaccctcccaagactaaacaggaagaagttgaatttctgaatagactaataacaggctgtgaaattgaggcaataattaagagcctaccaaccaaaaaaagtccaggaccagacggagtcacagctgaattctaccagaggtacaaagaggagctggtactgttccttctgaaactattccaatcaatagaaaaagagggaatcctccctaactgattttatgaggccagcagcatcctgataccaaagcctgccagagacacaacaaaaaataattttagaccagtatccctgatgaacatcgatgcaaaaatcctgaataaaatactggcaaaccgaatccagcagcacatcaaaaagcttatccaccatgatcaagtgcgcttcatccctgggatgcaaggctggttcaacatacacaaatcaataaatgtaatccatgatataaagagaaccaaagacaaaaaccacatgattatctcaatagatgcagaaaaggcctttgacaaaattcagcagcccttcatgctaaaaactctcaataaattaggtattgatgggatgtatctcaaaataataagagctatgtatgacaaacccacagccaatatcatactgaatgggcaaaaactggaagcattccctttgaaaaacagcacaagacaggggtgcctctctctcaccactcctgttcaacatagtgttggaagttctggtcagggcagtcaggcaggagaaagaaataaaaggtattcagttaggaaaagaggaagtcaaattgtccctgtttgcagatgacatgattgtatatctagaaaaccccatcatgtcagccccaaatctccttaagctgataagcaacttcagcaaagtctcaggatacaaaagcaatgtgcagaaatcacaagcattcttatacaccattaacagacaaacagccaaatcatgagtgaactcccattcatgatggcttcaaagagaataaaatacctaggaatccaacttgtgagggatgtgaaggacctcttcaaggagaactacaaaccactgctcaacgaagtaaaagaggacacaaacaagtgacaatactgcccaaagtcatttatagattcaatgccatccccaacaagctagcattgactttcttcacagaattggaaaaaactacttgaaagttcatgtggaaccaaaaaagagcccacattgccaagacaatcctaagccaaaagaacaaagctggaggcatcatgctatctgacttcaaactatactgcaagcctacagtaaccaaaacagcatggtactggtaccaaaacagagatatagaccaatggaacagaacagagtcctcagaaatagtaccacacatccacaaccatccagtctttgacaaacctgataaaaacaagaaatagggaaaggattgcctatttaataaatggtattgagaaaactggctagccatatgtagaaagctttaactggatcccttacttacaccttatacaaaaattaattcaagatggattaaagacttaaacgttagacctaaaaccgtaaaaaccctagaagaaaacctaggcaataccattcaagacataggcatgggcaaggacttcatggctaaaacaccaaaagcaatggcaacaaaagccaaagttgacaaatgggatctaattaaactaaagagcttctgcacagcaaaagaaactaccatcagaatgaacaggcaacctacagaatgggagaaaattttcgcactctatccatctgacaaaagggctaatatccagaatctacaaggaacttaaacaaatttacaagaaaaaaatcaaacaaccccatcaaaaagtgagcaaaggatatgaacagacacttctcgaaagaagacatttatgcagccaacagacacttgaatgctcatcatcactggccatcagagaaatgcaaatcaaaaccacaatgagataccatctcacaccagttagaatggtgatcattaaaaagtcagggaacaacaggtgctggagaggatgtagagaaataggaacacttttacactgttggtgggactgtaaactagttcaaccattgtggaagacagtatggtgattgctgaaggatctggaactagaaataccatttgacccagccatcccattactgggtatatacccaaaggatgataaatcatgctgctataaagacacatgcacatgtatgtttattgcggcactattcacaatagcaaagacttggaaccaacccagatgtccatcagtgatagactggattaagaaaaagtggtacatatacaccatggaatactatgcagccataaaaatggatgagttcatgtcctttgtagggacatggatgaagctggaaaccatcattctgagcaagctatcgcaaggacagaaaaccaaacaccgcatgttcttactcataggtgggaattggatagtgagaacacttggacacaggaaggggaacatcacacaccggggcttgtagtggggtgggggagtggggagggatagctagcattgggagatatacctgatgtaaatgaggagttgatgggtgcagcacaccagcatggcacatgtatacatatgtaacaaacctgcacattgtgcacatgtaccctagaacacaaaatataataataaaaaaaaagaatgaaggggaaaacattgtgaaatgaaggaaaacaaaagaatctgtcagtaagagatttaccttgcaagaaagacaaaaggaagttctttaaaccaggcgtcaccaaccagtaccggtctgtggcctgttaggaactgggccacatagccggagatgagcagtgggcagatgagcattaccacctgagctctgcctcttgtcagatcagccaccacattagattctcataggagcacaaatcctatggtgaactgcacatgcaagggatttggggttgtacgctccttatgagaatctaaggcctgatgatctgtggtgaacagtttcattctgaaaccatctcctcgcacccctacccagtctgtggaaaaattgtgttccacgaaacctgtccctgatgccaaaaaggttagggaacccctgctttaaacagaaaggaaattataaaagaaggactcttgaagtaacaggaaggaagaaagaacaatgaaacaggaagaaatagtgggagaatgcaatagactatccttcttgtgagtttcatgaatcatatttgatgattgcaacaaaaattataacatcatctgatactcaagacaagacaattatacttaaaagtaagcaaggtagagacctaactagtagtaaggttttcacacttcactcaaagtggtaaaatgttgataccagtagacggtgataagtcacatatgtacattgtattgccaagggcaaccgctaagaaaactttatatagtaatacactcagaaactctataaattaatcaagatggaatcataaaaatattctaataaccccagaaaagcaagaaaaaacagaggaacaaggaacagaagaaacaaacacaaaacaaataataaaacagcaaacttatggcctgacagaagtatttaccttaaaaggatacaatatgaagaaaaggaaaaattgaccatgaaaaaaagatttgtctatgaaaatgatttttttttacatgaggtattcctgttgtcattggagatatttatgagtagattctaattaccttgtattgttaaagtgaaagtcacactgtactctcagtaaatttgtgatttgttctttcctaatttcaacagtttttaaacagtattgaggaaaggttacttgcaaacaaaaattgtttttgtgtgtgttccatttgaatatgtaaatattataaggaacatttagaatcacaataatcagagaattcagattaaaacagcaattagaggtttttttgcctatcagatagggattaattaaattcatagttgctaattgtaatgggatatggaaaaataggtgctgttatatacaattagaagtgtagatttgatcaacatattctaaggcagttttagaggaatgaccttattttaacatgttaatttgcattcagcaattcagattatgggaagctgtgtataggaaatatgcttaattgttcacagtaacatatatagacaggtgtttattttagtggtatttgcaggggagaaaggctagaaatagttgggctatgccctggtatcaggaaatgttttaaagtgaaaactaatacatattaacacttcataagaaaaaaaattccgcaaagagcagacattatttagctagcttggtgtaatgttcataatatttctcagttccaaaatgtattggggatactttaataaacagttttgttgtgaactcattaatttgaataattattaattgcaaacatacccaaatgtaagttcaaggtacaacaacaacaacaaaaaacaaaagtaacatttaatttactgttctgattactagtccatttatttctatgggtaatcgagttgaacatcatatgtatgttttttcagagagtaaaaatcatctcatgtttacatcggtgacatatttcttctaaattaaaaaatttttttctaccaattttttaaggccttgcctgatgctaccctgtctgtgaggtttttgttaattattcatctttaagttatcgctatctcttttgaactataacatatttttctgtatttttatctcatcattttccataatattaatagtaataatactttttgtgctttaaatcatacattatacactgctttatttgctttacatatattatcagatttctcatattagcccataataaggtagacattactatcctgattttacattgaagaaactaaaatattcagaggttaagtaaattactcaaggtcacacaggtaagattaaagtttaggtttcaaattcaggtatgtttgctacaaaaccttgtcactgtgttagactgcctctaaagtgagtaaggtaaatgaaataaatgctttgtatgtttaaaattttgttataaaggaaaggaaataatgaattaatgaaatgttcaaattacagactttaaagtaaatacagatttcgttttatactagtcataaggtaattcagtgttagtagttaataccattaaatataatgtgataatcagctagcgaaaaagaaaaaaattaaagttcacggttatttgctacatatatatatatataaattttaagttagaattataccatttgttatatcatttatgccatgtacaaatgaatgaaaatttcactttttttctttctagaattctggaggtggaaatggagttgatctttcagtgctaaatgaggctcgcaatatggtgtcagatcttctgactgatccaagccttccaccacaagtcatttcctctctacggagtattagtagcttaatgggtgctttctcaggttcctgtaggccaaagattaatcctctcacaccatttcctggattttacccctgttctgaaatagaggacccagctgagaaaggggatagaaaacttaacaaggtcgaaatacagtaatcatctaaccctatttatcaaatttaatgatattttcaaattaactgctcctttaaattctatatagaatacaattttcgtttcaaggatcagacataatattgagctgcttgggatgttagaggcaattataagctcaaataattatagttgagtattcagtttttattttaaatacattgctgtgattagcacttataacaactatgtattattattcttgttaagaagtagagaacagcaagcaaattttgttccaggcttgtacaacaaactagtagtcagatcacgttattgctctattttattctttagaatctaggaattgttcttgttgagccaagaagaaatggtcattatcatattcattttatgaattacatagaattattttaaaatgatttttaagttttttgaaccctgttttcccccttttacacctactgaagattactgtagcccagtaggcattgatttttatatcattagaatagaggattaatttctctttaaaatataaatatttcaaaataggattttctttagaaaataataaatactgttctaaatgggtatgcattatccttgttcagagtgcttttacttgttttatttgactattatcagtatctttgccaatagctaaaatcataaaactttaaaactagaaacattgtagaaattattttactcaaccactttattccagataaggaaactaaccaagagaagacaaaatttatttcagttaattttgtcaattgtaataatgcttatagaacttagaaataggtaaatatagtttttgtagggattttgatcatcagttaattttatcagttgtcagcattagggtttagaaatgttgaaaagttaagcaaacccagttagaggaaaaggatttcagaagtattgatcacaatctggatcattgttatgtgatacttttatttttttaaagtttatgcagtagcacctacattagtcaaaacccaattaattagtacttagttacatgacttcctttttagcactctatcttataagaaagaggttaatcacaagcattcagagggcatagcaataaaccataaataaaataactctaatgtattcttgagttagttttcactctatatgttactctttctttgcattttctgttgatatttgatactcaggatagtaatttttaaaaatagtaattcttaaaatttttaatcagaaatcatattgatatcagtatttagtgtgtagaaaagtgtactggtacattttaggaatattttaaacataatattaattaaacaggatgcctaaatgcctcatttcctgagcattgtagttaatcaaggaaggttattttgggttctggaatctactgatagagtaagtcatataagaaccaggaagtaacccttattccttttctttgtgttctttaaactcgttattagaactctatatcgaatttgtctctccttttggaaaagcatataaaaagcctgttgttacttcagaaaagggcaaaggcatttattgaaaaaacaataggcaaaagggaaaaggaacagacaacttgatataactatcttatacacattaagaacaaagaaagatcatatgaacctaaatgacactcaacaaggatattaacataaaggactttttcactgcaggtctaattaactattaacctttacaaaatcagtgtccttgggaaaactgaaatataagacagatacttatctctgagattgctgcagtgtctgctgatagaggaaattcataagaagcagaaactattatgtaaatctcagtaaaacacttatttataatggtcaaaaatggaatattggtaattgaacatttgggttagttgagaatattttttaaaattagggcaaaatattaatgctaaaggtgttctgtatttaactcagtcatttattcaaacccagaatcctgcagtttctcctgattaacagctaagtaaattctatagcactgtactgaaaatataaaaaatttagaatatagggctgatcatccctgatcctaagattgtcctctgaagttgattttcagggtaaatctttcatatccactttttaaattgccgattgtttcttatgaaacaagtagtaaaatgtacaaaagaaaaagaatctagcttaaattatagagttcagacatattttttagtaggaggaagaggaatagaataacaaaatagagtgtgaaatttggagtaaattgacagattttcagaataaaatgtttcttttttctctgtacatgttaaaaatatactttgtattgatactttcatgtgccatcactaatattacatatatagcatattaaagagtgacattttaaaccattgttaaattattcaacagggactaaataggaatagtttgccaactccacagctgaggagaagctcaggaacttcaggattgctacctgttgaacagtcttcaaggtgggatcgtaataatggcaaaaggcctcaccaagaatttggcatttcaaggtaaaatctgcagagccttttaagaaacttgaatcaaatgcatctactttgtttctgtcaataatgtttcaaatagttctggaagcagaaaggaatggttgaagtattttaggtataggacaacatgtgtagtaataatatggtaaaatagagaaactgattattaaagagaagctaatgtgtcttgtcctaaaactttgataggctgggtacaaaatgtgctggatccctgagaacatgagatagtttagggaaatcaggatcaactcaggactggatgctggggaagtttttaaatcgatagaagtggccattacagggttagccaccaatccaatgaatagtatccaaaggtaggtctgcagaattactgacttctgaaaagaggagcacgtttccaaggctcatcacaattgttaggtttaaggtaaccagactttcaaatcctgttcctgctggaggttgagacaactaatatattctatattctgttgaggatttacttggaactgaacaatgctaatcttataaatgaaaggcatcagtaactttaagtaaatgaggctgggaaaatgcaggagctgaaatctcccgaatgtaaatatatacatttaccctgataacaaaggatttaataatacagtactttgtcttttgaaagccaggaaggatactgatccttgtgtgagtttgtcataagttttttctttactcagctttctaattatgttaatataatattggaattggcacaaattctgtgttaaccattttctggtattactgagcatgttttatacttttgagctgtatagtttcacatttgaaacagtagatggcaggattggatcatagctatttgttaaagtttatgttaacagataattagatgattatgattttctagattcttaggtggtttattaatttgaatcttgtataatatattcaagcaggtgaactccttttttgtaaaagaaaaattgaatgaagtgatgtctaaaacaggaatggattgaagtatgaagagtactgtacaggaaaatgagcattggtccaaaatttgccatggcctgaacatcatagtcttttttttttttttgtaaaggaagcaggatatagggaagtgaatgatgttaggaacagaaaatgtgacagtatttcttaactatgggtagcattatcttgagaatatagttgggttttaaaaggtatgataaaaatgttttatattttaacctttcatactgatgtaacagcaatgcatttgcagttaaagaaacatttgatacattgagttaaggtcatttttatcctgctgcctcagataattgattacaatagaaacatagttcagagaaaactaatctttaactctgaaaagtgtttattatataaagctaaatgtaggtagattctatgtagtgacttaactcattaaaacaaaatttatgcctcataaaatatttagaaatttggagaataaattaattggtggtattatgtacgtctattttaaagagaccaggctagatgtatcttttctagtttgcagaagctggagcctcttggtaataaatgtctatgtgtactttgcacataggtgggttacgatgggaatatatgaaacatttacaaccactattccttttcagattcaaatctctggatcagtgctgtctaatagaaatttttgcaatgatggaaatagtttatatctgcactgtctaatatggtactccctagctacatgtgactgttaatcatttgaaatgtgtctagcatgactaaggaactgacttttaaatgtgatttaattcttattaatttcattcagatataaagagccatatgtgactgttttgtagacatatgtgacatccatattagtgcagctctagatctttaatgcgtagtgatgttttgttcaggaatctttagactttagtagcacaaaactcatagacttatgactctgaaatcatcttgactttatattatagtactccagaatcgagatctcatatccttgattttgagtcttgagctttggattctgatcacagtttgcctgactgatttcagcatgattccggtgttgaacctctcatttcctgagcctatgcctgataccaggtttctcatcattccagctgcttttttgtctgttactattgttctgcccttatttcccggcacaatgctgctatcctctagtggagtggttgcttacaaaattgatttacttagagacttggtgttatctttgcatcctgttaccttattctacagataacagttgtcagatatctgtctgcattatcttttactctctattcttctcctttatcactgtgcctatactattttatgctttcattactacttacttgggctattgaattagcctcttaattccagtttccagtatccttcttgactttattaatcttccaccttacactagaaatcttccttaaataaaactgtgattgcagttgtccctggttatccctgggggattggttccaggcccctccccttcccatgggtacaaaaatccatggatgcttgagtcctttatataaaatggtgtagtatttacatattctctctacacatcctttcatgtactttaaatcacctccagattatttataatacctaaggcaatgtaaatgctatgtaaagagttgttatactctattttttacttgtatttttttattactgtgttttttttccttgaatatttttgatttggggttggttaaatctgtggatgtagaaacctcacatacagagagctgactatgtatagtttgtctagtcattgcatttttggactctttaccagtcctatagaataacgcccaaattcctagtgtagaatgtgaaacccaattattacctcatgacagagctgcagcccttacttggaaaaagtaaatgaactaacacagatgagcagtctttcaaataatgagaatagaaaaatgatatggaaagctttctaggtaaaaacagtaggcatgtaacttgtttaagactcttccttgatgttttctggtaattttgttcttggtttaacaccatttgaaaattaagctaaattatgtttcaaaataattaaaatacaaacaatgaaatatatataaggtatttggataaaaagtaataccctatttgtgtaaagaataatacaggatttaattttgcttttattcatgctttgcctagagaaaaaaattaagtattataaccctgggagctatgataaaaataatcagaagaaagaaaaccacagggaagaagagttagtcccccattgaacagcgaccctgttcttattgttaagagtttattattgttcatctgttagaggacttgagattttactaattaaggaggccattcctttacaacaccaaaatatgtttccaacatcaccttcctctagtcttctgaaattctagtcaagctgaactatttgatcttctctctgtccatctgtgcacccttttaatttaaaaagcaatttaactggaatagatctcaacttcagttctgtatatccttagttgggctcataaatcaccttataaggataacacctggaggtccttctcccttctccaaggagaagtactcttttcttcctctgaatttccataacacattctcttacggcgcttttcacatttgactttatgtcagccattactactcctctaaagcctgtttaagttctgtaaagagttcgagattgcattaaaatgaatctttgaagacaaatggctgcttaacaagtgtcctgcagaggtatggtatccatatgagattatgacccttaatcttgccttctgcttaagtttcagatctgggatgagatttctgtggtcagaaagttccaggaaaggttgttttctggatttgctgatgataaaattacccatctctgagttctagttttagtacaggttgaatatcccttatctgaaagtcttgggaccagaagtgtttcagatttcaggttttggaatatttgcctatgcataatgttgtatcttggggatacaacccaatattcatttatatttcatatacacatagcctgaacgtgattttatataatattttaaataattttatgcgtgaaacaaagttttgactatattttaactgtgacccatctcatgtggtcaagtgtggaattttccatttgcagagtcatgtttatactcaagaaattttgaattttggagcattttggatttgggatgctcaacctatacttagagttaaaagaagactgaactgctatttttgaactgagtgatgggacccagccttctctgaggtcaaacagcatatattcagggctcacaggtcactctttttgaacaggttttccctggggaaaaaaataggcaagttgtgttcaattaccctgtgggctatcaattatagttacctcctacactaaagagacttgcttttaaacccatgagtcaccatttatcttcaccgctactgtgtaatgaaatctaataactcgttgcctggcaatagtatgtatgttaaattctgtgccttataatttatcagagacttacaccaaggttatattagcaaacttgaccctatttgaaccccagcaattcaagagggctaattgtgtcatcctactcagcttcttaagagaataactctgtaaatttagacatctacagttatcaagtttatacaactgcattgaaactgagttggtacagaccttgttaaggtaatttgtattgactgtctagaagtcagctcttaaaatatagcttagctcagggaccataacttttgacgtctcttgttcgtttgcttttgacaactcattcccaagtgagtagaaaaagaaaaacaaactcaatttcttccaccatactctgacagcacatttctgataccagatgtgtggggatttctccccaccagcaagcaagcgagcaagcaagcaggcaagcaagcaattctgtagtagacataagctaggtgtcctataattcaattatttctttttcttttcttttttttttttttgagacagagtctcactctgttgcccaggctggagtgcagtggcacgatctctgcccactgcagtctctgcctcctgggatcaagcaattcttcctcaacctcctgagtagttgggactacaggcacatgccaccatgcccagctaatttttgtatttttagtagagacggggtttcaccatgttggccaggctggtctcgaactcctgacctcaggtgatctgcctgcctcggcctcccaaagtgctgggattacaggcatgagacaccatgcccagcctaattccattatttctgacaccatctacctggagatagcgtcagatcatactggttaaggactcagtccgacaagactgatctccacttctgatgccaatagcaagcctcaggttattttgcctgtgcttctgaccaaccagctgtaaatcagggttcccacagccccctccctgggttcaggtaatttgctagagcagctcacagaactcaaggaagcatgtttactggcttattacaaataatattttaaaggatacaaatcaacagccagatgaggagatacaaaggacaggtctggaaggggcctgagtacaggagcttctgcccctgtggagttggagtataccaccttccttgcttgtggacatgttcttgttcactttcctggaagcccccacgtgtttggctattcacaagctcctcagacccagtcctttctggatttttataggagcttcattttataggcatgattgagtaaatcattggccattggtgagcaatttaagctttagtccctctcctctctctggaggttgggtagtggggctgaaaacccccatcatctaatcctgtcttggtctttcaagtgactagcctctatcctgaagctacctagaagctgccagccatcagtcaactcattagcatacaaaaagacactttggagatcctcaggagtttaggagttgtatgctaggaaacagggactggactaaaaccaaatatgtatttcacaatatcacaccaagtctgactttaatcaccttcctgccaactattagtagtcattggaactactcgtctgcttgtcttctgctttcttcgtattgatttatgtaatttcattgaggtgtgtatttatctggtgctgggccaggacatgatgggaagattcgggaactaatctgagaacctatcatttgacctgtaactcttaattctaaatagctaaatgaatgtatgatatactgaaattattgaaagaccctggatcaaggtagaagacagtggagcagtgctgtggtgccattctgaaaggagaaatctctctttgtcttgactattaatcatagaatcagggagtgggctttggtagaatacacagatttttctctttttttgttttctttcttttttattttaaactagaagcttttagagtgtgtttgtatgctgtgaatgatatggacaagaagaatatgagatttaattttgtttgcatgtctaagtgtttgaaagctcaattcattatcttattattattattatcattatactttcagttctggggtacatgtgcagaatgtgcagttttgttacataggtatacacgtgccatggtggttcactgcacccatcaacccgtcacctacattagatatttctcctaatgctatccctcctctagtcccccaccccccgacaggccctggtgtgtgatgttcccctccctttgtccatgtgttctcattgttcaactcccacttatgagtgagaacatgtggtgtttggttttctgttcttgtgatagtttgctgagaatgatggtttccagcttcatccatgtccctgcaaaggacatgaactcttccttttttatggctgcgtagtattccgtggtgtgtatgtgccacattttctttatccagtctatcattgatggacacttcggttggttccaagtcattgctattgtgaatagcaataaatatacatgtgcatgtgtttttataatagaatgcttcataatcctttgggtgtatacccagtaatgggattgctgagtcaaatggtatttcttgtcctagatccttgaagaatcgccacactgtcttccacaatggttgaactaatttacactcaccaacagtgtaaaagtattcttatttctccacatcctctgcagcatctgttgtttcctgactttttaatgatcgccattctaactggcatgagatggtatctcattgtggttttgatttgcatttctgtaaggaccagtgataatgatcatttttcatatgtttgttggctgcataaatgtcttcttttgagaagtgtctgttcatatcttttgcccactttttgatggggttgtatttttcttgtaaatttgtttaagttctttgtagattctggatattagccctttgtcagatggatagagtgtaaaaattttctcctattctgtaggttgcctgttcactctgatggatggtagtttcttttgctgtgcagaagctctttaattagatcgcattggtcaatgttgccttttgttgccattgcttttggtgttttagacatgaagtctttgcccatgcctgtgtcctgaatggtattgcctaggttttcttgtaagatttttgtggttttaggtcttacgtttaagtctttaatccatcttcagttaatttttgtataaggtgtaagaaaggggtccagtttcagttttctgcatatggctagccagttttcccaacaccatttattaaatagggaatcctttccccattgcttgttgtgtcaggtttgtcaaagatcagatggttgtagatgtgtggtgttatttctgaggcctctgttctatcctattggtctatatatcggtttggtaccagtaccagaggaaagaacaggcagtaatgattgctgttctgcagcctctcctggtgatacccaggcaggcaaacagggtgttttggttactgtagccttgcagtatagtttgaagtcaggtagcgtgatgcctccagctttgttctttttgcttaggattgtcttggctatgagggatcttttttggttccatatgaaatttaaagtagttttttctaattctgtgaagaaagtcaatggtagcttgatggggatagcactgaatctatatattactttgggcagtatggccatttttgtgatattgattcttcctatccattagcatggaatgttttttcatttgtttgtcctctcttatttccttgagcagtagtttgtagttctccttgaagaggtccttcacaacccttgtgagttggattcctaggtattttattctctttataacaagtgtgaatgggagttcactcatgatttggctctcttgtttgtctgtttttgttgtataggaatgcttgtgatttttgcatattgattttttatcctgacacttttctgaagttgcttatcagcttaaggagatttggggctgagacaatggggttttataaataattgaatcatgtcatctgcaaacagagacaatttgacttcctctcctcctaattgaataccgcttatttctttctcttgcccgattgccctgaccagaacttccactaccatgatgaataggagtggtgagggagggcatccttgtcttgtgctaattttcagaaggaatgcttccagtttttgcctattcagtatgatattgcttattggtttgtcataaatagctcttattattttgagatacattccattgatacctagttcattgagagtttttagcatgaaggggtgttgaattttgtcaaaggacttttgtgcatctattgagataatcatgcggtttttgtcattggttctgtttatgtgatggattacgtttattgatttgtgtatgttgaaccagccttgcatcgcagggatgaagcctacttgatcgtggtgggtaagctttttgatgtgctgctggattctgtttgccaatattttattgaggattttcatatcgatgttcaccagggatattggcctgaaattttctttttttgttgtgtctcttccaggttttggtatcaggatgatgtcggtgtcataaaatgatttagggaagatttcctttttttctattgagtggagtagtttcagaacgaatggtactagctcctctttgtacctgtcgtagaattcagctgtgaatctgtctggtcctggacttttttttggttggtaggctattaattactgcctccatttcagagcttgttattggtcggttcagggattcgacttcttcctggtttagacttgggagggtgtgtgtgtccacgaatttatccatttcttctagattttttagtttatttgtgtagaggtgtttatagtatcctctgatggtagtttgtatttctgtgggatcagtggtgatatcccctgtatcattttttaatgtgtctatttgattcttttcttattcttccttattagcctggctagtggtcaatatattttgttgatcttttgaaaaaaatagctcctgaattcattgattttttgaagggtttttcgtgtctctatctccttcagttctgttctgatcttagttatttcttgccttctgctagcttttgaatttgtttgctcttgcttctctagttcttttaattgtgatgttagggtgtcaattttagatctttcctgctttctcttatgggcatttagtcctataaatttccttttacgcactgctttaaatgtgtcccagagattctggtatgttttgtctttgttctcattggtttcataaaacatctttatttctgccttcattttgttatgtacccagtagtcattcaggagcaggttgttcagtttccatgtagttgtgcggtttcgagtgagtttcctaatcctgagttctaatttgattgcactgtggtctgagagactgtttgttatgatttctgttcttttgcctttgctgaggagtgttttacttcccattacgtggtcaatcttagaataagtgcagtgaggtgctgagaagaatgtatattctgttgatttggggtggagagttctgtagatgtctcttaggtccacttggtccagagctgagttcaagtcctgaatatccttgttaattttctgtctcgttgatctgtctaatattgacagtagggtgttaaagtctcccactattattgtgtaggagtctaagtctctttgtaggtctctaagaacttgctttatgaatctcggtgctcttatattgggtacatatatatttaggatggttagctcttttgcatttatccgtttaccattatgtaatgcccttctttgtctcttttaatctttgttggtttaaagtctgttttatcagagattaggactgcaactcctgccttttttttttttttttttgctttccattttcttggtaaatattcctccatcactttattttgagcctgatgtgtctttacaggtgagatgggtctcctgaatacagcacactgatgggtcttgactatccaatttgtcagtctgtgtattttaattgaggcatttagcccatttacgtttaaggttaatatgtgtgaatttgatgctgtcattatgatgctagctggttgttttgccctttagttgatgcagtttcttagtagtgttgatggtctttacaatttggtatgtttttgcagtggctggtactggttgttcctttccatgtttagtgcttccttcaggagctcttgttaggcaggcctggtggtgacagaatctctcagcatttgcttgtctgtaaagtattttatttctccttcacttatgaagcttagtttggctggatatgaaattctgggttgaaaattctttttcttttggcggatcacgaggtcaggagttcgattccagcctgaccaacgtggtgaaaccccgtctctaataaacatacaaaagttagctgggcgtggtggtgcgcgcctgtaatcgcaactactcaggaggctgaggcaggagaattgcttgaacctgggaggcggaggtggcagtgagctgagattgcaccactgcattccagcctgggtgacagagagagactccatctcaaaaaagaatactggccctcattctattctggcttatagggtttctgccgagagagatccgctgttagtctgatgggcttccctttgtgagtaacctgagctttctctctgggtgcccttaacattttttccttcatttcaacttcggtgaatctgacagttatgtgtcttggggttgctcttctcaaggaatatcattgtggtattctctgtatttcctgaatttgaatgttggcctgtcttgttaggttggggatgttctcttggataatatcctgaagagtgttttccaacttggctccattccccctgtcactttcaggtacaccaatcaaacgcagatttggtattttcacatagtcccttatttcttggaggctttgttcatttctttttattcttttttctctaatcttcttgctttatttcatcaagttgatcttcaatctctgatatcctttcttccgcttgatcaattaggctattgatacttgtgtatgcctcacgaagttctcgtgctgtgtttttcagctccatcaggtcatttattttcttctctacactgattattctagttagcaattcgtctgaccttttttcaaggttcttagcttccttgcattggattagaacatgctcctttagctcggattagtttgttgttacccaccttctgaagcctacttctgtcagttcatcaaactcattctctgtccagttttattcccctgctggtgaggagttgtgattatttggagaagaggcgttgtgttttttggaattttcagcctttttgtgctggtttctccccatctttgtggatttatctacctttggtctttgatgtttgtgaccttcagatggggtctttgagtggacatgctattcctttctgttgttagttttccttctaacagtcaggcccctttgcttccggtctgctgcagtttgctggaggtccactccagaccctgtttgcctggatgtcaccaggagaggctgcagagcagcaatcattactgcctgttctttcctctggaagctttgtcccagagggacacctgccagatgccagccagagctcttctgtatggggtgtctgtccgcccctactgggaggtgtcttccagtcaggatacatgggggtcagggacccacttgaggaggtagtctgacccttagcagagtttgaaaactgtgctgggaggtctgctactctcttcagagccattgggcagggatggttaagtctgctgaagctgcacccgtagccaccccttcccccaggtgctctgtcccagggagattggggttttatctgtaagtccctgactggggctgctgcctttttttcagagatgccctgcccagagtggagaaatctggcagtctggcctcaatggccttgctgagctgcagtggggtccacccagttcaaacttttgggctgctttgtttacactgtgagggcaaaacgcctactcaagcctcagcaatggcagatgcccctccttccaccaagcttgagcatcccaggtggatctcagacagctgctgtgctggcagtgagaatttcaagccagtggatcttagtttgctgggctctgtggcggtgagatctgcagagccagaccacttggctccctggctttagccctctttccgggggagtatagggttctgtcttgctggcgttccaggtgcccctgtggtatggaaaaaacaatacaacaacaaaaaaaactcttgcagctagtttggtgtctgcctaaatggccgcccagttttttgcttgaaacccagggccccggtggggtaggcaccggagggaatctcttggtctgtggattgcgaagactgggaaaagcgtagtatctgggctggaatgcactgttcctcacggcacagttcctcacagcttgccttggataggggagaaaattccccaacctcttgcccttcccaagtgaggtgatgccccaccctgcttcagctcgccgtctttgggctgcatccactgttcaaccagtcccagtgagacgaactgggtacctcagttggaaatgcagaaatcacccaccttctgcgtcaatcttgctgagagctgcagactggagctctttctattcaaccatcttgcctgggaacacacacatttttctatttgaatgttgccccgggtggtactgttactcttcttttccagtctttgccaccccacatgtaggcagttgccggtatgaaataatcaaaaggataagaatccagcttaaaagagtttattcaaacacaaagctgtggatgcccatccaggaaacacagactccaaggaaatagggtcagtgcttcaaagttgaaaagttaagatcatatttgtataggcagaaaacaaagatatttagcagaataacattttccacacaaagttggcttctgagttacagcaatttgattagttacagcttgtttgttttctttttccaatttaaaagaatatatttaacagtccatcttagaaagtgtgtctttgtgtaagagaagaaaaagggaagttaatctataatgaagatcaacagtaaagagggaaggagtcttctttgacatcctttagttatttgcagcatttagcaaagcagtgtaagttaggggggaataaaaggctaatctgtagtcagggaaatcaaggctatgtctgcctaggttacagctgcctgttagtgactgaggtcccaaaatcacattcctttaaggctcagaataaaagttccaaaatttggttttgaattacttattttcacacaatgaaaatatgaagaatgactgagcattgacagggagatgagttcattgggtggtattatttgcttactgcttgttttttgcctacactaataaaagttgtcaatacttgtgaggatagggaacagaaaaaaatgaaaaactatactttagtccagtagttctcagtgaggtcactggatcagaaactccatcatataagaacttgttagaagtgtggattatctggccccacccaagacttagtgaatcagaaaccttggggacgagaccagcagcctatgttttaagaaaccttcaaagtaattgtgataacctatttcaccccagggattggcagtctgcagcctatggacctaatctggtctataacctgtttttttgtaagtaaaattttattgaaacaaaaccatacccatttgttcattttagtttatggatgcttttgtgctacatcagcagagttgagtagctgcaatagagaacatatagccaaaagtatttaccatcaggttctttacagaaaaagtttgctgactcctgctttaggccttaggcactagaggcgcaaactctgaatttatgaggatatatttgctaattaaattgagaaccatgaggaaaaaaggtgaaacttttcctgtttttaaaaattttaacctgttatttttcccttttagtcaaggatgctatctaaatgggccttttaattcaaatctactgactatcccgaagcaaaggtcatcttctgtatcactgactcaccatgtaggtctcagaagagctggtaagaaatcattctttatgactcaaatatgggggttctcaaagtatatggtagtgtaaacacttttcatcacatatttatagctaattttgaatacaatttcatgtgttataagttaacatgacttagcagtttgggttggctactaattgaccgtttgctaattctttcagtaaaaacagttttagaacatctactctgtaccaggtattttgctaagcagtagggattcagagataaaatatataactatttaactaacctgaatggttgcagacccaggacaagggaaaatcttcaagaaagagtatttttttttttcatagaatgataattgtggagaaaaaaattttaggattagaatagaaaaaaccatgacttcatcctggaaaaacattatgataggaattttttttaattaaaagattatagaatgattaaaaactcttggatgcaagatattttaataaatacaacataggaatagcaaagcaatactgatattgtgcttttaaagtacattatggctgatatcacataggtacaattttgtgattgggatatacaattacaaaattcttttatacacaataacctataaagcatgtgaagagatcagaaaatattattgataatcaagaaaagtaggcactagaaaaagatctatatatgatattgatgctgtattttacaatctttaaaataacaatgatgtttaaaaggaaatagaaggaataatggccaaaatgaatggatacttcgaatagagaactagaacacatagaaaagaaatggacagtctagaactgagaaatgcacttgattaaattaaaagcttattcaagggtttaagaatggattggatacaacagaatacaaaagtagtgaacttgaagacagagaaatagaaaatacccaaactgaagcacagagaaggaaaaatacataaataacagaacaaagtttaaaagacatatgggacacagaagttctaaaatatgtgtgactgaagttccagaaggaaaggagagaaacaaaaggacagaataacttcgcaaaactaataaaagaaagcaaacaacaaattcataaagtgcagtgaaccccaagcaggataaatacaagaaaatcacagctagatgtatgaatcaagcctccaaattataaagaaaaagtttcaaaagcaaccaagcaaggttgtttttatttttcaaggaacaacaataatgatattgacagtgacttgttaacagcaactgtgaactccaaagacaatggcatatttgaaaaagtgtggaaagaataaaacttgacagcatagaattctttatccaatgaagaaatattcttgaaaaattaaataggaataaaaattttttttagtatcctcacttccctgcaacagtaactgtggtgatgggtatgttaattaatttgattgtcataatcatttcacagtaaaaatgtaaatcaagtcattatgttgtacaccttgaatacatgcagtttttgtcaattgtacctcagtaaatctggaaaaaatcttttagtaaatcagatgagaagtagaaaaacgtacatttttttcaaacaaacaaaagctgaaataatttgtagctggcagacctgtgctactaagattcagtaaaggaagtttcttaggcagggggaaaattatccagattgaagcatggaactacaagaacaaaccaaaagcactggtaaggctaaatagatgggtgaggattaaaaagtgttgatgggtcaaaaagttggcaaaggatatgaatagacacttctcaaaagaagacatttatgcagccaacagacataggaaaaaatgctcattatccctggtcatcagagaaatgcaaatcaaaaccacaatgagataatatctcacgccagttagaatggcgatcactaaaaagtcaggaaacaacagatgctggagaggaggtggagaaataggaaggcttttacacagttggtgggactgtaaattagttcaaccagtgtggaagacagtgtggcgattcctcaaggatctagaactagaaataccatttgatccagcaatcccattactgggtatatacccaaaggattgtaaatcattctactataaagatacatgcacatgtatgttcattgcagcactgttcacaataacaaagacttggaaccaacccaaatgcccatcaatgatagactggataaagaaaatgtgacacatatacaccatggaatactatgcggccataaaacggatgggttcacgtcatttgcagggacatggatgaagctgtaaaccgtcattctcagcaaactaacacaagaacagaaaaccaaacaccgcatgttctcactcataagcgggagttgaacaatgagaacacatggacacggggaagggaacatcacacaacagggcctattggggggtggggggctggggagggatagcattaggagaaatacctaatgtagatgannnnnnnnnnnnnnnnnnnnaaaaatgctcattatccctggtcatcagagaaatgcaaatcaaaaccacaatgagataatatctcacgccagttagaatggcgatcactaaaaagtcaagaaacaacagatgctggagaggaggtggagaaataggaaggcttttacacagttggtgggactgtaaattagttcaaccagtgtggaagacagtgtggcgattcctcaaggatctagaacaagaaataccatttgacccagcaatcccattactgggtatatacccaaaggattgtaaatcatgtggctgggcgtggtggtgcacgcctgtaatcccagcactttgggaggccaaggcaggcggatcatgaggtcaggagatcgagaccatggtgaaaccccgtctctactaaaaatacaaaaaaaaaaaaaatcagctgggcgtggtggcaggcacctgtagttgcagctactcgggaggctgaggcaggagaatggcatgaacctggaaggcagagcttgctgtgagccgagatcgtgccactgcactccagcctgggtgacagagcaagactctgtctcaaaaaaaaaaaaatcatgctactataaagacacatgcacacgtatgtttattgtggcagtgttcacaatagcaaagacttggaaccaacccaaatgtccatcaataatagactgaataaagaaaatgtgaggccgggcgcggtggctcatgcctgtaatcccagcactttgggaggccgaggcgggcggatcacgaggtcaggagatcgagaccatcccggctaaaatggtgaaaccccgtctctactaaaaatacaaaaaattagccgggcgtagtggcgggcgcctgtagtcccagctatttgggaggctgaggcaggagaatggcatgaacccgggaggcggagcttgcagtgagccgagatcccaccactgcactccagcctgggcgacagagtgagactccgtctcaaaaaaaaaaaaaaaaaaaaaagaaaaaaaagaaaatgtggcacatatacaccatggaatactatgcagccataaaaaaggatgagttcatgtcctttgcagggacgtggatgaagctggaaaccatcattagcaaaccatcacaagaacagaaaactaaacaccgcatgttctcactcataagtgggagttgaaaaatgagaacacatggacacagggaggggaacatcacacactgggaccaatctgaggctggggggctgggggagggatagcgttaagagaaatacctaatgtatatgacgagttgatgcatgcagcaaaccaccatggcacgtgtatacctatgtagcaaacctgcacattgtgcacatgtaccctagaacttaaagtataataataataaaaaaattgatgggtaaacacaataataactttcttttagcatttatgaaatacataaaagtcaaatatataacaatagcatagagggtagtcaaggggtaaatggaattaaatttgtcgtaaggtactagcaatgcttgaaaaacagtaaaaagttctaatttaagagaagctaatattcaaagatgaacattgtagtattcagggggccaattaaaagaccagtagaaaaagatataactaaaaagcttataaggaggtaaaatggcatgattaaaaaaagcttgaataattcaaaagaatctgagaaaagaaaagcaaaaacagaagaaacacacaaaaaataaatagcagcatggtggattaaacacactttattacattaaatatacacctttggggtagaggaagggatctgactagagttgtcagtatattatctgaaatgtcaagttttcaacaaaaattggactttacgctccaattaaaagacaaagattaggctgggcactgtgactcacacttgtaatcccagcactttgggaggctcaaagtgggtggatcacctgaggtcaggagtttgagaccagcctggccaacatggtgaaaccccatctctacaaaattcaaaaatacaaaatacaaaaattaaccagacgtggtggtgggcgcctgtaatcccagctactcgggaggttgaggcacgagaatcgcttgaacccgggagacagagattgcggtgagccgagattgtgccactgcacttgagcctggacgacaaagcgagccttcgtctcaaaaaaaaaaaaaaaaaagtaatcttctgactgctcattggttgatgtccaaattatactgatccccccagggatgacttctaggaaaccatgcttaaaaatataatcaaaaacttaagagaaaaagctaacagaaaactgagtaactacacattgcaggagaaacagaaactacacaattagttcaggtaagtcactaaacaaattatcagaaagaagaaaacacaaagccagcaacataataaacctttggtgttggagggatctgatatcaaaactttacagtattttatgtaaaatgtacgattttcaagaaaaatatgtgaaacatgcaaagatacaagaaatttttgacatgtacccaaggaaaacgtaacccatagaaattatccctgaagtggattggattttagacttagtataaaacaaaactgtaacattgttttaataattataaagtaaggctacttttactcaatattggattagaggttctagccagggcaattaggtgagaaggaataaaaggaaaaagtaaaattgtatttgcagatggcatgagcttgtatatgtaaaatcctaagaaattcactgaaacctattatcaccaataaataagtttatcaatgtggcaggatatacaaaatcaattttatttctatatgctaacattaaggaatccaaaactcaagttacagaacgatttctgtttacagttagcattgaaaaaatctttgaaataaatttagcaaaatagtacaagacttttacaatggaaactataaaatattgttgaaattaaagaagacctaaatatattggaagacattccacgtttaaggatcagaagacttaatattattaagatggcaatattctttgaattgcactagattcgatacagtccttatcaaaatttcagctttgccaaaattgacagtctgatgctaaaattcgtatagaaacgcaagagtcccagaatagccaaaacagttctttaataaaaaagaagaaaaagtacgaggactcccactttcaaattttaaaacttactaccaggctacagtaatttagtatggtactggcatagagatatttctattcaatgaaattcaatttggcagtttctcaaattttaaacatgaagttaccatatgacccagaaattctacttcttgatatatatccaagagaagtgaaaccgtaggtccacacaaaaacttgtgcataaatgtgtatagcagcattattcataatagctaaaattagaaacaacctaaatggctatcaataaatggttaaacaaaacgtggcttaaccatacagtagaatattttttgtcacaaaagtgaaatggagtagtattcatatgccatgaatgaaccttgaaaacattatgctaagttaaataaggcagtcacaaaagactacaaattgtacaaatctactcatataaaatgtctaaaatggacagatctatagatagagaaagtatattagtggttgctatggttttaatgcttgtgtacttccaaaattcacatgttgaaacctaatccccaatgagacagtattaagagatggggccttttggagatgactaagcatgaggttggagcctttgtgaatgagattagtgctcttataaaagaggcctgaggaagctagctatcctgtcagccatgtgaggatacagtgaaaaaagtaccatctgtgaggcagaaactgagccctaatcagacatcaagactgctggcaccttggtcttggacttcccagcctccaaaaactgtgagcagccaagttctattgtttacaaattgcccagactaaagtatttttttttttttaggtggtatagatggaattttaatacagtgaaagaaaatagggagtactgagttaatggttttgggtcatctttataattatctggtagaagactgaatttccatcttacatattatatacacagaaatctacagattggctacaatttaggtgttcaaaatgggaattaaaagtattataaaagcatataagattcagaaagtttaaatagataaatattttctaataataaaaccattaaaagttgataacatttttttttcttttatttattattatactttaagttttagggtacatgtgcccaatgtacaggttagttacatatgtatacatgtgccatgctggtgcgctgcacccactaactcgtcatctagcattaggcatatctcccaatgctatccctcccccctccccccaccccacaacagtccccagagtgtgatgttccccttcctgtgtccatgtgttctcattgttcaattcccacctacaagtgagaatatgcagtgtttggttttttgttcttgcgatagtttactgagaatgatgatttccaatttcatccatgtccctacaaaggacatgaactcatccttttttatggctgcatagtattccatagtgtatatgtgccacattttcttcatccagtctatcattgttggacatttgggtcggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctcggatggccagtgatgatgagcattttttcatgtgttttttggctgcataaatgtcttcttttgagaagtgtctgttcatgtcctttgcccacttgttgatggggttgtttgtttttttcttgtaaatttgtttgagttcatcatagattctggatattagccctttgtcagatgagtaggttgtgaaaattttctcccattttgtaggttgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaatgcctaggttttcttctagggtttttgtggttttaggtctaacgtttaagtctttaatccatcttgaattgatttttgtataaggtgtaaggaagggatccagtttcagctttgtacatatggctagcgagttttcccagcaccatattaaatagggaatcctttccccattgcttgtttttctcaggtttgtcaaagatcagatagttgtagatatgcggcgtgatttctgagggctctgttttggtaccagtaccatgctgttttggttactgtagccttgtagtatagtttgaagtcaggtagtgtgatgcctccagctttgttcttttggcttaggattggcttggcgatgtgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccctcacgtcccttgtaagttggattcctaggtattttattctctttgaagcaattgtgaatgggagttcactcatgatttggctctgtgtttgtctgttattggtgtataagaatgcttgtgatttttgtacattgattttgtatcctgagactttgctgaagttgcttatcagcttaaggagattttgggcttttttttatagcaagttgaatgaactaagacagtggtcccttgtgactatgggtaggagcgacaggaatagagaatgactgctaatgggtctatggtttctttttgagtttatggaaatattccagaattagatagtggtgatagttgcacaactctgtggatttctaaaattcagtgaattgtacaatttaaaatagtaaattgtatggtatatgaatgatatcttaaaaggctgtttaaaaaacacgtaagcatgttctgtcaccacagtggaattagatttgaaaacatctctcaatagatctgcagaaaatcctcaaattataaataacctatgggtcaaagaagaaaaagcaatgaaaatcagaaaatattttgagctgaataataatgaaaataggacttattaaaatgtcggaagaagctaaagcagtgctttcttgggaaatttatagcaaaaaaagagaaaaattaaaaatctgttaagcttacattttaagaagctataagtttcacagcaaagtaaaccaaaagaaagaagaaaacatgacactgatacaaaaagattacactgatacaaaaatgataaaaaatctgaagagtcatatatcttctaacgaaattaaacctgtagttaaaaaccttcttacaaataaaattgtaggtccagatgactttactggtaaattcttccctatatttaacgaaaatgttgttatgaaaggttatatccaatgccttagttttctatagctgcttgctgtaaactgcatattcatatctcctcacttacaccccaattcatgtgttgaaacctaatcctcagtgtgatggtatttggagctggggcctttggaatgtgattaggtcatgtgagtggactcttcatgaatgggatgagtgccttataaaagagacctcaaagagctctctaatcccttccgccatgtgaggacacgagaagatggccgtcagtgaaccaggaagtgggccatcatcagacaccacatctgccagtgccttgatcttgcacttcccagcctccagaactgtgagaataaatttctcttatttataaaatacctagtctatggtattttgttatagcaatccaaagggactaacacactactgtatcaaattaccatatgcttagtgacttaaataacacaaatttatacttataattctggaggtcagaagtttaaaattgatctcattgggcccaaagcaaggtgtcagcagggctatgtgtcttctggaggctttagggggtaatccattttctttgcattttccagtttccagaggccttcctagagcttgcctgcctggattcctggcccatggccccattactccatcttcattgccagcaatgtcagtctgaatcctgacgctgccatctctctggctcttttatgtctgcctctctcttttacttaggcataggacttagccgtgtgtgactcctgtaatgacaagaacccttgtcattacattgagcacaactacataatccaggataatctccccatctcaaggttagctgatcagcaaccttaaggccatttgcaatttaaatatccctttgccatgcaatctaacatataggttctgtggtttaggatatggacatctttgggggtgattattctgcttaccacagccaatcttacacaactctttcactgaaaagggaaagaggaaacaccagttttttatgaggccagcataaccctaatattgaaacctgacaaggatattacaagtaaattagaggccaacatctcttgtgaatatagatacaaaaatcctaaacaaaaagttacacatataattgagtaatatattaaaatgataataccataatgttcatgttgggaagtattattacaggaatataaagtctgtttaacctttgaaaattcactgcattaatagaataaaagagaatactcatatggtcatcttaattggtacagagaaagcttttcatgtatgttcatttgataaatttgataattatgataaaaaattataagcaaattgggaatagaggggacatttttaatctgataaagtatctatcaaaaatgtttttcaaacataatacataatgaaatactgaacatttttctcctgactttggaaacaagataaagatgttcactgtaaatacttgtctccaacattatcctgtaatttctagacaatgaatgaagacaagataaagaaaaggaataaatattggaaaggaagatataaacccttttatttatttgcagattaccattttgtatacatggaaaatctagaaggctctaaaaatatagtaatagaattaataagtaaattttgcaatattttaattgtacagaaaaattaattatattactctatactatcagaaaatggttaaaatgaaatttaaaacaccatttaccacagcatcaaaagccaccaattacgtagagataaatttaataaaaaatatgcaatgctgctacactccataacttcagggaaaaatttccgtaacaagacataaaaatacttaccatatgggattagatgaataaatttgactacatgaacattcataacctctttattgaaaaaagtcatataaaggccaggcatggtggctcacgcctgtaatctcagcacttagggaggctgaggctggtggatcatttgaggtcaggagttcgaggccagcctcgtcaacatggtaagaccccatctctactaaaaacacaaaaaaattagctgggcgtggtggcgggcacctgtagtcccagctacttgggaaagctgaggcaggagaatggcatgaacccgggaggtggagcttgcagtgagctgagatctgagatcacgccactgtactccagcctgggcaactgagtgagactccatctcaaaaaaagaaaaaaaaaaaaagctaggtgtagtggcgggtgcctgtaatcccagctatttgggaggctgaggcaggagaattgcttgaacccaacagatggaggctgcagtgagcccagagtgcaccactgtactccggcctgggcgatagagtgagactccatcaaaaaaaaaagtcatataaaaagaattgaaaatagtaacaacatctgagaaggaactagaattcagctgtataaagaactttgtcagtggaagaattatggacaactattcattttctattgctgcatatcagattacaacaaatgtagcagcttttgtgcaagagtccacacacagctgagtcctctgcttgaggtgtcataagtctcaaaacaagatgttggctctaccttgttctcatctggagaatcagctgggaatgaatcggctgccaagctcattcaggttgtcctcaggttgttcttcatttccgttggttgtggattcttgatggctctgggttcttgatggctattggctgggggccacccacagttcgtagaggctgcccatagttttttgtcacatggtcttcctcagtatggctgcttacttcatggagctagcaagaagaatctctagagtgagtctctagcaagatggaattcataatgaaacataatcataggggtgacatcctgtcatctttcttttgataagaagctagtcacaggtgttttctacacaaagacatgaacaccagggggcaagggttaatgctaccttagagtgtgtccatcaccacaagccaatagaaaaattagcaaaagacttgaatgaggatttcagaaaaaaaactatacaaatagcatataaacatgaaatgtgcttaaccttattagtaatgaggaaattaaaaagtaaaggtacggtgctcttttatttatcatcagattggcaaaagataaagaacattatatttatacacacacacacacacacacacacacacacacgcagagaaagagagagaaagtttgttttaagggattggctcacacaactgtgtgggcttgcaaggcaagcaagtaggaagttttcaggacaggctggcaggctgaaaattccagcagggttaatgttgcagtcttgaacctgagacaaaattttttcctctttatgagacctcagtcttttctcataaggccctaagctaattggatgaggcccacccatgttatggaaattaatctgctttactcaaagtttattgatttaaatgttaatcacatctgaaaaatatcttcacaacaacatctatactagtgtttgaataaacaactgagcaccataaccaagttgacaccatcgcacacatctgtaagtgtttaccactatgcctgaaaatattgtagctccttaatgactgttacttgttttcctttctgaatgagactttacttgggtctttatttttcaaataaggttataaatctgcctgcatctttccagatatacccacactgctttagtttgaggcactcagcaaaggtttctggaataaatagacagaattatagactcatcttatgtgttcctgaagcactctgttttgttcccttattaagcacttagcacttgtttgtattcttcactacactctagcttcattgaatttcagggatggtatctttttcttcattgtgaaaaccagtatattttccagcatatagtaagctctaaatatttgttgaatgaatgaatgagctggaaatactttcatgtaatttttaaagcgatctgacattgcattaacatatgatgttattctcaacttgcttaaatgctattaagaattttagttcttacttttacactgttggtgggactataaactagttcaaccattgtggaagatagtgtggcaattcctcaaggatctagaactagaaataccttttgacccagccatcccattactgggtatatacccaaaggattataagtcatgctgctgtaaagacacatgcacacctgtgtttattgcggcactattcacagtagcaaagacttggaaccaacccaaatgtccatcagtgatagactggattaagaaaatgtggcacatacacaccatggaatactgtgcagccataaaaaaggatgagttcatgtcctttgcagggacatggatgaagctggaaaccatcattctgagcaagctatcgcaaggacagaaaaccaaacaccatatgtcctcactcataggtgggaatgaacaatgagaacacttggacacagggtggggaacatcacacactggggcctatagtggggtggggggacgggggatggatagcattaggagatatacctaatgtaaatgatgagttaatgggtgcagcacaccaacatggcacatgtatacatatgtaacaaacctgcacattgtgcacatgtaccttagaacttaaagtataattaaaaaagaaaaaaaaagaattttagttctttggccagatgcagtggcttaagcttgtaatcccagcattttgggaggctgaggcaggaggatgacttgagcccaggtgtttgagaccagcctgggcaacatcttgaaaccctgtctctacagaaaaataggtaaattagctgggcacggtggcctgtgcctgtagtctccaaggccagaggatcaattgaacccaggaggttgagtctgcagtgagccatgattgtgccactggaatccagcctgggcaatgaaatgagaccccatctcacagacaaaaaaagagaatttaaataaaatttaattttattgaattgaaaataattcaataaaatttggtagagatgctttgctcttgtggataatcaatctgatagggacacataggtgaaagttaaagaccaataggaattaggaaaatttctgccatacagtatgtatgttttagtcatactgttcacatttacctattataaatgtagatatttacccaacaaggggtgtttacccaacagccattgatcatgacaaatatggcaaatattgcataagtttctagaatattgtgaggccccatgcaggaatttataatttatttgtaaataatctgctttttttaaataaggaaaaaatccataaaaacacaaatatatttaataaacatacacacataaatacattcttatttatctatctcctttcttttaatttttaaaggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacaggtaagtttcccaactgtttattatttctgtttcaaaatgttgattacagttaagtcctcaacattttggataggttcttggaaactccagctttaagctaaatgaccatagtttttttcggtgttataatgaaatgacattattttaagatgtgctataagttgtttcacttaaaatgtcagttttcaaaaacttattgatgatattgaggactttactgtattttaataaagtattaccagttttctagttctatgttataactagatgatggattcagcctatattcttttccttatttatctagtagtttttattctaaataaatatcttctcattttagtggttattaattttttaaattaaatggtctccatctgagctaaaatataatggtattctacccatcctaagatcttagtaaatattaaagtattttagtatacactactttagtacctattcatagtacccagtaaatggtgtttgatcttatttctgctttactaatagtaagggtttacctcagatccaatgttgacttttcaaaaatattttgtttccttcaaggacacacagatactttctaggttaaagcctttgaactttatggagagattggaattttaggatgcgttgcagttgggatcttggttaaaaattaaacagattttctaattgtgttcaggtaaaaaacttgtacctcatttaccgtatatatttatctattttattctataagctgtggacatcaaatgctgaaatatgtttcaacatctgaatcagatggtacagattgctgcagtggaaaatcaggtgagattacaaaagtcatatgtatttgagtttaagagaaatttcttacaatgatttttagaatgggaaaatgaatgagtttaacttcagtttatccatctttaaaatgaagattattattttttacccacttcacagaggacttatttagaacaaattataagtaatagatggtgaaagtaattcaaagaataaaaatgtcccatacaaatgaatgtagtcttcttaggttatgtctattgtttataaatagtggaattatttatattaaacattgaaatttgtagtgcacaatctaaatccaaacggttttgcataaattttttatggcataaagaggggttgttttaaagtgtggttaattatatcattctgaaatattttgtatcctcatacaagacatattgtgttgatgaaattatagttgttttataaccttaaaatttgatgactcaaactaccagtagtagttaactaagtaactcagaccaacatttcccctgagggcagctagaaaaggtggatgaattatttttttaaaaaaaatctacttgaagccattgaagaactaaaaaaatcttatgaatcaccagtacaagatctgttggaagacagaactccaagaaagtgagcctggagtttggggctatcaaaagagtgtatgccaattccacagagaccaatgactgataggatgagcaattttattagcagcttcatggggctaggaagacagaggctagagttgaaggcttgccatggtttggataacttgataaactctaaagtgttgtatcctaagaaaaaagttaaaccaaaaatagataagccttttcagggattataggttcttctcaatccctttacataccataaaacttacccttttaaagtgtgcaatttaatagttttttgttttttacattttaaaggattgttaacaaataaaataaaataaaaagactaattcttcacaaactcttccaaaaaatagaagaggagggaacacttcccaactcattcttttttttttttttgtatatcattacaatggaattcagttcagcaattaaaggaataaacttctgatacatgctgcaacatagatgaacttcaaaacattattctaagtgaaagaagccaggcccaaaagatcatatattatatgattacatttatatgaaattcttgaaagacaaatttatagagacaataatcagaacagttgttgcataaagtgagaatagggattaactataaataggcatgaaggaacattttgggtgggggtgttgagaatgttctaaaattggattgtaatgattgttgataactgcaaatatactaaaattgttaaattgtacacttgtgggctggatgtttgtgttcctccaaaaattcatgtgtcgaaatcctataccctgatatgacggtattgggaggtaaggcctttgggaggtaattaggtcatgaaggtggatccttcatgaatgggattagttcccttataaaagaaccccagaaaactctctttcccaccctctttcccaccgtgtgaggatacaatgtgaaatcggtagtctgcaatactggaacttggccaggctggcaccctgatatcagacgtccagcttccctaactgtgagaaataaattcctatttttttataagccactcagtctgtagtatccaattatagcagcctgaactaaggcattttacaatgggtagattttaatggtatgtaatttatactcaataaagtttttaaaaagaacaataatttattaagtgtcatatttctttgggtggactagcctcaactgggagattctcacctgaggactttgatgagattgcagtcagtgcagtcagatattggttggggaagcagttatctgaaggattgattgggcagaatttccaagatgggttactcatgtgccttttggctattgaccagtccatctaaatatgacccctccatgggcttcttcagtttgttggcagcattccaagagagtaggaagtggaaactaccagttcagttaatggctgaactcagaacagagtgtcacttctgccatattctgttatcagagcagtcatgaggcctgttgagattccagagggttggtaaataaatgctctgtcttgatagaggagtgacaagaatacatttcagaaaagtgtttgggacaagagatagtgttgtagacatctttagaaagaaatgcttcatttacctcacctgtttttattattatctgtaagataatagttattaggagttcatatcattaaaaagtaaattatgtaatatacctcaagtgcaaacaacttttagattaacttctattttagaatatcattgtagttattgccttaccttaccaagaatactcgaatagtctaaatttaatttcttagactaattgtttttcatttggaaaaaataatattttctaaacagtaatacttccagatcatcatctaatcaattaatgattggtatattcattgtattaagttgagattatactgacatttattaatcacctattatgtataacatcttgtaagatgggtattattatccaaattttacaggggagaaagcttgccattattaagtacgaaaatcaggatttgaacctagttttctgaaactcaactccaatgattactcttaagaatttttttttttttttttgagacagagtcttactctgtcatccaggctagagagtacagtggcacaatcatggctcactgcagcttccaactcctgggctcaagcaatcttccctcctcagtcttctgagtagttgggactacagcaccatgcccggctaattaaaaaaatttttttttgtagagatgagaactcgctctgttgcccaggccagtcccaaacttttggcttcaagtgatcctcccgccttggcctcccaaagcactaggattataggtatgagctgttatgcctggccaagatctctttttacaaaaaaacaaacaaaactctacatattgagcttatagcatgtaattatcatataatcagcacccagatccagaaacaaaataagaggctggccaaaatggccaactagaagcagctaatgtgcactgctgtcatggagagaaatagaaggggtgagtacatacagcaccttcaactgaaacatacatgtacacatgttgggattcatcaagaaaacaacccacagagaatgtagaaaagcaaggcaggatgactgcccacctgggagtgacacggagccaggggagcctccctcgcccagggaagcatgagtaagtgggcaaccctggggacccatgcttctcccataggtctttgcaacccttgggtcaggagaccctcctcgtaaacccactgcaccagggcttgcagtctgatatgcagagctctgtggcatcttggcagagtagctgctcaggcacatgtggagccccaggagctatagatacttgggtttctaggcaaaagcagctgcaacttggcaaagtaggaggttagacccccatacagacccctaagaagtagctgaattcaggggtctgagcagcaatggtcttcaggtcccatgtccacagcaccttgcaggataagaccactagcttggaactccagccagccactggtagcagtgttgatggagctcccagagggaggggtaggctaccatctttgctgttttgcagccttagccattgttgccttcagtgtaaccaccctacaaaaatgcagccagcttgcttttttatgtgggtccctgacctctcttctcctcactgggcaggacctcccaaccaaggtaaccagccactcttgccactgtttttcagctggcagtggttccgagcctccctgagatagtgctcccgggggagggacaggccgccatctttgctgtttcacagccttagccattgttgccttctggctctaggaagtccaaggtgactaggtactggagccgtctctcaccgcagcacagtagctctatgggaaagcagctagactgctttttcacatgggtcccagatcttatttcttttcactgggcagaatcctgtgaccaaggtctacaaccacccctgctagtgttttctgtccagcaacagtttcaaactttgctgggatggagttcccagagggaggggcaagctgccatctttgctgttttgcagccttaaccattgttgcctttgggatttggagagtccaaagtgactgggggctgcagcagaccccaaacacagcccaactgttatataaagaagtggccagactgcttttttacacaggtcctcaaccctatttctcctcactgggtgggacctcccaactagggtgtccagccatctctgctggtgttttctgaccagcagcagtttcaaacctccctgggatggagctcccagagggatagggggactgccatctttgctgttttacacccttcactgttgataccttcaggtgctagataaaccaaggtgactagggactggagtgtacccccagcatactgcagcagccctacagaaaagtaaccagattgtttgttacttgggtttccaatctcatatctcttcactgggcaggtcctcctggcctgggtctccagctcccctcacctccaggctatcaagccagtagcagctctggaactccctgggaaagaactcccagtgggaggggtgggttgctatctttgctttctcacagccttaggctttgctgtcttcaggctttggagaatctgtggggaccaggggctagctagtccatacccgagcacagagtatccacctcacagaaaagtggtcggactgttctccacgtaggtcctggtcctcacttctcctctcaacctggtactctagcacaaacacgctgtccctgtcagaccacatcaatcagaggcagcccagcagttaaaggaagagccacatgcagagataagaaagaaccaatgcaagaactccagcaacctaaatggtcagtatcttatgacctccaaacaaccacactagttcttaaccaggctgagctggctgaaatgacagaaatagaattcagaatatggataggaacaaagataatcaagatcaggagaatggcaaaacccagttcaacaaaactaagaatcacaataaaatgatacaggagctgacagatgaaatagccagtatgaaaaggaacctaactgatctgatagagctgaaaaacacactacaagaattttgtaatgcaattccaagtacagcaaaagagaccaagctgaggaaagaatcttgaaacttgaagactgactctctgaaataagaaagtaagacaaaaattattttaaaaagaatgaaaaggaatgagcaaaacctctagaaatatgggattatgtaaagaggccaaatctacacatcattgacatccctgacaggagaaagcaaacaacctggaaaacatatttcaggatatcatccatgaaaacttccccagccttgctagagaggccaacacccaaactcaggaaatacagagaactcgtgcaagattctactcaagaagatcatccccaagatgcataatcatcagattttccaagtttgaaatcaaggaaagaatgttaaaggcagctagaaagggcaggtcacctacgaagggaacctgatcaggctaacagtggacatctcagcagaaaccctacaagccagaagagcctgggctcctatattcaacattcttaaaaaaaaaaaaaatcttcaagaatttcatatccagccaaactaagcttcctcagtgaaggagaaataagatccttttcagataagcaaatgctgaggaagtttgttactaccatttgttactacgagacccacttaaaagagatcttgaaaagagcactaaatatgaaaggaagaaccattaccaggcaatacaaaaaaacacagttaagtacacagacccagtgatgtaaagctaccacacaagctggcttaataaccaggtaacagcacaatgacaggaacaaatccacacacatctatactaaccttgagtgtaaatgggctaaatgccccatttaagaggcatagagtggcaaactggattttaaaaaaagtaagacccaatgatacactgtcttcaagagacccatttcacaggcagcaacacccataggctcaaaacaaagggatggaggaaaatctaccaagcaagtggaaatcaggaaaaagcagaggttgcaatcctaatttcagacaaaacagactttaaaccaacaaagatcaaaaaaggcaaagaagggcattacataatggtaaagggttcaattcaataagacctaactattctaaatatgtattcacccaacacaggagtacccagatttataaagcaagttcttagagatctacaaagtgccttagactcccacacaataatagtgagagacttcaacactccactgacagtattaggtcactgaggcagaaaattaacaaagatattcaggacctgaactcaatatgggaccaaatggatctgatagacctctacagaactctccactcaaaaacaacagaatgtacatttttctcattgccacatggtacatattctaaaatccatcagacaaccctcagcaaatgtaaaagaactgaagtcatgccaaacatactcctggaccacagtgcaataaagatagaaatcaagactaaaaaaaatcactcaaaaccatgcaattacatggaaagtaaacaactggctcctgaatgacttttgggcaaatagtgaaattaaggcagaaatcaagaagttttttaatacgaatgagaacaaagatacaacctacaaaatctctgggacacagccaaggcagtgttaagagggaaatttatagcactaagcagccatatcaaaaatttagagagatcccaaattaacaacctaatatcaccactaaaataactagagaagagagagcaaaccaacccaaaagctgacagaaaacaagaaatagccaaaatcagagctgaactgaaggtgattgagacacaaaaacaccatccaaaagatgaatgaaaccaggagttgattttttgaaaaaattagtaagataaataggctgctagctagagaaatacagaagaaaagagagaagatccaaataaacacaattagaaatgacaaagggggtggtaccactgaccccacagaaatacaaccatcagagactactatgaacacctctttacacacaaactagaaaacctagaagagatggataaattcctgtacacataacccctcccaagactgaaccaggaagacatggattccctgaatagaccaataagaagctccaaaacggaatctgtaataaatagcccaccaaccaaaataaataaataaaaataaagcccaggaccagatggattcacagccacatcctaccagatgtacaaagaagagctggtactatttatactgaaagtagtattacaaaaaactgaagaggaaggactgaaagtattacaaaaaaatgaggaggaaggactcctccccaacccatactatgaggccagcatcattctgataccaaaacgtagcagagacacaagaaaaaaacaaaacctcaagccaatatccttgatgaaaattgatgcaaaaatcctcaacaaaatacttgcaaaccaaattcagcagcacatctaaaaggcaatccaccatgatcaaataggcttcatccctaggttgcaagtttggttcaacatatgcaaatcagtcaacctgattcatcacataaacagaactaaagacaaaagccacatgattatctcaatagatgcagaaaaaggcttttgataaaattcaacatcccttcatgttaaaaactcaataaactaggtattgaaggaacatacctcaaaataataagaaccatctaggagaaacccacagccaacatcacactgaatgggcaaaagctggaagcattccccttgaaaacgggcacaagacaaggatgccctctctcaccactcctatttaacatagtattggaagtcttgaccacagtaatcaggaaagagaaagaaataaagggcatccaaataggaagagaggaggtcaaactatccctgtttgcagacatgattctatatctagaaaaccccgaagtctcggcccgaaagctccttaagctaataagtaacttcagcagagtttcaggatacaaaatcaatgaacagaaataactagcattcctatacactaacacagccaaaacaagagccaaaccaggaacacaatcccatttacaattgccacaaaaagaataaaatacctaggaatatagctaatcagggaggttaaagacctctacaatgagaattacaaaacactgctcaaagaaagcagagatgacacaaacaaatggaaaaacattctgtgctcatggataggaagaatcaatatcattaaaatggtcatactgcccaaggcaatttatagattcagtgttattcctaacaaactaccaatgaaattcatcacaaaactagaaaaagctattttaaaattcatatggaaccaaaaaagagcctgagtagccaaggcaatcctaagcaaaaagaacaaagctggaggcatcatattacctgatttcaaagtatactgcagaactgcagtaacaaaatatcatggtactggtacaaaaacagacacatagaccaatgggacagaatagagagcccagaaataagaccacatgcctacaaccatttgatctttgacaaagccaacaaaaacaagcccattaatggggaaaggactccctattcaataaatggtggtgggataactggctagccatatgtagaagattaaaactggatcccttccttacaccatatacaaaaatcaactaaagatggtttaaagacttaaatgtaaaacccaaaactataaaaactctggaagacaactgagtcaataccattctggatatagatactggcaaagatttcatgacaaagatgccaaaagcaatcataacaaaagcaaaacttgacaaatgggatgtaattatactaaagagcttctgcacagcaaaataaactatcagcagagtaaacagacaacctatggaaagggagaaaatttttgcaaactatgcatctgataaaggcctaatatccagcacctacaaggaacttaaattgacaagaaaaaacaaacataaaaaagtgggcaaaggatatgaacagacaatttgcaaaagaagacatacatatgggcaacaatcatatgaaaaacagctcagcatcactgatcattagcgaaatgcaagtcaaaaccacaatgaaacaccatctaacaccagtcagaatggctgctgttaaaaaggcaaaaaataacagatgctggcgatgttggggagaaaaagaaacacttatacactgttggtgggagtgtaaattagttcggtcattgtggtagacagtgtggtgattcctcaaagacctaaaaatagaaataccatctgacccagcaatcccattactgggtatatatccaaaggaatataagtcattctcttataaagccacatgcgtgtgtatgtttattgcagcactatttacaatagcaaagacatagaatcaacctaaatatccaccaatgatagattggataaagaaaatatggtacatatacaccatggaatactatgcagccataaaaagaatgagattgtgtcctttgcagggacatggatggaactggagaccattatccttagccacaggaacagaaaaccaaatattgttatgttctcacttataagtgggagctaactgatgagaacacatgggcacatagaggggaacaacacacactggggcctgtcagagggtggagggtgggcggagggagaggatcagaaaaacaactaatgggtactaggcttaatacctgagtaatgaaataacctgtacaacaaacccctttgttacatgcttacctatgtaacaaacctgcacttgtaccactaaacttaaaaaataaataaatgaaaaaaaatcacagctagtgaagtagtgaggctaggactcatttctataagtagtatttagatttgaatccagattctattttactatatagtttgggctctatcttatatgtccatagtggaaaagtaataaatgattatcatagtttttctaagagaaaaggcaaagaaaagaagatgtagtatatatacatcatggaatactatgcagctataaaaaagactgaggtaatgttttttgcagagacatggatggagctggagtcaaactaacataggaacagaaaaccaaatactgtcacttataagtgggagatgaatgacgagaacacatggacataaagaggagaacaacagatactggggcctacctgatggtggagggtgggagaaggaagaaaatcagaaaaaaatagtaattgggtactaggcctagtacctgggtgatgaaataatctgtacaacaaactccatgacacaaatttacctatatgacaaacctgcacatgtacccctgaacctaagataaaagttgttttttaaaaaagaaacaaaatattacccacacctcaaaattacccatcatgaccccttccaatcatatgccccaaagataatgatctttttgtctttcatacgcttttgaacttttcttaaagagaatcagagagtatatacttttatgcctggcttccttcactaaacattatatttttaagtaccatccatattgtagttcattctctttgctctgtagtgatcaattgtgtaaatataccacaagttatttattctactgtcgataggttttgggtaatttccctgtttaagatattacaaatagaatgaatatgaatgttttttaacacgtgaatgaatgctatttagctatgaatactgctcttcttttccatgtgatttgagaaaagaaattattacattggtagagatataactcaccattaataatattatggtttaaggtttacatgtgatttaatcttattgatttgtaattatgattttagaatttttatctaaaactcagagatgttggaaattgtttatatcaaattggtaagaaaatttctattgataggaactttttctttttctcacttttataaagaatatccacttagcatccatgagtagatatgaaaggtgagtccaatacaggaagtgtctttgttgcctgagcataaggtatctaggcaaaatagcacaggaagatacaacttaatggtatcgtgaaataatttagattgaactccattatgattcattttatctaaatatttttaacaattatttttcatgtaaagctgtacatatagggcacattttactcctatatattactatatatattttttgaaaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatgtaaaagataaactttcaatatgattatgttaaggtgaaatataatactgttagtactggtttcattacttttgcccagaacaagatttttaatataatagtattttttaatttttttacttataagtcactataactgaaatattgcttgggttacaaataatacagtaacttgttctaattctatcatcctaaagcaacaaactgcattcagttttaaatgaacatattttatttagttttatataaaatatattattttctattctgatattttcttttgcgtatgtgaaggtatagagaatatgtgcatgttactaaaaacaatgaaaacaatgtatttataatggcaatatagttttgttcttaaatttcaaaatttaggcttttagggaaaagaaacacctatttcttttgaaaaattatcctggtaataaatgccaatataaggatatggttttttttcctcttaccctttgatacctgtaactactaaaatgaaaataatagactttggatttgtgtagtaatttggaaatataatacttttattcataaaagtaatataagaagattaataagtcttacacccaggagttatgtttttagtttttgaagataacattctagaaagagaaattagaagggcagataagactatatttaagaataaccattatagaaaatagtactgacttttttaaatgtttaatcctaagtgttctcattgtaatatatattttacagtatttataaaagataaaataaagttgttgtttccctgtatgtacagattgaacaggaagtatcactggacctgattttagtagaagagtatgactcattaatagaaaagatgagcaactggaattttccaatttttgaacttgtagaaaagatgggagagaaatcaggaaggattctcagtcaggtttgctttcaaatatctactttttaactgtaaattaatttttcttaaatctttataaaaagcaaaatctaatatgtaatggtttaagcactagttcaacaatgacattgttcattatttttttcagaaaaaaataaatatatacataaaacaattatatataagatgtagatcatactattatatatatgacaagtagtttatttgaccatattaatgggatttaatttatgccaaagaaataataaagatttacattttcttgaatgtggaggttgaaaaggatatgaaaatatcatctagttctaaccattgcaatttaagcttcatttttttcacctgcactccctatactttacccaaggccggatgattcatttcatgctagaaccatgggaaagtactttgattttaccacccagactcagggttatacctgatgggtccgcataacagcatcagattaactgccccaaaatattactctcattaattactttcatatcttatttatgaaatgcaaaaacgtaaggataaattttgtgaaatatataagttcatttaattgaagttcttagggataaaaatgtgataaacttagtattgttttgaattttgtttttaatacccaggactagattagaatagaattcacatgaccttcagtaaattaggaataaaaagctaaggagaagaatggaaaaattaaaaattgggacatgatatgtatggtaagccttctttaattttcagtggctttagggtgacatcttccattctgatttttttgaaagaattaattgtaggcaagttttaaataaattattaaagacgtatattaatacatggttaacattccagaatacaaatcacaaaaacattatactcagctacaaatagaaattctgatttttaaagtaaactttattttaattgacatttaggttatgtataccttatttcaagacactggtttattggaaatatttaaaattcccactcaacaatttatgaactattttcgtgcattagaaaatggctatcgagacattccttgtaagtattaacatattttattatttaagttcaaataatatgggttttgaaactctttatcatctttctcttcagatggtcccttaaacacttttaaaactgcttgtttgaaattttcttttttttttttcttgagacaagagtcttgatcttgtcgtccaggctggagtgcaatggcgcgatcttggcccactgcaacctccgccccccacgttcaagtgattctcctgtcttggccctcgcaggtagctgggattacaggtgcccgccaccacacccagctaattttttatatttttagtagagatggggtttcaccatgttggccaggctggtgctgaactcctgacctctggtgatccacctgccttggcctcccaaagtgctgcgattatagacgtcagctgccgcgcctggcctgaaaaatttttaaatggagttttaaaaagaatatttgtattatactacctagatttaactgactactgttaacattttgtctgttttttgttaacattttggtatatattctccaagagttcttacataaatttattttttgtaaaggtggtcataatattgatacatatttatgatctgctttttcacctggttgttatacagtatacatctttctatttttaaaattaattgcctgtgtactttatctttttaaaagttagtcaagagtttcagaaaatcattcacttaaaaatgcttaaaattgatcatctaatttcagtttttaactgtgttctgatttatggaataatttaatggctattatatattatgtttgaatataatttgagtttcatattagaaaaagatggactgtctttatatattgtctacagtttccctccatgtggacacatttttgagaaattaattctataaatagtgaattattcttcaattggcataactcactaataatgtttaataatttaagatgagttacatatactataatttccacttatatattgtgcattcaaaaaagtggttggattttataaatggaatatagggatactttaagatggacttcaagggaaatggaacgaaaagaaagaggtggtaaggagtcttcactgtcagcttcagttaggatacattagttaagaaaatagtctctggacctaacttttctaaactttaaaaatttgtgaatgagaataacaatagtacctactccataggtagtactaatataagataattaatgtaaagcacgtatcagaattcatgacacttagtaaattgttagtaaaaggtggtgatttattaataataattaagttcccagtgtacgccatgtcatatctataggcaaaacaatattattttatctactaatgcatacatacacattaaatatttgttgaagtgttaaatttttattggatatcgacattaactgcaatcattagattcacataggttatcttattcaatcttttttggcaaagttgtattatctaacttttataggtgagaagtaaactcagaaggatctttcccaagattataaaactagataccaaagtagtgtttcagttttaggtctatctgagttctgaagcctatactctttacactatgccacattgccttttcacatagttgaatttcaggaaatagatgttttattgatcatatatgatgtgtcagacactgtgctggatgctttcacatatttagtatttaattcctgtggcaagcctgagacatagtatttctgacctttttgtgggggacacaaatgtaagtaaccagaatttgtaactgttctgtgtacaaaactgttttgtgtgcaaacatgggtctctgtaatccagacactacatgatatttttgaaagccagaaaatagccaccttgagaacattttccaatgcctttcaatactccttggttatcctgccttttctttggcacctttactatgttttcatagtatatgggaaagtttttaaaagataatttttttaatacatcaagagactttagatgaaataaaattcaattgtggggaattagtctgtcacatcttttttatgaggatatagtatgactaggaaattattgtactttttaaatgttgtgtgttaaacctaacagaaaaacgttttggtgactttagatcacaatcgtatacatgccacagatgtgctacatgcagtttggtatctgacaacacggccagttcctggcttacagcagatccacaatggttgtggaacaggaaatgaaacaggtacttccttctacaaatctcttaattattttgatcaggaatagtaaatcaagctttctcatttcattacctctgttcttttaagtttttcattaagtaaccgtttagtacatacgaaggactgtgtacgtttttttaaccacttatccccaagttctactgtgtaagttttgatgcataataatgacatgaaaaattttaaacctgatacccatcttaaagatagattaatattcagtactgctggatctatcatgtttccttctttcccccattcttttgttttcctcactgaggtagccactatcccgaatattatgataattagtcctttgtttttttaaaaaaatttttttttttgtttcaagtacatcacatacatttaaaatacataacattcaaaaaccaaagagaacattttcaaaagccttgcaaagtatttcaatgatgacattaaaaacttttataaacaaattttgcttccaaaaaagttaatgctattccttatcataaatataatagtttatataaatacaatgaatcataacatttatagttctcttattctagcttattaaaagggccaggcctggtgactcatgcctataatctagcacttctacaggcttaggcaagaggatcacttgaggccaggagtttgaaaccagcctaggcaacaaagcaagaccccatctctacaaaaaaatttttaaaaaatttagctggatgtggtgacacacacctgtcctagctactcagaaggctgaggtgggaggatctcttgagcccaggagttcaaggctgcagtgagccatgattatgtcattgcactgacatatatcaagacagaatttgctcagttaccaatacttgagaaataacattaccatactaaccagtgtaaatgtcatagactcaaccactgatattactttttacattttggtagttgagtctaaagtatgcattatttgtttaatggatttgctttatgtcactggttcatttttgtctgccatctgtatttattctttctagtgcccttcattccttccaccagtcctgtgcttttattagagataattttcttcaacttttttgttttagctgtcattttgtcttagaagaatatatttatattttagcatgtttgaaggtattattccataatcttgtgactttcacagtttttgctgacaagtcaagacttaggtcatattgagaaatataatatataaatataatatgttcctttttctctttcctattggtttttagcattttaactatgatgtactcatgtaatttttttttgtattaatcctgcctgatgtttagtgaaccttttgaatatgttgattggtagttttttactggtttctatcatgctcttcaaaattcagcctctccattgtctaattccaaagccgctcccacatttttaggtgtttgtcacatcagtacctcacttctaggtgccaaaagtctgtattagtttcctattgctgctgtaataagttaccagaaatttagtcactgaaaaccacacaaatttattatcttacagttctggaggtcagaagtccaaaaaaggcttcactggagtaaaatcaaggcatcaacagaactatttttctcctatatactctagaggagaatttgtttccttgcctcctccaattacactccttggctcatggccctttctttctttctttctttgtttattttggagacggtgtctcactcagtcacccaggccagagtacagtggcttgatctcggctcaccgcaacctccgcctcctaggcgggttcaagcaattctcctgcctcagtctcccaagcagctgggactacagacgcacgctgccatgcctggctaatttttcgtattttagtagagatggggtttcaccatgttgcccaggctggtctggaactcctgagctcaggcaatccgcccacctcagcctctcaaagtgttaggattacaggcgtgagccactgtgtctggccggcccattctttaaagacagcagcataacatcttcaaatttctttttgaccctgaccttttgatctttccaaggaactagtgaaaatcaatccagctctgcaaccttggctttctgtgcagaacacacttaactgacagtgactctcttaattttagtctctcttgtagtctggataggctgagaatttcctgaattatcaagtccttattcctctttgcttacgagttctcccccaatctttctttttcctctcatatttactataaacagtaagaaaccagactacaccttcaatgctttgcttggaaatttcctcaactaaatgtctaagttatcatttgtaagttttgtattccacataactgcaacacctaattcagccaaattttctgttactgtgtaacacggattcccttgcctctagtttccaataacatgtttctcatttccttctgagcattcattggcaatgaccttaatgaccatttttctatctccagtctgttctcaatgacttaggtatagtattctctaagacaatatatgttttctctctcatgctgcacacttccttctgagttcttactagcagtgttatgagttctcatacatagtgttatggagccaagtatctgtagaagaaaggaaaccaagtagctttgggaaaccaaatagctattgcaatggaaaattatgatgaaaactaagacaagaaggaccatgggatgtgctgtcctattctcactgcactggagaactaatggaaaataaatgacaagtttagggctgtaattaatggttggagaaccaggtagcatctctgactgacctaaaagaaacccttattttttttttaatttattttattttattttttttttgagacggagtctcactttgtcgcccaggctggagtgcagtggcgcgatctcggctcagtgcaagcgccgcctcctgggttcatgcgattctcctgcctcagcctcccgagtagctgggaccacaggcgccctgccaccatggccggctaattttttgtatttttagtggagacgggttttcaccgtgttagccaggatggtctcgatctcccgacctcgtgatttgcccgcctcggcctcccaaagtgctgggattataggtgtgagccactgtgcccggccaagaaacccttattttttatagtaataggatcataacttctgaaaataaaacccaatgtctgatcctgaagttgcttgaaatacaatgcaaatgagtttgtggcctcagtagacttcttatgttagaattaagatatcaaatgggaaataaaggatcctgataatcaaaaagagatcatttggatagatttaaataaatgttgccttgtattccccaaatcctgctgattcttcatgctgggaagcagtcatttctccttgtgttgattgcctgaaaaccctgtaattacctcacttgagattcttgatttatagggaaataattcacttctaaatccaactccactgtcactcatttctttgagatccataattaaacttaaatcctgcagatcttaggggaataagtattaagtctgaacaccagaataatttaccaattcatattggtagaaacctgggggatatatgtctgaatagacttaagggtgttagaccagggagaaaggaagatgtacctaccagagattctggagtcagtgtattagcttgagcaactggcagtggctctaacagtttgcctcatgagttgtctaaagtataggcatcagatgaagtagaattgttgaaactccttgtatactgtagaggaaggaatccagaagctcacaatgttaagatgttgaaatggggtgatcatattcaattttatcacccatccctaattttatccccaagaagtatcctcctttatcacagtggtgagaaatatatttcagcattaattcctggagagtgaaatgctatgctggtcctacagccagagttaggggcctatggaatttaggtgataaaaggattttggcctgggttcatctcataatggtagttagcagaaccacacccattttctgaatgtatagtttgagtaaacatattcagcaactgtcagaatcccttcatcaattccttgatctttggaaagaggaccatcgttgtaggaaggatcaaatggaatctccaggaattgcctcattctggcaaaacagtgaaccaaaagcagtataccacattcctagatgagttgcagaaatcagtgctactagcaaatacttaatagatgcaggaatggtgatttccatcacattgctgttcaacttaattatatagcttttacacaggataagtagatcctggaaaatgatggtggattattctcaatgtaatcaggtggttactctagttgctacagctgttccagatgtggtctcttcttttaataagttaacctaacttgtgatatttggcacagagcaattgatctggagagttgtttttcctccataactcatagcaaaattcacaagaagacatatatttacatctggcaggcatcacaatacacttctattgtcttagttctgggctatgtcaagtctttcattctctgttataatctagtctgttcccgtaagttatcaaggtcagccattacattgatgagataatgatgaatagctccattgagcaagaagtaacagatatcctagatgccttcataagagtgccagaagatgagagatgagaaaaattgctaaaaaattcagagatctgtcatatcattgaagtatactagggatccagtggtctaggacatgttgagatatttcctccgagttgagggataactgagacatttgaaattctctacataaagggctctttggattctgaaggcaaattcatgacttctgagtactattgctccaaaatactactgtaaggctgtatgtgcaacccagagcaagagaagcatgtgaagcaatttctactcgttgtgcaaattactctgccatttttccatctgactgccaaaagaaaatgtcttttgcagatagagatcccctttggagtctctagaagaccactacaagataattacagtgtaaatacatggagttttgaaacaaaaccaggcagctttcctcaaataattattttcctttctgtaaaagcagctaaattgttgttgcactttggtagaatctgaatacttggccatgggcactagattaccatgttacctgcccataatgaatttggggccctctgatcctccagttcataaatttgtcatgtgcagtagttctcaatcatcaaggggaagaattacttacaagattagttttgagttgctcctaaaagcacagaatgtaagttcagacttccatgacatttattcctaatacaccaatacctcttccttaatccatagttacggctttgtggggaattccctatgaccagttgacttaaagagaaagaccagttgccctggtttataaatagttctgcccaatatgccagtacttcctcaaagtggatagctacagcattgtaggatcactcaaaggtatcttttgaaaggtaataaggtaaatccttccagtgagcaggtcaagcggtgaatcagttggtcaagaaagagacatggccagctgaaaggatctgtactgatttatgatcagtagctaagagcttccttggatgctttgggacttagaaggaaaaatattttaaaattggagtttttaattggacaaggtgttttagttagggggtttatggctaaccttcccagagtggaaggtggatatttgtttgcgatgtgaatgcttactatgatgcttaattttacatgtcagcttggctgggcagtagtacctacatatttggtcagacattaattttaatatttccttcagggtattttttggatgagattaacatttaaattgatggactttaagtaaagcagataaccctccataaggtcggtgggcctcatccagtcagttgaaggccttaatagaaacaaagagtgacctcctctgagcaaacaggaattccaccagtagacagccttcagacttgaactggaatatcagctcttccttgggtctttagccaatcagcccaccctgcagattttggatttgccagcctccttaatttcatgagcaagttccttaaaataaatctctctctctctctatatatatatatataaaatatatatatgaattatatatattcatatatatatatgaataaccctcactaatatataatatttgccaaaggccattcactgcaaagaaggctcttgatgatcaggtggacaaaatgatctcttatcttatagcgatcagtctctttccctatgaactccagttcttattccgtgggtttatgcacacaacagctaagtgtattagtctgttctgacattgctataaggaaatacctgagactgagtaatttgtgaaggaaagaggcttaattgagtcacaattctgcggctgtacaggaggcatggctggagaggcctcaggaaacttacaatcatggctaaaggtgaagggaaagaaaacaccatgtttctcaggctggtctagaactcctgagctcaagtgatccacctgcctcggcctcccaaagtggtgggattataggcatgagccaccgtgcctggcccatgctgttttgattactatcgctttgtaatagattttgaaatcaggtagtctgatgcctccagctttgttctttttgctcaagattgctttggctacttggaatgtttttgtggtgccatatgaatttttttttctatttctctaaaaatgtcattttttttgttgctaagtatgtagaaatgcaattgatttttgcatgtttatcttgttccctgctaacttgatgaactaatttattagttctaatagtttttcagtagatttcttgggatttcctacatatacgagattaggccatctgtgaataaagatagttttgcatcttcatttccaatctggatgtcttttactgaggcgtccttttaaatgtgtcagcaaatttttaaaatcacagttttctgaaacgaagtgaataaatgggattctaagtagttatgtttcattgcccttgccaactgtgttcttttttgtactgttatttttttggaaacatatataagctaatgttttaagatcctaatatataaattccaagtaattactgaatttaaaaggaaatattttgccatgtttgatttttaaaatatattttaaaattgtagggaaagtccagaatgtgtatcacataggaaaattccaaattattgactctgtattgatatttaaagtcttattagaaatttgagtgcttacatatatcattatgcatataatttaactgcctcatgtttgctttttataattatttaaaaaatagctctaagccggtgtagtggtacataactctagtccaagctactcaggtggctgagggcaggtcaattgagatgaggaattagagggtgtagcgtactattacgattggacctatgaatagctagctgctgcactccaacctgggcatcatagcaagaccccatctctaaaaacataaattttaaaaaaatgctctagtgtgggctattccaaaacttaattttgatacaaattataaatagcatgaaaataatgagatatatttataattgtcactagtgtattaaagtcatgttaaaaaattcttgtgatggtgtattgagtcaactaaaataggattaaataattcttttggactttaacaagccagagcattatttctaggttcccccaatgaatacaaccaaggaaactttgtacctaatatctgtggttttatgtgtctactttaaatatagtttctttttccttcttatactttttaaaggtttcttttgcaaaaataatagaatgatcatctagatagataaagccaccaaaaaagaagaaatcaatggtaagatattaagacaccagaagcacagtgtggatagtgaacatattgtttctaagaagaggataaaaatagagttatgttgactgagatgttccccagttttccatgccttttcattttccactattttttattccgttatattatatggagcttcatgaaagaaaacaaaagggagataaggagttgtagttagggctacaaatgaaatgtaatctttccggatgagatttgaaaagcatctatgtagagaagcttagtttggtaagatattaaattcctaaatctttgtaatgttttcatcaaattttattctctagtattgcctttttctgttatatcatatatcctggccattgtatctatctagtcattaaacagcaaatatttagaaaatcagaggtttttaaaattattatttgcctgagtaagcatcaaacttgtgtgagaatcctatcacgtcttgtaaagtaagcaacttcagggtcagatttaacactgttcctctctactaacatgttaaattgggaataatatactcttttaagttcatagattttagttcttacttaaatcagcaaataaaataagtaagcatattacctatgagaatcccctccatagcaaaattgtgaggaatttatgtgctaatgctggtttattttgctatttattgtttctcagattctgatggtagaattaaccatgggcgaattgcttatatttcttcgaagagctgctctaatcctgatgagagttatggctgcctgtcttcaaacattcctgcattagaattgatggctctatacgtggcagctgccatgcatgattatgatcacccagggaggacaaatgcatttctagtggctacaaatgcccctcaggtaggaaatatttttaagaacctttaaagagtaattctgaaattttcagtcatgctgtgtatccctttataaatcattcagttgaatcatatgtccaatccatctgactttaataccctacattttaattaattggataacacatggcattaatgtgatgtgtgctaggaaattaggggaagaatcaacttcttgaactagaaaataatagacagtttttgaaacaactcattgttttgtgaaattctagagtccttgctgtcaatatttttgtctttaatcaaaccagcaaaactctgactgtatttaagatttctgttccgctggagccaagatggccgaataggaacagctctggtctacagctcccagcgtgagtgacgcagaagacgggtgatttctgcatttccatcggaggtaccaggttcatctcactagggagtgccagacagtgggcacaggacagtgggtgcagtgcaccgtgcgcgagccgaagcagggcgaggcattgcctcactcgggaagcacaaggggtcagggagttccctttcctagtcaaagaaaggggtgacagacagcacctggaaaatcaggtcactcccaccccagtactacgcttttccgacgggcttaaaaaacggcgcaccaggagattacatcccgcacctggctcggagggtcctatggccacggagtctcgctgattgctagcacagcagtctgagatcaaactgcaaggcagcagcaaggctggggaaagggcgcccgccattgcccaggcttgcttaggtaaacaaagcagctgggaagctcgaactgggtggagccaaccacagcccaaggaggcctgcctgcctctgtaggctccacctctgggggcagggcacagacaaacaaaaagacagcagtaacctctgcagacttaaatgtccccgtctgacagctttgaagagagcagtggttctcccagcacgcagctggagatctgagaacgggcagactgcctcctcaagtgggtccctgacccctgacccccgagcagcctaactgggaggcaccccctagtaggggcagactgacacctcacacggctgggtactcctctgagacaaaacttccagaggaacgatcagacagcagcgttcacggttcacgaaaatctgctgttctgcagccaccgctgctggtacccaggcaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcccttccttacaccttatacaaaaattaattcaagatggattaaagacttaaacgttagacctaaaaccataaaaaccctagaagaaaacctaggcattaccattcaggagataggcatgggcaaggacttcatgtctaaaacaccagaagcaatggcaacaaaagccaaaattgacaaatgggatctaattaaactcaagagcttctgcacagcaaaagaaactaccatcagagtgaacaggcaacctacaaaatgggagaaaattttcgcaacctactcatctgacaaaggattaatatccagaatctacaatgaactcaaacaaatttacaagaaaaaaacacacaaccccatcaacaagtgggcgaaggacatgaacagacacttctcaaaagaagacatttatgcagccaaaaaacacgtgaaaaaatgctcaccatcactggccatccgagaaatgcaaatcagaaccacagtgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacctagccatcccattactgggtatatacccaaaggactataaatcatgctgctataaagacacatgcacacgtatgtttattgcggcattattcacaatagcaaagacttggaaccgacccaaatgtccaacaatgatagactggatgaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccgcatattctcagtcataggtaggaattgaacaatgagaacacatggacacaggaaggggaacatcacactctggggactgttgtagggtgggggaaggggggagggatagctttaggagatatacctaatgctaaatgacaagttaatgggtgcagcacaccagcatggcacatgtatacatatgtaactaacctgcacattgtgcacatgtaccctaaaacttaaagtataataataataaaattaaaaaaaaaagatttctgctcctcctatttaggcccattgtatggctagaaagctataatggttgagaactattaatcttttttgttgttctcttttttcccttaagatttgccttaataccagagctaaaatctcttacttctgaatatattagtgtatgtaaaaattcttctggtatattatttttgtacctagtatagctggtaaaatataaaattcctttaaggtcacaatttgcatgaaagaggcaagagttctcaacaaatagatactgtaattgcaatagctttaaacattaggacttggaactaaatatgtgttgtgttttgctttgttttgttttttgagacggagtcctgctctgtcacccaggctggagtgcagtggggcattctcggcttactgcaagctccgccccccaggttcatgccattatcctgcctcagtctttggagtagctgggactaccacacccagctatttttttttttttttttttttttagtagagacggggtttcactgtgttagccgggatggtctcgatctcttgacctcgtgatccgtctgccttggcctcccaaagtgctgggattacaggcgtgagccaccacgcctggccctaaatacgtggttttaagtagaatttagtgtggttgtggtttaagcagatttttgtgtggtagctgggtttgtttatgctggggattcctgaaatgtgatctgtgtgtttctaattggatgctttatgaagagtaggtgctcagtgatagttgctgaattcatctcacttcccacttctttattctatgtttaaaccttggctctgatcctttcattttctgtagccattttctgtttttcttttttttcttcaatctctttcatatactccaacttttttaaaaataggagatatattctcttgaattgtgagcatgtgtgttggggtcgggggaaggcatgtagggaactatgaatatgtatatgtgtaaatgggtataatggggtgtgtgtgtgtgtgtgtgtgtgtgttaatgggttaaaagggccatgtgattcatttatccaatgagactttattaatagctcatgatttccagaggtaactttctgattaatttaaatctagttactagtagttgcccactttctaagtattatttttttaaaaaagtaccttctaagtggcacatattttcttatttgcaataccattctgtaagaatcagatgcccattctctcaaacctagcacatcataatctttgaaaatcctagtcctttggtgaatcatagacctgaggattaatggcatagtggaaaaagcactggacgagattaaaagtcctgtcttagatttctgattgcccacttattagctgtatgacctcaaataaaggtttattcctctgaacctaaaaatagttatctgatatgattaaggaggtaacatatggaaggttttatactgtttctgatggcatgagaagctcctgaatcagaaatcacataggtagaagttacttactgttctagtccactctgctgttttgttttgctttgttttgttttgagacagagtcttgctgtgttgcccaggctggagtgcagtgacgtgatcttggcccactgcaacctccatctcctggattcaagtgattctcctgcctcagcctcccaagtagctgggattacaggtgcctgccaccatgcccggctaattttttatttgtagtagagacagggtttcaccatgttgaccaggctggtctcaaactactgacctcatgtgatctgtccgcctcagcctcccaaagtgctgggattacaggcatgagctaccatgccggcctactctatgtttttattacagctttcattttcgtaaagtatatcttccctcaaggatgttagaaatgagtgaattccaatgttaactgtctcacatgaagataatttaaaacaatgttatatgaacaacttatacaagttgcatactcaattgttgtcctaatcaaaatacagttgtgaagtctgaacatgatatcaataatcacgttatttctaacttctcattgttacgaattgccattagatgaagccataggaagtgctagaatggaaaggagatggattagagagttcagctgtgaaaatgcatagcctcttacctagtctccttgcttgttgtctgctctccttcagtctgttctcaacatgtcagccagaatgtgaccctgtttcagtgtgttgcatcactctgttccagactcttttgccaggcgctgtggctcacacctgtaatctcagtgctttgggtggctgagacatgaggattgcttgagcctaggagtttgagaccaatctgggcaacatttgagaccctgtttcaaaaaaataaaaacaaaatagtaaactctccaatggcattcaccttacccctagtaaatgacaatcataaaatgttctgcaaggccctacattattggtcccattaagtctctctctcttttttttttttttttaacttactcaagtctagtctcactggcttccttgctaataccatctctgtccctttctgagagtgtttgcactttctgttctccctgcccagagggcttttcctttagatatccgtatacgcattttgtcacctccttccatctaaaatttcaaaatccccttctttataccattatgctccttctctgctttttttccattgcagtgatcatttaggatactatatattttgtttatgtactttgttttttatatgtatcttctcaatggaatataaagttccacaagggcagggatttttgtcttttattccataatacctagaatagtgcttgacatacaaaaagcatttagtaaatatttgttgaatgttgaaggatgtctgaattctttgctctgtagtactcctaggttttctgaaaaatgttctgtgcttcccaaagtaacgaagtttatgaggccttcttcaactagcacctgtgagataaggacccttgtaaaaatctagggcttaatgtggttaagtaacaaagtaggttctttcatctttggaaactcagtgggtctagtcaggccataattaatgaaagatattatagtttcagtgtaatatagacagtagcatataataccaccagctgggtcaagcattcttcttcattctcatggtaaggaatgtgtgctagaaagatacaggaggattcttgccacgaaagaaggtgatacatatagtcaggtatatcctggaggaatgtcagtattaataagattctaagagatttctgagctatttccaaatgagaagttggctgaaagatgcaggttagtgcttgagatagtaaaatttctggaatatttttatgagactgggtaaaaggaaacaaaattttaagttgagatttttaaatgttttgtcttccaaaatatggattaagatgactaaacacatgaatctgttaccccttcttcctgagaatgcattaaaataatagtaagatatgaagttcattacaacagagagcagtaagaggaggatgggtattatcaccagcagataaaagttttttttataacatttctggaaaatgaaaaatggatgaatattgacagataaaacaaaagtacccagcacagctggaaccccagagactcctgttaccatttgctcctgcttgctctccctgtgcatacacacacctttatgcagagtgactaaaaccctatgtttacctccaggcagaaaactcatctcttagatattgaaggaactgcctggagagagtaacagttcctggagtgggtattagtagtctaaagtaaatttctctcattctagacatctaatagctggcacccattattctaaagcaaaacttgctaggtaacaaaccctatccacatttacatagttcccactcactcatcccaaggggagagactccacaataaaacatacataacagcagagagattacaactgaaatctagaattttttttttttttttgtgagacagggtctcactctgttgccaggctggagtgcagtggcacgatcttggctcactgcaacctctgcctccagggttcaagagattctcctgcttcagcttccgagtagctgagactacaggggcatgccaccacgcccagctaatttttgtatttttagtagagatggggtttcaccatgttggccaggatggtctcgatctcttgacctcgtgatctgcccacttcagccacccaaagtgctgggattacaggcgtgagccaccgcacccagtttaaaattcatttttctatatacacagaaaaccaaggatcatcagccatggcattaatcagaagcttggaaagaaaaggctaagatggaaagaataactgtcacagggagaatctagggaatagagaagcatctaattattttttttaaaatgtattctcagaatttgaaaaatattgcatccataaagtaagaacaggaaactataataaaggaacatcagaaaacaagttaggctcttagaaactaaaaatattactgcaggaaattttaaaaattcaatataagcattggaagtagaagtccaggtagtctgtcccaggacatagaccaggaagataaaaagagaatatagggaaggagaagataagatataggggactaggtcaagatgtgactagtggaagttctaaaaagaagggagtctttggattgaaggggctcactaagtgccaggaaagttgaatagagaaaaaaattcaaacaccacacatagcacatcatggaaaaatttcagaacaccagagattttgtttaaaaaaaaaaagaattcccgagaagatgaaaacaatacatctataaaagaacaaaaattcaactgtcattgtattttagcaacaatagatgctagacaatactggaatgaagtctctaaaattctaggggaatttattcatttatttatttgttcaagtatttattgggtgcatattgtgggataggcactatttaggcattgttatattaaataaaacatgggaaaaaatcttgcccctcatcgaacttacattctagtacagcaagaaaataaatacataaataatgtgtgtgagcaagagagagagagagagacagagacagagcaagagaaagagagaccaagagagacagacagagagagaaagagaagattatgacttaagagctaggaaataagtaaaatgagaggagataggaagtgctggcataagagtattattttcaagttagagttctatattcagctaagctaccattttacatgagagcaaaataatgagattctcagatatgcagtgattttaaacagtcatatcttgaccatcctcagaaagttattttaaaatgtatttcagcagaagaagggtggtaactaagataaaggaagataagggattattagaaatttttgaactgatacggtttgtctctgtgtcctcacccaaatctcatctcaaattgtaatcctcacatgtcaagggcagggccctggtgtgaggtgattagaccatgggggcaggttctcccatgctgttcttatgatagtgagggagttgtcatgagatctgatggtttaaaagtggtagtctcccctgtgtgtgctctctctccctctcctgctgtcttgtgaagaaggtgcctgcctctccattgccttccactgtgactgtaagtttcctgaggcttccccacccatgtggaactgtgattcaattaaacctcttttgtttataaattacctagtctcaggtagtatctctatagcagtgtaaacacagaaaagaacaaaccgagaacagtgtaaaagaatcctgagataacagctgtttgtcaagactatttctttaccctataaaaaaacaacaaaactagctgctttgtgttctgtggcaccttatttatctgctatctctctactgaatttttttttgagttgggaatattattttttaaatgaacaatctttcttaatctttttcacttgaagtgccttcttagttggccaggtgtggtggctcacgcctgtaatcccagcactttgggagtctgagaagggcagatcacgaggtcaggagatagagactatcctggtaacatggtgaaaccccgactctactaaaaaacacagaaaattagctgggcgtggtggcgggcacccgtagtcccagctactcgggaggctgaggcaggagaacggcttgaacccaggaggcagagcttgcagtgagctgagatcgcgccactgcactctagcctgggcaacagaacgagagtccatctcaaaaaaaaaaaaaaaagtgccttcttagtcatgagataatggctatgacctagatttttgttaatgtttcctcctgtttcttatgttttaaaaggggacatttgttcagattagtcagacttatcctttgtatgatctaagtccttcttatgtctgaagggttttctctttttgttcttatttaagtgttactatttgctaagattctgtcagtttgtattaaaccccttctcagatctttccaactcagagggtgaaaagtaagatttatgaccaactaatttgttttgccaaagtattgatgtatttgctgtagagagaaggatctatagctagaaaaagcaggtaacaagatgctttagcacaaagtcaaaggatgttagtttattgcagctccaaatgagctgggaccctgtcttttttctctgcttctaagagcccgcagtaagagctgaggcttcattatctgtttgcttgaaatgtttttcttatttggtttaagcttggtctgctgctctgtgtgctaccttcaagtattcttctaaagtagcattgacatttgcttcctacttactgcttcatgattctttcttgcctcccactcatctttgagcttgtgagtctactggggatcagcagggaaccccttccacttactcttcatataggctttttccttcttatgcagtgacttggttagcttttctcaatccattctcattttcaccatgtctttgaagtttccagtatggtcattatatctagattctaatactgattcagaccttcccccctccgcccattttatatttctttggcaatttcaaagggtaatttgaatggtgaaagaattccgaacttgctcatttttttaaaaaactgatcttgctatctgtaagtttattaagtcagctagcttcacagggcattcattgtacattgtgttgtattgagcccagaatcagattacttcctcctgaacagacagagctgttctcatagttaagtccttgtcacatttgagcatgaattagtcaaatcattattaaatgtaaatgaccccttagggagttttcgaagcttactctttctgtttggtatttataatgtttagaagttgtattacaggtggtatgaaatgcctttatatggctcattgcaaagtttaaatcataccattgcttttataaaaccaaatagcttaaaaaataatcacttagtgttatgcatctgtgcttaaatctaggctatagctaattttcacaaataagtagagctattcaattaagctctcagaatatgtatcctacctgagatctcattccgtccttctttctcattacacagtaggctccatgaaaacagggatagggttttaatttttatccctggcctttaacacaacttggctgtagaagttttttttaataattactatgcttatttaataatttaaagaattgcttaatttgtagaggtggaagaggctttagaaattctatactccactgattttaagtctgtattccaaagtcctagagtactgaggaggcacctcagggtcttctgctggagtgaagtgtagaaaaagtgagtagttccacaccatttgaaccagaggatttgtgtttttatctgttacatagttctgttttactcccaggccctgtgtgaggatgggaatccaggatatgtccatctcagacaggcaggtctcttacttaccctggacagtactgcttcctcttctttagtcaccatcaccattgactccagaatgactaaacaacagaaatgtattctgaaacctgctctagatccctaatgactttattcacagaagtttatctgagaaggttttctgattaaatgaaatagacctcaaagtatcaactttacatctcttgggaggcagcacggtgtctgcaaagataaactttaaagatatataaccctttcacttactagagctatgtatgttggaaggaaaggtgtatcttaacctctttgtacttcagtctactcatttataaaattatcacaacctattttcacaggtactaaaatacctggtaaaatgcctagtatatagtaggtattcattgtttgtatacttccaacctgatattaaagatattaaactttaatatctttgaggtgtctgcctcatttttctatatttctttttaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggtttgttatgaaaattagtgcctgatttaaaaaatctttattgtcagtgttactgataaaatatgttttttaatgttaagttagaattattactacttaggaagtaacaataaatagttgatataaaataatatatatgcctatatttttaaaaataaacatttttattgttatggtaacatttcctaaaatattattgcttgttatattttctttcgacacataaacttatactattgtgactttatttcacatatttttcacatagaaacaaaccagttattagaaacaaaccagttatttcaaatgagtttaaagagagatttgacaaagccatgctcagtgtcaagtaaggcattatataaaattaactttatgtgtttcttaagaatccagttaattatgtctacctcactgcacctgttataccttctttatattagtgattctttagctggctagtgtagggaaaaggaagcaccctcttctacttgagaataattcattcattcaacaagtatttattgggattgcccactatgtacagacattgtactaggccaaagaactcatattcaccaggggatcaagaatcactgccccagtatgacggtggtactcatgggactatgctttatccctcagacatttgaggtgaaaaaagttgagaaccactgctttagattcccaccctggcttgcaggaagctgctattttcttgatgacttttgtgacctaaaagaagctgtacctgcagggtagagaaactggtaacaaaggagtactagattagacctgctggaaggagacccttatatatgttgctgtcatgacattaatgaaatgcttataaaaatcagtgagaagtaagggtacctttaaaattatttcatagttgtatagtcttattcactttaatttttaaataaaattcatttaagtgcttaagtcaccttttataggtaaaagattatctaatacaatactttgaatgtgtattccttaaagacttctattttgaagtctctcaaaaaaatgccatatgaatggggctctagacttcctattaagtttcaatcaaaagagctcttctctcaagtgttttctatggtggtgttctacatatatatttttttttttctgaaagagtttggtgccaaaaagcaaccatcacactgaagttcaaaagctatgatgtggctcattcttttcattttttacaaaatgaaattttagttcttgaaaggctttttttcagctaataattatcatttatttaaataacaatatttaacattttccgtgaacaaggcattttttcatttattaatcctcatagcagcatggctagattggtactacttttcctacttcatagatgaagaaagttagattcgaataggttaagcagttttttcactgttacacactgaatttttgattcagaatacaacttgctgattcatgacattctgagtcaggatttaaaactatagggccagcttctcagacttgtgttcagttcactatatcatgttgcctttcacagcaagggcaaacttctctagcttcttaagtgttcttttttgaggtagaaataagtagttataattcttatatgattttttgatattgtgtatgtactatacttaataaatacatatatatatatatacacacacacacacacatataattcatgattctttgtggtaatcacaaatattgaaacccatggttagttatatgttttgctagaaagcattttttagaaaggaaatttaaccaatagaggtccatattatggaataagctgattttaaaaagaactatttgctgaaatttctttctgtcatttagacaggaaacagttttaagataatttggtaaaagcaaacaaaacaacaagttttaaaaatgccttcagaacctaaaatgatgttgtttttccaaaataggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcaggtaagttgaaacctgagcttggtgggatttttaagagctgtcatgagaagacactactctttgggttttggatagctttattaagtgtttgaaatctgagttgctttgactgggaagggttaaaaattgttgcatttgctttggttcttagtattttctgtgttctgtttgcctttgctgttaaaattttaaaaaataacttattccctatcttgactgagctgaatatactcatgagtctacaggtaaggctgttagcagccgcaaatccgagtttgcagcaacctcaattcttgccccctcagaagaaagaattcaactgaggggcataaggcagagggagagactgaaccaagttttagatcagaagtgaaagtttatttaaaagctttagagcaagaatgaaaggaagtaaagtacacttggaagaaggccaggcgggcaacctaagagatcaagtgcatggtttgacctttgacttggagtcttatacattggcatgcttccagggttgtgttacttctcccaattcatcctttgaggtggctgtcacatgtgcagtgacctgccagcacttgggaggggccacatacacagtgtgtttactgaaattgtactcatgctcacttgaggcatttttcccttaccagcccagtgttcatggaagaaggtcatataccaattaaactccaccattttgcctcttagtgcacatgcttgagcccactcacccacctcctgagatcttaccaggaagctgctgatcaccagtttctgttgggtgactgcctttccctggtgccagctgtgaccaattattattttagagagacagcttaacctatcacctgatggtcacctgacatttctgatggggttgggggtgggccctctcctgctctgcccatgtctgcctgactactttctataacaagtctagactacattatgattccaaggtctctttcaaccctgagattctgtaacctagaagaatttatttccagatgaagtggtttttaagttattcagggtgtgctcagaatatatttaaagaatatcaatccattttcaattctgctataaaaagactaactccctgcagtaggaacatcaactgggaagaaatccggacagagggctacaaaatggagagaatagacacttagtggttctcaaggattcaaagatataagcaggctcttttgttcttaaatctttttttgagacagaggctttctctgttgcccaggctgtagtgcagtggcgcgatctcggctcactgcaacctctgccacctgggttcaagcaattctcttgcttcagcctcctgagtagctgggattacaggtgcacgccaccatgcctggctaatttttgtatttttagtagagatggggtttcaccatgttggtcaggctggtctcgaactcctgaccttgtgatccgcccacctcggcctcccaaagtgttgggattacagacataagccactgtgcccggctgttcttaaatctttaatttttttttaaattattctttaagttctgggacacatgtgcagaaggtgcagttttgttatataggtatacacgtgccatggtggtttgctgcacccatcaacctgtcatctacattaggtatttctcctaatgctatccctcctctagccccctaccccctaacaggcccccatgtgtgatattcccctccctgtgtccacgtgttctcattgttcaactcccacttatgagtgagaacatgcggtatttggttttctgtttctgtttttgctgagaatgatggtttccagcttcatctatgttcctgcaaaggacatgaactcatccttttttataactgcatagtattccatggtatatatgtgccacattttctttatccagtctatcattaatgggcatttgggttagttccaagtctttgaaaagcattcctatttctccacatcctctccagcatctgttgtttcctgacgttctaatgatcgccattccaactggcataagaggttatcccattgtggtttttatttgcatttctctaatgactactgatgatgagcttttttcatatgtttgttggctacataaatgtcccacgatgcataatcattggattccccagggttgaaatgaaggaaaaaatgttaagggcagccagagagaaaggttgggttactcacaaagggaagcccatcagactaccagtggatctctctgcagaaaccctacaagccagaagagagtgggggccaatattcaacattcttaaggaaaagaattctcaacccagaatttcatgtccagccaaattaagcttcataagcgaaagagaaataaaatcctttacacgcaagcaaatactgagagattttgtcaccaccaggcctgccttacaagaactcctgaaggacacactaaatatggaaaggaaaaaccgataacagccacctcaaaaacataccaaattgtaaagaccatggacactatgaagaaaccacatcaactaacgggcaaaattaacctgctagcatcataatgacaggatcaaattcatacataacagtattagccttaaatgtaaatgggctaaatgccccaattaaaaggcacagactggcaaattggataaagagttaagacccatcagtgtgctgtattcaggagacccatctcacgtgcagacacacataggctcaaaataaagggatggagaaagatttacccagcaaatggaaagcgaaaaaaaagcaggggttgcaatcctagtctctgatgaaacagactttaaaccaacacagacagaaaaagaccaagaagggcattaaataatggtaaagagatcaatgcatcaagaacagctaactatcctaaatatatatgcacccaatacaggagcacccagattcataaagcaagtttttagagacctacaaggagactcagactcccacaaaataatagtgggagattttaacaccccactgtcaatattagacagatcaagacagaaaattaacaaggatattcaggacttgaactcagctctggaccaagtggacctaatagacatctacagaactctccaccccaaatcaacagaatatacattcttctcagcaccacatcgcacttgttctaaaattgaccacataattggaagtaaaacactcctcagcaaatgtaaaagaatggaaatcataaacagtctctcagaccacagtgcaatcaaattagaactcaggattaggaaactcactcaaaactgcacaatgacatggaaactgaacaacttgctcctgaatgactactgggtaaataacgaaattaaggcacaatgacatggaaacggaacaacctgctcctgaatgactaccaggtaaataatgaaattaaggcagaaataaatagacacaatgtaccagaatctctgggacacagctaaagcagtgtttagagggaaatttatagcactaaaatgcccacaggagaaagcaggaaagatctaaaatcgacaccctaacgtcacaattaaaagaactagagaagcaagagcaaacaaattcaaaagctagcagaagacaagaaataactaagatcagagcagaactgaaggagatagagacacagaaaacccttcaaaaaaatcaatgaatccaggagctggttttttgaaaagattaacaaaatagaccactagctagactaataaagaaaagagagaagaatcaaatagacacaataaaaaatgataaaggggaaatcaccactgatcccacagaaatacaaactactatcagagaatactataaaatttttggcattaaaataatctttccactttgctgaatctgccattttttggggtcccgttttgaggcttcctacaatgtaggagtgcactgatttcctgacatgcctaacattttgttatctccaaaatagcaactacacctttttggctttggaattacattccttaggaatccttgttggccctaattatcaggaaaggtcaacatatctactaggtgagggctttcttaacatgagtggaaagtgggagtaattgagcctatataaccatgcacctggtatactttgttacttccagattgtattgaaaatgtgcaatgttttacacccaccagctaaacatcccaacacaataatgtatactctgctgtttataagttacaaaatgccgtactgtataatcatggaaagattattaatattttactattatctatttaaattatatttaatttcgggtagtaaatggctatatttacctaatttgtaagattatactatgcagtttgcatattctcattctcagtgataattgaaacttgctttagagctcgcccatggatctcatgtttacaaaagaggaattttatgctagggaaaatgttatctttatattatatgtacaaatgggtaataaaaaataatagtgtatgtaaattttagaaaattcactagttcagtgagagaacattagaaatattcatttaggtcccgcatatcattttaaaagcatatagaattaatacttattaagcaaacctggaagccatgcctgaggttgaatcctggcttctcttccttatctccaatacgaccttggttgggtaagttacttaacctctctgtgccagtttcctcattgataaaataggaatgatggtacctacctcataaggtttctgtgaggattaaatgaactaatatatgtagacttcttagaatagtttctgatacataagtgctcaataaatgttaactattataatttcatatatatcactaaaaacaatatgttatctcagagagtttcacttaatctaagtgtcattattcaatatcaaagcaggaaaatgtcatctgatatcctcccacttatgaaagttttaatcatccctcatcagaactaaacttctttctcattctggttatgctattaaactttcttcagatattgatgtaaaattctaaccatgcccaactttttttttattatactaattatactgtctttagatgcctacagccatttaactgccatggacttagaaaagccaaactcctgggttatatctgtgaaattacagagtcctatagataaacccaactgtttttggaaaaatatcaattgttttcttcctcatagacaataatctcgtaaaagatttctaatcatgggacagttaatcacggggacagtttctggttgtttcctcagagttatgttggctcattacagaacagacactccttacctgcagaatttgtacattgtggggagtaatttatcccaaaccagttcagacactaggactaaaatgttaatagtaccatttggagaatgctcagtacttgctaaacactttatattaatatttcctttaacctcatcatagcatccctattaggtagattattattcagattttacacacagtgcatttgtacatagagcttgcccaacaccacacaggtagtagtctgatctcaaattaagccctagaagccacagtgggagagtaccagaaggcaggccgttggggatctagccccaggatcctcacctcaatcgtggtagctctactttatttgtttttcatattaggttttctgattttgaatcattagagagttctgctgttaaaaaaaaaaaaaaagggggtggaggtagtgttattgaaaagcacttgcaaaattcagctctgtacatttgagatataactacaacaaaaatgtttctattatgcttttgcccctagataaagagaatccataattgacactatggaattttgcagtttgtcagtaaaatatctgatacttattttaatagatctgtatgtttcttattaactgagtatcagccatattggttgatgtgaacagaatgtgagaataaagttttgtttaggatttctcaatgttaaattcttacagttgaaatgatagattgatgcttattcataaaaaatattttgatatagattgtttattttaaaaaaactcaagataattttaacagcaaagctcagtggtggttctttcaccagttaaaaatgtacttttctttttaaaatatgcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaagtaagaatatagggacattataatttatttaatgttataggttgagtattccaagtctgaaaatctgaaatatgaaatgctccaaaatccaaaattttttgagtgccagcatggtgctcaaaggaaatattcattgggacacttggatttcagatttttcaattaggggtgctaaatataatgcaaatattccaaaatcagaaacccctctggtctcaagcattttgaatagggatattcaacctttaataactgcatatatccatttaacttagatttggaactttgtttctcagatacagattcagcagtcattacattgagtaaccactatctaaatgttcagattcaacagtcatgttttgagtaacttctatatgccgggtactgggtgaatactgtcatacaacaagcattcttattcttatttaattaaagtaacatctcttgaggtgttgtcctccagccagtactcttcacagtacctgtgcatgcacgatagggccatcaccacatctgaacatatgtgaggtggatcctcatggcaagtcctccttcatgtcactccttttcacacatctcacccccaatcccactaggcagctgaggagcacaacttccatagcagcctactaatctgctgttcacatagacttgagaagtagatcaaaacagtgggggggaggggggaaggaaaacatacattccctggctgtagagggagagccaattttgtggcattatgaatttgagttaccaaactgtaatgacatactttcctgtataagacaattagtataaatggaaaatgaaatgaaaattatcactttgtaattgtgaatgaaatcagttatttgctcattttaaagtagaatttaaattatacctacataagtattgttttgattttcaagcatgcaataaatcagaccagacaggaaaactacaaagaacctcccactgcaacacacacatgccttgtatttaggattagcatggcaaatcctattaaaatgtatttaaaattctttttttaaaaaaatggcattagcatctgaaggttgactgacttctaaaaattatactcccccatctctactaaaaatacaaaaatatgctggaaatggtggcaggcgcctgtagtcccagctactagggaggctgaggcaggagaatggagtgaacccatgaggcggaggttccagtgagctgagatcgtgccactgcactccagcctgggcgacagagcaagactccgtctcaaaaaaaaaaaaattgtactcatcaaaatgttggtaattgtgtttaattcaatacataagaatgcccttaaaggttggtttttaactttgggttattttcatttgaaatttcagcacgcttcttccctctccaccatacccagccagttttccctaaacctcttctctattttgtttttatccgtaacaataccatctaacatattcctgttttgcttctttctgttttcctagctctttccactagaatctgaacaccataacgcagggattatttttatagtactatttcattatattatttttattatactattattttatagtactgtttacttttatactcccagtgcttagatacctagaataggcacttaatatttgttgaatgattaaatcatattgctatgattagaatatatttattttaaatttcacagaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatagcgacagtttgagtaaaagaaaagtcatattgaagaagcccagagggttgtgcccaggggcagaaatcattgcctagtgttcaccggctgactctcaactgaccattcccatgtggacaggccttaatactgtgagaggatccttgctctgctggcagtttcccactcctatgcactttcacaggaactagaaaactattcttaaaccaaaaataccatccgtgttgacccatgttgcagagcccttacttaaatccttcactggtgtatgaatactttgtcataatgctgctttgctgggtagtgagctcttatttttcactgggggtcagctataactaaaaactcaagtgacatatttcagttaccaaagtggccaggaactttttgcttttatgaaaatagattcatattgtatttcccagtgtgtcttttatgtctttgaatgttttggagaaaagtctatgcctgtctaaaaatgaatccagtgttgcctttctgagggatttctgctcaatgcaatacactgttcagtgctattctcccagctaggtttatccatgaaggactgagtgacctttgttgtatttaacaaaatccaggtgcatcaatttctgatgctttttactattgtgtattatctactatgtgtgttttatttctgctgagagtattcaggtttgccatggacatcagaagtttgaattccagtcttatcttatgttccatggctgaattttaaagctgtttaggtttaacaatgaagggatttattctttagtcaaaattgttgtttttactctagctcaggattcgtatttttaaagatttagttaatataaacacagcacagatttgtcagaagaaaaaaaatttgctgtaataccaaaactaacctcatcaaagatacagaaaaaaagaaatatagtgagccctaaaggacacatacattgaataaataattggaacatgtggttatctttagatccacatcttagctgtcatttgttcactctaaaactgatgttcatctttctgttaatttccctctgcctaaagactacatgacagaaatgacctatcactacttattatttctgaagcctaactgcaagactgatttctgagaacaagtaaagaactggaatacttatttttcatataaaaatctaaatgtgttaataaatcatttcatacaaaagtacattattaaataaccacattattaaaataattgcaagaaaatggaccatatttacaatgttttgtaaacttgctagtgtgtggatatgtaccctacttgtgaaatacatttgaagatataaagagcagccaaaatgatggcaaaatggtaggctaatattttctattattattggagaacatatcatattttggaatcatgcaattttgcacacagtgaaaccattaattttccaaggtaattcctttagaatatggtattggcatgcagtttcttacttatctagaatatttggcttatctgaaagatatcaatttaagatctctggaagtgttagaatttttgatccttcacagtgtcaatatttaatgaatcactaagctttatttattagacgtgttgagtgagtgctgagttccttgctgccacttttgttaccattgtcacacactatgtgtaaaccagtcccaccacttattactaataaaattttgactgataatttatatttgcacttacaatatatatatcctgtccttatatttctctagagtacattttccatcatgtttaagtgtatttctgctattatttcctctcctgcagaatacatacaagtgtatgtgtataaagtcatacatgtacaagcatgcatattgagattgaatcacatttccatactgtctgttattttattgggttttatattgggtttctttagtttatgttgttttctcaaaagcagcattttaaattacgaatactggacttattggatttaattataaatccaattac

SEQ ID NO: 13735 - DNA, 6728 bp, Human
atagaccatctccgccaggcagcttggcaaacaggtggcagagttgcagggcagctgtgtaagccaacttcggcgcagcagtggagggtcctggcttggcgtgggggatgctggacccgcggtcgaggatttggggatataggggaagagggaggaggtggatgctgagccttgtatgcaggctatgtcagtttagccctctccccaacctctcttcggctcctgcccgtcccagaggagtgaggtggagaagggctggctgccagactggcaccaaaacagccttctttgggtgcccaggttgccagggctcgaggggtcggaggatatccagggaagcaccccaggtggtccaaaaagatcaaattttgaggacccctccctccccttttccctccccccccctccttccctgccgtgggctctttcagctgtggtccctttagaacccaggactactactgctcaacctcgctgggggttcgggtggctggattcgggtccctcactggcgtgacaggagggagtgcgaggcaggaatttaggagccaaggaggtgagagcagctctggcccctcactgtaggtgacgccaaactctcctcgacttgccccgactcttagttgaaaaatctctgtcctctcccaggctctccagcttcccaagcaatgacctcaatgaaaaaaatgacagcggggcggactgcccccgctccagagtaccagtgccggcagtgcgagctatgacgcaatcggagctcggtcggtcctttgattggctagtcctggccactttggattggccgcgcgggctggtggggaccccccccctccagctatctctgtaataagagcggggtctccgcggggaaggcgcccacagcaggtgtggtgttcatcccgggtcgaccggccgctcgcgctgccctgaaactctagtcgccaggtgaggaacttcccattccccattccgctcactcgaataacctgcttcttcgactagttcatccagtttgctccatctgcctgtctgcctctccgccgccatctggtcctaccttacagcggtggtcctagctctcttccaggccccgtagaaggcgagcggttagggttgtcctggcagtttctcctaccagtgcgagaggagcccaagcatccccatggctcagcgtgggcgctggaagcgcagcgagcggaggtaggcgggtctgcagccctggcgttggggcctggctgagcgcaggattctgcagagttgggtccgggagcgccctgcgccgtctttgtccttcgggagcatgtttcgttcccgggaggtcggaaccctgagctttcctctgaggcgcctccctggtgagccttcccgggattccggtccggatctaaggcagtgttgttagcggactagaaccctgggcgctcacctcgcggagctgctgctcagcatctgctgctaaaacgcgctccggcagagggctggctttgcgggcgagtcctgagacacccgtaactggcacgttaaaaatttttcccagttccaagactgagaaatgagcgctcctttccaatccacccttcccaccttcccctcgcatgcgttggcgcgaagcccagcagaggagaaggcgagaaggggagagcaggtctacagcaaggtgcgtccacgcctggtttaggcataaatcagggcagaagtgtctgtttgtgtgcacgggcgcttgtggcttctccctggccttcaacaaaacagaaccaaaattcatcctttctctccacccttcccctaggacacctttttccgctctatcaagccattcactcactgcaatgtgtctcttgagattcacagcagcccttcctgcaaatgaagggaacagaggctcaggcagctgaagtaacgtgcctaaggtcacatggcagttgtggcagaggcaggactggaacctagatctgtgctggtgcagtagtaacgtcatccttcctttacagagaggcggcatgggtttccggaagttctcccccttcctggctctcagtatcttggtcctgtaccaggcgggcagcctccaggcggcgccattcaggtgagacagcctggagccagaggcgccttctgctcccactgcccctaggaccagacagctctgtgcctctgaagtcacgcgtggctcctggtgaatcagtgcccacaggtggaccctggcctcatgcccgtcccctgggagtcgcggtggccacatccccaggggaagaagcagagaccaggaagcctggctgcctatcctggggagggtcagtcaggggctcacagcctgcaaggagtttgcttcccttccacaggtctgccctggagagcagcccagacccggccacactcagtaaagaggacgcgcgcctcctgctggctgcactggtgcaggactatgtgcagatgaaggccagtgagctgaagcaggagcaggagacacagggctccaggtgaggttccccaagcgcccagcacagggactcctctccccgcagcatacacaggaaggtggatcccaagaggcaggagagaacacactggcaaggggtccagcaagctgatttgtccagcaggctccctttctcaagttccaagggagacagaggtcccagtgcacctggagggactgtgtgtggttagacacaataaaaagctccgtttctgaaagctgttagaacatagatgtagaagctttttctagacatagaaaaaactcaatttgtgaaaactgatagaaaatgaaatggggaggtgtggaatcgttcactgtggaaattgctcttgcagtactgggagatctcctagcattggatgagttaagactggtaagggtgaagtcaggaatagacccaatatctcagaaagttttagaaatttcacatgtgcatgccattctttcatacctgcaagaagccttcatttcacatttgcaaggtgaagatgaagcccttgcagggggtggggacagagcagtgtctgaggtaggtttgagcctttagatgtgcaagctctgtggagatgtgcatgttgtcatgaggccagggagagcaccgtttcccagacccacatccttgtgcatgttgagcctgagcagagaccaacccctggcctgctcccagcactgctgggcagaggcatgtgtcacacctacattcaccccgagaacctctctgttgagcatgaagggctgaacatcatgggaataccagaaaagatcatccttcctcattcagcccttctctacactgccctggcccactgaccctctcacctctcctaatggagtgtgtgtgagctgccctcctgcctgccccacctgctcccactcgacatgtcccctgcctggtccaaccttctgagtgactgcccatggggacagtccctagtgcatggtactgtctggcatgtccttcccttgcagcttgagcagtcctagatttaagtagcatatagtaatctgagtacctgcttgcagggcacatacttgcagtacctgaaaaactttcatatgttccctggcatcaacttcgggcctgaaattcctggcaagaatagggacatagtcaacagcttgcagagggaccactacccgactccagggtcccccagatggcagctgaacttctctcaactctcctgattccccttcttgctccactttatgaacctgatgcatgtggattcctctctgatttgtcttcatgctggtattggtatttttgcttatgacagagaatgttttgaagacctcaggatggaagggaagacagcatgacttactgaacacgttagagataaaagaaaataagggaagcttcttgagactgtagagggtgttatgacagaggcatccaatttctgcttctaaatgtactacgataaaataagcacgtccttaatgccttggcattagatgaatcaatctatttttctaaaaggaactgagctgcggtgctcattgctctggtccacatccagacttgagggtgtccagtgcctatgctcagaagtagccttagcttcagggtagctgggtatggggcttggtgggtcatcactatgacccagctcaagcagcaagaacagtgtgtgaaggagctggtaagtacttctgggagaggatgctgcaaaccctgttctctgagcttcttctgaagactttagggaatttcattttcctgtggtaatgggtagtgttggtgcttgtggctggggtatggtctctgtatactcctcgtgtatcttggggtgggtctgggcctcgttgcccacttcctccttgaatggtaagtgcagggtttcagcctgtgccccgtggcttggaattgttttttcttctttcttttcatgatggtctttgggcagagctcctggtgaagactgccaggccatttcccctaacagctttgataattgcattttcgagaaacacttactgttaggtggtgtgtcgaagtgttgcagttctcttcatgaaggctcctcccccagcttttcactcacaggtcttctcttctttctctatcttgcaaatcagctccgctgcccagaagagagcctgcaacactgccacctgtgtgactcatcggctggcaggcttgctgagcagatcagggggcatggtgaagagcaacttcgtgcccaccaatgtgggttccaaagcctttggcaggcgccgcagggaccttcaagcctgagcagatgaatgactccaggaagaaggtaactaccctaatgctatgggataagagggggaagggacttggagttaaaacctacattttgaaaacctctgctctggtaggttctttaggttccttctgtccagttacattgttcctcctgaggcagtgagttctttctagaacctagcatgatgtcagaatgacatcagagatgtagtgtcatttttctgataagggaaatggaaagaaaataaaaagcttgctggattcagaaagggagaggtctgcaaaccttaaccagggccagtcttcattcattaggctggtttcagaaagggctcaacccttgactacagattcaggtggataagctgtaatcataacctactaccaagattaatagatgcagttgaattattttagtcttcatttgccttacaagcctgcttacctctcataaccataattcataaatgctgtttaaagaaacacttctgtaaattagtattttttcagtaataattgtgattattcatgacttgtcttctacttctttttttctcttccttctccttttcatcttcttcctttttctctcctttgtcctccccttcttctccctcctcttctttttttcccctaatctcaggttatcatgaaactgaactcaccatttctattaatttctgttggtaagaacttggtgagaatgccctgtggaagatacacatgtttgcatcctaagatactgaaaaaagggcacctttgtcacttgaaaggaatgaaactgaatgcaaaataagctaattccatatttgctgtgcatcatttttatatttaattctatgtccagtaaaagtgatggcatctctcattgacttatctggtagcaaactggttctttcggagccatcctgttgatcatgcagctccaccaaaccttagggggacgtgaaatcactgcctgttgtggtctccgaggacacatggtaatggtgatgctgtgccttgttatctaagaacatgattgtataatttgtttaagaaaatgtcaatattgtgccatttgtgaacttcatcaagattaaaagcatattttgggtacatttgtttcaaaaccttggtgatgcattacaacttgttttcttatgtaataataatgatgatgatgatgataataataaatatttttgagtgcttactatgtatgggccagatattattttaaaacagtgctttacacctgtgaattcatttaatcttcatgacaaaaccatgaagtagatgctattattcatgtcccttcacctctgaggaaacagaggcagggagaagtccaaggtcacacacagatagatagaggtagacccaggtattgggttccagggcttacagtggaaatcactgcactataggcctttctacagtggctcctgatgtttttcagagacttgtgagccattctttggcctagctgcctgataaggtagaccctcagattttggagatgcataacaaattttaaacataaaaacaacctagtctttacagaatataatgaattttttgtacccatttcttggcctcaaaaatgatcagttgccactgttgttatgtctgtatatcatctatatcccttcctccagtgtattatcatgtcaatatatccataagtaaatatttcatcatgtatttccaaatgggaagggcttttaaaatataatcacaatttcatttaacaactaaaataaatttacaataattttaaaattctttaatattacacatcagccatggttcaaattctctatgtatcatgtaatataaatgataagatggagaatttacatatatttatatatatgtgaaaccagggctcaaattgaatcttcacattgctgctggttaataataagttttaatttaaggctcttacaaattagaggttcctccctcatctattttcccccttgctgtttatttgttggagagactaagttatttatccaataa

SEQ ID NO: 13736 - DNA, 15847 bp, Human
aaggcgggggtcagaagtgggatgtgtgtggagctggggcaggatacgggcaaccagccaggacagatggacctcccttccctccctctactgccctctctactccaaatccccagggccacacgactcttctgtgatgtgtataatcctcagagcaaaacatactgtaagcggctccaggtgctgtgccccgagcactcacgggaccccaaagtaaggttttccctcagctcctcccattttgcccctcctccctgcctcgctgtcccacattcatcccttccttcctcacctcacttttccttcactttttcctctcagcttccctgctgcttcaccctccattcctccttttccatgcctcctcaccgttccctgaaccctccattcttttccttctccctccttgagcccccattcctattctcccttatcaccgctattcatccccccaacctggcctccttgcaggtgccagctgacgaggtatgcgggtgcccccttgtacgtgatgtctttgagctcacgggtgacttctgccgcctgcccaagcgccagtgcaatcgccattactgctgggagaagctgcggcgtgcggaagtggacttggagcgcgtgcgtgtggtaggtttctgtgcggttttggtgctgcatgtggtaggtttccatgtcggacgtggccggggcaggcggggctgcaggtgttcctgcttaggactcctgccgctcccttggcagtggtacaagctggacgagctgtttgagcaggagcgcaatgtgcgcacagccatgacaaaccgcgcgggattgctggccctgatgctgcaccagacgatccagcacgatcccctcactaccgacctgcgctccagtgccgaccgctgagcctcctggcccggaccccttacaccctgcattccagatgggggagccgcccggtgcccgtgtgtccgttcctccactcatctgtttctccggttctccctgtgcccatccaccggttgaccgcccatctgcctttatcagagggactgtccccgtcgacatgttcagtgcctggtggggctgcggagtccactcatccttgcctcctctccctgggttttgttaataaaattttgaagaaaccaaggaagctgtctccacattgctgcggttgcaactgttccagacttctggataagatggggggcgcctgcaccccgcgagagcccagggacccacattcccagcctcccacgggcagagggtctacgcagcgcgccttcagtgtggtgacaccgcccatgcatgctcctgtctcccacccagagctgtcgtccgctgtggacgccaggccccgccttttccccacaagccccacgttgaggatccgcctcctgcaggggcgcgccctcccgcgtgcctcagtttacctgcggtgtggcaccgcccctttccccgccccgcgcgctcccacagctgttcggcggggaggagggagcgggacacgacccccccggggttgatgttcggagggacccacgaacacaggatagaccccagcgagaggtgggagaggagagcgccggcagggccagggagtgcgcaggcgcgaagcagcttccttgccgcgttcggtatcggctgtggagaccgcgggagggaagggagggcgcaggcgcaagccctccccgaccgcttcccttcaggttgaggctggaaagcgcatgcgccagctagatgggcagcgaggagagccgcaactgccagtccctcgaaggggttagctgtcgttgaacgtcagcacgcagatgcaactggctctcggcaggggggcgcgcgcaccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggtgagacagccttggggctggacgtggagagcgctcaggcggaggatgggaaggaattgtggctcagaacgctgacggggaggaatgaagggccctcaggccgataagggggaggaatggcggcgtcggaatactgacgaggagaaatggggggatttaggctgaggacgggaaggaatgcagctctgaactctgacaggtaggagtgtcgggatcctgggacgaggacggagaggaatggtggagatcagaacgctaaagggagacatcggggcatctgaagttgagagagaaatgggggttcagaactctgagagggagaaatgaggggccctcaggctgatgacaggagaaatagaggctttggaatgctgaaagggaggaataggaggccccatatagaggacgaggagcagtaggggatcagaatggtgacagttagggatggcatgatcccgggacaagaacagagagaatggaggagggttcggaatgctgaggggagaaattagggtctctctggatgataagggaggaatggaggatgagaacagtaaggaggagaagtggggaactttttggctgtagaggaaggtttgggagctcagactagggagaaattgtgggtgagaacattgaaggagaagaaaaataaggggggaggtcttgggctgaggaaggggaggcatgggaggcttccagtgtgaggaatggaaaagatgaggggctgttcaggctatgggttggagcagttgtgtctcgcagaggaagtcgaagttgtaacactgaggtagcaggataagaggacatcaggcagagaaggaatggagtggttaaaacactgaaggagggaaattaggaactcctgggtcaaggaaggggggaatgagagactactgaagtcaagtagtgagggcaagagaaatggggccctttggggctgaggatggggactatgggggtcttggggtgataaaatagagggatagaggcccttaggtcagtgacagggaggaatgagggggaaggatgaaaagtttctggattggcagtgaggagaaatgatgggttgtcagtctgaggatagagaggagtaggggattaggacactgagaataagaaacagggatccttgggttgaggaatgatgatatcctaggcccagaataggaaagaatggggtgagaatatgaggggtttcttttccatatatgggctggttgcctgtggcaggtcctagggcttgggcaagcactaatggataccagtgatttgtgtggcctggggcacagtgttgtcccttcctagagcctcagtttccctcatcccttccaccccctttcaggctactgctgcttcctgtggcctccatggctgaggactggctggactgcccggccctgggccctggctggaagcgccgcgaagtctttcgcaagtcaggggccacctgtggacgctcagacacctattaccagaggtactgggtgggtagtgggcagagtcaggagtggggtagagcctgattctggtaaaatcaaatggtgtggttaaatttatggatgaagtttaaattatgcacatacagttaatccttattagcggattttatgtttgaatttcacctacttaataaaatttatttgtaacttaaaagtcactactcacagtgcatttgtgattattcaagaatacgtacagagcagtgaaaaactgtcactcaatgcatgtatttctagctgaggctgaaggagcccttttcagctttaatactgtaaacaggtgtccttttcgtggtctgtttagtgtcacatttttctaatttttgtactttttggtgattttgctttttaaaatggtccccaagcatagtgctgaggtgctgtttagtgttctgtgagaagactatgtcgtgctttatggagaaaatacaaggcagataaactttgctggttatctgagttacaatgctgttggctgtaagttcaatgttatgcatcagaattatggtacaaccagaaaaagaaggaaatttgccaatatgtgcacaaagctgcttcagaaagtacagaaagcatttatagtcttgaagctatgtaagagatgagaaagcagctacattggtgggttcatgaaatgacgatcaataaagcatagttgacagcattgttgaggaaagccaaagtcatgttaccctgggttaggaaaatattaaggttatatcagctagtgctggctgacttgcacatttcaaaaggcgacatggcatgaaacatgttaaacctgcatgcaatgcaggttctgctgatcaggagtcttccgaagaattttaaaaatacctgttaagtgttgtacaggaaaggggttgtgtggaagagtggttttcaatgtcaatgagattggcttgttaaacaagaatattggcaaaaaaccttacagaacacatacggcctccaagtcccctggtttgagtcattcaaagaccatgcaaataatcatttgtaaaaaaaaatatgtattaagtaatgtgtgtttaaacagaaacacacacaaaacaaaagttcagatgctctcaggaacctaaccctgtatttcttctaggagcaatggttttgtattcaatgttcatgatagctttgtagaacgtaactaccataactaatgagagtcaacatagatgtttataagcatttacatgtgtttaagaaacattattaagtttctatattctttctgattttttaaatctaagttgctatctttccaggtaaatatcaaattacaaattactttttgtttatatttagttataatttattcacatatttatgtacttgtataaaactttcaaaacttaaaagtgcagttgtcaagaactataaagaacctgagatttcattcttaggacaagataatagtgaatttgtcagaattttgtagatgctggtaggaggggtaagactcctgggttacagatcaaagacagtttattacaacagttgcaggatccagaatacagtagtctcccccttatctgcaatttcattttccacagctttagttacctacagtcaaccaccatccaaaaatattaaatggaaaattttagaaataaacaattcattagttttgaattgtgtgccgttttgagtagcgtgatgaaatctcacaccatcccgctcagtcctgctcaagaggtgaatcatctctttgtccatatccgtatccatatccatgttctagacacaacctgcctgttagtcacacagtaaccatctcagttatcagatagaaaaaacacagtacatattacattagggtttggtactatccacggtttcaggcatccactggggaacttgggatgtatcccctgcacgagagggggaattactgtattactatttttgtgccagtttctgaatcccaattcctacagcatgacgtgaagagggttgtattattataggaaaagaaccgtgagcttagagaatcaggtttttttttaataatattaagacagtaagtatgctttccctttggaaaaagtatactttcccttcctcctatggaaggagaccctatctcttatcttccaaggttgtttgctttacaaacatccttggaaagatagtttatcaaaaaggacaatcgttgtctctcttgcagggcatacaaaaatgcaagaaacccatgggggtcccaaaatcaattacttatactttaatttgtatgtagttgcatttgtttatatgtttttaaaacatatttgtgttttctttacttgatatatacttggtacataatgctaacatttatatgttatatttgtgttatatatatataacacaaatataatatatttgtgttcctatttgtgtttatttttacttacatgaaatagttccagtattactagtattatatgttgtaaatatgttcatctgtttacatttatattgtttctaatgtttctatatgtgttggtatttatattaatttttttatgttttcaaggttagttgaggtggggctgggcagggctcacaagccaattccaggctgcctcctatatcctgccagccctgtcaaaaggttgtatgagtgaaatggcattggctccacctgggtgctaacccatcatggcccatccctagccccacaggagacaggatccgaagcaaagttgagctgactcgatacctgggccctgcgtgtgatctcaccctcttcgacttcaaacaaggcatcttgtgctatccagcccccaaggtacttcacaacatgagatacctaggtaggggtggatgtgccacccaacacccaaccactgacccatattcctccttcccttactttccaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgagtgttggtctaaggtgagccagatgggtgagggttgtgattgggggtgctcttggagccccacacctgcctttcccatcccaggtgctgtgagaactgtggaatcagcttctcaggggatggcacccaaaggcagcggctcaaaacgttgtgcaaagactgtcgaggtgagtggcctccagaggatggggcatcgggagataggagctggagcaggtccagtgtcatgctaggctggggtttgaatgtggatgtcaggacagaggctactggcatggttggaggttggatattggagatagcaggcataggtagaggttgaatagtggaagtcagggcacaggcagtgagtgaagtcagatgtctgttgcttcctttccacttttcttcttccctcttcctccccacagcacagagaattgccttcaaccgggaacagagaatgtttaaggtaagcacaacctgcttcctcttcacaactctgcagtgggagcaggatgtgatggagctggtagagtctgaagggatgatgatgggtccacaggatgaagagtcattttatagggtgctctccataggtcagcagacacaataatgggaattaatggggtaattaatccccattaccattagtgcatcagtagacacagtgatgaagtgaacaggggaccagtagacatactaatggcctcagtgatggtgactaaccagaccttctcagatacggtgatgaggctaatgggggactaaaattcatggtgatgccagctgatgtagggtcagtagacatgggaggaccagtgcttctggagcaggcccgtgatctcgtccctaccattcctggcagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaagggtgagttgggcaagtggaaagagcccaaggctcacctcggcccctggcccccatgggcttggccccatgcttcatgcctctgctcccacctgccccccgccaacagagccgagggtgtggagtatgccggggctgtcagacccaagaggattgtggccattgccccatctgccttcgccctccccgccctggtctcaggcgccagtggaaatgtgtccagcgacgttgcctacgggtgagttgggctggagggagcagagctcattctgctgttaaaatcgtcgctgcctctgcttcctttcaacctggccttgcctacctcatgtctttcttttctgcctaaccctatgctcgcctttctggccccgcctacctgcctctgtctgccagcaccttgctcaccgcctgcgtcgccgtcatcagagatgtcagcgacgcactcccctggctgtggctcccccaactgtgagtgcctcacgccaccctctgtctgcctgtcccatgcatgctttctgcacttagggtgtggggagtttctgtgtctgcctggtgccaccaagctgaaaccaccctttctgatctttcccagggtaaacatgcccgccgcaagggaggctgtgactccaagatggctgccaggcggcgccccggagcccagccactgcctccaccacccccatcacagtccccagagcccacagagccggtgaggccccagtgggtggagggaaggcacaaccctgaccttacccagtacctgccctgaccccaccccatttgcctctacagcaccccagagccctggccccctcgccacctgccgagttcatctattactgtgtagacgaggacgagctagtgagtggccccaccctacctggataagcctagaatctcaggacgcttggttaacttcaaagaagcagatgctggaatgagcctattggggaacagcaaggcacaataatgggtcctaggatgggatgagtagataatggaggactaatacggggtcagcaggtgcatgagagtgcttcatgtcacatataccaacactctggtagctgatgtggggattgacagaggagcagctagcatagtgactggggttcacctaggatgagcgacagagtaggcacagtgatgggagctaatagagagttatcaaaatgttgctggaaatgggggtcagagacattttcttggtagctagtggtggcctaggaaatacagcagtggatactgtagtggagcagccacagtcctaatggtatcgagggccagctggcacagtgatagtggccaatgttgaactagcgaatgctgaggagtgactagtggggagtcaggaggctgagactagtatgcaagtagctccgtcttatggggctagaggagcaccaggaccagcactggaataggcgttgaggatggcctctcctagtcctagttgacagcaccacccattccccccaccccagcagccctacacgaaccgccggcagaaccgcaagtgcggggcctgtgcagcctgcctacggcggatggactgtggccgctgcgacttctgctgcgacaagcccaaattcgggggcagcaaccagaagcgccagaagtgtcgttggcgccaatgcctgcagtttgccatggtgggtggggcaggaagggtcaggtggacgggataggttgggccaggcgccccagtgcctggaagtggtgggcaggcttggtaggtgggtgggtggggcagtagctttggttgaggattaacagacattgttcttggcttaatgagtctaggtggcattggtgttgctaataggagactagcaggctcagtgatgaagggctcatatgtaagcagattccgtgctgggactgatgggagattagcaggcatgtggagccgggcagggtggatgtgattggtcaggacaccaggtagccatagcaccctatctttccccatagaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggtgagggccccaccctgtcctgccttcccagcctcacccagctgcatgccagggagctgagaccaagtctgctgcaatcctccctcacgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggtgggggcagtgatggatgttctgttggtgccgtagcggagtggtctgtaagcagagtgatgatgagccatgatggttctcttgagcagagcaatagatgtgctgattgcgacgtttctgcagaattaccccgcctgtctaacagacaccctacctcccacaggcaactagctttgcccgctttgctatccagctaacagaaaaacggaggtcagtgaggaatgggaatgggaaagctttgtaggcagagagatggactttctgtgttgaaatgtgatggaagtaggatttgtcagcacagtgaggggttggctgatagagactttcctcaggtgaactctgcccttctaatggttgcctgtttcctacttctcccaggcagtagacccaggcctgccttctgtgaagcaagagccacctgacccagaggaggacaaggaggagaacaaggatgattctgcctccaaattggccccagaggaagaggcaggaggggctggcacacccgtggtcagtgctggggatgccccaccctgccctgaccctgctgtagccccaacaaccacattgacctatggtgttaattcttctctagatcacggagattttcagcctgggtggaacccgcttccgagatacagcagtctggttgccaaggtgtgccccacacagtgaggggtggggaaggagtgggtgttggccagatgtgggccctgagttttgaaagtatagccggcagtttggcatggtgtggtgggaggtaaaggcccatacccactatgctggtcacaattaatgaggggcgtgtgtgtaggaccctagagatttctcctgagatccagcccaatagcattccaggttaggactctcctttgggggtaggggaaagacttggtactctatcatgagatttgaaagaaaaagatagggagtctggtccctattttcctaaggaatttctataggggtcagctttaatatataaattcttattcagagaataatcatttgggtcttgaaggcctttagagtctccaggagacctctgggtgggctgttgcctgacattgagcaatgtgtaccagagaaatggtgctgggcttgcctgggcagtggtatgggcaggagatctgggttccgagctggctttgtgagctgggttcacacgtagttgtgtgatctctggttgccctgcacttcctggagcggcctctgtggaagggcttgggctggatctcttgagcctttcctgagcctattgaggttattaacttcagatgccttgcagaactgtccctgtagtcctggcatagaacaaagggtagatgcctgtaaggactagggtggttgggaggacagaggagtgctggctcctgcagaatattgacagaccctgcatagagccccagacactggcgatgtaaactattggcctaagcacttggattcctttgctcctacaaaccagcccaccaggctagaaaccctttcatctatacttggccaattacagaagtattgattgagttcctgttgggtgcacagcattgaggacaatgagccctgcaaagcttacccttcaggagacacaggatacctaccttcagggagcttataatctgactatgtacaagctgtctataatggtagtttttagaagatataaaaaaagataaaggataattaaggggaagtggatggaggacacagaatagtaggaaatggttttgtaatgctccattgcgcacatagcaaacctcattcaacatacagacctgctcccttttccctaggtccaaagaccttaaaaaacctggagctagaaagcagtagactggaggcttctacagactgtaggattcaaggtgatatttgcagactggctttatgagagacaacactgatctactaggggctggaccctagattggttgccagggcttgtgtgtgaatcaaccctaggaggaaaaacctactaccaaaccagaagagcaggcctaagagtactttgagcttctagaagaagtaagcgggaaaggaagagaaagagtagaaagttggtgcatcttctcctccccaagagcctgagtataagaagttggattttaagggtgggggagctgggttggagaaaggtaatataattaaagccaccacaaaacaacctaaacaagccatgttcatgagtaattgtaagtggcttctggatgagacctggcagtgtctctacatacttcctcagggagatagcaattgaaaatgtaattgaataaataaggaaaggaactgctatttggtgtgttcctctgtggacccagtttatttaatccttaaaataatatttttgggaagacattgattttgtccatttatgtggatgggaaaactgagactcattaatttgtccaatgtcgaacagctggtgttagtagagcctagactcaaacccagcttttaaagcccttgttctttactccactaaactgtaacctgtaatcctgtatgcactaacaggagttttcggtgaccttgaaaacacagattactataattactataataaatcccttacattcctgtctctagcatggtttagggagtgccaaggctcaatgtagatggggtcaccttgtcagagcatctgttcatacagaaactgggtttcctgcagaccccaggtgctgcataggattcctcaaaccctacaggatatatctccccactggctgctgtccattttgcttgttaccctgactccccctcttcagccagagcagtctttgtaactaaagctgccagcctggctcatctttcctgacaacgtgcatctcctgccctgtgatcacctttgtgcttggctcctgccctcagcctgaatgtgttctaggaggctgaattcctgcttcgagtcctgcccaagagccagtcttggctcagccctacctcactctctcccaattcttcattcataaagtgccaaaaagattagacctgtaatttgttagccagctttacagggccaggactgagtgagtgcctccttaaactttgtatcctgtgtgcctcccttgccttaccctagtcccagccctgcagctttaagtaattcagacatggattagccatttcccagttctgtctcatacagtccagcctctgccaccttccccaccccttcctttattccatcctaactagttcagccctagtcaagactggatagactgatactgctttgtttcccccaggaaccaaccacccaaccccagtattctggtaattttgacaatgatctatatgaaatttatttgattgacatttagactcatgagttaagcttctgctgaccatttatgttagggtacaatcagaggagcagaaccactaagataaagattatgtatatatgtattttaagggatttattatagggatctgaccgcatgccattgtgggagctggttaaacagtctctgtaaggctgttgtctttgcatctaatgctggagcttgaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgttgctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccacttacttacatgcttagtgtttcttttgggagtggtttggtgggaacagtgttgactgcctctgagaaactgggatagtgggtgggaagatcaaatcaaggtcacttctttccaaggaccctgagcgattcacttacctaggccgcgggggcggggggttggctgaaggctgaggctcttggtgctcagcactggccggacaccttcaacctgctggtgggtccgccagggggcgccggggcgagaaagcccgtagttcccagccacagtcacccaccggggccctggaggcaccgctcgtcacccatcacccctggcctggccgccctggggcgtggtctccgtccggcgcaaaccccagtacttgggctagggccagagggaagctgagtccccctcttcaaatagtggtaaaacaggcaaaaccgaaccggggttaaatttcggagctcgcccagggtgagggcggggctcgacgacctaggacgttcgagtgcggccgggtgtcgccaagggtcggtttaccccatcgcctcagaaattccgacgaggccctttgggctgcacaaccttgggaatccccaacgggcggccccgaatctgcgccgattttcccaagccgtacttcgggcccaaggcgttttcattgccgccttcccggaggatgtgtggtgggggtggttccgcccggaccgacgggcgggcccggagcccgttggactcgaagatcaaagaaccgcccctctggacactccaggaaaccgagacgaccacctaatttgtttgttttctgtttcaggccacgtaaactcttagtaaatgcaaatgcgtattttactgaactgcaattgaaagaaccgttatagaaaagaacacaaaatgacagaattattaaaagagaagaaaaacattatttcgtggctgaaaagctgaaccagcaattcaggaaatggaattcgtatttagaaacataccacatacaaaatccgaagtgggtggtttacaaatgattaaggaatgctaatttacagtaaattgcgtccttaagagggcatacacattagttgtacttattatatgtcagtttgacgtaggtactgatttgttgcatgtgctcacaagtgttctatgctcacccccactttagaatgggagtatcacagtgtcattcttaattggcttttaggtattaccaccttgctcttgactggaaatgcaact

SEQ ID NO: 13737 - DNA, 15847 bp, Human; identical to SEQ ID NO: 13736

SEQ ID NO: 13738 - DNA, 15847 bp, Human; identical to SEQ ID NO: 13736

SEQ ID NO: 13739 - DNA, 15847 bp, Human; identical to SEQ ID NO: 13736

SEQ ID NO: 13740 - DNA, 15847 bp, Human; identical to SEQ ID NO: 13736

SEQ ID NO: 13741 - DNA, 60592 bp, Human
atttgtaactttcttcttttttccccaagaaaatgggcttagttggggtgctttggcaccaatagtcctgcggcggaatctgtgggagctagacagggagatttggaagagaatgctaggttgtgagctcttgcttttgagttgtttgaagagaatgctgcatctctggcatgtcaacaagcccagcagaatccagtaacgttcaccaagaaggcttgattagagctggttaggggatgatcaggatggttaggtgtgaagagcttacgctgattatggagggtatgggagtcacggggttggtacccagtgaggaaatttaccttagtagaaacatttgggatagtgtagaagagagaagagctagaggcgaggattcaggaaatagagaatgccagagtctcaattaacaggatggaaagctaaggagatgaaagacttataatagtagcatagtactaaaagacaaactatgtgtaaaggtattagaaatggggactgggactctgaggcagttaggccagagaaaagaagaaggaaaagatttgtcttcatttgattcaattacataagcatttctcagaatctgctatgtgtcacatgctgtggtggatgctgagggagctgatgaaaaagacagaattcctgcccaccagggtcacatagtctggagacacagacacgtaaacaaatgacgatagtgtaaggtgtgtgtaagaaaggaggaatgtacagggttggtacaaaggtgacctcaaggcatccatgggaatcagggctgagggaggaagagccagaagacatcagcacaaagagaaccaagatgctgaagtcacagggggaaagaacatactggagccccgggcagagcagtgctggacaaggacagcaagtgtggagaggaaagggagatccagaagaaccgaggagatccataacagcatgcttggaggaggaaattcgggaaaacgaatggacatgtcagagggagctagttatgaggaagtggactgcaaaccagatagtgagcaagatgaagaaatgaggtgtttatccttgcaatgggagagagacaataaggctgacaaaaactcaagtggtctgtggatagacgatttcgttagctcgatttaagggtaaagggcacactctctggtaggagatgaaaggggatgtttaaaacaggtagaaaaaaattgggccgggcgcggtgtctcacgcctgtaatcccaccactttgggaagccgaggcaggtggatcacctgaggttaggagttcgagaccagcctggccgacatgatgaaacccctgtctctactaataatacaaaaactttgccaggcattgtggcgcacgcctgtaatcccagctactcgggaggctgaggcaggagaattgcttgaacccaggaggcagaggttgcagtgagccaagatcgcgccagtgcactctagcctgggcgacaagagtgaaactccgtcccaaaaaaaaagaaaaaaaattgaatttgggaattagagaaaaagactgtgattggaacccacacaccaagagaggagataaaacccagccttagctcttccatgtcgctgaaagagaagaaaacgtctctttttccttttccgtagccataaaagatgaaaatccgtcatccagctactgaaatcaggtgcacacggttgttcctcctgtgatgagacagggcggagggattgttaccctgttgccagggaaaaaggaaggggctgttcccagttgctatggtgacgaggtaggcgcgttccctcggtaccgccgcacacgtctgaagcggtctcttctcctcgttgctacggcaacgcagtgggcctgttcctgtcgccccccgcctcccgccgcaatcgctaaggcaaggtggaggtaggggctgtcctcccgcggctcagttgccttggagacggcgggtgccctggccccgccccgctcggactgacagcggcggccgcatcgcgcctgcgcagtgccctcgtcccccgcagtctctgtgcgttgaagccggagaccgcggcggcctcagcgaggaccctccgccccggagccgccggccggagccgcagcctctgccgcagcgcccccgccacctgtcccctccccctccgcctccgccggagccgcctcgtgcactgtgagtccgggccgaggcgacggacgccgtggggctgagtcagcgggaggccagggcccgggctggggggaggggaacccggcatccaccgcccctgcctccccacccgcactcccgcatcccgaccgcgccttccccgcgccggtcaaccccctccatccctgtcgccgggttccctccggccttggcggcccggcctccccagccactccccctccccttccctcccctccccttccctccgtctctccgggtccaccttgaggctccttccccactagacgtggccaccgcacctctgccctgggctgatattttctccaaactacctcccgtccgcccttatcccttctccctcctcctcactcctcctaggcctgacatctcccggcctctctggatctccccagtgatgtgccagaaaaagagtgacaggagagcgaggggagacttgggggagggggaacatcgggccaggcccagcctgggggcctcgggtttcttccccacacgctcctgcctggctggtttggggaagcaggtctggacagttctcactggctgctcagagcttgcagggctttccgaatagatttggctgggaagggttcagccccatcgtgatcatctagcgtttaatgaacgcggctagtgcctggtggccttctagtgggctgagctactgcccggccggtgttgcggagcggggagtagaagtagtggagggaagggagaagaggttgcgtttgggagctccaagttcctgcgcttccggtgtggtgttgtgaataagcatcttgcggaactctttaaaatgcttttttttttttttaaatcgcactacaaccctggtataatgtgaggtttggaaaaaggcctgataccatccataggaagtgcttactgtttatatatgaaggggctgtggcaggacttgatcttggattcctgtaaattaactaattggatagtagtgagtttttaacataacgtgtgcagagttgagaggaaggagaaaaatcgaagcttctccatggtgtaggtgtgaggcctgtacactgtgcctcctccagctgtgtgtctttgtggggctgtcaccagataggggttctagcatatttggacaattccctgggttatgtttgctacccctccacctgcccatcttgcagtccctgttcttggaatagaagagggtcccaaacagttttctttttccagaagaactgagttgaagtcagagttagtgcccagagccagaaactcttaataaacatgtctcaacttgagggcccctaactactatatgacctcattgtcagcttcttttttatttggcttccaaatttcagtgtgcttttagaaagcacgtgtaaatataagccagatctaccgcacaagaggctttgggatttttactccagatggtaaaaggaacgcatggtccatttctaaaaatcatggtgaaggagccactcatttggagtttccggggttgcaaacaatgagaaataactatttcactctttactttgctcaatcatggcctattggcagcctcctcatagccactccctgcccccatgcccatcagattagtttacagtagccaagacggctgtcgccctagttttaaacatagagatgaagttcaggaaaactatagcccccatccagcagggcagtttcttctgtttcgaatgccagactggggtttggtgggatgcacctgcctgtggtgcagtgggaactgtggggcctgagagtggcattccttctgtgtggtcctgtgtcacatagctcaccaaaatacccgagcagggcaggagcagacagctgtactggagagctgctcctcctgggctgagtgtattttgggaatcagcgatattactggggtggagggttgtgaattaaggaggaagaaaatgtgtcaaggctagatagatcaggagggtgtaagtaaaatgttcctttccagtttgctatgggatagtacattttcagaggatcagagtagtttttatatggattaatttgcctttgaaatccataccagtgttttatgagataatgatggaatgccttttaaactgctactatgaggaaacaggactaatacttgtcttatacattgcctatccagctgttgctgaatgtaattgttaagatcaaggagagggacatgatttgaaccaagttagacctaaatctatgtaatggtattgaggttttgtaggactgtattcttgattctaagacacaccagcaatttaccaatagcttttaggtaaaataatctaatgctaccagatcaaaatatatatgctgattccaaggtgcatcctcattttagaaacattaaaaccctcgggaaatggcaagacttgagggagggatttgtgaatcttggaactgagaaagaatgctattgatagtattcctgtgtgatgatgccgtttctgacctaccgtcctgagagtgcatgcattgtgaagctgagtttcttctagtccttcctgcacgccagcacacattgtggggttgtatttgtaagatgactggctggagttaggcatagtaggaggctattgaacggaggaaagttcccatatgagaatccaacccagggtcttaatgtggtactctccagaaactgagccaactaactggcagcaaacgtcttatgagctattcctgaatttagccgagtaacatttgtcagaagccgaacagaaaatatagttttttttttttttttttgagacggagtctcgctctgtcgcccaggccggactgcggactgcagtggcgcaatctcggctcactgcaagctccgcttcccggggttcacgccattctcctgcctcagcctcccgagtagctgggactacaggcgcccgccaccgcgcccggctaattttttgtatttttagtagagacggggtttcaccttgttagccaggatggtctccatctcctgacctcatgatccacccgcctcggcctcccaaagtgctgggactacaggcgtgagccaccgcgcctggccagaaaatatagttttttaaaacagaatgcatctgccctgatttgcttacagatacatttgtaaaggtcccaaggcacatgtctccctcgcttaggatgttagcactggaggtgaccccagatggtatagtttaatgccctcatttctaaagttgacacaagacaccaagagttaaatgacttacctaaggtcacccaacccatgcagaacgtatgtaaaaacactttgtaaactgtgtacactaggcagatgaatgttggtggttattagtggctgagtcaggattagatctccagatttccagactagagttattcttcaacaccacattgcctcatccctcataatgttccaaagggttttaataaaaataatttagtagtccgtaattagccctgtaggcaagggcttgttttgtcatctgagatgctgcacagccaggcaaaattttgtgtcaaactgtctaactaaatatttattcttgccactttaaaaataatattttttatcacacattctgacttcaggaaggtctttctttttttaatttgcatcaactaacagaaaagcaaatgtgaagttgggtatttgaagtcttttctacttcttatctgtgagactgccgcattccagaaagcaaggtggagaggcagatggggctgagaggaggagcgtgcacattgggcagctgcgggcttatcttccacctctcagaatggaaccttttgtagtttctgggagccataaggacttctaaaccctctccttgggaagcgcggaggcagcctgacctctggaagcaggcagacttgagttcagatccccatccagccatctcctggctgtgtggccttgggtgagttatgttacctctgaatgccagtttcctcatttataaccctggaataataactatctgttttacagggttgttgtgaagattaaatgaaagggagtatgtagagtgcttgcttcataagaaatagcaatgattattttatattgactaaagcataaaatagcaaataatggtttcaaaattgtttcgtgatttaggtccatcttggactctcagttttgtagcccccatctctcagcacccctctcggtatttgacacgaacagagaaaaggtttgtaccgggaagacccggcacttgcattattatttcaactgccaaaaccggagtatatgaaatgtatctttgctccatgtattcagccaacctgaaagactggcaggacaggagcatttgactttaggaggcacagatgtggtgtgcttgggtgtgtggtgggggtggctagttctccagcagggaggccagtctggggagtggtcttcatttgaaatagaaaagctgctgagctcttgcttgtgagggacacacatgtggtctttattgacttcctcaactggtagaggtatagatttcatcggtgactttgctaaaatcagcttctgcatccgtgagatccagggggcaagggaaaggagctattcatcttaagagggaaaccttgccagtgagcagaggtaaagggaggtcattttggatggagagaattacagactggctcaaggcagaaactactgagtaattaaagaaccagggcaagctgttcaggtgcaagagcaaaagtgaatttaaattcctagataaatttcagtagggaaggaaatacccatgtatagacatctaaagattgaaaagaaacgcaataatgtttacctctgggaggtgggatttgggtgtggggaagggaaaaggagactcaaaggggaacttttactttatatgtttttgtatttgacttgttataagaagcatgtatgctttagtcatttaatgaagaccaaatagaatgggtagtgattgttgttcagtaaatacattttggtacaaaagaagcagctgcctttacttggagcctcccatgcctggggcaaatagggtttgacagcttcaagcaggcccaggcagtttgcaccaaatcaagctcttaagtgagggcaggaccctccaaagtggctgcttcccggtcagcccagggtacttaactgaccacctaccccatcaactcttcctagtcttttcactcccctcttgagaatagtcccctccatctgttgaccagctaaaataatcataattattctaataagctaattttcagctattgatgaaaatggcatctgactatatgaccttcatgaaaaattcctgcctcttagttaatgtcaagagggcttgaagtttaaagggacccaagctgaaatgctggcacactgtgtagctaagttctaggtcagacctggctggtacagcacatctttcacataatgactgattaactgcttctggtaggaattactggtaaactctgataaaatccttaaggattgttcagcttttaattttgtcgtaagttggccagctgtattttctagccagatgtcatgtttattatagaaagatgacacacctatcatttggacatgtgctttgggttgcttacccaggagttaggatgggttatgctgagtaattcacattccatcacccagtcttccctttggccaagagtacaatttcgtgtgacagttagccaagtttcgtgaagcatgctgtggccacggatggtttttcttgtgcacagagttgactggccaatactagcataagcctagatcttgcactcactagcaccatgccctaccagctttgctaaactgaccagatgttgttagtcaactttttagcataacgtcagtgttttaggctctggatgcttcatttgcctcaagtaaataaggacttgtcctatctaaaatgctttaactccatgcaaaatgattttttccctgaaactatttcctagatataggagatacataccacttgtgtgatacatttaaaataactgagcaagaagcatggcttcaaatctgccttgtagcttgactatatataaaaaagcttaaaaggatgtatatccttagaccagaaagtgccattctagcaatatttagaaaatcagaggtgtgtacagaaataattgtaaaagatttattaatgcaacattactagtaatatcaaacattgaaaacaaccaaaagtgccagcaactgaggattggtcaggctcgcccaaataaaatactgcatggcattaaaaacatttggagaagaatattaataccagaacttttaatatcagtgaaaaaagcaggatgaaaaatagtatgccaaggaaaaaaccatatttataaagaaaaacatgaaaaagatactagaagagcatgtgccaagtcataagtgattgagtaatgggattaaaaacgaatggctttccttagtgcttgttggtgttttctaagcttttctgcattaagcaactataacttaattatgacattttaaaaccagtgacttctagattccatgtagtagagcaatctttagagtcttctttgcctcttccttttactgtttacatgtatcggaaggttttagtaaaaccttgtataccacagggctctgttttgggtggccttcttttcccaggtgtcttttcagattctctgtattcccagttctccagtgttccaggggccttttttgagggttttgctcattttttggtgtggatgtgcacctgtctgaattgtctgtttcaaaagactctgcccaggcccactacagttgccttcctccctttgccctttgtcaccttccgttcagccatgagctcagaggccctttttccttccagggatagagagggttgggtgcccacctgtggccacccgatgggcagagccctatgtagacataggctaggccactccccctgtgccacaccaggtccatggagctgctgactgtgttggtagggcctggccgggcagctgtcctctggcctcatctttcccatccacacacacacactgtacattgcctagatggcccagtccagtggactgatacctgccttcaaccagtggtggagtctgcccagctctgagcactgagaaaggggcactttggcctcctcctgaggatccgggacttcgagttgaagaacatatggcctgtcacatagctcgaactgtgctgtgataaatgtttgctaagcaggatctgcctcttcctccaaatggtctggctacccaaatacttgtcctagatggggtggaggccttccctgctgctggaattattagtgagcaagtctttgggtatggctggctggagagactccaccactcggagagagtgattgtgggagaaacagtcatcttatcttgagggcattgtggtcctggtcaccttgtaatttatatggtgttctctgactggtaagaaatgaaatcttaactgcttctgagtcagcaagatcatagttgggtctaaggtgtgtgttgccatgtgaaaggggcaggtcttagaccactagatgaaattagatacctttcccatgtgaggagtgtttcacgcaggcttatctccagtggcataatgtgtgctgtgtagccaggcctttccgcagcaccagactcttggcagccagccaccctccacccccacccgcttccctgaaggttattgacacttacctgggactctgatttggtccttgatttgttctgattttagatgcttagagctcatagctgaaagctctcagtttaggcatcctattaacactcttaagtgacaggatcactgctaagtacagagatgtgttatgctggccccaaaatagcaaggtacagtgtcttgagacaacttgataagacttctattaccccaaaagtatagttcccaggtttacagattattcatataaatttgcatatcatcttcacaagacatgtaagcatgctctcagcacgtattcttcatcaagccctttctctgttttgtattgttagtcactatgggatataaaggaaatgagactcaacccttgtccatgaggaggctgtaatgtgtgtggaagacaagatggatatatggaatgattagtgcatatgacaatattgcatgtcagaaacacatctttggtgccttattctataagacacagtgtcagcccttaaggaattcagctaatattctggcaaaagagttggacacaaaactgtatgtcactgtaacatgaggggatggaaccttatcagctatgggaaagggtgctttggtaagccagaaggaagagtcaccctgagcctgtgagaaccagaaagacttcagagatgaagacacactggagctgggtgtgcaggttgatgtggagactcatcagaggacagctgaggaagagaggcaaaagaaatgaaaagaacagtgcattgggtgtcactggtactacagagtctaaattccaaaagggtgctgagaggaaaataatcattgtgaactggagtaatcagaaaagacttcagtctaggtgcaatggctcacgcctgtcataccaacactttgggaggccaaggggggaggatcacttgaggccaggagttcaagaccagcctcagcaacatagcgagaccccatctacaaaaattgtttttaaattagccgggcatggtggcatatacctatagtcccagctactagggaagccaaggcaggaggatggcttgagcccaggagtttgaggctgcagtgaactatgatcatgccattgcactccagcctgggtggcagagtaagggccaatctctattaaaaaaagacaagacttcacaaaggaagcagaacctgaccttgtctcaaggatgagcaggctgtgagttgacagaacaccagagagggcttttcaggaggcaaggtacagcatcagcaaaggaatggccgtgggaaggggtgtggtggggtttgtaggcagggcagccttaccagactgaggatgtgtgctggttttgagtttggagaatattggtgacattaaccagaaattaggaagtttgaagagacagtttggaaaggagttgctttttagacacagagagctaaaaacaacgtgactgtgggttgcaggacatccaagttgagtgatctcatagaaccggaagctgagggtcaggttgtggatggagctgtagagtgggagtcagcagcacagaggagggctggattccctcaaaggaatctctccagaggtcttgcatgcagagtacaaagaccagagccccaagtaataagctttgagaactgtccatagttaggaaaaaaggaacaagatggtgggaaattaggatgattcagcagcaagggaagagaaaatgtctggaagagagtttcagtgctgctgatttaactagatttaaggatttaactagaaggcagtcatgatgattgcttagggtatccattcagtaaaacactggagtggtttaaggggaaaattgacagagaaaaatagaagcaatggctggtcaccagagaatggcagcagggagggaaagaaagtagtaaccagaagaagcaatcgaatcaaatattttatttttgtaaaataattctattctttatcagcaaacatataaaattgtagtatgtggttcttaaaatatattttgtgtattaaaatgtgcttcatctgcagacttctctatattgacataatccatatatttgtaacttcacatatttcattcctttggtggtatcccatcatattgataccagtatgcttaacctcaatctgttgttgggcagttggagtattttgcaagtgtaaatatctctgatttgaacattactgtacaagtgacatttttttcttttgtggattatttattcatggtatattccataaagtgaattacagaggtgcaaagggtacgattttttaaataagctttttatacaacgttcttcatggtgatctaaccaactttcaattagagtaaaagtttggtattgacgaagaatcattttttataagaaggaggtctgagcatgtttaatggcagaagggaaaaggagttatccaaagaaaatagtacacagacaagagagaaataaagcaaaaaggaatgatctttaggatcccagggaaaggttcctttgaagagaagagggcatggctctttctacccctgacttttagggtgaagtccaggatagattactggggttcctcctaagaaaagacctttctttctttagtaaaatagagccaaggccacttgctgaggtgggggagggagagggttggtggggaattgagttcttgaaggtctgaattacccacagtgagaaataagtctgggcatatgagagatgaataaaggtcttattgtgaatgctgcattggacctatgaattcataatgggctgagtctttaaagtcctctggccagagaagcagcagtgagtggggacgggcaccaggaatgggtgttgcttggcatgttcagggcaaggtttctgaggagtcaaaacttaagatgcagtgaagtagctggccctaaggccggaggtagaggaagggccacaagttgaagacaggcgctggttgtcagccagaatgaggaggcagaggaattacaggggccagtgggaacggaaaacaggtttagaatatgagggatgagcagtaaggaggccactgacagaggaagattttcatattaaaatttggcagaggcttcttttacttttgttcatctttgtataatgtttacgtttctaacacagacgtgtaaccactaacatttcttaaaggaatatttgaaatctcaggagtcgagctgtgccttccgggtgtggctggattgctgagatggatgaaggagaaatgaagatggagctggatcatggagcctaccttgaaaaggtgctgggcctctaaggagcctccacgtgtcagccagtggcttctgtggtctcagcttgtcacaaaagagtggcacccagccagcagccctcctccacctacactccagtagtgttcaaaatccaaggaggcccatcttcccaggcttgacagtcgactcttagatgtgctgttgcgtgagtctggtggtttccaactctctgagcagatccctactgagccatgcctctctggcctctgtgagtgaaggttcttcctccagacagatagagtcccttgctaggaatgcagttttgtgagtggagcttgggttctactcattttgtgagggttccagccctcatctcctccacaaggtgctttgtgcagtgtacaaagtgtacaactgtttataacagccctgtttctctcttgcctattatgaaacttggcctaaagtcctttcctcctctgacccctctctttctcatgtcctcctagatcattcactttgactctgaccctgtctaacaccctgggttgtggtctttattccacctgctggattcacattactttcatgctgcacaactgaagccatttacacagctcaccatgcaaagcagccacaggggctgatagcaggggacttaactaggtgggaatatgtggaaagtcaggtgcaggagtcaacctgtggaaacggaaaagctagggctgctttctttccagggccttacactgacattaccttgcctggacattttgtagtcccgtttcatgaaagccaggacctaagcagaagtatggctccctgccagtccctaccaggaaggaacaaacagcttgcagtacaggcctcaagccaggtggggcaggagcaaaagtgcattgtgttgcctgtggaattaaatggactctctgtaaacacagcctcctgccactgttcttttctctttccacctagtcagcctacctgagaataattagcccttggcctataattaggtagaatgattattttactactgtttatccatttcactagataactagcttcatgaggcagggaccatgtgagacctagcagtatctggggctcaacaaataattgcagaatgaatggatttctaaggcatatttgttgctgtccatccttaatgctatgaaatggtacctaggagtgagtatatagtgaccatagtaactaacgaaaaagccctcacatttgtccctaatggacaagagtgccagcaaaagcaatgttttggacttctcaaagtcaaaactcagagactctcaagatttggagtagcattgaaaattaggaaggcccaacccagctcctgtcagagggaaatggaaagacatgagaggaagatcccactaccgctaccactatcctgttcaataaagcctcacttgggcagagttaagcttccagtaagacagagacagagatagacattcagagacggaacccaccacataatctgtgcttgcataaattaaaaatcaaatgtgtagtggagcctttccgaagggtgcatttcccactctcctaggtatggatgactagatcttccaggagcccactgggttccaagcttaggctccagaactccttttctccatgcagcacccccaaccctgcctagcaactctccccaagtactgctctgcttcccctgtggcttctcagacatgcaagcctctgattgaacttctcctggcctggaaggcttgatttttcaggacccagcaaggcactgctctggcctcgtggctgtcccaggatgtgttaggaggtcataacacaagaggactcatgcctctgaggccctctcgaagggtattgagaactcagtgataatgcaggccctgtcaagggtacttaagaagatcccatttgtacctttatctttaaaattcatcatttgaactcagatggttctcccagtatctagctgttctgtggaaattatgttgcttgccacctagagcagatgacctctttgggaggcattaggaaataactagttgttttaaagctcccagagctgttagctaaaagatcttatatattcctttcagcttggttttctggaattgacagccttttctaattccaaagaggctgcctgtcagcttccttaagaagcttcccaagatacccattgaaggcccaaggcaagcaaagagaaacaactgagaagcctttgactccaggtgtccctgggtagcagctgcccctcaccccgtcccttccccttgttggggatgtgaggtttggaaagaacttcctcagatgactgccaagtccacagttattcctctgaagaacactcgagaatttttgcatcacttgtctcaccctcaccctaataatgtttgtgtccatgcattagctttcccatgaatttaaatatatttatatattattctcaaaatcattacgaccttgcccatattttcagagaaacttgtaagagtgttatgtgtttaatgcctttagtgtatagtcataatcaaaaaccccttgctggatgacaaatataattcaaaattgcttttagaattaaatatttatgaattaaaacattgcagaaatgcacaatgcaaaaagtagaagtcctccataactctgtcccccaaagagaatcactgccactattttgttgaatattccaacttttttctacacacatactaacatattattttttttaaacatggaatctaactatttttcatttgtagaaaaattggaaaagatagtaaagagtaagtgagaaaattagaactacttttaattctaccactcagacagcagtggcaccagggggtggtttgggtgggctttagcactgccctcttcctgaaagctgccccaaggaaacatatgctccaaatacaaatgtgtccttcttctgcatatgcagcttcaagactttcttctagctccctcttcccaccagattaccaaccctaagcccctccatacagaaagctcgttgccaccattgcttttcactgtggtgaacatattactccattttcttccagtcgcacataaatcttttaactaaggatcatattcatttatagtttttacagtagtcatatcaagttccagtgtaaattacatgcagaacgcacttcccattgccccaggtaacattagttttgattttgtccccagtagcactatttccaagacatgtcagggaactgttttgaactcacccctaggagatgctttcactgtgccagtggagagctgaaacataggggcaatgacttgtttaagatcaaaatgaaactctgccttagctaaacttacccacaggtgtctaaatgcccaagatcattggctgaactgcctgagtttactgcagcatttgggaaggagtagaagggacatccctaggtcctgaattcttcctttttctttagcctcaatatcatttgcttagtaccgtttaggtagatggtgcttcggccctgagagagattgttaagacatgtgctgttgaaactcttcttcccttttggggaaggatgttggcctttcctcaagtcaggcagaatcctacctgggccatcttcccagctcctgagataattcacaatattctcattccaaattctgttctgtgcatctcatttctccatgtgcaaagacttagccagagagcattctggcagcatagatctgagttggtgaagctattcctatagcagtaatgtggcagaagcaggccctggagaccctccccacttgctcaggtgtggcccagaccagtgctgtaccatactgccatggccacagggcaaccaccataactcagagcaacccctggagaatgagagagcagcctaggaagtcccagtgagaggagacctaatcagccaggtattcatttcttactgctgcctaacaaattactgtgagagttctaatcccccagaactggtaaatattcctttataggacaaaagaataggtattaccttatatggcaataagtgttaattaagttaaggatcttgagagagaggtttatcctggattatctgggtgggccctaaatgcaatcatatgtatctttataagcaggaggacagaggggtgttgagagagaagagacagtgtggccacagaagcagagattggagtgacctgaagccaccagaagctggaagagaggcagggagcagattcccccaagagccttcagagggagggcagccctaccgatgctgtgatgctggacttctggcctccagaccagtgagagaatgacctttgttgttttcagccacccagtttgtggtcatttgtcacagtaggcacaggaaactaatccagtgtgccaaaatcaaggtgttggcaaggctgtgtttcttctggagcctccaggagaaaatccgcgtctttgcctcctccatcctctaaaggctgcccacattcactggctcctggcagcgcatcactctgcttccatcatcactgttctctgactgacccttctgcttccccttataaggaccctggtgattacactgggcccactcagataatccaggataatcttcccatcacagaaaccttaatcacatctgcaaagtcccttttgccatttaagatgacatatttatatgttccagggattaggacacggacatctttgagaacctaccatagtctgtaagcctaaatggtatgggtatgttcaaattagatgctactccctgaatcttgagaaaagcagtatcaaaggaaacacttctttatacagaagtggtatccatggaatgtattacctgcacaggttctctcaggcagaaaacatggaaagctacgtcagctgcaacagaaagatgggggtatgaatgtgagctaggcaagatgaggttctccctgtaagttttcgaggtgagagcgtgggggagggtcttctacagcactcacctttggtccttctcaggcagactaagctggatgggcctttggtttgggccagtaagggtattccgtgcagccatcaatcatagcactggtgcctgtggagacaccggccactggagaagatccagaggatgaatcacagcagtagacatggtatggggattagaggtaatggggcatgcttgtttgaatggagagtgagagggctgtgggagatgctatggaagatggaaatggtgcttgtggagtgttggttggagggagagtgggaagctgaggagccaccgtgtgaaagagtttccacctagaggtaagaactcaggagggagtgccccggtaatagctacccttgaagtcagacggaattacttgaagcggtttggcttcacatcaagaccatcaaaagccaagttcccattctgctcctgcctatctctctagctctggaaaaaatgatttcttcctcagaagtaaataaaatttcctccttgtatatcagtgtaatgtgggaataaaaaaataaaaaatttcctccttgaagaggatgaaaaagcattaattattaatgtttattttcatatttacagatgaaagacatgctgagttcaaagaggtagagttgcgactgaggaagagaattaactctcagcattaaaattatccactagaaaatatttatgcctgttttgaaaagtctggctgggcgcggtggctcacgcttttaatcccagcactttgggaggctgaggcaggtggatcacctgaggtcaggagttcaagaccagcctggccaacatagtgaaaccctgtttctactaaaaatacaaaaaaatagctgggcatggtggcaggcacctgtaatcccagctactcgggaggctgagacaggagaattgcttgaacctgggaggcggaggttgcagtgagccgagatcgcgccattgcactccagcctgggaaacaagagcaaaattccatctcaaaaaacaaaaaaagaaagaaagaaaaagtttctaggggttgaatacaaagttggagaatttcaaaaagagatctgacaatcaataaagggatcagagaagaatcttattaggacagaaatgtttgtgttcctaaccacccagactcatttctaggacaaggcattagacaaaggtgtcagcaagcagccacctcctacatgcttgtgaaacactatgagaaattatggtgcatgcctcggaaacttgccagataattaatggcttaattctgcttcagctcttcttttcataacacaaaggtctgagactccaattaatgaatttcactttaaaaagaagtttgttgaatacttgctctagtttaaagcatgaagttcaaggtaggggacacaaaaagaacccattctcctggggccacctctctagacaacactagctcctaagcaggcgggcctgctggaggccaggttctaactgccagagccattgctacatggtgtgtcccttggcccactgtgagcagccacagcaaagtgataccattgtcttcatgggaccagcatcctgacctgctagaaggggaggctcctccctgacagtttttaaatacaaggacattccagcatctcattattctgtgatggtgtgaggtaatatctgtcctagtctctagcttgttttttttcaacttgtatatcagagcgtcaagaacactgcatacatttagctgcttttaaaaatgttggcagaagaaaccagttagctaagtggtcattaatagctgcaactcatcattgaaatttttcagcaaatttttttatatttgttctgcaagttgttttatctcatcacaacattctggaatccaaccagaaaggagactgaagtttctggagatgagggaaaactgcaatgtaaaactcatgctttgccctgactcagcttaatagtcagtccactgactgattaacagtgacaagaacagtgctggtaaatggggaaatcgtgtgtgtgttctctagagcggggttctcaagtgtagtcctgctgctgactcaccaggaaagccagcgaaaaatgcagactctgaagccccagcccacaactgtccctctctgagggtggcccaaggaatctgcattagtaataggccagtcacctatgtgtaccctaagttttgggaacctcttccctagagggggtttcctccttgaggtatgtggagttgatcttggcttgaaaacctttacccaaagccaaaagtggcccctgacactccttggcagaaaaactctcctgcttctctctttgtatccccttggacgcagagaagagttgtgctccagctcagcacctctgtgtgtggtgaagtcccagtttattattcattcttgctgcccgacaggtagacagcatcaccacctcagctttttcataatagccacgtaattccagcaccaatgtatcccacattgataaagaagccaagccttggaatgccaccatttcacctttcactgtgtgatggcattctgaagtttttcttggcactcgaagaagaaaaggctatgtagaatttctgatggctgttttgcagaacatccagaaacacccgctaggctccaaagccctaggcagtccctgtttagttgtggtcagggaaagaaatgactcgtctctgcatgagctgggtgctgtgcaggatgctttccatacactgcctcgattaataagaaagtgatccggagtccgtgcaatgcaagggaaaggacaataacagcagaaactgaatgaaaggcaggcttgaattctgttctgagctgtggtgtgactcatcagggtaggaaagtcggttccccagtgcctctatgtatccttctgtaaaatgaggttattgctgttcccatcgcccaatcatcaggtcagagttgggaatactttgaacttcccagatgaaaggtgatataaaactacaaagtgaagagctggtgtagaggagggtgctacaaaactaaaactgagatggctaagtgacagcaaaatctaaggatgtcaggatgctccactctgctgccaggagactctccggacttcgtttgccttgcttgtcttatgaaggatggtgtgaatactcactatcacataaggaggggcagcctagtgtggtggttaagagaaaagactttggggtcactgacctgttgaatcagaatattgagttaggagatggagaagctgcagttttaagaaatttccagctgtgtgtggtagctcaggcctgtaatcctagcactttgagaagccgaggtgggacgattacttgaggccaggagctcaagacaagcctagacaacatagtgagaccctgtctctacaaaaaatcttaaaattatctgggtacagtggtgcgtgcctgaagtcccagctacttggggagctgaggcgggaggaacgctggagcccaggagtgtgaggctgcagtgagcctgaaccattgccctccagcctgggcgacaaagcaagactgtcttgaaaacaaacaaaaaattcccaagtgattttgatgcagaccaaagtttgaagaacagtgtagctcccctggactcctgatggttcccaaggaagctgtgtatttccacaccccctcctatgcgccccatgctctccccgctccctgagccgctttccactcagtccttcctatgcatgcatcagaagcatcatcttttgggtttgcttccactaagtgaactcccactcttccttcaaaactaggttacacatcacttcttgcccaaaacttttcctgaacctttgcagaggaatgaatccttctcagataccaaagaataccatgcaaccatcaaagagaatgagggatggaaaactaaccatatttttagaggagaaaaaaaaactcacaatatttctattttgattcagtttttcttaaatgactgtacaaataggtatatatagtttgaatatgtatatagaaaggtctgaggaatatacatacctggtaacaggaaacttttaaattttatgcacctctgtgttttttaaatctacatactatttttataattttttgaatttaataacaattagagtaattaccaagagagtaattgcttaaataattacagggaagaatcaactgctgttatagctctagtatatcatgttatggttgcatgtgtcttcctgcactgttcagctgtgagctcctgaatggcaaggccttcaggctattctgcctgtcaccagtgcccagcatttccctgacactcagtgggtgcgcaccacgtacttactgaacttaagagatccacggccgggcagtctcatgcctgtaatcccagcactttgggaggccgaggcgggcggatcacgaggtctgcagattgagaccatcctggctaacatggtgaaaccccgtctctactaaaaatacaaaaaaattagccaggcgtggtggtgggcgcctgtagtcccagctgctctggaggctgaggcaggagaatggtgtgaaccgggaaggcagagcttgcagtgagccgagttcgtgccactgcactccagcctgggcgacagagtgagactccatcccaaaaaaaaagagatccaaacagattgtagggaagcttagtcaatcagtcccaggggaggtcgggtctgccactgaggtacagcctgtggtcagttggtatgtctggtcctagtggaaagacaatagcaggaaggaagtgatagtggtggctggaccaatactgcctacagcctcaccacaaaagaaacagtttggtggtggtgatagggagaagaggactttgttggtgacaattggctacaaatggtctgtgggtcactgccgcttgctttctcaaatccctactccagttctatcagctgtgtctgcctgccccgaggtagtccctactctttttctaaacaatagaattccacattcattttatagagccccacataaataaaagaaattggcctattttcacacagtttatctcctttctatttccatcccttcagaatcctgtaatcatgagattgcctaaatggtctctctggaaggccctggcaacgtctaggcacgcatcctgtcttgcatttgtagatcagattctcagactccaaattgggccagatgtaaatgggtaacaactgtctgtgttctctctatcccactaaaagcatcgggcattcctcctctccttctcttattgaaataacttgcgtaaatcatgctagactttgcaccttgacctccttaggccacacgtggaaattgattccctgcctttcaccaccaccaccacacactcatatactttgtgccagattcctaagagagattgaatgtgtataattttttaatctcatgattttggaaaatcagaaactgttactactccataactaagggagaagaataaaagaggtatgttcatatttattatatttatatctaagtgctatagcaataccttttgacaaaaatataattttaaagtcacattttaggagaagcgtagtactcattctcactgactaatgttaccagataatttttttttttttttgagatggagtttcgctcttgttgcccaggctggagtgcagtggtacgatctcatctcactgcagcctccacctccctggttcaagcgattctcctgcctcagcctcccaagtagctgggtttacaggcatgcaccaccacgcctggctaattttgtaattttagtagagatggggtttctccacattgatcaggctggtcttgaactcccgacgtcaggtgatccacccgcctcagcctcccaaagtgctgggattacaggcatgaaccactgcacccggcccagataattttttttttttttttaaatcctgacctatactaagagtttggaatggatatttgaggggaggagaagacaggtcactcagcaaacatgaagcacctacttcagccatgctttggaatttaaaaatgacaaatgtaagatactgcctcatccctgcccttgaattcatgttatagttttaacacaccccactgcaatcatgaaatgtggtatacattccataaaactagaatcaaataggatcaattgcatcttactcattgatatccttgtgaagactgtgtaggccagaagtgagaagatgatttgaaacccttctgtttcctacatggagtgttgattctgtataatgtgttgcttctctcctgagaaatccagtgttctgttttatttcctattgcacatgttgtacttccatgccctttttatattctgctactttccctagtttcagtttagtcatagggattgtatagctcccacttttcctttctctggaaataccatgcatgttttaactggaagaccctgatgaggtaaaatattaggacgttattagccaggcgcagtggctcacccctgtaatcccagcactttggaagccaaggtgggcaggtcacctgaggtcaggagtttgagactagcctggccaacatgatgaaaccccatctctactaaaaatacaaaaacttagccgggagtggtggtgcacacctgtaatccctgctactcgggaggctgaggcaggagagttgcttgaacccaggaggtggagattgcagtaagccgagattgcgccactgtactccagcctgggcaacaagagtggaactcatctcaagaaaaataaaaaaaattaggacattattaaaataaaaccagaaactggtttgttaaagctcctttcttaaccatctgttctatcatcagtcacttcaggctgtttggtgtcaaaattacagagtcccccaccatattacaccagtttctctacttagagctaagtccttctccaggtcacagaaagaagttgttccagggatagaaaaaattcctgttgagggaaagttctggggaggtcgggaggatgtgtagctcctgcctgatgtccctaacacttcaggtggtgactaaactcttggtatggatgtgactccctccccatgagattgccaggttgaagaccagctgaggagtcatctgcccccttctcagccttaccaactcgatttttgctggatttaggaaataggacagttctggttctttatcctactactgtaggccctacttggccatgaccattgattgtgtccaaaagttcatgcctggcaggaaagcaagaactcatgatggatgtcttgagaaccatgcttccttgagtaggagatggcgctctccccccagacagagactaattgagaagactgacattaaggaatgctaccagaataccccagaatttgacttgagccctaatctttgtgtgtgggagctgtccaacatttcagcatacttttgcatttgcctactttgaaagaaacatgataataatctggctgtcttgactgttttactgtgtgccatgttctgaggaaactgacacaattcaggatctagtctctcaggtattttgatctgataacttaattatcagcttttcttgaggtcaccaagccctgagaaaactgacttacatttatttgcttaggcacatttgtaccagaaagtcaatttaataaatatacttcttccctgtatcatggtggcttgaaaatcagaaaggtaatcagagcttgatttataagcatgaaatcagagcaaatacagttggaagttaagaaattatgtgttatccacaccatggttcaagcttgattaattctcctctctctaccagaggagacatcattcatcctagtgaccagaataccaattccagctaagcagagtggtccattggacagtgttacagttgcactaacatagttttcctttctaactatctttttctctagattccataataagccatcccctttttataattgccattacaatcagcttctacatcatgacatcgttacagtttgccaagtttgtagcttattttgcactgataaattttaagtaagtcctgctctgtgacatctaggaagacattgtagttttatttacaatatctccaaatcactctatttctcctgataggtaatcctgtctataacatgtagatacttattaactcattagcagggattggcagacattttcctttcttcttcttcttcttctttttttttttttttttttaagaaatgagtgatgtcttactctgtctatcacccaggctggagtgcagcagcaggatcatggctcactgcaaccttgaactcttgggctcaagtgatcttcctgcctcagcctcccgagtacctaggactacaggcacaagccaccatgcccagctaattttgttgttgttgttgctcaagacggaatctcactatgttgcccaagatggcagacattttttgtaagggccagatagtaaatattgtatgctttgctggccatattgtctcaagtcaaaactactctactctgctgttgtaaagtgaaagcagctatagacactaggtaaatgaatgggtgtggttgtgttccagtaaaacatcttgaccaaaagggaggctctagctcataatttgccagcccctgcttattagtcataatcacagaggggactctattctttcctggttttgctgcagtcctattttgtcctagatattaataggttgtttaaatcttcaaaagtagtttccactctcccctaaaagaactcagaatcctcagagaaatgccttgcttcaagaccgaggcagggaaactgcaagttgatcctggaacaaattattcttctagaaagtaaggaacttaccaaagaatgatgggatgtgtcaacaagactcaagagccagctgtaaggggctcccactgtggccaccaatactgggacactatgaacatcaaaataaatgataataatgtattataaccctttgaataaaataatcatctatgagtttatactggcctaaataaataaaagaaaaaataaatggaggaggaagggatagcttttcctttatgatggagttaaaagttaagaacagttcttaagtaggttggaggccaaatcagaatggggactttttcaaatacctgagggtctttctaagagaggtgtgtgtgtgtgtgtgtgtgtgtgtgtgtgtgtgtgtgtgtgtgtgtgtgtgtatgtgtgtgtgttttggaaaagctccccacaagatactaatgggccttttctgtttggggactactgatattccggccacagaagacagtggaaagatagcagagggaagtatgtcttcagcttgcttggcccattcatatctgcctatcgcctctattccttgttatcctcatcaatctatttggccatcttggaacctggtgtgagtccaaaaggaggagctcctgcttctggggtttgttcttgggtacccatagaaacagatgagacattagaagataggaattttattttattttattttattttattttattttattttattttatttatttttgaaacaaggtcttactctgttgcccgggctggagtacagtggtgagatcatagctcactgcagcctggatctcccgggctccagcttgatcctccccactcagcctcccgaataactgggaatacaggtgtgcaccaccttgccccactaatcttttttatttttagtagagatgaaggcctcactatgttgcccacactggtcttgaattcctgggctcaagcgatattcctgcctcatctcccaaagtgctgggattacaggtgtgagccatcacacccagccaacaggagttttcttaactagcagagactaaccatacaaggtttccttgttaaacccttcaccagggccgggcgcggtggtttaagcctgtaatcccatcactttgggaggctgaggcgggcagatcatgaggtcaggagatcgagaccacagtgaaaccccgtctctactaaaaatacaaaaaattagccgggcgccgtggtgggcgcctgtagtcccagctactcgggaggctgaggcaggagaatggcgtgaacctgagaatggcgtgaacctgggaggcggagcttgcagtgggccaagatcacacctctgcattccaacctgggcgacagagcgagactccatcccaaaataaatagataaataaataaataaataaaaataaacccttcacctgaggaacagaaaaatacctggagggaaagtatctagtgaagaaacggctctcactttccaggggatcttcaagagagaaaagacaagcccattagcagagaaattaaagtcaagttgtgaagtaagcatttaaaatatttttattctattttgaactagtgtagatatctggagaccaaagttgtaaaatacatgatatgtgatccctgacttcaaggcacttatctttttgggaagatatttgaaaaaaaaattaaatggcaatagtagaaattagcagtccccaacctttttggcaccaaggttttgtggaagacagtttttcccatggatggggtagagggtgggggttggtttcagaatgaaatttccacctcagatcatcaggcattacttagatcaagcttgtccaatccgcagcccatgggtcgcatgcagcccaggacagctttgaatgtggcccaacacaaatttgtaaactttcttaaaacatggagtttttttgtgatttttttttttagctcatgagctgtcctttgtgttagcgtatgttatgtgtggcccaagacaattcttcttcccgtgtgacccagggaagcccaaagattggacagccctgagttagatcctcatacagaacacgcagcctagattcctcaaatgcacagttcacaatagggtttgcgcttctgtgaggatctggtgccgccgctgatctgacaggaggtggagctcaggcgggaatgctcgctgttgctgtgcagcctggttcctaacattccacggacccgtactagtccacagcctgggggttgggaatccctggtagaaaggatagtttggtaatccctggtagaaaggatagtttggtaacttaaatgttgtgtagcagggtacatatatgcttaatcctcaagtgaattatgtaaactcaatattcactaaatgtagaggagtaaggaattgctgaaggctagagaggtcaacgaagacagaataatagaattgttgcatctattagaagggaccttaagaagtcatctaaacataaaatctcagctagtccagccttcagtctggttcttgaccccgatagggcatgcccacagggtgtcatcagcttgaagacctgccatggtgggacctcaccctttcctggggtagacatgctgcctttaaccatgttaaagctgtcagttaactgctttaactgaagcagtactgggaatgtttgtcttcagtgggtcaacatctgtttttctgtatcttcaacactttggtcacagttttacaaacgctgtggtcacagaaaataagtgtaatccctattcttcctctgggcccttaagtcattaaaggcagttctcatgtcatgctgagtttttcttctgtctctaagctaaccccttagtttctccaccaggtccttggctgaccgagattggagcatatccactccactcactgtcatggtctttctctttaaacaggcctgcttgtgaatgttattctaaaagtttgctgcacagaactgaagtcagtattacaggtgtcatctgacaagcccagaggggaggaatattatcactttcctcattctagaagaaggactttataaccagatatctagtttcaaatcagttctgttctcactggctgtgttaccttgagcatgttacctaagctctctgagcctcagttcagttctgctaatatctgagaacattctatgtgctggacaccatgccatacaatagggctgaaaaaaatcccagccctggggaagctcctagtgacgtggaagaaatagacatacttctgtgttagaagtatctccacacagtattacagaagtacccagaaggctaggctaacccagcccagaggaacaggctgggagtcaggaaaaactttccaggggagttgacactggagagagtacatgccagtgtaaaatccttatgtcttttgcacacagttttgcaaaccttatatcttctgccaaatatcttccatttgttttttaagatacaaatgcagaacctagtatgtgtttatttggagtggtttagcttcttcctatagcctgtcacagcactttggaatcctgattctgtcagctagtgctcacagaaatggtgggacatgagcttggccttgaaaggaggagagcattccagtacaagccaaggcggggagggattcagtattagggagactggcaggaggaagaacaacagtctgactgaagtgaggggcttggggttggagacatcagagaaagggtttggggaagaaggaagtggaattgatcctacagatgtttggtcttgatcctacagaatagagatatagagagccattggtgcttaggggaagggggtaactaaagcagtgtttttggaaagtttgtcttgcaatgagtagcaggaaaagttgaaagaatagggaccagaggcaggaatactatccagtcacaaaatggcaacaacctggacaaggatgatgtcagtgagaatggaagggacaagatgaatgagaaaaatcaatgacttgatgacaagttggccaaagcaagagaggcaggattagggtccaactacatgcacttttttcttctttctttccttctttctttttttttttttttttttttttttttgagatggagtttcgctgttgtcacccaggctggagtgcagtgcagtggtgtgatctcggctcactgcaacctcctcctcctgggttcaagcgattctcctgcctcagcctcctgagtagctgggattacaggcatgtgccaccacacccagctaattttgtatttttagtagagacgggtttctccatgttggtcaggctggtctcgaactcctgacctcagatgttccacctgccttggcctcccaaagtgctgggattacaggcgtgagctactgtgcccagcccaactacatgcacttttaatgtgactgacatctcatagatttttttttggcagatttttttaaccattttagtggataatacaaatttgaaatacaaattagttctaatattttaccataaaacatttcattttttccacattatcattattaaggtttccatttcaattctgaatatagttctcaatattttacaactgcagtaaggaagaaaaaatattgttttcaaactacttatctttctaccaattctcagttgttggttcttaaaaaatgacttcacaaaaatttttaagatgctaataacaaatttccacttaaatatatggatggctgattttacaaataaatgtacgggtttgtgttactattatgctctccctagataacaaaacaataaaagaaattttagtaatatcaagtaagtactgaccaggtgagtactgtgagacagtgtcatgaaaaggttcttaggggttgaaagacatggtttctgctcagaggactcaccgcggagcaaaggagagagacccgtggacagataagtacaaggcaggctcctgtgagaaatgacagaggtatgaggctgtggaggcccagaatgttctccattatgacccgatgaggagggaggagggaagtggaaagaggaacaagggtagaagagaaaggagaaaagtgaaagacttaaaaacaaggagggaaaagaatgaagaagaaagagttacaaggaaaataacttgccattttttacacctaataatgtatgaagtactttcagattggttatttcatttgattctgccaagaaggcaagagatgagagacaggaggaggaggagggaagcaaggcccatgaccaggagaaggagctgcaccacaaagagctcagagcccctctggcctcctaggccggtgcagctgccggtgtccgctggtgaaggtggacctcagtggccctagttagaagccagtgggaccttgtaaaaccagggctccagctgggaagtctgaacctcctggacagaaagcaacagaagccttaaagtagttatcttggcaactattgtcaaggactcattgctgcctgaccacaagatttatccaattatttatctaccttgttttattttttaatatttttttctcatcacgaaagtaagacatattcgctgtagaaaattttgaaaattcagataaacccaaatatgaaaataaaatcccatataaccgtaccatcagacagaaccacaattataattttagaatatacttcacatttttcttcaacaactgttggtatatttttgttctgtaatacaatcatacattgcttaatgatgggatacattccgagaaatgtgtcttgtgattttgccattgtgcaaacatcatagagtgtactcacccaaacctagatggtattgcctactacatacctagactgtatggcatagcctattgctcctaggctacaaacttgtacagcatgtgactgcactggatactgtaggcaattggaacataatggttagtattcgggtatctaaatatatggtctgggtatggtggctcatgcctgtaatcccagcactttaggaggttgaggcggcaggatcacttgagtccaggagttagagacagcagtgagccatgattgtaccactgaactccagtgtgggtgagacagagtgagatcccatcattcatagatagatagatagatagataactgatagataggcatataattgatagataggtacgtagatctaaacatagaaagggtacggtgaactatgattgcaccactgcactccagcctaggaaacaaatcaagaccccttcattaattcattcattcactcataaataaataaatgcatatatacacacatacgtacatacatgtatacatacatacattaaacagaaagggtacagtaaaaatacagcataatcttatggaaccactgtcgtacatgcagtctgttgttgatgtaaacattgtgatgcggtgcgtgactgtgttttcccccggcttcatggactgtaaacatctttccatgtgttttatcaattgggattgtgttttgaaacaagtaacagcaaaccctgtcaacagtggcttgaacaaataatggggtattttgctcgtgaggcaggagtctgaaagtaggaggtctaggctagtggaacagctcaaggacgttgccaaggacactcctgctgtcttaggcggctgtgttgctttacggtctcaaggtggctcttaactctcagggaggctgagaaagcaggcattttgtgttactggcctctctattggagacaggtaaggaagaagggtgttgggatgggagctgagtcacccagccagcagtgccagcatcattacatattctagaacatccctcttttcagagtggcattgtttggatgtgtcacaatttatttaacaattcattgttggacatttcggtggtttccagtttttcattattgtaaacatgctaatatctaaagttttacacatatctataattagtgattcagtataaaattcctagaagtggaattaaggtcaaagagtatataaaatctaaaggcttttaatcttttttttttttttaaccaaactgctctccaaaatggctgtactaaactatattctcaccaatcatgtttaaaagaacccatttccctgtaccctcaaaaccaggttttttgttctgtcattaagctgttataccatgcccattagtgtgggtttaactttgtattagccctgaccagactctgaactgcccatcttggaacccagagcagttgcacccttctgtgttgcacctgggggtgtgggtctgcaggctgtcctgtatgtccaggcaggctggtggggcccttgtgctgatgggcactgcagaggacccatgatgtttcttgtgagcatgcacctcgctcatctattcttgttttgaaagtcctttctgccactgtgaagtcatcatttgtcccacctgagtcctaattcaaggccatcctggcttgtcttagattgagatgcacctgggaactggcctctttcgatacagtgcaccccacatcctcactcgttgctcttactggcctacctcaggtataatggccttacaggtctgtgtcatcatctgtaacagagaaggctgagaagatggtgtcagtagattctggggacattttaatctattaagctgcttttgagacgtactacagtttcctgaggaggtggccaaaagagtgagtgatccctatgcatcaacactctatgaagtaattactaactggtgagcagttagccactacgtacggcccttctcatccagtgaggagtcagccatgggtgagacagaaggagtccctgaactgcaatcctctggccagattctctatatgcacacagtggtgtttcaatattcatgagtgtaggcagatagtcacgagtaaacaaatgagcaatgaatccaaatgagcaagacaggctgaatgcagaacacaggccaaagccccagaccacatcactacccctctaaaatcagaaaaaaaaatcagaattctgattccaggagggaaatgataaggactctatttcaatgctcccttcaggaccttaccctgatctcttgagaggtgacaccctcaagagagaagcaccatcttagggaatcagctgtctacgagcttttctcatagccatggctttacgcttctctgtcagttaccatcaccacttggaaagggaaactacaatttatgaagcatctgttatcgatccagctaatgctgggaaggtgatacctgaccagtcactactgtcaaacttccagctcacggcttctacccagatccctcactttccccatgagagggtgctgctcagtatggcatccacaaaatcagtccctcacacaacttacttatttaacaatatcacagtccccatccccttctccttacctaatttcattgttaccggccccatgtcaaagattatttaaaactccccggctgtcaaaattccattaacaacctctgacctataaccgtcactcactgaattgacacgtgtgaggttctgtgcggatgctccacttgagttagcttgaaccttcacaacagtccggcagcataggtattttagaattattagtaatgttgagcatgtttcacatgtttgttggccatttacacttccccttccatgagtcatctgtcaagaggctctgtgcccacgagccatacacataatgatgtccaaaaagcgcttctattttactgtaagaaactcaggcaaagagaggccgcctttgcccagaggatctctcatgcctgggaggtcgtgagaggcagagctggagttgggtgctgtggagtccttttcaccacctttttcatgcaccatgctgcccgtccacatagctcaatgtgcctgtttatttcttaggaaatacaccacagggctactatttaggtagtgcaattaaagtttactttctgaattctctatttcccctatctttagcagaaaacttgggaaagcctaagtcattttccacttcttagccccttcctcctccccctcattttctaggcaaaaatatgataagagagtagcttggataatgtctagctttgttttggttctctggtgatgtgaatttttcccattgttaccaaactcccactttttccacgtcgaaatacatttcatgatagctggagtatggcaacagcactcctgagttacaggcatgcgccaccatgcccagctaatttctatttttgtaaagatagggtctcactatgttgcctaggctaaaaccttctgataaggatattttctagtatctcatgtttagagcaaattactagaatatcaaggatctagtaaaaaaaaaaaaaaaaaagtaaatgccatggatatgtctgggatcagtacagatttatcccaggatactagatctttagtagaaggcatgaatggtgagaattcctcagcaggatttccggatgtttgttagacatgagcacacagatgacttgtgggttctcaaactcgacagcccaaaacagttcacagaagagtaaatatatatgggtaataaacatagaaatatgttctccctcactagtaatcaaagaaacattattttaaagataaaaaaatacttctctttcaatcaacacactttttaaaataataacaatgttggtgttgaaatgagcactcataaacttctggggaaaaaatgaaaggtacagcctttatggaagctgttagtccttaaaaaatatatcatgccctttgacccagtaattccctgcccaaggaagtagtcacagatttagacaaaaattgaatgttcaaatatattaattccaggactatcaaaaatcaaaatgcccagcaactaaagctaatgtaaggatagcatggaatattatgccccatggaagatgatgcttcctaatatccttaattattctttgaagtgtccacagcataatcttaagtgagctcgtggtcttcactgcactctcaaacctgctcttcctgcagttttctccatccttccagtggcttgggcaagaaactttggggtcatctttgacctctctcacatctcatagtgctctgcagcaaatcctcagtcccacattttgtaagattctccctactttccaggccttctgcaaagcatgaactgcaaaggctcgaggaggaaagaaagcaacactgaactcccttgagtggttagggttttggttcctaaattaaggcacagttttccttttccttgaattaattatctaactcttcctcctagggcagaatcaatgggccaaatggcctcattgagaacatgacatccaaagggagagtggcaggagtcaaagtattattataatgaatagaaataggtgagggagaaagtaatgggatttcattggtggcaaccctacttgctgagaattgttgtatattttcagtgagcaacaaatattgtacagcatggaggaccatcaaatttaaaagagaccttaaaaccaagagtgtgtcggccgggcgcggtggctcacgcctgtaatcccagcactttgggaggccgaggtgggcggatcacgaggtcaggagatcgagatcatccttgctaacacggtgaaaccccgtctctactaaaaatacaaaaaattagccgggcacagtggcgggcgcctgtagtcccagctactcgggaggctgaggcaggagaatggcgtgaacccgggaggcgtagctggcactgagccaagattgcaccactgcactctagcctgggtgacagagcgagaccccgtctcaaaaataaaaacaaaaacaaaaacaaaaaaaaaacaagtgtgtggaagccattagcttagctgctgtggctattagacaagtaggctttgccattgggtgaagagagacttagtagactattgatgtctgataattcccattattggggaggaaatgtaatttcttcttaaccttcataagttcatagttgggacagacccctgtaacaaaagacagatcagcaaaagaaaaacaagcaaagtttttttattttgtttttctcttcagatacagggtctcactctgtcactaaggctggggtgccgtggcatgatcacagctcattgaagccttgaactcctgggctcaagcaattcttcctcctcagcctcccaagtagctgggactacaggcatgtgccaccacgtcccactattttttttaaaattttttgtagagacggggtcatgctatgttgcccaggctggtcttgaactcctgacctcaagcagtcctcccgccccagactcccaaaccactgagattataggcatgagccaccatgcctggccaagcaagtttattaatgtgtggagggcacagaatgcaggagaaaccccaatgaaaggcaacttcaaggcagtggcgtcaaactctggcttatatgccatcttcagaaaagaacaatacatttgtagagaaataacaggacagaagaaagcaattttaggcttccaaaagggggaaactgtgggaagttagatacatgggaagaaaccaatggtgtaaggtttgtttacagattcctctggtgctgtgtctgggctgataagaactatctccagtaaagaagaatttatatcctgtctttaggcagaaaagcaggagaatagagctcatcctctatttgctgctctttaattacttttagctcaaaaataagtcaaataggcatattttggggtgacatattctggttttcctttaccttgaagttgagtcataacaccaaaggttcgtctatatcttgcatgtacaaataggtagaaaggtttatgctaattaggtgagcccagattggcaggttgttgaagggctaatttaactcacaaaaggccttttcgtgtttagaatcccaaggaagaagtttggacttggttaagttatcctgtgattattttagaaaagttgtaaacctgctatcctcattagcccggattcttcttaattgtgtcttagaagtaattgggaaagttttgaatggcctgtggtctgtcagaagtaaaggatttactgccctgggataaattatgttctgcataacgaactttattttgacaatattttagtttccctttgaaaaccttatgccctttctgaaagaaaacagtagatagctggaacagtcttggagcttatctttagaacacagcaaaaggtcatccacatgtcaaacaacagtagaataacagatatttaaggtccttgaggttgtcattcaggacttgtgaaaagtacagagggggcccctgttaatctttggggcatcacagtccaagtatactgttaatgttcccaggagaaggcaaacaaatattgcctattttgatctaaaggaatactaaaaaaagtaaaatacatatctacaactgtaaaatatgcagcttcaggaagcgctggagataaagaagtatttgattctactcagagaatgactattctatttatgacctcaaggtcctgagcagatgtctatccccacctattgagttttttgactgggagggtagggatgttacgaggacttgtttaaaatatgatgagtcctttctctatcatgcttttgactatctcagtccttctttagctctggtttagagggtattgtgcaagtttgggtagaaatttagatggatgtttctgaatctttatggattcagccccaataatcctacagacaattggatgtttgaaactttgtcctctttctgttctaaagtgcctctcaaacaattttgttcatcaaagcttccttgactagtgactgtaattctaaattatccttggtgaaattatggcatctggaaaaataaggccacaaattttagtgatagcgtaaatgcatttaagaagcgagagtcttctgggctgggcacagtggcgcatgcctgtaatcccggctacttggaaggctgaggaggaggatcgcttgagcctagaagttcaagaccagactgggcaacatagtgagacttcatctcaaaaataaataattaaaaattaaagttatgaaatttattttaaaaagaagaaaaaatctgaatttggattttttggagggaaaaagaagcaggaatcttatgaagcaggagtacaggtttaggattaaactgagacaaagccataattctaggaacagtcagtccagagtaactcaggtttaactcctcctgccctaagcaaatgcctgggccttccaactacaaactccaagcagattaacagttcctagaggacagaaaggtttggagaggagaactctcccagagccagacttccatggacaaagcaagagaagactgaggaaagttctcatagggtgtatttgtaatcacccaaaactggagacaaccctgacatcctcagtgggtgaatgagtagactgtggtacatccatacgtgtgccattgtttggaatactactcagcaataaagaggaaccattaatccgtgcaacaacttggatggaagttaaaggcgctatgctgagaagaaaaaaagccagtctcaaaaggttactggatgatttcatgtatataacgttgacaaaatgacaaaattatagagtaatggggaacaggtctgtggtggccaggggatagggttgggggggagggcacagctataaaggggtagcatgagggagtttctttgagattatagaacaggtctgtattctggtagggtggtgattccatgaatccatccatgtgataaaatttcatggagtatatgccaaaaaaaagagtgcatgtaaaaactgatgaaatccaaataaggtctgtagtttacttacaaatgtgccaatgtggatttcctggttttaataattgttatgtaagatgttactgggggaagctggatgagtagacatgaaatacatgagaattatttgttctgttttgcaactgtgagtctaaaatcatttcaaagtacaaaagtttacagaaaattggagggactctcttgggaatctcttcagcttttactagaaaagataatataaaatcctctgcagaattataaattgaatgcagtttctaagcactgtaatttcatttgttgtaattttgatttggaaattattttaactatagtattagcaatattttgtattgttgactaaaatactgtgtacctgaaaagaaaatcctctggagagtttcccttctagataaaataactccttaacaatggcatacagagctactggtgatgtggctttcgtctgcctttttagccacatcaccttctgccccaacatgactctgggatgagctacttgcagtcctttccttcctccccatgcattcccctttcctcttaactcttacctgcctgatgagtttctccttcaagacccagttcaaaccatgtttcctttacaaagctttccctgatgcaggaagcagagttgctccagcagctcctgtatctggagttggagcatgatgtgttgccctttggttatttcgttcagttgtccagctctcacctaagttcattaatttctcgagggcccagagtgggttcatttcttcctataggtcctgtgctggcacaggggctggcacacagcattgggtgctgaagcacacactccacaaatggtgatgagtgactgattgaatctgaggctctgcaatgtccttagaaagcaattttgtctattcttcctgccttaatacagtaattttccacaaaaccaaacattaaaaagggctctgattaaccacagttaaacaaagttaatcaatatgtacaacattattttccaaacattcaacttagttaagactttattatataaacacatttcttatcttgcttttcatttgtgatacagtgttgtgagtagctggagaaagatcgtgagtcgcactcatgggtcttcttggacagataaaatctagaacttgagggtaggatatggagtctgaagggggatgggtgagatgttgagataaggagcacaagcctacttttaatctgtatttctttttttttttttttttttgagatggagtttcactctttgttgcccaggctggggtgcagtggtgtgatattggctcactgcaacctccacctcccgggttcaagccattatcctatctcagcctcccaagaagctgagattacaggtgcgtgtcaccatacccagctaatttttgtatttttagtaggggtggggttttgccatgttggccaggctggtctcgaactcctgacctcaggtgatccacctgtctcggcctcccaaagtgctgggattacaggcatgagccacagcacccgggcccaatctatatttcatttcaaattttaactgaaagaaccaaaatgctctccaccctgcaggcagtcactcactatctacctgaagtgctgcagcagacacacatggctgtgatgacaaatgcctgatgtccctctccagcttcctcctgggcaagtgatcaaggactccacaatcatctgcaggtctagctgctgtccccacactccaacaaaatgactcagagtttcatcatttcttattgcacaatttaatgaccatatcgccacctctggtctggtagcttcattaaacagggcagatgacctcctctttgaaagtgggccctcccttggctcctaagacatcaccttctctccacctcctctattttcatcgcgtccctaacattcctccaggactgagtcattggtcttatgctctttttttaaaataaaagtaataataaatatgtttcccatgtccagaatttcccattttctcctcgctgctttctggcatcctgtcatctttaaaggcccaattaggtgccaccttcctccagaaaccctctaactgctgatccccctctcatctttttcatgtgcctggaacacttaaaagccaaaggtgctttcactatttagcacttcatatattctgctttgtggcgtcccttgttattttataaattactcttacctcttcaaccaaagaaaagctccttaataaagacaagacccatgccttgaaatgatcccatgtcctcatgatgcctcactgggtgttgagcattttgtcagtggtcagtaagcacttgctggtcgagattaaggcaatgctaggccggacctggtggctcatgcctgtaatcctagcactttgggaggctgaggcaggtggatcacttgaggtcaggagttcaagaccagcctggccaatacggtgaaacctcatctctactaaaaatacaaaaattagctgggtgtggtggcacacacctgtaatcccagctattcgggaggctgaggcaggaggattgcttgaaccagggaggtataggttgcagtgagctgagatcatgccattgtactccagcctgggcaacaaagcgagactccatctcaaaaaaaaaaaaaaaaaaagaaagagagaggttaaggcaatgctgcaatgtcttgaaaaaataagtataaagaagaaaactgggccaggcatggtggctcatgcctgtaatcccaacactttgggaggccgaggcaggcagatcacaaggtaaaaagtttgagaccagcctggccaatatggtggccccatctctactaagaatacaaaaattagccaagcatggtgatggacgcctgtaatcccagctactcgggaggctgaggcaggagaattgcttgaacctgggaggtggaggttgcagtgagccgagatcatgccactgcactccagcctgggtgacagagcaagactccatctcaaaaaaaaaaaaaagaagaagaagaagaagaaatcctctgaaattccctttccctcctcctaattctcaaggggtgaaatctgggcaagtcatcctgctctagagctgtgaaaaatcaaatcgtccttcctgcaccagtgtggtggtgtggaaagagcatgggatttgtgttcatttggccaggttcagctctgatcttgccagtggttgatcttgaacttggaaaagtcactggaatcctcatccttcatttcctcaaaagcaaaattgaggtaacaactcaaaggctttctggagctggatgctgtaatccacaagagtggcatttctggtgggaatttcgggcactatggtagggcaggagagaagctatctgcaggccttctggaagctctccagtgcatgtccccactggggtgggggctgactgtctccacgtggggttagtcctgcagaacaggcaggtagagtagagtctgagggcatgaggaaaggcagtctactggagagggcacagagagttcaacaaacactgaaacttaagtttgtcctggacatcttcagcatccgactttctggtggaaagcttaaagtataaatgactgtgccctctcaaaagggcacagaagtaaaactgggaggattttgggaggggactggatgtggggtgaaaggtatggtgagagcagagaagaggggcctgagcctggggtcaggggaaagtaggctaaacaattcacaggatgcagacatttcagagaagggtgacacatcacttggccctgaacaacaactataagccagacagtccaaagagacatagttccaaaggaacataaagtgacatggcttgttatgtgtccccagagacatggatgtgcttttggaacttgaaggataattaaaaaaacatcagacccaccagggctgctgcaaacatgacagttcccttcccaacacgtcatggcagctgctgcagctcccttccctctatcctgaggctagccacagatgggccagcagcccacccccagagcagaccaagcagagaggtgctcccaggagttaccaggttccactctcggaaccatcttaaaatcctgttctgggaaatccagcagcaccatgttatatgcattagagggagactgtttaaatcccttgccaaggttcccaaggcttcgtgctgcatctgtttgcgtgtagccagggagtgcagctagcattctcctctccttgcttctccatgtagccagtggcacctcctcagggtcaacaaacaagaaataaaagcagaaaaccacactttctgagtccacctgccatctgaaccccccaaaccctagtttaacctctcccattcattcattcattcattcaataaatatataggtactgagaagctattgtgcactgagccctgagccagtactaattgagggaagaaatgggcaacatagcttcaaaagcacagctctgtctttctgcctgaggcagcagagagtggatacccaaggctgtccctactctctccctgctcaggaccctgatcagagggtctgtgggaattgggtcagggtgcaggaaagaagatgttgagtcagatatgtctatgtcagtgatcttgcctatcagtaaaggttgctcagcccccaaagcagcgtgatggtgaacctttggctcctgccagcggtactcattatccttccaacagccccatgctcaatcataccatcattctgatgcttcatgagaactgaggcttggatatcttcgcctacttgcttgtgtctcacaggcagcgaatggcaaagcctgtagccaagtcacactgtctgccttctgctgggagccttggattgatgggtgactccatggacatttgttgacctaaaaagtaggtgtttgaggaactgaaagatctccagcaaagaacgtttagaaagaaaatattgcctatctgcccacctagatgaaccctactgaaatggattgattttagcgatgagaaattttgtttactatactgcagggtttccgttaaccctcgaagttatggtcagatagggtgacctagccagaacctaccccaaggactccttccctggctagcagctacagggatgtggcaccattatcccaaccagcctggggagagccttagtaagagttcagatcattattcagcaggacatgtccaggatcccagtggctggaacttcagcagggctcagggtcttagagttgtgacctaaaagtgttgtgagaacaaaatcctggaggagtttcagtccctacctgaacccacagccgtccagatccctgtcctggatgtgtgggagggggcgcatgctgggctccaggccaaccctgcaaatactccacttgccccgtctctgcattgattaatccagctttgagaggctgagcctctcaatgaatcaggtccttgctcagccataagaagaaggtgattggccaggtctgccagggctttgtgacccgctggcttgctccccagcccctcagaacccctcagccccacctgcacatactgcctccatgcaagcccagaataacctggatgtgtgactcacaggggtaggggtagcaattttgcagattttccaaacaggtgacttcagcccccgggcctgggcaggaaggggtagcccagtgacaatgggcatagtcccacttcaggaacgggaaacgtgttggctggctctgtggagttctctctcttctgatcccacagcatctgttccagttgtcttggccggtaggatggcgtctacaaagcaggctatatgggaaatctggagctggggagggattgtggtcagagcccagctttgggaagcccatgtggctgtctcaaggcaaagcagcagagaaaagttctgtagtctgtctcctttctggactggcatttccatggtctgagaccagaggctggctgtgtgtcaggcacctactcctcgaacaaatgcccttagattctcactgtctgtccccgcgatgctgacagcacttgccaaatacatactgaatgtcaggctctgtgctcagcactgtgtacacatggctcacttaatcctcataactgttctgtgaggtgggagctgtcactgtcctcactttatagatgaggacactgagacctaaagtcaagtcagacagctaggacatggtacaactaggatttgaacccacctgatgtgcctggagatctagtgttcttaagcactacctttctggagcttgctggaggcatgctggccacctccttcaggactggtagacctggtgtgtctttcatagccacgctgggcagagggtggaggcctggaaactgcagggggttcttccagggaccagccagaacagggctaaacttggggtaaaaagagctctagagaattagagaagactgagggcccctaaattacccttaagacatatttgtggaagacagatttaaaaacaaaaagccaaaattagatttaggctggtgataaggtcattaaataatagaatgtgaaatttcagttgtgcagacttattggccatctttatgatttaagaatataagtgcctagatctaagtgcagtcctaatcgcctgggaaggaagcagatggtctctagaaacccttctgaccatgggttagtgggatttggtcttgatgaccatttttaaggcctcagtctgcagaatgaccagcagcttcccctcccgcaatgagagctgtaattgcctttcccagttgcctgtgaatgcaccatgaaccttacagtcctagtataggaaatgactcagcaaaatcaccagattaaacctcctcaacttttctttcccttggctccattcctgatagcaggagtcgaggcccttcagagcaggctttccccaaagccacgttgtcggtctgatcctcgaatggggatccgcctggatgatgacatgccacaatccaatcagggtctgtttctcctgacagtcacatgtgccaaagatcatggtagaaacatgtggatggggttggaagacactgctactacatctcttgggacagagcctgccccctccgagtggctacctaccattctctccggggaggtgaaggagctcttgggaacaagtgtgttattattaagagtttcgtcaggttatgtctttttttttttttttttttttaagatggagtgtcgctcttttgcccaggctggagtgcagtggcgctatcttggctcactgcaagctccgcctcccgggttcacgccattctcctgcctcagcctcctgagtagctgggactacaagtgcccgccactgtgcccggctaattttttgtatttttagtagagacggggtttcaccgtgttagccaagatggtctggatctcctgacctcatgatccgcccacctcggcctcccaaagtgctgggattacaggcgtgagccaccgcgcctggcaggttatgtctttgctgtaattggaggcagctggtccacttagaccctgatgcttgggcaaatactttatacacctctgcccccagcagctggtctggtgtgagtccaggcccaagtcaacccccaatgcaaaagccaatcagaagttggacctctttggtgagttcaaactgtggttttaggggatacggaggctggcttagttcagtccaggatcttagaacagccccaatgctccaggcccctcagccagcccagcttttagaggctcccaatttgagctctaaactgagctctggaaagggggtttgggggatgggggatacatttaaaggagtttttgctcaggacctgggtgccacctgctggccatgtttagttctacttacagagccaaagctacgagaggaaaattaaaagggcatcctgccctccccaatgtgatgtttgctcaaaggaaacaaggaggctgttacttcatgctgccctagcaggtgcagcagagaattcctgcagagacccctgggtgccctggatgagtcctcctgagccaaatggacccccactagggcagagtgtagcaccagttgtgaggacctgagcgagtcctgagtagggactgaagctgtgttcctgctactagctacctgcttccccagaagccccatagtgggtaacagcatgattcgttgctgggtcctgaaaggagccattttttccagcttccttcacacaggcactgctgccactcatgggaccctagagtcagaccgaaggtatggaaaatgccctcccttcatcaggcattgacaagactgggtcaatgctgagaagacctgggcatttttcaagccgctatgtggctcttagtgactcttgggagccctaaaagcaaggcctttagttgtgttctaaactccagggaaactggagattttccctgtgtgccaaggactggctagtattttccccccagataagtggcagaacatcccaatgttccagcctttgccattgcaacaaaagccagtaaatcacagctaagtatgcatatcaaatgaaggctgtggttctcatacagggctgtgcaccagaatcatctgggctattctttaaaattatgtgtgtgtgtgtgtgtaaaatatgtgcatataacatataatgtatatataatatatcatacacacacacacttgggctgcactgtagcctcttgaagtctctgcaggagaagccagtggactctcctagtaaagaatctctgcaatgcatggaagaggcctgaaccattagcaggtccaatcctgtggaaccaggaaagctgcccccaggctggaagacccttgaggctcaaatgatttcaatcaaaaactggaggatatatttggactaagaccattgcctttccttttcttcagtagtcaccccttgaaattcatacactttaagcagaacaaagtccctaaagtggctcggaaactcccagggccaacctaagactactccttgcccccagaaccacccaagaccagatcagcccctctgaggcctgtcagccacagctggcccagaatcactctgccccaggggcctcatagggaaatgagtctctgagcctgtggaacactcctgcagagtcattctggacagttcccggaatagctggtgccctctgcaccagctcctggccgtcctctgcaccctccctggggacctggcagagtctgaccactgtggccctggggtcattcacatccatctctctacctctgcatgccctctccttccctattcttgtggcacttgctgtttctagcacactttggggcatttggttatactgttctcatgtgtgcattactctccccaataagattatgaactccttgaggacagggacaaatcttttcaatttcttgcagtccacaactaaataatactcatcaaaatcagatgccctttccttgaccctacccactctgccccttcggcaagcttagcatccatccacccatccactcctcctcctgttactttaggtgcatcctgggaactcagaaacactcccctgactccagtctgcaattccactccaccaatatggttaggcagttattatccaccaagaactggtgtagaacccgaaagtgaatggaacagagcctgaccattgaagagcttacagtcaggtggaaggggcaggcacacacatttttatttatttatttatttatttatttattttttttttggagatggattctggctctgtcacccaggctggagtacagtggcatgatcttggctcactgcaacactccacctctgggttcaagcaattctcctgcctcagcctccctagtagctaggattacaggcctggctaattttagtagagacagggttttgccatgttggccaggctggtcttgaactcctggcttaggtgatcggcacccccctcagcctcccaaagtgctggcattacaggcatgagccaccgcacccgctctcacacacatgatttcaacagaccatgtgggatgccatgaagagccgtgcccagggtgctgtaggatcatgggcacatgtctcccacagagggggtcagaaaaagtcccctggagctaaagcagagtcctgaggctgagtgctgggggagggaggatggcggggggatggtggggggatggcagggggatggcagggggacccaggccagaaggtgatgagacatgattcagaaagaggagaggacacgaggcatcactcaatggttcaacgttactgaacgtcttgcctgtgacaggcctggataccccactcttggcttcaagacatggggcgcaggcatttaaacaagtccaatggtgagcgcaagggccaagatgcagggcagtgggcgcagagacgttgtggaggaggaaactcaagtgcagtcaacattactctcggaaagctctgaaattgccaggtcttgagtctttaggcgctcccaagacaataattcatttctgtttctcttggctttttggccccgcctggcctccctttgcctgggcaatgaaggacaaggtttatttttcaaaggaggaagaactaggaataaagaagagggttttctctcatgatttttcttcaaagcattcatttaagttaaacatgctctgtcctatgtacttggggtcaggggtgggaacgtaagtggcacacagctctgcagatgccttgctgagcctccctgtctaaagcagtactactcaaacaggactgtgcctgcagatcctccgggcatcttggtcaaaggcagtttctcatttagttaggtctgggggaggacaagagaattggaatttctaaccagctgatccccatatagtcccactgcgcaggtctggggccacaattgagaaccatggaacagagaatgaatgaactttggggtggggacggcattccagacagagggtgagtaggaagctgcctatagctcctaactggggaatcaaagtaggagataaggctgaagaggtggggtccccttatgagtttgataagtggtcaggaggagtcacatgataacagcagatgcctgcgacaggcagggaaatattctttctgtaagaatataaggtgtataagatgtatcttatttcacagagacactttacatattaaacctgaagaaatattcttcactcactccagaaacacatgtcctcacaattctcggaaaacacagtccttttgacctatcttgtttttccatttctgataaagatgtggttacaagaaatatgtccttttcttaacagcgcaagtcagttagcagcagcagctgacccttggcctctggggtgggaaggaggctcactgctggctccactccaactgctggtttcagtgcgggagcatagggtcagagtggccaaaagaagccagaaatcccaagttgttaaacatctgaactttaaaatattgggcactaattcaaaactgtttccaacactatgagtgctgaacagtttaagtctgcaaggcaaattcggccaaggagtgtctcttttatgactgctggctgaaaggacttgaagtgggggagggcggtggccagacctgcttttaggtagattctgactacagcaatgtcaaggatggattaagaggagggagagactggaggctggaaggccttttaggaggctcctgctagcctgggctagagagaaaatacagtcagcccttcacatccgtgggatccacatctgtggattcaatcaaataccgatcaaaaatattcaggaaaaaaaaaggattgttgcattgcttacagacttttttttcatgtcatgatttcctaaacaatacagtataacaactatttacatcgaagtgacatggtagtaggtattataagtaatctagagatgatttaaatcatacaggaggatgtgtgtaggttaactgtaaatactacatcattttatataagggacttgactgtgcattgactttggtatggggagatgttctggaacaaattccctcatgaataccaagggacaacggtatgcataaatcctgagggtaagcagaaaagggcgaattgaggaagtcgggttccaggacttgaggaatgacttgataggtgcatgagggagagtaagctgtctgggatgaccccgcaggtttctaaggtggtgattaattgctggtgatgacattcactgggataatgaatacaggagccagaagcatattctaaggaaaggttgtggacaagcagaatttagatgcctctgcatcagccacaggaatgtggagtctgaagtcggagcagaggcaaaggttagctggctttctaaaacacaaatctggtcaggttactgtcgcttaaaaccctctaatggcttcctgtcatccaaatagaaagtccagattcctccttctggtaaacaagggcctggcaacctgtccctgccaacctcattgtgccacaccccaacagaaaaatctgctccccgggcctgctccacgactcagagtgcccggaataagctctgcctttgttcttgctagtccctgtggctgaaatgccttccacccatccctttttatgtctggaaaattcctattcttctcaggctccaacatctctgctctgaagccttcgctgaccctgcccagcagatgcgctcacacccttctttgtgctgtccctgaacatttatgtgcctgtttcactgcctcatcactccctactgaggggatctgcctgtctgtaaatgcctcaaggcagaggccatttcttaattaacttggaattactggctcctggtgcacgtctagcatatagtagatgctcatgaaatgtctaaggaataaagaccctccctctggggataaactgcgaggccaatctggagggaatgtttcttacttcccagtatcatacagcccctctctcttgacagctaaggagctacatgaggccccagtgctgacctcacctttcttcttgctttccagctggggtatggccgtcaatgtgtactccacatctgtgaccagtgaaaatctgagtcgccatgatatgcttgcatgggtcaacgactccctgcacctcaactataccaagatagaacagctttgttcaggtaggaggctgggaatatgggaagtggccctgctggaaggaaaggaaagaaaggtcggaaggcagagcagccacaacagggaatatacagtcatgcatggctgaatgactgatgtggccagagaaatgcatccttaggcgatgttgttgttgtgtgaacatcacagagtgtatttacacaaacctggatggtgtagcctactacacacctcggctatatggtatagcctactactcctaggctaaaaacatggacagcatgtttctgtactaaatactgcagacagttttaacacatggtaagtatttgcacatctaaacatacctaaacatagaaaaggtgataataaaataaaaacatggtattataatcctgtaggaccaccatcatatatgtggttcatcgttgaccaaaccatcgttatgcagcccatagctgtagcttgtgattagattaaggaggagagctggaggccctgaactagtcagactgtctggagctgaagtcaagaaatggaagcagggaaagagaagagcaggagaggcaccatgaaggactgcagggaaaggaggagcggggagctgagagccaggatggcagcagagccacaggtctgaccacacctctctgggtccagctctcagctcttctggtggtgcaaccttgggcaagtcactatactgccctaggcctcagttttctcatccataagatggagatagtatcaccaactaactagagttcctgttgggattgccctacctacatgcagtgtttggtgtggtgctggttcataatacgcatcaataaatagtcattgcttttattcttggaaagctggggggattctggccatgtctatcctgaaagtaggactggtccctggcccagaacaaggagagagaagaggagacggggtttggggaagtgagagagagcagctcacagaaggagagcagcaagacccctcagccagccatccttctccacaggggcagcctactgccagttcatggacatgctcttccccggctgtgtgcacttgaggaaagtgaagttccaggccaaactagagcatgaatacatccacaacttcaaggtgctgcaagcagctttcaagaagatgggtgttgacaaagtaggtgcctgcgctctggggggccctgaggagcagtgtgaccctggggaagaagaggacccaccagcccaggcaactggggctgctggggtcattccggtgctcgtgcctccctccacctcccgactctccagagggaattttccccctgctcaaggcacaatggaaaagcccacaacacttgccatgccatcatgacaacattcctttcccttcctcctctctggaccctgcccaccccaacactgagctctgtgcaccgctcctgtgaagttccacctctctctgtctctgtagggcccaagaaagtgtctctgctcactctactgcctcggtggctgcagacccccagcccacacgcaggcagtagagccaagggacgcctccccacacagttcttccacacggtgcctgtagagaagggatgcctctggatctgacactagggcctaccagcctacctgtctgctctggtgccgtgggaggggggcaagtggagaaggtggaggacgctgcagcccaggggctggctttcctgagagcagtggccctcagcagaggaaggcggtcctacagcagcaggtggctaaagtactctgcttatgtggtctatttcagatcattcctgtagagaaattagtgaaaggaaaattccaagataattttgagtttattcagtggtttaagaaattctttgacgcaaactatgatggaaaggattacaaccctctgctggcgcggcagggccaggacgtagcgccacctcctaacccaggtgatcagatcttcaacaaatccaagaaactcattggcacagcaggtaacgtgcccgagccgggggagggagcgtggggggccgggccggcaggcctctatagccaggagtgccccctgggccacggcccggccctgccagcctggaggagacttgttatcacggagttcggatgacgccgcctgctggccagttagaccgggggagtgaaagtagtgggtgagagagctccacaaattggtctaagaggagagccaccagcaccagccatggtggcaactggggtaggaggcccaaggcactttgtttcatagcacgagctaacttgtttgcctcaagatgatggggcagcaaggtggcttggtttctccatccaggtgcatccagaccaagagcctggtgccagcaccacagccccttcttgccccctgccccctggatggccaggggcaggagttgccaagctggatcacacctttccccactctaaaggcccaatagtcctaagtcctcaaaagatgagtctctagaaacgaggctttgtctgggtcctggaggggaagggagaaaagcaatagggcctttgggaagcagcagcgttgggaggggaagggagaggagcagccccagcccgcgtcggaccccgtcatagcagagccacctcctctgtctgcactgctgttctgcctgggcctgccccactcgcccgcccgcttgctttgcactagaagcagcccgctctgtctagggaggtgcagtcgctagtgagcaagtcgccacggcatgctggctgcgctggggaggagctggggtccctgatttggccaccactgtgcagatacctggtccagcccagcagagggcaaaagagcccatcctgacacagggcccctggaggggcagccacccagggacaatggctttgggctggggcttctgttaggaaagaccctgtgccagctgcctttcctctagctatgagtacgagagggtcccgcacccttccaactctacttccccaaatttgcgtcctaatttctctcctctatccctcaggccagctctctccctgccccaacacctcacaccttgtttagttccctatagtttctgctctcccgggctcgccaaagggctgcccagctgctggagtgtccatgtggccaagactcggggcctagctgtagatgcccttcctggggtgggggcaggggggtgagagtgcctgcctgtcgcatgggcctgcccccgcagtcctcacaccaggctgtctcctgccacgtgcgctgtgggctcacgtggacttacctgactcttttcctctgggcagttccacagaggacgtcccccacaggcccaaaaaacatgcagacctctggccggctgagcaatgtggcccccccctgcattctccggaagaatcctccatcagcccgaaatggcggccatgagactgatgcccaaattcttgaactcaaccaacaggtgagtgggatgggtaagggtagctgagatagccctgtcaccaaagccaggcccttggggtgtctgcagggacgagaggagggcaggcaggggaacctgaggtggggacctctggcttgaacatcactttgtccccaagcagctggtggacttgaagctgacagtggatgggctggagaaggaacgtgacttctacttcagcaaacttcgtgacatcgagctcatctgccaggagcatgaaagtgaaaacagccctgttatctcaggcatcattggcatcctctatgccacagaggtgagcactcccaggcccattgggccctccccagtctggcctggccctaagaccagaagcgcgatagggccagaagggaccgtggagaacatttactgatgagagagaggtgaagtcactagcccagggtcacccattagcagggctcctggactcctgaccccttgctcttcagctacttacagaacctgagaagccctgcctggcctgcctggcccaccactttcctctctctcccaccctccaggaaggattcgcaccccctgaggacgatgagattgaagagcatcaacaagaagaccaggacgagtactgagggcggccgcagccctggctgactgcacagcttccccgtgcctccctccctgctccactcccacattatagtcctttcctaacacggtcggccgggtgctttgtgtcagtgctgcagcactggggagccaggcgaggggggcttgggggcatggggccggaaagcaggcagaagcccgtcctgggtggtgctggcccagttggtgggacccctgtccacacccaccctatttatttccgttgtctctctgctgtgtcgcccaacacttcccagggtgctgctgccacccgccccagccagccacctgctcctgacagccagcagctgtgtatttgacaaagtcattggtatatttttacttactggattctccttgcactttacctgttcttttccagagctgacagcacgggctccggcgcagtgtgcctggcttggcttcccttccccatggctgggggctggggtaggactcacccattctaatttattttgtcttttggcttctcagtagctaaggggaaggctgatgtcaggagagggagagggggctgaggaggtagtgctgtaggcccagggggtcagggaaagggaggggggcatgtgagggatggaaatgacctcctggcaccaggctcacccacccaaggccccctgccccagcactgaatcccagcgctgccctgaggcccccagccactccctccagcagcctggttcaccacacaaactctgcctggaccccattgtctgtctgcttcccacctgccctccccaccccctgcccctcgggcaccagcctgcatatgtgttcacttttatttaaataaacttgtgtggtaaaagtacatgccatgtgtccctcaactgagccacagtccaggtccagtgctttccacctcccatgcaccgctctctccggaggtgatagcggcagcacagcctcactgtcaccctcccacaggcctggaaaccaccaccagctctgggctcagagcccagctccagcctagccccaatgcccaacactggtggtagggctctgagggcaggtaggggccccaaccccccgtcactgaggaggaactaggtctgggcccgtggccatgacaagggacagccggtgaagcggctgtggggcaccgtggtggcctggccaagaggtgcttcgtttcagtctcctttgggtcagggggactgcatgtcatcccccacctgttgtcaaagctcatacaactcatcatagtgattcagctggggacaagggctcacgtgacagagagagctgggatggccacaaagagcaaggagttctgagtgctgaagcccgggacagcaacatccaaggggttccttctgtagagcaggctccagtgggaacagggaatcaggaacccttccacatcacctgcacagccccagtcctggcatgtgcctaacaaaaggccatactaaccgatgtcccagaagcccagcagagaccaagagtgcagaaatgaatgtgagagccttggggtcatctagaccagcccccggtttactgatgaggggtcagaggcccacgtgcatgactcaatcaccgtggctgaaacctggactagaactcacacttcttgacttgaggttcagggctcatccccaaagaccactgaggttcccccagctgcaggacagcgctggtttcctcaccaccctgagtatggtcaacatgcagatggggccgtgtctcttctgtggccccaccccatggccccttttgagaccaccaccatttctctcatgacaccaggttcaagccttaaataagcaattcatatctgtttattcctcaatcacctccaccaccccttttgactcccccccccacatacatagacacttctgccttattctatctctgttctcctccagcaagttccttgcctgcttttacttatcgtgatgattttaattcccttgcctaatttttaaaggcttttccccatgattacaggtagataccatgaaaggataggccaggccgagacctcaccctgaaggtaaagtgggtgtgggaggcagaacagtgcctcccccaatgtccacgtcacaatccccagaagctgtgaatatgtgggttacatggcaaaagggaattaagctgcctgtgggccaggtgcggtggctcacgcctgtaatcccagcacttttggaggccaaagcgggaggatcacttgagcccaggagttcaagacttccctgagcaacatagggaaacaccatctctacaaaaaataaaatttgaagggcgttgtggcacgtgcctgtagtcccagctactcaggaggctgaagcagaaggatcacttgagcccagttgttgttaaggctgcagtgagccatgattgctccactgtaccccagcctgggcaacagactgaaaccctgtctcaaaaaaaaaaaaaaaagaaaaaaaagttgcagatggaattcaggaagttaatctgctgaccttaaaatagggagagtgtcctggtttatccaggtgggtccaatgtcatcgcaaacgtttataagagtggaagcaggaggcagaaagggtcagagtgggcagggtgtggtggctcatgtctgtaatcccaccattttgggaggccaaggcaggaggatcacttgagcgcaggagttggagactagcctggacaacagcgagaccccatctttacaaaaaatagaaaaattagccgagcatggtactacatgcctgtagtcccagctacttgggaggctgagatggaaggatcatttgagccctggaggtcaagggtgcagtgagccataatcatgtcactgcacttcagcctgggcaacagagcaagatcctgtctcagaa

SEQ ID NO: 13742 - DNA, 12307 bp, Human
  misc_feature (1)...(12307): n = A,T,C or G
ggtccgtcaagtcccgcgccttaaagggaggttagagggagaacgaccccctcgctcccttaccccctcacccctcatgggctttggactggggaggctgggggctggcgcggaggagaggctggcgcagccgggggtggggacggcgcggagggcgcgcgcagcccctgtggctctcccgtgccgctctgcagcagcggcgcaggacagtcccttcgcacgcgccgcccgcacaccttggcacgggccaagccacactctcccccgccggaacagccagcccgccgcccagctttcctaatccgtttaagcctcacctcctccgcgaagctctcccgggttaaccccatcacttccaaccactgtatctggcacgtgctcccgtttttgttttgttttgttttgtttttttgcaagtgcactcttgggctcgttggaataacaatatcgagggtaggtgtctgtccccagaagcctaagttcaggacgcccagtgtgttctgaaggatgcggctgatgagtttcttgcctgggctcactaaccattcccaccctccacgcttccccatccctgctcactcgctcccctcctcctacggaccctcctcttcacagactgtcacagcttcgagtgcacaatcctcttcccaccccctcccattctacagtggcggcaggtgcgaggggagagaacattgagcatttgaagcttcgacttgaggctcggccaccgactttgctgtaagtcgctccctcccctgggttttagtttcccccaaatgaggcagaatgcggtaatgtccaggagggcgctgcaggtgtggaggatgggaatcactagctgacacgctgccccgctgcccctcagcccctctccataaacagtggccgtgacaccagataggcggctcgacttcactggacccccgcccgtaagagaactgtgagcgctctccagttgccagtgcggcgtccagagccggggagggaaagaggatgggggtccaggccgggccctttattcacagcctgcatgaccttggactcttcttcctctgggtctcagtttactcatttgaaaagcagggataacagtgggttgaaggagagcaggaagcttgtcacccaatgtttctgtataaaaataaatgatcattcgcggtacagtgattggcagcagactgggctcgtgaattccgaccccagattctccgtaaaggggtttctggagtccctggaatctccctgtgtcaccgctcacctcatgttctttctggttctctggagataggtaatgggtccgctcctgtttctgcctccgcgtgagggttgcggccacagggtgacggcgtggtgggcgacacccccgcgcaggcatgcacagagtggtggtcgttgggcgaaggttggtcgtgaggttcttgggcttcaggagcgaggcttggaaccggtgggcgggactgtgtgcagaggtggggctagctcgcctgggggacggggctgtggagatgaggagttctccagaactcgggtggcggggcgctcccgggctctggcgcggggaaatggggctttggcagtgggggcggggcttaagggtggggagaggccggggagcctggaggcggagcttggggagctcgccccacgcggggcggggctccggcggcagcgggatctgcagttcggactccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcttggagaccactcgcctggtgagcccccgggaccgcggtgggccggacggtctgcgtttgaagaggtaggacagacctgggctggccctcggccgggggcgccaccctactaccctccgtccatttcgttgtctctctcggcgcgggccccggcggccgccccagcgcaccgcggtgtccctcgctccgctgcaccccgcttcatcccctctggccacacggagcgcccagccctacacagccggctacgcctcctcccggccgcgctgacttcctcgggtgaagcggcctctcactcccctccggccggcgtcccaggccgccggacccctccgccacccccgcggcgcctgccttccctgggagcagctgccgctcggtcgggccggagccctcgcccggtgcgccaaggtccgcattgccccgggcccagggcgggagcgcctcgctgcccaggcttcagagctccctctgtaggccccggggctcccctccgcgcgccccctccagccgcggccagctgtgggcgccggggcccgaggatgggcgggctccgcgcgggtcttgcgggcccctggggggcgggcggccgccgggaagcgagggggcggcgaggaaggagcaggtgcggtctgggcagcgggggtattcccggctccgcacagacggggccgggggcggcgaggtgtgaaatgaggcgcgcggagcggccgggacagcgggccgggggtggcaggagaaccgccaacgcgccccgccggcccccgcgcctgccgccaccgtccacctgcccctctgagcggccgtccgacctccctgcccacccccgtgggccatcttgtctgtcggctgaccgtccgtttgtctccggaatttggcagggtctccggctttttctcttcccccacctctctcaatctttctgtttctctcctagtccctttccctttgtctctgacgtggtgcttctgtgtgcttctcgctctttctttgggtgggggccttcaagctgggttgggggagggggtgagcagaagagagctggaccccttcctgcaggggcctgcagagacgcggtgggggctctgccgtaggcctggcatctcttcaggtgtccttttgattttggttcagcccctgctacgtcacccctcttccccgctcaatatcggttgttggttgggggtttcggagggccagggagaggaaacagcctttccttgtctctaaacagcatgtagccaccccacatgcccacacccccacacaccaacagccaggcttccttagtgcccaaattatgcagaacaaaagggagcagcctgttgatgggtggccaccttgatgactggctgtgctgtgccttacaaggccagggaatgaatgttgcccactgcccccaaagccacccagcctctgcgcttcagactcacatctccaactccagtccatcttcactcatatgaccattagtcaccgaatcctgcagcattttctgaaaggcatttcctaacctacctgcccctccagggaagctctggcctggtttgttctagacccctccatttcctctcttctcctctcttcctcccatcagcaaggtcatctcagtgctcaggagatatttgttcaagcagtcagtgtatctccctttatgttcctttgagcccatcactttcctcctcagccctcccctgacacttcacgcttagactccaagccacaaacctcgtctttgtcattctacatgtctggaacacccttctccaactaggtctcatctccttaaacatacctttctctgtgaagttctccgagcccgctgtgagggagtgctcccttccctgcaccccaaagtgctttgttcataaccctcctagcatcaacctgtccttatgtagtaagccatttgttacaatctgtctttcccaccagaccaggcttcattatgtgtgctctgcctggtgcacctcattgaatgaatgaggatcggtttcacagcctccttcaccacgccatctcctctggaaacacatccagaatcatacacgcccagattctaagtcttggatggggctttggaaattcaagaaattaatctaccagtatttcagttctctgtacaagcaccaaatgttccccctacctccctcaaaactcagttcacccacttggcagaattgtctttagccagaaggccccagacatcccgccccactttgctgctatgatcacatttctatctggagccatcgtttttacttgtgggtattcttgtcacacctccatgagtatttctagtactgtattttctattcaggtcctgaattctgtggaaaattctgtccttgctgggttcaggttgggtagtggtggggctgagaattggaccagaatggacttagcactcagcctgacctcactcagcctctggcatccccaggtgaggtcccaagccccattcatttgtcaagggagacttatggtaccatgcagttaaggtgggctctgctgggtgcttatagtcggactgaagtccaattaacatgctcctcccactgccatcctcagccatagcaggctgcaccccttcctcccatgacaaccccagctctggaatctagccatcagttctctgtgcccggaatcagactttttggccccaatgtcccgctcgtctcttaaagggccacacttcagcttcatgtctagggagggcgggggcaggatccaggagtggaggttctgggaggtgggcctggaaaggaggcacaccaaggccaggaacacatgctgagtcccactccacacttcactccaccttcccttcatactgccttggcgtgcctggcatagcattcacctgtctttatcaaaatccttcccatccttcaaggcccttctcatgttacctcttacagctgtttccctgatttcctcgttataattagtctggccctccatcctcagaaccctgatagcactctaactgccctaatgacagtggccaccttcgctctatatcattgtgtaggtacatgcttgccctgttcaccaaaagctctcagagatcagtaggaatcctgctcattttggggtgcctagcataagaaattggttggggtctagtctcagctctagcaactaactgggttggcctccatgtgtcccccaactctgtgagcctcatgcctctaatttatttaataaaatgttagatgagagccgggtgcggtggctcacacctataatcccagcaactcagtaggctgaggtaggaggatcgcttgaggccaggaactcaagtgtgcagtgagctctgatcacaccactgcactccagcctgggcaacagagcaagaccccatctcttttttttttttttgagacagtctctcactctgttgccaggctggagtgcagtggcacgatctcggctcactgcaacctccaactccctggttcaagtgattatcctgcctcagcctcccaagtagctgggattacaggcacgtgccaccacacccagctaatttttgcatttttagtagagatggggtttcaccatgttggccaggatggtctcgatctcctgaccttgtgatctgcctgccttggcctcccaaagtgctgggattacaggtgtgagccaccactcccggccaaccccatctcttaaaaaagttagactagaccgtctgtaaggtgctttccagctgtgaaattctatggctctgtgtatggaaggaaaagggaggctgggctctgacctgttcatttagccccggtctctcatgtggccctctgccgatgcagctcccagatacgaccaggcctggggaaggagatggtctgatgaggccagcactggggactaaggacgtggagtgagcaggccagcctgtgggccaggcccaggttgaaccatgttgcttgcctcagtctcttcacagagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggtaagttggggagcagcccttaaaccccattctccaaatacctgcccaagccactctccacccagagtcccaggaatgttcctgggtgcagatgcagagatggggatggctgggataggggagctgggtgcccaggactcaggaagtaggagggataagggacagcaacaaagggaattccagccgaggtccggggccagtaggtcagggctgacttcttttaaaaaccctattttcttgttattaaaataaatcattgtagaaaataaaatacagatgaatgaaaaaaataacataacagtagttaattatacctgtagtcccatcacctgagaaaaccccaaatcacatttttggtgtatatcccccaatttattttccatgcctatacacactacatgatattttctaaatggaagcagactccatcatttcaccctggcaggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcaggtaaggcccctgcatggcccagtgactctccaatcttgccagagggcacccgtcagggtcccaagcaggtctctgacagcttgtctccccccccacccgcagagactctgggggctttggcctctgtggtctccctctggatggtcactggcatcctcctgtacctggccttcgtccgcctgctgcacagcgactaccacatcgaggggggtgccatgctgctgaccgccagcatcgcagtctgtgccaacctgttgtacgtcccagtatggagcaggcaccttgtggggcccagggcgaggggtcttcctccaggatgggagagctggctctctcctccccaccagacacacagacacgcacacacagctctccatgggctgccctgcgtgtgcctgagaagggtctgggatagagacctaaaattcagtcagcagatctctgtcaagggcctgccatgggccagccactctgatgagggctttcatcaacatgattgcatttaaacctcacagccaccccatgaggtaggtagcattacccctagtttaccattaatgcagtcaatcccaacaggtgacttgcccaagtcacatatctatttaagtaacagggccagcttccgaatccacatgtgtggcaccaagtctggtattctttcccccaggctgcattgtttatctctcttgcaaaatgctgttttcttccaggggctgggaaagggctactggggaggtgagacatggagatgggggtataggaggccaggagcagggccctaggctgaggtgctctgcttacccctcagaatggcctttgtgctgcaccaggctgggcccccccacagccacgggtctaggggagcagagtatgcaccgctggaggaggggcctgaagagcccctgcccctggggaacaccagcgtccgggcggcatttgtgcacgtgctgggggacctcctgcagagctttggggtactggctgcctccatcctcatctacttcaaggtaccatcattggagacctgccccagccttcctccccacaaccacatcccagcccactccttcccaggtcccaaagcttccttcctcctccctccagctcctccctcccacctcccaggactctcccagacatgagtcatgttccctgtcccctcttcagggttttgaggggcctctcaggtcatgtttgttcaagatacccctagatcttcctctgaaaggtccctggttgttgggcttaggggtctctttctctgcagcctcaatacaaggcagccgaccccatcagcaccttcctcttctccatctgtgcccttggatccaccgctcccaccctccgagacgttcttcgaatcctcatggaaggtgagtcgggcaccacagctccccatccctgtggccctctctgactttactctcgcagtgggccatcacttttttctttgaagatagtacgggaagaaggcttggctcatggggtctgctgctggaacaaggatttgggcatagggtgaattgtaggggtcaaaaggagagtgcatacaggataggggaggtggaatccagtggtgggggtgctgcttctgggcaggagtagccctagcagtaaggcatgactggtgctggttgcaggtaccccccgcaatgtggggttcgaacctgtgcgggatacgctgttgtcggtgccaggagtccgggcaacccatgagctgcacctgtgggcccttacgctcacttaccatgttgcctctgcacacctggccatcggtgagtcacactggccccagctagttactacctggaacataccccaccccaaacatgggaccatagcttgagttactggaattgtttcagtcttttttgatctgtctctgtttctctgtgtctctctctctcacatagacacatacacacacacacacatgcacgtgcgctcgtgcatgttggagacaaggagtctccatccactggatgcagtgttctgggggcagtttcaccctctttgaagtagcacagggaaccaacaaccctttaaaagatcattagtacctacaggtctagtgatggggcacagttaggtaaattacagcacctccaccctgaggtatcacataactgttaaaaatgatgcttgtgaagactgtacagcaactatgaaaaatgtttatggtataatgctgagaaaaaagctgaatataaaattgcatctacattatgattcaactattaaaaatatatatggtgagtcatgagctgacaaaggatttttgagtttcttccagatgcaagaagcaatcagagtcatgcaatttgtatgccaaaaatattataatttgtgggatatttgatggaaactctagagggacaatgagacagatatttaacaactggattgtcctgggaaatcgggtggtatggctgctgaaatgttgagctgtatgttgacacttaatgacaggagagaataggagactggaaagagtttagtgtgttagcatggttgattggggtgagtctctccaacatttgatttgacacttttatgctgttcatacaatacagaaagaaaagcaggcttccattcacgcctggctttaatgctgtgcagcccctttccctgtccttatctcagtccctgcctgttctttctcccccgggatggatgccgcctcttatcactctcccacagactccaccgctgaccctgaagccgtcctggctgaagcctcatcccggctctactcccggtttggattctccagctgcaccctgcaggtcgagcagtatcagccggagatggcccagtgcctgcgctgccaggaacccccccaagcctgagccatggccctgccctcaccccactgccaggccgaggctcagccccagactctcagcatctgctgccctgatcacagagacgggaccgagccaggtccataccccttcctctctccctcctaccacctgccagtttccccagcctcagccccagccccagccccagtgggcaagaccaaagtgtggcggggagtggggtgggagtcaggggaatagatgtgactagttcaggggcggggactcccaggcctcagtgtggcagggtgtgttgaaggcctgtggtgccatctccccatggttcatgtggagccacgaacatcctttccctgcagtccatttgtctgtgtggcaggctggctggctgggggcatctgcctgtctatgtgctgttggtgtgcctatgcctgggggaggtcagtaggggccccctccccacatggccctcgctctgtctatgcaggggccccaaagcccgcactttgtccgtgtgtcttagccctgtggttttgtctgtgtgtgtgtgtgtgtgtgtgtgtgtgtgtgtgtgtgtgttcttggtgctgtggcctgtgtgtctctgtgcctatgtggctgtgctatggtttctatgagtctgctccatccatgtgtctgtttgggggtctatctctccatccctctgttggtgctgtgcccttggctatccctgaaagagggaggactccgctgcagctccaccaataaacttgtgtctcactgcatctttcagcctgtgtgctgactcctcaggagggggaagtcaaataggtcacttgagaacaacagaatccctcctgtcccttcccagcctctggagtgacctcccacagacctcctgtcccttcccagcccctccaccctcagatggagggtaaaagccaccagtctctttactccccttcccctggctcacagcatgcctgggtccttggctcagggacagtcccatgtgccctgggcttggttgcaggagaatgctggaaggtaaggagccaaggaatccctgggagtcagtcgttctcagaggtccctgcatgccagtgggcctcaggctggctggagggaggctgggtccctttgagggagaatggctagaccatagcactgatgtgggcttggttctcaggccatctaaggtgtccagcggtagggacccctcaaccctgatagcagccaaccctgagtccaggtttaggctgtgaacaccaaggacctcttttacacctattccccctttgtcttaagaactgcatattttgacacattaagtcttaaaatcaggctcattaagggattgttgattttctctttaaaaaaaatcaaactcaagctggacatagtggcctgtgcctgtaatctcagccctttggaggctgaggcaggaggattgtttgagcccaggagttcaagaccagcctgggcaacctagggaaacccctgtctctacaaataatttaaaaattagctgggtgtggtggtgcatacctgtagtcccagctattcaggaggctgaggcaggaggattgcctgagcccaggaggtcaaggcagcagtcagccatgatcatgccactgcacttcagcctgggcaacagagcaagaccttgtctcaaaaaaaaaaaaaaatcaaactcactgggtttggtggctcatgtctgtcatcccagcactttgagaggctgaggcaggaggatcgcttgaggccaggagttcaagaccagcctggtcaacatagtgacaccctgtctctacaaaaaaaattaaaaataaaaataaattagctacgtgtggtggtgtatgtctgtggttccagctactcaggaggctgaggtgggaggatcacttgagcccaggaggttgaggctgcaatgaactatgatcatgcaactgcactccagcctgagcgacagagcaagactccatcaaaaaaaaaaaaaaaaaaaaaaaaaagaaaaatcagctaggcaagatggctcacgcctgtaattccagcactttgggaggctgaggcaggcagatcacttgaccccaggagttcaagatcagcctgggcaacatggtgaaaccctgtctgtacaagaaatacaaaaattagctgggcatggtagtgtgtacctgtagtcccagttacttgagaggctaagtggggagaatcacttgagcccaggttgtcgaggctgcagtgagccatgattgtgccactgcactccagtctgggcaacacagtgagactgtgtctcaaacatggtcaaaccctgtctctactaaaaaatacaaaaatttggccgggcacagtggttcatgcctgtaatcccagcacttcaggaggccgaggtgggtggatcacctgaggtcaggagttcgagaccagcctgaccaacatggagaaaccccgtctctactaaaaatacaagaattagccagtgtggtggcgcatgcctgtaatcccagctactcaggaggctgaggcggaagaattgcttgaacccaggaggcagaggttgcggtgagccgagattgcatcagtgcactccagcctgggcaacaagagtgaaactctgtctcaaaaaaaaaaaaattagctgggcatggtggtgggcacctgtaatcctggctactcgggaggttgaggcagggagaatcgcttgaacccggaaggcagaggttgcagtgagctgagattgcgccactgcactccagcctgggcgacagagggagactct

SEQ ID NO: 13743 - DNA, 17584 bp, Human
acagatgagaaaatagacctggaggaaacccaagtctatcaacagcagagaccacaacccatgtcagtgcaaagaagccaagtgttgcactaccctattgggatccagctcacattgagccagttttgttttttgagctgttacgcaagtgccttctgtcgaagagaagctttactcaattctacagggcagcccccttcctattttcagtggtagaaaagatgagacctggggatccacacttgaggctgtagattggtgctggcagccctgcttctgcaactgagtctcagccctagtcttgaccttgttctttttctctaacaagccttttctctttctaaccctccctcccaatatacccacttcatactatccattgttcatacacttctctacctttattcctcttctcatattcctcccttcgccagagtgtctttttccaccatcttcacctgagttcaattcatccttcaaggtcccggctcaaattccaccttcaccaaagagcttcccagttttctccagtaaaaaatagtttccctcccttgtgttcccaagggggaagggaggaaaaaggataaacaagcattaagcacttgatccattttaggcacttcgcatgtgtcacttgtatgaggtaggtattgccattttacttaatgataaaagagttggagagggtaagctgtctgtaaaaggtcaaggtcatataactagtaagtggtggtgctggggatttgaactcagtctaacttcagaatataactttacagcctaccacatttggtctcctattacatttacttttgtcagttcactcctctagcatgctgttttgcaaatagcattttagttaaatgtttgtgacattgacttctcttgcttccttactctgtttctccaggatttgtggcaggagtctccctgccttaatcataaaggaattgagtaaattgggggtggagctgggcaggtggagagcctgaaagagtgtgcctcctgacgtgtgggctccctggagataagtaaagcctgccagcctgacaagtccattgccagggatattgtagacatttccaacgctctagaaaggatattgctctatattcacagactcttagaatgttagagctggaaggggattaagaaatcacctagcttactggttttcaaacatgcagttgtgggccccgttaaaaatgggtcttttgagaagtatatacttggaaaaaaaagttggagaagcagctgtagtaatgctgcccctctcatccccacacacaaacatctgaaaaatccctagaactgaggagccgagtttggaaagtcaatagtgtaacctccctcattttacagatgcagagccttaacatcaagtctagtcatgaccaaggctgcacagcccgttagtttgggagccaatacctaatgtcttctgaggttctaattccaatgctttctgtggaagaatcatacatacgcagtatttcttaagtggctgtttgcggcaaagcactgaaatagttgctatgaggacgacaaatatgaacgaccccagttttacccactcatgagctcacagttgaggccagtgaagaacctagagacaaaacacgcacttaactataacttatagttccctaactacgattgctgagacaaggatcgtagttatggccagttatgcggggagggtgggctgaacaatgagactaccggattgagagaggcccgggtctcgcgcggagagaaggggcaggaggaggcagagggtcgaacttaggtgagaaatatggctggcgggccccacaccagggtccggcacagtccagctggaaaaggggtctctcacagagtgggtggccgagttaggccgctctccacgggtattcatggctcggtccacccccattcctgtcctggctgcgtaatccgaaggacgctgggaggaaggggcgggacttgtggcggaagttcctaggccagcctgtcacgtgggagggaggctcggcgctcaggtgagtggcgggtgatctgcggtctctggcttaaagcgtcgcaagccatgagtgcccacaaggtgtgtggtcatcctatatccgggcagtgacgggccctattttcggtttggagctggactcaggaaggttacaaactggttccaaccaagtctgaatctggagacggaccaagctatcttttgaggcacccaagctctgggtagaagccagagcaaagctgtcctcatgagtgtctccgtcgggaacggaggcttccaggtggtctggcttcaggaatgaggttggggtggctggtggctgctaccaggagtccatagcttcccacagcctttctctcttccccaattgtctaaggcgactcctgcgacaggaagctgtctgggaagcatccttcatgtgcctctgcccctttaagtcacattggaagtgggaaggggaagggagtgggcacaagggaatgtcaggcggcttcttagtcgtggagagggacggtgggggtgaccccctctcctcttggcttgacaggaagcatggcactctggcgggcataccagcgggccctggccgctcacccgtggaaagtacaggtcctgacagctggtgagtgtccctctaggacttgagtgggaccagggcagactgatttggaagccagaggcttgccccactgcaccaccctcacttcctgtttctattcggctctcttgaagggttggctgtctttcatcctacactgtccccagtctgttttggagggtggtccccaaggctgtttttaaggggtatgcgtagttggccaagctgtgcagtagggttttaggatttcaaagtcctcaaaaagctgaacagtcagccctgaaggataaaggcattgccccaggaggcctcaacttggaaaacattttaccgtatgcaaagcactttcatatacgttatggcatagggcccccacaaaggtgtgtgagctaggagggttacttgagtccacattagatcacacctaataagtgctgaatcaagactcttaccccagtttttcttggtattttttattgtgaaacatacaaaagaatgattaagatgtgtatgtacagtttaaatggcattaaaactgaacactcctgtgtcagtaatcagctttgagacctcttgagtgcctctccgtaattcacccaaaatttcctgagttttgtttatatcgttcatttgcttttgttatcatttactgcctaaatatgtatctccaaggttagtatattggtatctgatcactccatcctgatccatttggagtgatcagataccagtcactccaaatgcagtgattgagtactaacctcacagaggtaatgcagtgacctacctgcatttgttaccatcttcattttgcaagttagctaatgtaagaggatggcatgaagataagtaagtcttagagggggaatgtcagaaggccttagaacattggggtgcaaagagtgatcacattaagatgaggtcttgcccatgtttagagaaggggaacaggattctagtgatgactggccttctgagaagaggactattggaagggattgggggctactgaaggccagagtggaacagggatcctgtgaccagaacagccctgcatcggcacagaaacttaactgcatgaatggccaggagatggattctttggcccttccctgggcccctctccagtctccggtgcccaaccacctcttgtcctgtcctcagcgtccgtcagcctgtatgactcacctggctacgtgtgtggtgactcatgctggacagtgtggctatgatgggaactgacacgctgggccctttgcccaggctcagattccctcagggcccataactgccagatggaagattcccccttgtggtcatcaagaatagggagggaaagagtccttatatttccctacctgaggcatctgcagctgacaagggcaggagctagagctccaaggaggcctaggtgccgacatgtggctggagttctgggctcttggtgctggagcccttcagctccacagcctcagtcttcctgaggctatgctgacgtcccagctcagccctgaagcaaaatgtagcctcccagcacttttcccagactttttcagaccatccagacttttcctttcctgctgttcactgtatttggatcaaactacaaataaaaggtggaagtggctttagttcactgagccatttttggaccccagcacagtagttcctaaggtcccatgggatagctcatcacactggaaaacagtacagagatttcagacttagaagaccaggatttgaatcttaaaaccatagcacctagtaggtgcattaatcaggacaagtcagtaagcttctttgagccttagtttcctcttttaaaacttgagtttagggactgggcgcggtggctcacacctgtaatcccagcactttgggacgccgaggtgggcagatcacgaggtcaggagatcgagaccaacctggctaacacggtgaaaccccgtctctactaaaaatacaaaattagccgggtatggtggcgcatgcctgtaatcccagctacttgggaggctgaggcaggagaatcacttgaacccatgaggcagaggttgcggtgagccaagattgtgccattgcactccagcctgggcaacaagagcgaaactccatctcaaaaaaaaaaatcaacaaaaaaaaaatcttgagtttagttatatgacctcacagggtcagtataggagtatcactgtgaaaaggttttggacattttttttctttttttttttcttcgagatggagtcttgcactgttgcccgggctggagtgcggtggcgtgatctcgactcactgcaacctccgcctcccgggttcaagtgattctcctgcctcagcctcttcagcagctgggattataggcatgcgccaccacgcccagctaattttttctatttttagtagagacgggatttcaccatgttggccaggctggtctcggacacttgacctcgtgattcacccgcctcggcctcctaaagtgctggggttacaggtgtgagccactgagctcagcctttttttctttttcttttttttttttttttgagataaggtgtcaccctgttacccaggctggagagtggtggtgctatatcagctcactgcaacctccgcctcctgggttcaagcaattatcatgcgtcagcctcctgagtagctgggactacaagtgcacagcaccacaccaggctacttttttgtatttttagtagagatgggctttctccatgttggccaggctagtcttgaactcctgacctcaagtgatccgcccacctcagcctcccagagtactaggattacaggtgtgatccagtaggccccacctggaaatgtttttaaatgctcagtgaacttaaagactcaacaggttggttctttctatgagtgttggcaacacaggcacaataaactattttattattattattatttgagacggggtcttgctcttttgcccaggctggagtgcagtggcatgatcccatcctgaactgtgactatgccactgcactccagcctgggcaacagaggatcctctgccttagcctcccgagtggttgggaccgcgggcttgcaccaccatgcccagctaatttcttttgttttttggtagagatggggttttgccatattgcccaagctttattctttttatagtggcgtttgggttaggtttgttccacttgccataatctgaacatggatcactatcttagccttgggttccggaaagcagagcctgaagcttatgtgcagataccttgttaggtagtagggagtgatcccatggagggaaagagggagagccactctaaggatgcattattgaattagccactgctaagggcagctgttgctcagtcccttggaactgagaaactttttgaaatactccttaaagtggctgggcgtggtggctcatgcctgtaatcccagcactttgggaggctgaggtgggcggatcacctgaggtcggaagtttgagaccagcctggccaacatggtgaaaccccgtctccactagaaatacaaaaattagctgggcatggtggcgggtgcctgtaatcccagctactcgggagactgaggcaggaaaattgcttgagcctgggaggcggaggttgcagtgagctgagattgcgctacagcactccagcctgggcgacagagcgagactccatctccaaaaaaaaagaaaagaaaagaaaagaaatactctttaggactgtctggatgaatagctattttctagagaaaagaagaaacctttatctgccactcccatcccacaatggtcaaagattccaaagacttaccccaggctgggtatggtggctcaccagcactttgggaggccgaggcaggcagatcacttgaggtaaggagttcgagaccagcctggccaacatggtgaagtcccgtctctactaaaaatacaaaaattagccgggcatggtggcgcatgcctgtaatcccagctactcaggaggctgaggcaggagaattgcttgaacccaggaagtagaggttgcaatgaaccaagatcctgccactgcactccagcctggacgacagagcgagactccatctgaaaaaaaaaaggccgggcgcagtggctcacgcctgtaatccctgcgctttgggaggctgaggtgggtggataacctgaggtcaggagttcgagaccagctgaccaacaaggtgaaaccccatctctgctaaaaatacaaaaattagctgggtgtggtggcaggtgcctgtagtcccagctacttgggaggcggagacaggagaattgcttgaacctgtgaggcagaggttgcagtgagctgagattgtgccactgcactccagcctgggtgacaaagcaagactctgtctcaaaaaaaaaaaaaaaaagaaaagaaagattgacctcatgggataactccgctccgctactagttcacacatgcatagtcactgcagccatcaatagcaaaggcccaggtgtggcacaggcctgaagcaagaatctatccagtagaactgcagtaatggctggagtaagagatagtgaatcaagaacatttgaaatgattcaaaagaaatgtctagtataccagttttggccaagccagagtccagaacaaggtagcctggggaaaggtttactgtatgttctatggagtgtgagtcagccttatcccttccttctttgagggcccttccactctccagtgggcccagggccgagcttcatccatcttagtctactcggtcctgctgtgggagcagctgagctcttacaaatactggtttccctggagtctgaattaagccagggtatgagagctcaataggccttacatacaatcctgtccagcccaggagactgcagagaaggaaactgaggcaggagtgggagtgtcatgcactgaggtctcagatagtcagtggctgagctggcgttataacctagggcactgcccaccatactgccttgcacttgagactactggagcctccagatgctgagtgcaaccccagctgatctgagcttagatacgtaacaagctgcaaaactacccgttttgtctcattttctagcagtaggatgggttcaggtcagaaatgggagagcattcagaataatcccagaggatccactcccctcccgctgctgggcttccactccctctgggctctgtgccagactgagcccctatcctaggcagctaactaatgtttgcagacttctggggaggaaggcagcactgctggccccatgccagtagctatacctgccgacccaggcctcctggactgaaggacacgcttcctgctcctcactccaagaagccacttcttgcccctctgccttctgcgcatgaaactcaaaagccacaaaagtaagtagaggaacaaaataggagaagtagggaatttaccctgcccatgcccgggaagagggtgtggaagttggggcttttccactagtgggcaggaagtggtcccaaattgatctgctcagaggcaggctcccttccccctggccgctggatctgttcgggagtgacggcatgagaactggcacctacccaggggcatgatgtcacacctgcgccagcatctgctcgctgggctccacgcccagcctgtcattgggcatcactgcccagcagcccctagccctgccccatcaggcctctggccattatgtgtctgcaggcctccagtcccaactccctagaaacaagtccaaggggagggggcccagagcactggagagtccagaccaaccaaatatatccaggagatctcccagaggctggggtggtttgggtctatttgggctctgggttgggaaatgtgggatgaggaatctgaatgtctgggtccttcctgcccaaagggtcacttgggctggaaaagcaggcttgctctatgcttgctccaaagccttataccaccttggagttgctgcaggcacagggggcctgatcatctgtgggcaaaggaatccctgggcaccactcttctgaaatgaaccgtcagggactgcagatctacataccacctactcacccctactgctgccctgtcacttggtagtccctcaggcttgatgggcacagtctgggggacttgaatccatctttctccaaggctgcaggcttccagaactatggggctagaagtcagggacttggcttttcattccagctctgcctctagcttgttgtgtgactgttggcaagtcatgaagagtgaaaacacacacttctctgtttctttcccaggaatattgctgtctgccatccccacgaggtgacaaggagcagaatgatggaatttgggggagtaaagacagagaggaagtgcattagtctagggaatgtcctttgatatgcaggccctttggggcctcacttgggcaggaacacccagcaggggagcagccacaggggcctcctggtgccactgacctctgagcccatctcagcccatgccaggaataccctggcctccttggtcctccttgagagaaggcctgggttcagttccaactgcactccttaccaagtcatctcatctctcaaagactcatcattaaatgggggtgtaggctgggtgccgtggctcacacctataatcccaacactttgggcggccaaggcaggtggatcacctggggtcaggagtttgagaccagcctggctaacatggtgaaaccccatctctactaaaaatacaaaaatcagccaggtgtggtggtgggcacctgcaatcccagctactcaggaggctgaggcaggagaatcgcttgaacccggaaggcagaggttgcagtgagcggagatcgcaccactgcactccagcctgggcgacagaatgagactccatctcaaaaataaatgagtgaatgaatgaatggatgaatggaggtgtgaccacctacctcccagatcttttgtgaggattaaatgtataagagtcttttgtaaacaccttaccaaagtagaccgttacactgttggtcccttcatttgagaaaggactgccttttctgcctcaccatcccctggccttcttggcagcactcttccctttctgcagggctgcagcagctccctctcatccctggctggagggatagggaaccgggtgcgggtgggagcaaacctgcagttcccccgacgtcctcacaccttctacccgacttggacctttgggcaacttaagaattcttcagaccctttctcagagtcgtcctgctgtttgggacagtacatttgacgttttccctttattttctgagcacctaccagtagcttgcttagctgcatggtgaggggatgggataacaaaggtatctaggattctatccttggccctgggaggtcatgcctcgcagtgttctgggaagacccccaccactttgggagtttcagggagagacgaggcaggactgggggtgcccagagctgctccatggccagtagccgaggtgagccacgggtttccatccccaaccccagctctcagccatacccagctgccactgactaggctgctcaggggcagggccggccgggcagagggtgtggaggaagaacgcaacagtgagtgtgcagccagcatggacgtcagagccagttctgggccaaggaatggggcagaaggatgtgtttgtccagtgctaattgagggcacagggacagtgtgactgtgggtctggaggggggctctcattactcggtgagatagacaggtgagctggaaatcacacggtcactcccaagtggcctggtaagtgtgtatttgctagaaaccatcacaccaccataatggactgggggctctgtaaacagtgatgatttctttcatcgtttctgggtgtgggtgtctaaatagggctgcttggagctgggtatctgtgcagttggggcaagggaagcaggtgcagagtcctggaagggaaatgaccactatatccattgccaactcaatctaaggttgtgaatgggggaaatcttggtttagctgattgtgctaagaggtggccaagactctttgttgtggggactcttatcagctcaaccagtcatcttcctgcttatgaccatttgagcactcttgttttattactttttttttctttttgagatagggtcttgttctgtcgcccaggcagcagtgtaatggcgtgatcactgcagcctggacctcctgggctcaaacagtcctcctacttcagcctcctgagtagctgggactacaggcacgtgccaccgtgcccagctaattgtttaaaaaaattttttgtagaagtggggtcttgctatattgcccaggctggactcaaactcttgggctcaagcaatcctcctgcctcagcctcccagagtgccgggattacaggtgtgagccaccattccaggccggcactcttgttttagaaaaagatttattctggccaggcacagtggcttatgcctgtaatctcagcactttgagaagccgaggtgagcagatcacctgaggtcaggggttcaagatcagcctggctaacatggcaaaaccccatctctactaaaaatacaaaaaatagccaggcatggtggtgggtgcctgtagtcccagctacttgagaggctgaggcaggggaatcgcttgaatcgggaggcagaggttgcagtgagccaagatcatgccactgcactctagcctggacaacagagtgagactcagtctttaaaaaaaaaagttattcttgctgttctctacaaatagagatcccctagaccaaggtgaaagctgttggcagggtcttgcattgggcttgggggagaaaacagggtttcctaccattctacacatgatttattcattgtgctgagtcctggaaagaacagtgtctaggaatccagccacctggttgttgcattggccctgcacttactggttatgtgagaccctggacttcatttccatacctctaaaataagtggtttgcattaaattatcttaaagccccttttgattctgacagtctgtggttctcagccctgtggccttaaattctccttcctctctctatactttctgactctgacttccctttactgctcaatgcaaagttcctggacctgggtctgctcatcccagtttctgacagaatacacatgaggtgtcaccatcattggggaggtgagggctttgaggcagcaggaagggactagtcatttgtttccacaatgaagccctggggttcagagtaccagagcctcagtggaggtcagcagatgtccctccctccttggaatggcagcccatcccaggagatgtcctgacaacacctgtgtaccctgcatagggtccctgatgggcctgggtgacattatctcacagcagctggtggagaggcggggtctgcaggaacaccagagaggccggactctgaccatggtgtccctgggctgtggctttgtggtaagttctcccctcaacagggcttcagtggactcaacagtggtcttagttctttgccatcctttggcttcccttggactctcacacctaagccaacctgccgccctcttttttcttagtgtccacttcccctattctgatacttggggcagggagcttagtgaggtagaggcctagggctccctcactgcagcctgctgctatctggggtttacttccagggccctgtggtaggaggctggtacaaggttttggatcggttcatccctggcaccaccaaagtggatgcactgaagaagatgttgttggatcaggtgagcaggagaacagagtggggagggtgagctgtgttgggggtaggtggggatttcagcactcataggactttaatttctcttccctaggggggctttgccccgtgttttctaggctgctttctcccactggtaggggcacttaatggactgtcagcccaggacaactgggccaaactacagcgggtgagctgggcaggtgtggagaatgtctctggctggcgggctgacagcccaggggaagaagacaggttttacagggataaaaaagggggtaagtgcaggtagggccccaggccatggaggagaggagctgagggttatggtgcaggaatgtgctctttgaacccaagtctgtgtgtgacattcatactgggaagtgggagctgcttggaggcgcaagtgttaatttgttccttctctgtctccccaggattatcctgatgcccttatcaccaactactatgtaagagctgacacctcaactgcttgttctcctgcttccttaagtctagaactgtcctgggattggggggtcctcctgacatgggaaacccttccgttgggattactctttcattcccaggatgggcaccataaatagggaagccatcacccaactgttcacctttttcttgtgtgcagaagttggggtagggccaggcaagacagtgagtctggggtcaggtggtggggcagccatccaacctttacattttctcttgcagctatggcctgctgtgcagttagccaacttctacctggtcccccttcattacaggtatgttgcacccctaccccacccatcaaggaagacccacgttaccaacagttggagacaaaatgattctcatttcaaccttgagctaccttagacccccaaacggaacactgagccgtgatcagagttcctcagattcccaagcgtgttattcagaatgtcttgccatttccggaaactgtcccagagtgtctgcccactgaccttcttcatctccctagggaggatcctgcttctaccacccttgtctccatcccacctgagctccgtctttgatggcatatctggagggacagtggctggggtgctgcagcctaggttagacagagaggtagaccagaaggccaagtaggagcctggtcagacactcacaataaagacagttgctgaactgcacccaaaaagatagtggcactgaagatgtgtggttcaaatgcttgaaggtgaaggatcgtgggaacaggggaaaatatggaacgcttcagagggaacagggccaaaatgtacatgagtagcatagctaaaacgaatacagactggctgggcacggtggctcacacctgtaattctagcactttgggaggctgaggcaagaggtttgcttgagtccaggagtttcacaccagcctgggcaatatagtgagacctcatctctacagaaaatacaaaaaattagccagtcacatggtaacatgtgcccgtagtcccagctactcgggaggctgaggtgggaggatcacttgagcctgtgagatggaggttgctgtgaactgagattgtgccactgcatttcagcctggtgacagagtgagacgaccctgtctccaaaaaaaaaaaaaaaaaaaaaaaaaaaaaaggctggacacagtggctcacgcctgtaatcccaacactttgggaggctgaggcaggtggatcacaaggtcaggaattcgagaccagcctggccaatatgttgaaaccctgtctctactaaaaatacaaaaattagctgggtgtggtggcaggtgcctgtagtcccagctactcgggaggctgagggaggagaatcgcttgaacctgggaggcggaggttgcagtgagccaagatcttgccaccgcactccagcctgggcaacagagcgagactccgtctcaaaaaaaacccgaaaaaacaaaaaaggaatacagacttatgaaccaaatcctaaacattagggtcctttgcaacactctttgaaaccagagcaaggttaatttaaaacagaaagatgctactttatatgatagtccgtacatttcggaagatgaaatctcagctggtacaagacagatcaatgaacttagaaggggcccagataggggccctttctgtgattaacagagctatgcatggcaagagagccgctgaatatttagcctttgaggctctcagccaggaaacagagctctgggatggcactagaatttgagccagttgtcctttagtgcaagccacacaggcccttcatagggtgctgaaagggctgggtgtcgtggctcacacctgtaatcccagcactttgggaggccgaggtgggtggctcacttgaggtcaggagttcgagaccagcctggccaacatggtgaaaccctgtctctcctaaaaatacaaaaattagccaggtgtggtggagcacacctgtagtcccagctacttgggaggctgaggcacgagaattgattgaacccgggaggcagtgagccaagattgtgctactgcactccagcctgggcaacagaggagactccatctcaaaaaaaaggtgctgaaggaaagagacctaaacctgccaatcctttgtcatgatccctcctttgccatttcatgctcccatctccagcccttgctcactgcttagccttcctcctcttcattgtgttattcctgttccttaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccggaatctgcagtggtaatgagtaagtttttaagcagaaaactattggggagtcatttctagagctggaaagaagccaagagaccaccaagcccaatttttttttttttttttttttttttttttgagacagggtcttgctctgtctcccaggctggagtgcagtggcgcgatcttgcctcactgcagcttccgcctcctgggttcaagcagttctcctgcctcagcctcctgagtagctgggaccacaggcgcataccgccacgcccggctaatttttgtatttttagtagagatggggtttcgccatattggccaggctggtttcaaactactgacctcgtgatccgcctgcctcggcctcccaaagtgttgggattacaggcgtgagccaccgcgcctggccaagcccagtcttacaaatgaggaccctgaggttggtaggagggaggtgacctgtccacaccaggagttagcagaaacttgaacccatatttctttgctgctcatgggcagagttacactgctgctatgattcccaggagagaaactgaactttgctaaactactttggcaaactcaaaagcagatgggccagccatttgtggtctgaaagcactcggatgctagagaccctctgttacatggtgcctgtcagacagccctacaatttggatcctggggctggaaaaagataagaatgctgggagactttggttgtggcagactgcctctcagtgggtcccactgtgttggctgagtgccagcggtggactcctgatgcctgcatttgcagaactgatagctgcagggaggcagtgggttccagcggcacagcgttctcacatttctggccacttctagaggcagaggacggggtcagcaccatggacagcctcacggtcccgcctccctttcgtgtgtcagaacacgcgacccggactagtctggtctggggacggccctagtcattgctggctgttctaagcggggcgagggactcccgtgggtcccagagcagtctttacgccccagccggcttctcgctttcctgcgtccagtgctgcttccagcgctagccccaggggcacgaaggctggtgtagggaggtgcgcccctccgggggcccgccagccgtcagactcgaagctgtggctgtcattgcttctacaatcagtgcatgttcttcgctgacgtcagtcggagctgtcctggcactatataaggctggcgacagccccgggacagaccctgtgttccccaaggcgtcttcagcctgccccgagggacagagactggagctcaatcttggaccgtacagacgctcgccgacaacctgtgagtggctcagagcgtccgcccagcctccccctgcaccaggactccgctcagctcagccaccacgctcctccggggagggaggctgggtggaagggatggaacagcactggcgcagtggctggggctggagggcaggctgcgggcattgggcggcggccggaggggtcgccgggcgagcgcggggaggggagcggcggcctgcagctgtcccaggcgcacctcaccctgcgctgcccctgtgtgtccagggccggcggcaccatgaggcaggcgggacgcgcagcgctgctggccgcgctgctgctcctggtacagctgtgccctgggagcagccagaggagccccgaggcggccggggtccaggacccgagtctgcgctggagccccggggcacggaaccagggtggcggggcccgcgcgctcctcttgctgctggcggagcgcttcccgcgccgcgcggggcccggccgattgggactcgggacggcaggcgagcggccgcggcgggacaacccttctctgtccattgacctcacctttcacctgctgcggaccctgctggagctggcgcggacgcagagccagcgggagcgcgccgagcagaaccgcatcatattcgactcggtgggcaagtgatggcccggtttggggctgcgaaaacgtt

SEQ ID NO: 13744 - DNA, 21800 bp, Human
  misc_feature (1)...(21800): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggttgaggcgggtggatcacctgaagtcaggagtttgagaccagcctggcccacatggtgaaacctcatctctattaaaaatacaaaaattagctgggcgtggtggtgcgcaccttgatcccagctactcaggaggctgaggcaggagaattgcttgaacccaggaggtggaggttgtagtgagctgagattgccccattacactccagcctgggcaacgagagtgaaactccgtctttaaaaaaaaaaaaaaatggaagctttatttgtttacttgtttattgtctgcttcaccaaaatgtaagttccatgagggcagggaccttgtctgtcttgtttattgtcatatcaccagtttccttttttgtttttaatttttttattttattttattttgctagagaaggggtcttgctgtgttgcccaggctagcctcaaactcctaagctcaagctgccttcctgcctcagcctccctaagtgctgggattacaggtgtgagccaccgcacctggctcatattaccagtttccagaacagtcctgacatatagaaggtgcttagtaaatattgttgaataagtgaataatcagggaacttggttatgagtgtgagaatgagggagaaaagatggggaaataaaaatctgagctagtacaaatagtttttgtcctctactcatttgtgtgtctctgtatgcaggggcagccattttggggggtgctgatggatacctgcggggtcggctatgttgccctgggggaggccggccccgtggggaacatgactgtggtagactctcctggacaagaggtgctaaatcagcttgatgtcaagacctcttcagaaatgaccagtgcagaggcttccgtagagatgtcattacctacccctttgcctggatttgaggattctcctgatcagaggaggctccctccagagcaggaaagcctctccagactggaacagccaggtatgtaccttgtcctcttatctttttattccccatgccaagcttaagatgaaagagcagattgagctcataggatcttacaaacctgggtacagtgtaatcttttccatagaggtttgagttctggtcccatctcacagacccatattcttctccacagatctttcttcagagatgtcaaaggtctcaaagcctagggcctcaaagcctggccggaagagaggtggtaggacacgaaaaggccccaaaaggccccaacagcctaatcctccatcagccccactggttcctggtctcttagatcaatccaaccctctgtccacccccatgcctaagaaacgaggtcgaaagtccaaggcagagctgctgctgctgaagttgtcaaaagacctagatcggccagaatctcaatctccaaagaggccccctgaggactttgagaccccttctggggaacgaccccgccgaagggctgcccaagtgtaaggattgtggggcatagcttggtggaggggggttgggtgaagggatcagggtggggcagatgttggagagagaagactgatgaggtattaggtaagcaggggtggtgtctggattctagggacttgagcagtcctttaggctcttaccgcagcactattaatggtatgtattgctaacttggtttatctaagaattattgtctgtactttatgtcctatgccatttttcacaaactttacccagctctttattgttttactgtccagtatatgtcagtatatatattctgttccattctttctcttgccctctgtgttctttgactgtggtaggatgaaaaatgtattgaacttggagtgagaagacctgggttcagattccacatttgttatctcagtcatctcggccaagtcacataacttagatttctggtttttcatcttccaagggggaaggggaaattaatagagttaattggttaatcatggggttattgggaggctccattgagataaaaatcaaccatgtctggaaacgtgggttctcagtcatatgtgagaatggctctgactctgtccgttcccacagggcacttctgtatcttcaggaactggctgaagagctctcaacagccctgcctgcccctgtgtcctgtcctgagggccccaaggtgagcagccccaccaaaccgaagaagatccggcagccagcagcctgtccaggtggagaagaggtggatggtgctccacgggatgaagacttttttctccaggttgaggctgaagatgtggaagaaagtgagggcccaagtgagagctcatctgaacctgagcctgtagtgccccgaagcaccccacgaggatctacttcaggggtaacctcaatggacaagaaagtgaatggggacatagtaggattttaggggaccagcaaggtactgagaaaggaaggacagctttgacctggtaactataatagacaaaacaggttaaagaaaaaagggtccatttccaaaacatttggcatattagggagagcgcagaagaaggggtatggtaaacaagattattcattcatatattgagtatctgttctctgttaggaaacacaacaaacgtaaataagacagtgtatcctgcctcacaagttcacagtgcaatcagcactaccccaggagtgaacaaaatgatttaggcatataaaggaaagggtaattaactgcctaggcttcacagaggaatgatagttgaattgcttcttgaaggataagtagaagtttgccagagaggatggttttcccataaattgattatggctggagcatagagcctggagtaaagttgtaggcgagattaaactggagaatatgaaaggacatagacctataggaaccaacaaaggctgtttttgtttatggttttttttggtggtaaaatgtatataacataaaatttgccattttaaccatttaaaaatacacaattgaggctgggcgtggtggcttatgcctgtaatcccagcactttgggaggccaaggcaggtggatcacccgaggtcaggagtttgagaccagactgaccaatatagtgaaaccccgtctctcctaaaaatacaaaaattagccaggcatggtggcacgcacctgtagtcccagctacttgggaggctgagacaggagaatcacttaaaccaggcagggagaggttgcagtgagctgagatcatgccactgcactccagcctgggtgagacagtgagactccatctcaaaaacaaaacaaaacaaaacaaaacacacaattcagttgtacacaaactgtacaacaaacatttttaagtagaaaaataacatcagttgggaaaataggtcaaactatagttgacagaagacagctttgccagatgcggtggctcacgcctgtaatcccagcactttgggaggccaaggtgggtggatcacaaggtcaagagttcgagaccagcctggccaacatagtgaaacaccgtctctactaaaaataaaaaaaaaaaaaattagctggatgtggtggcgcacgcctgtaatcccagctactcaggaggctgaggcaggagactcgcttgaacccagtaggcggaggttgcagtgagctgagattgcaccattgcattccagcctgggtgacagtgtgaaactgtctcaaaaaaaaaaaagacagtttcagttatccaggtaagagataggtcctaaatcaagcagtgaaggaagagaagagcagggagggggcagattcaagagatatgtaagaggccaggtgcggtagctcacacctgtaatctcagcactttgggaagccaaggcaggtggatcacttgaggccaggggtttgagaccagcttggccaacatagtgaaaccctgtgtctactagaaatacaaaaataattagctgggtgtggtggcatacacctgtagtcccagctactcgggaggctgaggcaggagaatcacttgaacccaggaggcagaggttgcagtgagctgagatcgcgttattgcactccagccagactctgtctttaaaaaaagaagagatatgtaaggtaattttttatttttatttttgtaattcttttgtttctgtgttctctcacataatggaatatgtaagagaattaacagtatttgggaattgaagggagggaggaagttgaatagcagtttccagcttaaatggtggcatcatgcactgaacctgggaacacgaaaagggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaagaaggccaggtgtggtggctcacacctgtaatcccagcactttgggaggccgagggggagggatcgcttgagcccaggagttcaaaaccagtctgggccatggcgaaaccttgtctctacaaaaaaatacaaaaaaattagccaggtgtagtggggtgtgcctgtagtcccagctactcaggaggcagaggtgagaggattgcttgagcccaggaggcagaagctggggctgcagtgagccaagattgcgccactgcactccagcctgggcaacagagtgagaccctatctcaaaaacaacaaaaaaacaaaaagacagtagtcaaagccatgggacatgagatgagattaccaggagtgtgtgtgtgtgtgtgtgtgtgcgcgcgtgcgcgtgcgcgcctgtgtagaggggcgagaagacgacaggaactctggggaataccatcatcgaggagacctgtcaagaagggagaacctgtgaaggaatattaagagaggggagaggagtaagggagactattccatagggcgggagtttcaaagaggcataagggaatcctgtgaatcaaataccatggagatgttgaggaagctgaacagaaaataggtaacagattttgcattttcgatggaggagtagagcagaaggtgaagaagtcattatagtggttgaaacacaaatcttttaagatgctgatagggcagtgattggagggggaggtattgccaaagaagataaaaactgggaaagagctgtctctgggactttgtccaacctgtagaatttgctcccttatattttcttcaatttgatcctcagaaacagaaaccacactgccgaggaatggctcccaatggcttaccaaatcatatcatggctcctgtttggaagtgcctccatctcaccaaggacttgtgagacttggggacagggggctggggttaataaaggggtggtagaggagtgcaagggcggtattgaagtggggccgtgggaaagagaagcactcatgggtggaataccgtgatgacattcattactaaaaagcactgctctagaggcaagagctctagaactctttaattaaagtgaaataaaatgaaaggctctgtttctcagctgcgctagccacattttaggtgcttggtagctaattggagctagcaactggcatattggggagcacagataatggatcatttccatccccacagaaagttttattggactgtgcggctgtagaatccctctccttcattaatgcttcttctgtttctccagccgagagcagaaacattcatactgggagtttgctgagtggattcctttagcctggaagtggcacttgttatctgagctgtaagttgaagcaacatctctgtagcttaggaagggtgacaccactggagacgaaagggtgacagaggctctataatgggaaccctgagatgggtgaaacacttccaaatttagactgttccctttgtcttcccccagtgaggccgctccctacctgccccaggaggagaagtctccattgttttctgtacaacgtgaagggctacctgaagatggcaccctctaccgaataaacaggtgaagattgcacatccgcccttttttctgattctaggagccagaaacaagaaaaatgaatgttgaaagagatgacagataagtcctgtccttcccctgatgctggttcagttggtcccaagaataagagtgctgactagagctggtcagtcctctctgatttgtagtgttcattactggcaggctgagggaagctagagagatttaggggccaaagcagttcacaaggttacatctactcagatagacctggacagactagccttagggagactactatagtatgccagaatgaacagccctgaagatgagctggagttagacagactttggaggccgggtgtggtggctcacacctgtaatctcagcactttgggaggccaaaaagggaggattacttgagcccacgagttcaagaccagcctaggaaacatagcaagacccctatctctacaaagaatttaaaaattagtggggtatggtggcatatgcctgtagtcccagctactccagaggctgaggtgggataaccacttgagcctgggaggtcacggctgcagtgaaccgtcgatcatgccactgcactccatcctgggtgacagaccccatctcaaataataataatataagacagactttgggaaggaaaggaggaagatacaagtggaagccaaggactctgttctcacttgtaaactgtttttgatattcaggctcttgcttgagccagttcatactggctctgggtggagcgcccattcagtcctcattacctttcattaattcctttcttcatcccatctttgatttttctctagatttagctcgatcacagcacatccagagcgctgggatgtgtccttcttcacggggggaccgctctgggctctggactggtgcccagtgccagagggggcaggagcctcgcaatatgtggctcttttctccagccctgacatgaatgagacacacccactgagccagcttcattcgggtcctgggctgctccagctctggggccttgggaccttgcagcaagaaagctggtgaggtggggttggacactgccatgggagggtggttgaggacagcaggatggggtctggacaggatagggggaagggcttggattgggctgagacaaggggagcttacctctggcagccctgcgtcccttcttcctacccaccatccccacatgctctctctctccagtcctggcaacagggcccactttgtctatgggattgcttgtgacaacggctgcatctgggacctcaagttctgccccagtggagcatgggaacttccaggcacccctcggaaggtacttcccagtcaactgtgggatggccctaggactcaaagccaggacaaagaggccctgggaattcttagagttgaaggaacgaaggttggagtgtagtggatggagtttttccagcaacttcatacagtatttcagggactagaacctcaaaggttttctgtgagtcagctgaaggcagcaagcctcagcataccttttaccctttaggctcctctcctgccccggttgggtctcttggctctggcctgctcagacgggaaagtactgctattcagtctaccccatccggaggccctgctggctcagcaacccccaggtgagtagcacagcaaggagaatggggctgctgtagtggtggtcacagcatagcagggcctgtctgtctccctggaaactcctctgggccagtctctcttagcacaaagccttactcagccacacacacaccctgcattgtgactcaggtttgttcttgagccctctctcttttgcagtcttacagctgtactctttcagcacatttccttttatctcccccttcttccctcttctgtgctctcaagactttccccctcttgctgccacaggtaactggctgtgtaaagagctgctgagggcttgggctgatagatagggcccatctcccctgctatactcttgttcccccaatcctgttcttagcctctcctgccctcaccaccacacaaacacaatctcttgttctgctgaagagagggatggaatagagagctgaagatgagcaaaaggagggaggagtcaggaaaaggcagctcctatatgttgaatttatttttcattagtactgagtatttaaagaagagggcacccaggctggagccctgggaagtcccatatgtggtggtctggtggagtgggttgaggaggtaatagaaggtcagaaagtaaagatagtaaatatagaccattctttcaagaagtttggctgtggggctgggcatggtggtccatgccttaattccagtactttgcgaggcctaggtgggaggattgcttgagcctaggagtttgagaccagctggggcaatataatgagatgtcgtctcgacaaaaaaatttttaaaagtagccgaacatagtggtgcatgcctgtaatcccagctacttgggaggctgaggtgggaggatcacttatgcccaggaggttgaggctgcagtgaactgagattgtgccactgcactgtagcctgggcggcttagtgagatgctgtctgaaaaaaaaaaaaaaatttcgctgtgaaggggaaccagtaattgagggtggtggattgcctaagtgtggtcaataaaggaaggttttgtccctttatttggataggagacattagggcatgttcacatagcaatatgggagtgacctagactagggagggaacaagtggatgacacaggaggaaggaggataacagaatgagcagtgttctggaaaaggtgctagaggatgagaagagagtagagtgaagggattgctcttctgataggaggaaggatactatcaggtgtaacagaaggaaagaagatgggaacagatagaggtaggttcataaatttggtgatgaaaagataaggactttctcaataaaggataagggaatgtcattattcaaaggattggttgctgatttaagagaaggcctgtgtccacagaggaggtctaaaggaaaaaaaaaaaaaggcaaggcctggctaggcatggtggctcacacttataatcccagcattttgggaggctgaggcaggaggattgcttgagcccaggagttggaggctgcagtgagccatgatcatgccactgcactcgggcctgggtgacagagtaagacctgctgagtccttgggatccatagagttagttcctgctctttttcctcacagatgcagtgaagcctgccatatataaggtgagtgaggaacctgctaccttagctgaggctccatcttcttagagcctcaccttgctgattccacagtgagtctccttatacttctgaaaaataccctcatcctgctggattaagcactgatttgagctttcgttccaaacagtgtaggtgtccctaaccctagtcccatctcttctttccctgcaggtacaatgtgtggcaactctgcaggtggggtctatgcaagctacagacccctctgagtgtggtcagtgccttagcctggcctggatgcctaccaggccccaccaacacctagctgctggatattataatggtaaaaaaaccaaaataaaacataaggaactattgctctttaaattttttatatatgcttgttttttggttctttctttggtggttcaatactggacatatagttagaaatattcaagcaatgtaaaaaaaaaaaaatagaaagaaataagtcactagactatttctactcagaaaaaaattaagagtacatagatgctgggccaggcgcggtagctcacgcctataatcccatcctattgagaggctgaggcaggcagatctcttgaggtcaggagttcaagaccagcctggccaatacagcgaaaccctatctctaccaaaaaaatacaaaaaattagctcaggatggtggcacatgcctggagtcctagctacttgggaggctgaggcctgagaacccaggaagcataggtttcagtgagccaagatcacacccctgcactccagcctgggcaacagtgagatcctgtctggaaaaaaaaaaaaaaaaaaaaagagtagatgccggccaggtgtggtggctcatgcctataattccagtactttgggtggccaagatgggagggaatcacttgaggctgggagttcaagaccagctgggcaacctagtgagacctcatcattaaaaataataaaattttgccgggtgcagtggctcacacctgtaatcccagcactttgggaggctgaggcaggtggatcatgaggtcaagagatggagaccatcctggccaacatggtgaaagcctgtctctactaaaaatacaaaaattagctgggtgtcatagattgcacctgtagtcccaactactggggaggctgaggcaggagaatcgcttgaagctgggagacggaggttgcagtgagccaagatcatgccactgcactccagcctggcaacagagggagactccatctcaaaaaaataataaaatttttaggccgggcacggtggctcacgcctgtaatcccagcactctgggaggccgaggcaggcagatcacgaggtcaggatatcgagaccatcctggctaacacggtgaaaccccatctctactaaaaatacaaaaaattccccgggcgtggtggcgggctcctgtagtcccagctacccgggaggctgggtcaggagaatggcgtgaacccgggaggcggagtttgcagtgagccgagatggtgccactgtactctagcctggaggacagagcgagactctgtctcaaaaaaaaaactaaaaataataaaatttttaaaaaattaaaaagtgaggaacatcatttcatgcagttctttatagataaaaatagaaagattagaggaaagagttttataaaaatgggatcagccaggcatggtggctcacacctgtaatcccagcactttgggaggctgaggcaggaggatcgcagcccaggagttggagactgggccacatggtgaaaccccatctttaactaactagctaactaactaaataaatgggatcatactgtgtaaagtattctaaaaatgtattaaatttaattatatcttaattttatagaagaaaaagacactaaagtcacactgaaatattggctaagctcctgatgaatgttccttcactataagcgacactagttcctccaagatacttttagaattaaaaagactataaataagttacaaataatattaagtagttggagttattaggttttgttttgttttattttcagatagggtctcactctgtcacccaggctggagtgcagtggcaagatcttggctcactgcgtcctggacttcctgggctcaagcaatgccccagcctcagcctctggagtagttgggactacaggaacgagccacaatgcctggctaatttttgtattttttgtagagacggggtttcgccatgttgcccaggctggtcttcacctcctgagctcaaagtgatctgcctgcctcagcctcctaaagtgctgggattacaaatgagagttaccatgcctggcctagattgttatttttaaatgacagtgttattggccaagtgtggtggctcatgtcggtaatcccagcactttggaaggccgaggcgggcagatcaccaggtcaagagatcgagaccatcctggccaacatggtgaaaccctgtctctactaaaaaatacaaaaattagctgggcaggatggcgcgtgcctgtagtcccagctactcaggaggctgaggcaggagaatcgcttgaactggaaggcagatgttacagtgagccaagatcgtgccactgcactccagcctggcaacagagtgagactccgtttcaaaaacaaaatgacagtgttgtttttagatataagtagactttctgctaggaagataaggaaattagcactcttacacgtctttttatcatccctttcgccatgttttttcttttggtggtattattcttacattgtcaaggtacatgattctcgatgctgttctgctttcttaattcctaaacttgattgagtgcctctaccagtccatttatcttagtctcccctccaattgctgaattatttatattgcatggctataattcatcgtcaacaaactttttcaagaaaggttcataggtgctgcattcattccctgagtggctcagccttctgagtagctgagactacaggcatgcgccaccacaccaggctattttattttttttgagacagggtctgtggggtccaggctggagtgcagtggcatgatcttggctcactgcaacctctatctcccgagttcaagcagttctcccacctcagcctcctgagtagcagggattacaggtgcataccaccaaaggccagctaatttttgtatttttagtagagatgagatttcaccatattgttcaggctggtctcaaactctggacctcaggtgatatgtccaccctggcctcctaaagtgctgagattacaggcatgagccatcgtgcctggcctttttttattttttagaggtggggtctcactatattgcccaggctggtctcaaactcttgggtgcaagtgttcttcctgcctttacctcccaaagtgctaggattacaggcatgagccattgcacctagcaacattgtgttgcttttgactttttgcctgttctctttgtcttggggcagagttagcgaacattttcttttttttttctttttttttgaggtggagtctcgttctgtctcccaggctggagtgcactggcgtgatctcggcttactgcaacctctgcttcctgggttcaagtgattctcatgtctcaccctcccaagtagctgggattacaggtgtacaccaccacactggctaatttttttttgtatttttagtagagatgggggttttaccatgttggccaggctggtcttgaactcctgacctcaagtgatccacccgcattggcctcccaaagtgttgagattacaagtgtgagccactgcgcctggcttcctagagtttttatgcttttttttttttttttttgagacggagtctgctcttgtcactcaggctggagtgcagtggcacaatctcactgcaagctccgcctcctgagttcaagcgattctgctgctttagcctcccgagtagctgggattacagacacccaccaccacatctggccaattttttgtatttttagtagagacggggtttcaccatgttgatcaggctggtctcaaactcctgacctcaggtgatccaccacctgcattggcctcccacagtgttgagattacaggcatgagccaccgtgtgccccacctatgctttttaaaagtcccttgacgtttatttatagggagtagagagaggtgcattctactctctgcactaggtgtgttcaccctatcatttttcaactgtagattccagacaaagctattacttttttgttgatgagaattagggttaaaataccaggttgagtctttaagccctggagggagtgttggatagctaatcaggatccccacatcctttcatagtggtttggatctgagggtagaagacaaaggtcctaggagcccagagaaagaaattagagcaaggaagagagaacttgcttttaatgctcacacattctgtccttatttcaggcatggtggttttctggaaccttcccactaactcacccctgcagcggatacggctctctgatggctccttaaagctctaccccttccagtgtttcctagcccatgaccaggctgtgcgtacccttcaatggtgcaaagctaacaggtatggaataggaggtatgtggagggggaaggtgaagactgggacaggctgacttccggatttgtttggatttgaccttctcccgtctttttacagccatttccttgtctctgcggggagtgaccggaaaatcaaattctgggaccttcgacgtccttacgaacccataaactctatcaagcgcttcttgagtacagaactggcctggctgcttccctacaatggtgtcactgtggctcaggacaactgctatgcctcgtacggcaagatggagataggacctctagggacaggccctaagggttggaatgcaaagcatgccagattgttgtggggagaggagggtagagagttggttcactgaggtggtttaaattctggaagaggttaagaagaagaaatgaatctaaagaaaaggaaggtttaaatttatttctcttttaacagttatggactctgtgggattcattatattgacgctggttaccttggtttcaaggcctacttcactgctcctcgaaaaggcaccgtttgggtgagcccccctttcttttgcagtcttcattacaaaggaaaatggctcatttatgcactattagtagtcagaggcagtagttttgggtagaaggagaagatagggatgttgtaactctatcatcagggctgtcggttatggtaaactcatttttgtttgtgtgtctgtctctcagactgtgcagctgttaccagttcatagctctgaatgaatatatgaatgaatgaaatctgtctctttctattagagtctttcaggatccgactggcttgggacaatagctgcaggagatatatccggggagctcattgctgctatattaccagatatggcactgaatccaataaatgtcaagcgacctgtagagcgaagatttgtacgtatacgaacatctaacagcagctgttggatcctaacccacatgccctcccaaattctggtagagtacaaactagtgtcaggtctcccggccctgatatcccagaaaatcttagcacagagttgtatataatcttccctaccgtactgcatctgagcatatatttaaagatactacttttttccatctttaagcctttcctgcccaaaccactttcctctgcttttattctgtcttgagtattatagaacctaatttcatggtctcctttccagcctatatataaagcagatctgataccgtatcaggacagtcctgaaggtccagaccattcttctgcttcatctggggtccccaaccctcctaaggctcgaacttacactgaaactgtcaaccatcactacttgctctttcaagacacagatttggtaagctgaggccaggagaatgggtgtggtattagaaaaggtagaaaactttagtctttgtatagtacgcaagcctgagttcagcacaaagatgtaaaactaaggagcctcggccaggtgcagtggctcatgcctgtaatcccagcagtttggggggattaggcgggcagatcacaaggtcaagagatcaagaccatcctggccaacatggcgaaactccgtctctactaaaaatacaaaaattagctgggcgtggtggcgcgtgcctgtagtcccagctattcaggaggctgaggcaggagaatcacttgaacccaggaggtggagattgcagtgagccaaggtcacaccactgcactccagcctggcaacgcagcaagactccgtctcaaaaaaaaaaaaaaaaaaaaaagggccaggcgtagtggctcacacctgtaatcctagcactttgggaggctgaggtgggcggatcacctgaggtcaggagttcaagaccagcctgaccaacatggtgaaaccctgtctactaaaaatacaaaaaatctgccgggcgtgacggcgggcgcctgtaatcccagctactcaggaggctgaggcggagaatcacttgaacctgggaagcacaggttgtagtgagctgccaagatcgcgccactgcactccagcctgggtgacagagcgagactccgtcttaaaaaaaacaaacgagcgtctcactttctctctcctattccatttcccttccccagggttcattccatgatctgctccgtagagaaccaatgctgcgcatgcaggagggagaggggcattctcaactctgcctggacaggctgcagctggaggctattcataaggtagtctctcatcctctccaccctccactctcatttccccccagttctgggcctggggctgatgaaatggtagatgaaaaggttacacagatgacaacctcctcctcctccagagcatgacagacgtacctcattcactggcttttcattcttacctctgtcacccctcatggtcctgtcctttcagattgtggctcattttttttttttgttcatacagctaggagtcaccctaaagcaccacccatgagcatctctctcttgttttctgttctcttcacaggtacgtttcagcccaaacctggactcctatggatggctggtatctggggggcagtcagggctggttcgaatccattttgtccgtggactcgcctccccactgggccaccgtatgcagcttgaaagccgagcccacttcaatgctatgttccaaccatcctcccccactagacggcctggcttctctccaaccagccatcgccttctgcccactccctagccttggcccacaccagatccttggagtgaagtcggtcaagaacaaatggcccctatgcacagagccataggaactgggggccttccctggacagtgatcatgccaggcctggacctttaggcctgcctccccaggactccttagatcccactctttctacagacttctgtgatcacagccccctgcgggcaggggggctctccctccaccaactctcaaggctcctcagcctaagactatggctcatgagaaacactcaggcctgacctaggcttgggagtcaaactgctcatattgagcatattgttaagtgggtaaagccaagtaaaggtactgggtgtttttgtgaccacttgtgaatgggtgtatggagaactgaaaagggtatctgcatgaaggctcctgtctgactattccaggatccaatattactgccttctgaaacttcctctttagggtaaccatcatgtatgcccacgagggtgatagtaattcgtgagactgaagttgcttagagtacttctttgaccaaggaataccacagacaccctaccgatagaacagtggctcagatcttacttgctcctgcttacgaagtattcccaatcactggtcatctgaccctacttgaacactcctgaacagtcatgttttttaaaatcttcctttatatcaagtcagagagtatacttctataaatttcactcatggatgttaggaaatctagtcatcttccctgtgattgccctgttaagtatttaaccatagctatcatgtgtttcccaaatcttctctagattaaatatcttcagttacttcaaccattcttttacacgtcatgatttttgatccttcatgatactgtcacattgttgactcattagaatgtttacctacttcagttctatgtataggaggtgtttagaacccaagtactgtaatgtattgttatatctcatcttgttagagtcctcttgtgggatgctgcagactcacagtgactatgatactgcctcctaagcaaggacacaccccagtgatgagaaataggcaaaccatggtcttgaaatgcctaggagtataggctggggtttggagggaaatagttggatgacctcaggaaatagaaaaaaacaggcagctgctttttggagagagtggagatgagatcagtgcctacctggaacaaaaccctctggcattctagactggctgaatatgtagtgtagggactttatcatctgtcagaaaatctcctttaagaagaagcgatcaagaagtttagtcctggccaggtgtggtggctcacgcctgtaatcccaacactttgggaggccaaggcaggcggattacttgaggtcagaagttcaagaccagcctggccaatgtatggtgaaaccccgtctctaccaaaaatgtaaaaaattagccaggtgtgatggcacacacctgcaatcccagctactcaggaggctgaggcagaagaatcatttgaacctgggatgcagaggttgcagtgagccgagatcctgccactgcactccagcctgggtgacggagcgagactccgtctcaaaaagagttcagcccctatcctgtacagatgagaaaatagacctggaggaaacccaagtctatcaacagcagagaccacaacccatgtcagtgcaaagaagccaagtgttgcactaccctattgggatccagctcacattgagccagttttgttttttgagctgttacgcaagtgccttctgtcgaagagaagctttactcaattctacagggcagcccccttcctattttcagtggtagaaaagatgagacctggggatccacacttgaggctgtagattggtgctggcagccctgcttctgcaactgagtctcagccctagtcttgaccttgttctttttctctaacaagccttttctctttctaaccctccctcccaatatacccacttcatactatccattgttcatacacttctctacctttattcctcttctcatattcctcccttcgccagagtgtctttttccaccatcttcacctgagttcaattcatccttcaaggtcccggctcaaattccaccttcaccaaagagcttcccagttttctccagtaaaaaatagtttccctcccttgtgttcccaagggggaagggaggaaaaaggataaacaagcattaagcacttgatccattttaggcacttcgcatgtgtcacttgtatgaggtaggtattgccattttacttaatgataaaagagttggagagggtaagctgtctgtaaaaggtcaaggtcatataactagtaagtggtggtgctggggatttgaactcagtctaacttcagaatataactttacagcctaccacatttggtctcctattacatttacttttgtcagttcactcctctagcatgctgttttgcaaatagcattttagttaaatgtttgtgacattgacttctcttgcttccttactctgtttctccaggatttgtggcaggagtctccctgccttaatcataaaggaattgagtaaattgggggtggagctgggcaggtggagagcctgaaagagtgtgcctcctgacgtgtgggctccctggagataagtaaagcctgccagcctgacaagtccattgccagggatattgtagacatttccaacgctctagaaaggatattgctctatattcacagactcttagaatgttagagctggaaggggattaagaaatcacctagcttactggttttcaaacatgcagttgtgggccccgttaaaaatgggtcttttgagaa

SEQ ID NO: 13745 - DNA, 16631 bp, Human
ttacaatgtagttagaggaacaagagcactgcccaaaaataaaagcactgtaaacattaaattacaatataaaagaaaccacaggacagtgtataaatatatttgagtggacactaaagattacaggaagtttttaaaaaaggtattactgaatcgcttgaacccaggaggtggagggcgcggtgagccgagatcatgccattgcattccagcctgggcaacaagagtgaaactccgtctcaaaaaaataaataaataataatttaaaaaaggtattactctggaacttagtagtagtaaatattcacaaaagatgttggaattgaaggatggatatttcctaatttggtagaggaaggcaatttcaggtatggagagaggcctgaacaaaggtggaatgcctttgagggcaggcaaatctggctggtgcagaccattatggaggtttgagcggacaagtaattggaaataatgttggaaaagtgggttgggactagtatggtacttaatggtttgaattttgtcctgagacaaaatttaatactaaatatagtattaaagcaagagagtgataatggaaaatgttggttttctaaaagcttaatacagagaagtatttaggtagatgaaggaaagaagagaatggaagcaaaacataacattttgagtttgaagttagggtgcactcagtaggaaatgcttaataggaagctagaggtacccgtatgtacctggagtgtggaaaggttaaaaaagacactaaagagatctagttttggtagacatctgcgtgatgattacagctgaaaccataataggtggattctttaaataatataagggtataaaagcagccaggctaaggaatggcctgtatccagcatctagggatgtcttcccctcaccccaagatggtgcccttctgattcaggcagcaacgggcatgcagcattagctctcgtgtcgttttacaataaaaggccacttttgacaaattttgcacgctccctggacattgggtgcatatctgcagaagagaaagaaacattagaactccagaaagaaaagccaagaaaagaacaaacggcgatcaagaattaactgccagtacacgtttccagaattcctctaacacggggccgataaatggataaacggctcgtgtcccacccttgtaacaggctaggctaggagatgccatctcttcctccagagtcctgcgccgaatcagctcccgacactttcagtaccagatatcgcacagggaaggtcctcatctctgaagatcactattcgaacttatttattatgctttctgcagagacttctcaatctgacagccctagtttggcgcggtgtaaaacgaccgcaggtacgtaaagaactcatcaagcattacaaaagtacagccctaccaccgcacgatatatggcgttcgtgcgtagagagattacacaagaggcagaggacccgtctgtagaaagaacttaaagttattctaaaattaaggggcgaaatcaagtttcacaggtctttgaaagtcggcaggactggggcgccgaaggcctgcacgacgtgagtacttgggaacaggacctggctgggcagggtcgggaagcgtcagggacgaaatcagaaccgcaggcccgccgaggagaagggggagccgctggcgagcgcgacgcacggctggccagcgaccctgcttcagcccgacctcaaacttgcttctgtacctcgggtagcgccagagccctttccacgcccagagcgaggagcagggcggcagcccagggcaccagggtcgtaagactacccgggccgtgaggcgccattttccgttcccttggtgctccgctgctcgcgcgacccggccccgcggccccgccccgcagcgcgtcaggccctcttccccgggcgtggcctaagcggcccggtccagtcgccctggggctgcttgggggcttttcctgctcgtggagctctgcgctggtcttcatgcgccctagccctctttcggggatactggccgaccccctcttccttttcccctttagtgaaggcctcccccgtcgccgcgcggcttcccggagccgactgcagactccctcagcccggtgttccccgcgtccggacgccgaggtcgcggcttcgcagaaactcgggcccctccatccgccctcagtaaacatggcggcacggcgagcggggcgggcaaggggcgggcagggggcgggcagggggcggggcccccgcgggctcccggccagggctctcggccgggctctggctacccacgtgtggagaccgggcaggtgggcctggagagcgtgagccggtgccgagaggcaccggggagcggcgtctgagccggggcggggacaagggggcggggaggggcggagcgagccggcctccggcgtgggtctgagatcttaagtgcgagcggtaaggtggtggtctccgccgcgtagagggaagcgggaaaccgagaaagaacgagggtgagggtgatgagggaagggcaaacctcaaactccagcgggaggacacgagcctggatcgccccgggcacctagtcctcttcacctcaatgctgatagcgcatagcgtcccggagcctggcgaggaggtaggagcgggatagacgcttccctaactcattttctttgccttcccaggaaaagggagcgatgttgatctcaggaagcacaaagggaccttcctagctctgactgaaccacggaggtaagggagtgcgttgctgccccagggtgggccagcgccctgactgaagggcgccaggggatccctgctcccggcgcgacagtgttggttagggccagccagaaagctccttaaagccgacccaagtgatcatctcgagtagccgagccaggcttcccttccacattacccccatggtgtctgcctggaagttcctgaaaggtttacgtttagctggctggcaaattttctaaggtgttagtagctattagcattttaaggagggcccccaaagcctttcacaccttgaggaattataggccccaggacagattttgagggaatctttttggaacagttagtcctgcagtggtctcattgccttttgtaggagtcaatgcgatccactgcagtgtgtgaccaaagtgagttcaggtttttatttttatttttatttttattttgagacggagtctcgctctgtcgcccaggctggagtgcagtggcgcgatctcggctcactgcaagctccgcctcgcgggttcacgccattctcctgcctcaacctcccgagtagctgggactacaggcgcctgccaccacgcctggctaattttttgtattttttagtagagacggggtttcaccgtgttagccaggatggtctcgatctcctgacctcgtgatctgcccgcctcggcctcccaaagtgctgggattacaggcagtgatgtgggaccccttttaaaaacctgaacttggcctggcgcggtggccaggccaccgatccgccaaggcaggtggatcgtcatgtcaggagttttgagaccagcctggccaatatggtgaaatctcgtctctactaaaaatacaaaaaaaaaaaaaaaaaattagctgggcgcggtagcacatgcctgtagtcccagctactcaggaggctgaggcagaagaatcacttgaacccaggaggtggaggttgcagtgagccgagatcgtgtcactgcactccagcctgggcgacagagcgagactccgtctccaaaaaaaaaggggggggggtcccacaatctgctgtttgtgccttggcatgttatagttgtagtgaaacaacagctagctcttgcttttggccgccctctttctggagagatgcgagaccatagcgtttggatcaatgtagggtgtttagaaaactacagatctgttctcagaatctggtctgttgctaggtcaggtttttcctgtcttccctggggctctctcaggccatccaggggaattctccatacatcacgcaaatagaattttatcaggaagtcccatcagcagagtgtctttatttctgtacctccgtgtcccatactgggactttccttcctgtctctggccacctacctctctaaaccactaaccctatagttagttctttgttctgtgttctttgcacacaggagacctcttctttcctcttactccccagtagttcccatcatctctatcatagcagtaaaaacttgccaaagacgaatgagaaaactcagggtgttgcaatgtgcaaaggcccagggcatgtttaggttaaaccagagtttaagcctgttgggaatcttgtagaacatgtgatccaagagttgccaggtctgattttccctctttattggccccaagaggttcagagttcaggtttagtctgcatgaggccatatcttgccagccagccagtgtctgcccaagaacacactgtgggagagcggaaagacagcctaatctttctcctagtgggcaaaagcagaagacatagtttatgtcagtctgtctcttgattagttgaaatctaaactatgtcctgtgaatgactgactgcaacactctgctcctgtcctggttctgggaatagtgaggacagggcccttgctgaacacctgtcatagctgcagacagcactgtttctctctctcttgttttgtatcatgctgcataaccttgagcaagttatttaatctctcagttttcttgtgttaactggagagtattcgtgtcttaatctgagacatgctgttttgaaaatgttagcttcattatgtattattactaatgtttataaagcacctcacacactgctgggttacatagcaggtgttcagcaaatgttaactgtcgtcatgttaggctgtgtaactacatggcattctctggtgttttttcctcataccaataagtaccccagaggattgcctttgaagacaatatgatacgcttggagaacagacagggtggatggtgaatccctagacctgggttctaatttatgctctgacaatagtcggctctgtgcttttggaaaggtcacttgaaccatctgagccttagcgtgtttatctgtgaaatcgtcagtggtggggggttggttgtaatagtggtgtccaaagatttaagattttaaatattatgatcccttccctctttctctgaggattgtggtgtattcttgggggattaacatttcttgtgcaggagttagaaaatcaactttcaactttcccatgttttcagttccttctttccaactccctcccgcacagagtgccaagagtactttaggctgaaaggctaatccatctaggaatgctgttgaatatgagctccctcttccctgttctggagcctctagggctgagttggagtttgggggccatagggtgatagggccatttggaacacagccattggttccctgaaggggccagaacaaatgactgctgagcttcaccccacccccaattcctgatctctcacctcagctactcatagagccagatcctcagctctgcagctccaggcaactctgcctcagaacagggattgcttctccaggtaggtgtctgtccccagcaggatacgaccactctctttggctggtccctttgcctctcagctccgtggctgggttgcttctctccagaatggagaatcgtcattctgaaaccctgactccagcatggtgccctctcacctttcccctctcacttttgaatccagccgctcttcctgcgtctgctgttgactgtgatgttgcaggtagaggggctgagaggtgggtggcagcacttatctagtggtgttggggagaaccttaagaaaggggttggcctggggacgcctgaaatggagtctgtggctgccacagaggcagtctcactgatgatcagttagaagggtgacactggggatcacaggaggcgagggccgaggccaggggcagtaggggaagccctgctgccattagtctccatgctgtgtttcctgctgggctgtggcgccaggctgggctctgctggcttagtgtattgtagtgactgggtctgtgccttcaagtggggctgggaaattctgctaagaaacttaggctagagtttatttttcttttggtactcgggtggagacctaagaaggttgttgaatttcacagctgtgcatactcaaaggtcctggccaagttatattgtctcctggctgtcgcactctgatgcttctccctcacttatgtcccctaccaaacccataccagggcctccagaccttgaagggctaccactatgctggctggtccacttctgatggcatgcgatgtacaaggcccaagggtgaatggctaccaaggccagataggcctcactaagagctaattcctttgcagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgaggtgagcagggacagaagggagaagtgcgtgggacacgggttggggtggagaggagggacaggcacataggaaggacctgggaccctagacctcctccacctaatgagagggacagaaaactcattgtgtgtttataattctttctcagtgatgttaggtataggggcaggattggagaggagggtgctatgccgagtaggactcagagtgggtatgggttggatattccctcatgttcctgagcatcttgagggaatttgtctgtgagttgtcggggtgaagtcaggagaaaaatctttttttctgtatacccagtacctggagcttcgattcaataaaactgtgcgagtgtgtggaactgtgaccttcatctttcagatggtaagcagaatgaggatagaaaccgagcctagggcatgttgggggacctgaacgcaagcatgctgagggaattggagtctcccctgctctcagattggcaggattgaaattcctgctagaggttagcatctgtgaggaccccagaggcatcctgctgcccatgccttccaattccagcacagatactgtggtggcagcaagccagaatttgagaggagaaggaagagggaagtgagcctaggtgaggggaagccatgggcatattggcgctgaggcccatctttcttcctctctcttcccaccattctccggcccccatcacattttttccacatgcaacaggtgatctacatgggagttgtgctctatgctccgtcattggctctcaatgcaggtgaggagtcacacagcccctggctttcagccgtggtaggttaggaaagcacctttgggagaggcagatggaggagcgtatgtggaaaagaacctgaccttgaatggggaattaattcaccgcttgggcccttgggtgggtctctaccagaggaaggcttggtccacctcaattgacagctagtaacatgttaccatgccctatctgaactggttagtcaatatcttttggtggagctctgcaaacatttttctccgttgtggtgaatgatttatttcattgttaatgaccaatgctttatctctgtggcatgacgtgattgccctaccagggcttctcccctggggaacccttttccagggataagaatgtggcttctatgcttacagtgactggctttgatctgtggctgtccgtgctggccctgggcattgtctgtaccgtctatacagctctggtaagtgcagtaagccctggtgtggggaggggaagggatgaagtaaggaggggacatgggaagagaaggaaaagaagacataagctgagaatatagatgaggagaataggtgaaattctggggtggtaagatttatgataggatttagcagtggggatggtatatgaaggtagaggatgggatgggaatgaggtcaacagggtcacagcaattacatgcctaatggcaggagagtcccctcactggtagtatgttcttagggtggatggtttcaggagtgtccaagggagagaatatagtcatgggttcttagtttctgtttctggttgggtcagtaaagccccttcgtcatccctcttttatacatatcaccagagacagaaactaaaaactggcttcaggctgcaaaaagcctaaaacaaaacaaaacaaaacaaaatggagcaacaacaaaataaggcaggttggacaagctgggtttagaaggcctctgtggcaggtttgctgtgctttccttgcagggtgggctgaaggccgtcatctggacagatgtgttccagacactggtcatgttcctcgggcagctggcagttatcatcgtggggtcagccaaggtgggcggcttggggcgtgtgtgggccgtggcttcccagcacggccgcatctctgggtttgagtaagtatacccctactcctggctggggtctgcagtgcctgggcgctgagcccatcctagaggctggtctcggctatagtaagcagaaggtaaactgggaagcctgaggtgtaacagcagacagtgggaaactggtcctgcagagatggagggtgattacaggtgcccggctagtgtttatagagagtcaggacattacctgggatgagtacctggaatgagcctggggtggaagaatggagcctccctctaactggctgtgctgtctctcgagtgcacccagcttcttgctttcagtgtcccccttggccctagcagtggtgtctctcctttcctgtccactgactcctgttgccaagagggcaggaaggctgtgtctctcaggctttgcacaatgactgggtggtgtctgttacaggctggatccagacccctttgtgcggcacaccttctggaccttggccttcgggggtgtcttcatgatgctctccttatacggggtgaaccaggctcaggtgcagcggtacctcagttcccgcacggagaaggctgctgtgctgtgagtgcagggacaggaagggagtggagcaaggtctaggggaaggggttccccagagataattggggtggggcaggatgccagagtgcatacacatccactgtggtcaggatgtgggtctcctttctggaggtcaggggcacacacctgagggtgtctgttaacgccggctctcctcctggcactgacctcttttgcagctcctgttatgcagtgttccccttccagcaggtgtccctctgcgtgggctgcctcattggcctggtcatgttcgcgtattaccaggagtatcccatgagcattcagcaggctcaggcagccccagaccaggtgagaaggcgctgttctgttcccatgagggcaggcctggccccacaacaggagtgtctaggtaggaaaggactgactgcagaaaggactcccaccctgggtgggagacggttgtaaaatcctttcccactctgagatgctaggaatctagcatgtgaggatcgcggtccctagcatcacctaaccacagtgctcatcctactggggtgaggacctacccttactgactccccattgggctccatgtgctctgctgggagctatcacatacctggtctcacctaagcctctaacagcctcatttcacagaggagaaaacagactcaatgaggtagccagtaagcagaagtcacactagtagccagaaacagagctgcgggcgaattgtgtcattccctctgtagagctcattttctctccacttaatgtgtagacacttgggtcagcagaagtgccccaggccctggcttcccttgtaatgcacccagtctcggtagactcgctggggcacatgtaaagggagcttccctgcagagccggccctgggaagacccctctctgaggactgctgtgtacctccgctctgcttgcagttcgtcctgtactttgtgatggatctcctgaagggcctgccaggcctgccagggctcttcattgcctgcctcttcagcggctctctcaggtacccactttaacgatttccctcaggcctggtgcacctgacccctatttggtacaaggtgatgggtggagcggggtgatagtgggtggggaatccctctaagtttctcactgtgcctgccccatctgtgtggatgacaagggatagctcatctttgtaggccacagcacaacagagatacccctgttttggttaagagttcttttatggtaccagaaattgatctactcgaatgaaacccatatccacattcaaaaaaggactgtgtccttgccttccaggcccgctctgaggtggcatcaagtccaactatgaggaggtttcttggtggtacctgtcatctccccgctttaggacaccatttcctccatagagtcccatagagctgacaattttgcctcgctcaactcctcatcctcttcctctttttcagcactatatcctctgcttttaattcattggcaactgttacgatggaagacctgattcgaccttggttccctgagttctctgaagcccgggccatcatgctttccagaggccttggtggggttatgcttcctcatctcttcagtctgggtctttctaagcttcatcctgaccattgtcatcagtttgctgtaaaacacccactttatccggggctcagcacttgcctaatgaagcacacaaccttccctgcatgcatggttgtttccatctcagggcatgtcctagggaggtctctgagtcacataggagtgaggacttggtgggaggaagctggggcgtgatgtaatatgccttttgtttccagagagacagaggtggtagtttggctgggcagggagccttgctttaccccattgcttgtgttaactcacaccttcttgtttcctctcctgtccttttcccccagcctttggctatgggctgctttgtctaggaatggcctatatttcctcccagatgggacctgtgctgcaggtaataactatagagggtaggaagcaattttaagggagagaaggaattgattgaaacaggaagttgagaagggcagctatattgaggggaatgaccggggggcaggcgtaagagattcccctttgatggaccgtctttactgtgaacagacttgcaagcagccagaggacgcagggtcattcctgggatgttgtaggctgagagagagctaaggatcagcctcagagaactcaaaacacatccctctccatcagccccctagcagcctttcctgccctctggagttctttttttttttttttttttttttttttgagacagagtctcattctgttgctcaggctggagtgcagtggcgcgatctcagttgactgcaacctccacctcccacattcaagtgattctcctgtctcagcctcctaagtagctgagggactacaggcatgtgccaccgtgtctggctaatttttgtatttgtagtagagacggggttttaccatgttggccaggctagtctggagctcctgacctcaggtgatcctcccgcctcggcctcccaaactgctggaattacaggcatgagccaccgctcggccacctctggagttctgattgttcccacagaagagacagatctgacaagtggggctccaaggtcatggctggtggctatgctttatggtgagtctgggcatctctgagtctgtgttctttttccttttcttctcaccctgtcctcctaggcagcaatcagcatctttggcatggttgggggaccgctgctgggactcttctgccttggaatgttctttccatgtgctaaccctcctgtgagtgatgcatctggatccacagtcatgtgtagcaggatggacctgggggttggcagggctgtcaccaggagagctgaggactgccgtgagggctggcaggactggccttgtgacaggcctgcactgtgtctcggcagggtgctgttgtgggcctgttggctgggctcgtcatggccttctggattggcatcgggagcatcgtgaccagcatgggcttcagcatgccaccctctccctctaatgggtccagcttctccctgcccaccaatctaaccgttgccactgtgaccacactgatgcccttgactaccttctccaagtaaggcagggcttgctatcttcttgttttctcaaagtcctcctttgagggctttcacaggggtcttgctaagggatgggccaccagaggccccagggaaatgttgggtattgggtcccaagaccctgggaccatgcgggcaagtagagattggtgcccaaggaatgccctgccaacgaattgctaattgttctcacctctgctcttcccaggcccacagggctgcagcggttctattccttgtcttacttatggtacagtgctcacaactccaccacagtgattgtggtgggcctgattgtcagtctactcactggtaagggtgtgggattgcggtgcagatgagcaccgaggggttaacagagggccctaagggactctagggagaaaggctcctgccctctgagctcttgggtgtccgtagctgtcaggcttttctgctgggatgtaggaggtgggtgggggctggggtctctgggggccaagggaggacatggggcccgctgctgtggatggttccacccagagactcagaagcacatttccattcagggagaatgcgaggccggtccctgaaccctgcaaccatttacccagtgttgccaaagctcctgtccctccttccgttgtcctgtcagaagcggctccactgcaggagctacggccaggtagtacctgctgtccaagtgacccctccctgcccttctccacagatgccactgactcttcaggttcccttctaccccttttctctccccctgccccgggtgcctctctcaggatcagctaagcctaggctgtcccacacggctgtctcaggttctacccacaggactgcactggcttggtgggcagaaggatctcagggctcagaggagctcagccccggcctgggccagtcagctcccctccccagcccaccctgtgctccctgctgtgctatgccctccctcttttccccctgctctccctcccgaacccagccttgctgggctcccttctggcggggaccttttttgtgtgaatcctgtcaagcacccgtcatccgtcttcaccagttccacccctttggctctgtgtttgcaggaccacctcgacactggcctgtttcctgagaagccgaggaatggtgtgctgggggacagcagagacaaggaggccatggccctggatggcacagcctatcaggggagcagctccacctgcatcctccaggagacctccctgtgatgttgactcaggaccccgcctctgtcctcactgtgccaggccatagccagaggccaccctgtagtacagggatgagtcttggtgtgttctgcagggacaggcctggatgatctagctcataccaaaggaccttgttctgagaggttcttgcctgcaggagaagctgtcacatctcaagcatgtgaggcaccgtttttctcgtcgcttgccaatctgttttttaaaggatcaggctcgtagggagcaggatcatgccagaaatagggatggaagtgcatcctctgggaaaaagataatggcttctgattcaacatagccatagtcctttgaagtaagtggctagaaacagcactctggttataattgccccagggcctgattcaggactgactctccaccataaaactggaagctgcttcccctgtagtccccatttcagtaccagttctgccagccacagtgagcccctattattactttcagattgtctgtgacactcaagcccctctcatttttatctgtctacctccattctgaagagggaggttttggtgtccctggtcctctgggaatagaagatccatttgtctttgtgtagagcaagcacgttttccacctcactgtctccatcctccacctctgagatggacacttaagagacggggcaaatgtggatccaagaaaccagggccatgaccaggtccactgtggagcagccatctatctacctgactcctgagccaggctgccgtggtgtcatttctgtcatccgtgctctgtttccttttggagtttcttctccacattatctttgttcctggggaataaaaactaccattggacctagaatttgggctcctgtactgtcttcacctgctcttgtccaccctactgcatcctctggtgaggataaggagtcctatcctatgtacaggtcaccttcctgtgctgaggaggggggctgtggcttcaagtccctgctgtccctgtgtctgcaggggacagtgttgtgctcaccatggtagaagatgcacaccctctcctagggcttctcatcccctggggcttacttagtctgtcccttctccggccccactttccctttgccagaaccttttgctctcagatttttacttttggaactggaggaagaatgttcccatctgattttagaaacggaacattctagctggacttttatggtcttgtgaagaacactgtgctcacaccctcccacacctggcctctgcccctgcctggccctgttcagctgcccacatcagctctgcaccagctctccggggtctcttaacagagaccgggtcccaggcatatctgaattcagcctcaactgaggccttctcccagggcttctagagcacattccagctgttctctcatactccatgtagcttaggcctgggatgttctgtgtccctttttctacctctaccccagctcactcggtcacaccccagcccctttcacctctgccctggccagccctgtggaggaacagggcctggttgtgccagagccaagacactagctactcccaacctgcctaggcctcatttatattcatgacgacaatattgtctcctaatgggtcttaaacctgttgccctggatttttttttccattccacaaggctctggtcttgaacataaacattccttccagtatggacttcaggtgtctggtcatgatctattctcagtctgggaaggtactttgacaggccaaaggtgtgtccactgaatctaccatatttcagacatgcctgagtggtactccagggagaactggggagaatgatccccagggtttaatttgctgaattaggtagggtggaagtgagtctatgtaagaggacatggaaacattttacgaggggcccttggactcaggcctattttgttttgtcctgtgaattaaaacttcaatgatgggaagataagaagcctataattattatttagaaaagattcctttgggagaccgaggcaagacggttgcttgaggccaggagttccagaccagactgggcaacataaccagatcctgtctctacaaacacaaactagccagcatggtggcatgagcctgtagttccagccacttgggaggctgaggtgggaggattgcttgagcccaggaggctgaggttgcagtgagccaagattgtaccactgcactccagcctgggcaacagagcaagaccttgtctctaaaagaaaacagaacacaacaaaatcccttttccttcatagattgtttttggggaatgtaatcgaatctatcatgccagactcccaaattcaagccttatttgtttcctggttcaggtgtcctggtagagctgcttctaggacaaggtcttaccaatggaggcaatagaaactgagaatgtctgtaaaaactagaagtggacgatttatatctcaagccctacaagaaggagagactggtgattgtcaccaagaactgttgagggaatgggatcatctctggattcttagggcctgatctctgaacccattttctggccaagccagtgtctgtaggagagttgagagcaggatgcccctcactgctgcccttggtccagggctttacataaaaaataccacattggtcatatctgcaaacattgggattgtaaagtaagtaatgcccagaactgcactctgtaagtcctccaagaactgtgcatccttccattagaagtgaggacagtccccgaacatgccaggttgactctgccccgaggtctgccctcttctccttagtccctcctcctgggacccaagggcactgttccttggttaactaccttaccctac

SEQ ID NO: 13746 - DNA, 4867 bp, Human
ttagccaggtgtggtggagcacacctgtagtcccagctacttgggaggctgaggcacgagaattgattgaacccgggaggcagtgagccaagattgtgctactgcactccagcctgggcaacagaggagactccatctcaaaaaaaaggtgctgaaggaaagagacctaaacctgccaatcctttgtcatgatccctcctttgccatttcatgctcccatctccagcccttgctcactgcttagccttcctcctcttcattgtgttattcctgttccttaggttggccgttgtccaatgtgttgctgttatctggaactcctacctgtcctggaaggcacatcggctctaagcctgcctcactccatcgtttccaccttgcagtgatgcagcttgaccctggaacggtcagacaacctcctcaaagtgggcataccagtttccacggggttgggttgccggtcagagcttaagaggactagcaccctgcaatgcccctcttcactctaaaatgtacactgactgctttagagcccttgataatagtcttattcccaccacatactaggcactccataaatatctgttgaaccttcatgaccttatcaactttacacccatatcccagcaaatgccactcatccccactcttcatagacacatttgttactctaaccctgcctaggcttcttgtagctccagctctttagagactcccggaaccctttatatggtgcctcagtaaatatgttattaaatatgtaatccggaatctgcagtggtaatgagtaagtttttaagcagaaaactattggggagtcatttctagagctggaaagaagccaagagaccaccaagcccaatttttttttttttttttttttttttttttgagacagggtcttgctctgtctcccaggctggagtgcagtggcgcgatcttgcctcactgcagcttccgcctcctgggttcaagcagttctcctgcctcagcctcctgagtagctgggaccacaggcgcataccgccacgcccggctaatttttgtatttttagtagagatggggtttcgccatattggccaggctggtttcaaactactgacctcgtgatccgcctgcctcggcctcccaaagtgttgggattacaggcgtgagccaccgcgcctggccaagcccagtcttacaaatgaggaccctgaggttggtaggagggaggtgacctgtccacaccaggagttagcagaaacttgaacccatatttctttgctgctcatgggcagagttacactgctgctatgattcccaggagagaaactgaactttgctaaactactttggcaaactcaaaagcagatgggccagccatttgtggtctgaaagcactcggatgctagagaccctctgttacatggtgcctgtcagacagccctacaatttggatcctggggctggaaaaagataagaatgctgggagactttggttgtggcagactgcctctcagtgggtcccactgtgttggctgagtgccagcggtggactcctgatgcctgcatttgcagaactgatagctgcagggaggcagtgggttccagcggcacagcgttctcacatttctggccacttctagaggcagaggacggggtcagcaccatggacagcctcacggtcccgcctccctttcgtgtgtcagaacacgcgacccggactagtctggtctggggacggccctagtcattgctggctgttctaagcggggcgagggactcccgtgggtcccagagcagtctttacgccccagccggcttctcgctttcctgcgtccagtgctgcttccagcgctagccccaggggcacgaaggctggtgtagggaggtgcgcccctccgggggcccgccagccgtcagactcgaagctgtggctgtcattgcttctacaatcagtgcatgttcttcgctgacgtcagtcggagctgtcctggcactatataaggctggcgacagccccgggacagaccctgtgttccccaaggcgtcttcagcctgccccgagggacagagactggagctcaatcttggaccgtacagacgctcgccgacaacctgtgagtggctcagagcgtccgcccagcctccccctgcaccaggactccgctcagctcagccaccacgctcctccggggagggaggctgggtggaagggatggaacagcactggcgcagtggctggggctggagggcaggctgcgggcattgggcggcggccggaggggtcgccgggcgagcgcggggaggggagcggcggcctgcagctgtcccaggcgcacctcaccctgcgctgcccctgtgtgtccagggccggcggcaccatgaggcaggcgggacgcgcagcgctgctggccgcgctgctgctcctggtacagctgtgccctgggagcagccagaggagccccgaggcggccggggtccaggacccgagtctgcgctggagccccggggcacggaaccagggtggcggggcccgcgcgctcctcttgctgctggcggagcgcttcccgcgccgcgcggggcccggccgattgggactcgggacggcaggcgagcggccgcggcgggacaacccttctctgtccattgacctcacctttcacctgctgcggaccctgctggagctggcgcggacgcagagccagcgggagcgcgccgagcagaaccgcatcatattcgactcggtgggcaagtgatggcccggtttggggctgcgaaaacgttgacccctttcccccaccccagagttgggatgcggggcagagccaccagggcactgtctgcgtgactattttttaataaaagtactgaagacccgttggcttttgtcgtagaggcagggcagtcacagcagcgtgggaacccgtgggaaggtggggcccccgggccagcgggaggggaacaaaatgctgtggggggctccgagacagcggctttcagccaggtcagccaggtgcatgtggaccccaagggtccccaaatccccaggacctcagaggtcccggcaccaccgccccgccctcggccctcttcccagggcgctgggctcaccagttcgctcctggcatcacagaggtgcccaataggggttcatttggcttccgccccccagacggtctcaggttctgggaagggcaggatggtgggcgggtcgccttcgaagcccaggctgcggggttgggcagcgaaaggagatacgggtctgggacgctcgagttctttattgagatcctcccggggccggcgccgatttgggtgatgctgcggtctctgcgcagatcctccccgactctagcgcgggctctcgagcagggtcgggtcggcgcaggcctgtgcccgggaaagaaggctcggtgggcgggtgctgcgaaggcacgaggcagctcgagccccgctcactccgtcccccgccacgtgggtttctcctctactcagcctgccttgcctgccctcccagcaccccagaggaacagcgggtgaggaggaaagtgtacttttccgccctagggggcgcgcctttgtggctccggggttgggttgcaccgaggagtgggggctccacgctacccgcagggagggcaatcactgggggaggggacgcgagcacaccagccaggccccaccccaagcccctcaggccgctctcaccttaaggcccatcgggcggctctcaccttaaggcccatccggccgctcttcctccggccccgcgctgccctcctctccgtctggggccacctcctcttcctccccggaagcgcctgagcccaaggaaggcctggtgaggtggagtccctgcctttacggccatcgtgcccgccgcaccccccacacagagggtccgaacccgtctcagcggccctcggccacctccttcacctggctggaagtcgatggtccgcagcatttcggccacgtgctccacccttacggtgaattgctccatgctctcatagcctggctccggccgccctgccagctccaccttcgacatggccccgaccctgcagtggccacacggactcagctggcaatgccccagcactctcaagccccaccccagccagtggagcagtgcagccccctcctttcccttcccgctatgcctactcacttattgatcagctccttggcctgctgcagggaagaaaaggagggtgagagtaagcactgggccaacctgggcaaagtcccatttctgaatctcaccacagtcctgcggggtaggtgggaaggcacgtcccaattcgttaagcagaaaacgaactcagagggggtgacttgcccaaggtcgtaggggcaagcaggtgcaagagacaagacttgaacccgggactccaggtaccaaggccctgactccagccactgtgcagcgctgccaccctcccctagagcccacctggagatacagcgccatttgtggctcttccatggactggatggcagactccaccagcttagaggaggcctccaggtggtcgccatactgacggatgaggccgcggacgcgctgcagcttctcctcttgctcccgggccagcgcctgcagcagctcacccttgcgctcctccagcactgcgcacaggctctcaaacctctggtttaacaactgcttctgcctccggctattgtcctaaaagatggggagcaaggatgagggaaggcgtggctgagacccggtggctgggaaagcacagggtactcacagagaaccaacacagaaagtgacccatccgtagtgacactgtgagttagtggctgagccagaacccagcccagatcttttccataataaaaacacaatgctttaaagtagcttca

SEQ ID NO: 13747 - DNA, 264665 bp, Human
tatggttgactttatggagccaataaagtcttcgtttgaaaaactggcctgattgttcccagacttacaggtgagtggcctgagtggccgggcgcgggggctcacacctgtaatcccagcactttgggaggccgaggcaggtggatcacgagatcaggagttcaataccaacctggccaagatggtgaaaccccatctctactaaaaatacaaaaaaaaaaaaaaaaaaaaattagccaggcgtggtggcaggtgcctgtaatcccagctattcaggaggctgaggccgagaattgcttgaatccaagaggcagaagttgtagtgagctgagatcacgccactgcactccagcctgggcgacggagtgagactccgtctcaataaacaaacaaaaacaaacaaaaaagccaaaaaaaaaaaaaaaaaagaaccacagatgagtaaggaatgtcactctctggcaggcccaggaacttcagtgtattttagggacccccaagaagagaggaatacagtcaaatctctaagtgtttcagatgtagcctgatggctaatagtttaagatgtagttcaggtaatccatgaagatttcctgaaggaagttcgcatgaatgtgagagggcaattaacttttataatttttattgagcacgtagtatatacttgtcagatgctcttctacacattttacaaatgattcttaatcctcacaacagatctttgattaggtttttaaggaaaactagttctttccaaaataacctaatgatcacaaaacatatagaacatacaactctgcatcttgactatggtgcgtaggtctacatgtgataaaatgacattgaactatacacacatcatacaactatcaaatccctccttttgagattgtactagaattatgtaatatgcaaccattgggggaaactgggtaaagagtaaattggatctctctgtactatctttgagtagtgtttaggtattttataaaaataatgtcctacagtttgggtttgtcaaatggttttctcatagttagataggggttatggcttttggagagaaagaccacagaggtctgtagtatattttcaactgtaatctatttcaaaataaaaagttttaaaaaaattctccaaggggggatgattagtaaattgattagtcctttctagacctccaacacaccccaccacacactcacacagacccacactcctattaattccggtaactcgggttgtttggaatgtggatagagaaactaagcttaactatgcgcttccagcacctcgtatctggtacttctgttcaacagaaagccttgggaatggggagggcaggcgtggtaaaaggtacaggtttgggaaggtcgctcggttccttccaatccaaacgagaggcttctgattgtttattctcacaccagagccgtgaccgagacccagaggtccgcttccggccacggccgaacagctgcaccgtgcgtaccgggaacggtcaaggcgcagctggaaccgctgcaaaaggcctccgggcgtaccggacaggtcgcaagggcgggggtccccacctagcggaaatgcacggaggccaacccctccccctgcccccgcgaggagcggggcggactcggcagccgccactccccaggctcacaggaagaaactgggacgctgcggacgcggaactggccagacccgcggcgcgtggcacgcgcgagccctcccgcgcatgctccacccgccggcctccagcccgcgccccgggccccgcctccctccctgcttctccccctctcccgtcagcctccctccgagtttggcccctccggccgggcgatcgacgttccgcgtgcgtgcgggcgcctgacttcacttccggctaacgcgctcggcttgccccctggccccggatggtgactggtggtggtgctgcacctcccgggactgtcactgagccgcttcccagtgtgattgtgctgagcgcaggccggaagatggcggctgcggctgcggcggcctcgggccccggctgctcctcggcggcgggggcgggggcggccggggtctcagagtggctggtgctgcgggacggctgcatgcactgcgacgccgacgggctgcacagcctgtcctaccaccctgcgctcaacgccatcctggccgtcactagccgcgggaccatcaaagtcatcgacggcacctcgggggccacactgcaggcctccgcgctcagtggtgagtcttccgcacgccgggcgggcgcgaagccggggaaagaagccgtccagccccggggctcggcctcgcgactcggggaagcgagatggcgagagggcagggctgggggttcgggcccagccgtgaagggaggcccggaagctgatggagggggaccttaggacttggctttttcagcggctgcagttgggaggaaagaccggcgagtcagggagtggtgggaggggagttgcctttcgggcctggagcgtccggtctggcttggtcctccgcgagaggtgaggagaccttggagcttggcaccggaggaagcgaggcccgggtaggccctggagaggctgtcggtcctgcgtccggttagatgagagcgaaaggctggaagggttgaccccgggcggagaggctggtggccggaggcgaggggcggggagcgtctgagccggcaaccaagccctcccttgtgggagaggagccggcagtctgctgttctcaggtcccgcaggtgcgggggacagaccgcgggctgtgcgcccagcgtgggggtgggggtggggttggggtgggatgagtcgtggttggggtggggagaggaagtaggcgggccagctgcctgaactgcttggtcgacgactgtaggactctgcggacgccgaagacgactagacctggtccccttgctcggggcttccaacttctacgccccagtgacgagaaagtcaggacctgtggtgtatgaaatagattcctttgggtttgtaacttcaggctgtctctacttgttttcccacagcgagccgaaaattaggatttgaaggtgtgtctgagtctcaccattggaggagagcacttctgggtggcgtaaaccttggtccagggacgggactttcagatgcgtgaggtgtatgctcagtggacggactggagtggttttggaatggccctggctgagttagatttggcggagatgacatttcatttgtggttaaatgatgggtggcttaatttggatgttgtaggtttagattgaaaagttagtgtatgagtgaatcggactcctgcatagagatgtaatgtatacaactgtctgcgtttagccaagtggaagtagttatgtggtcaaccaattcacttgtattttaacgtagacgaacaaggaaaagtttactatgtgagtaataaggcatttgtaagagtaaatggcaatttagggatgcaaacgtgaaattagacatgttaattattgttgatgtgagagttgtgaaagaattggattatgtatagtttcaggatataaacttggaacatatctaagagaaagttttgggaggtaggtttgtaattttttcttttcttggcttaggtaaatgatggggtggcccagatgtagcagtgaacagttactgcaacttggacataatggcttctcactgtgtgtaagagggagatgctcattggtaattggatgtctttctttttaaaagtcatttaaaagtatttcaagtatgaaaaggtatgaagagtaattacagtgaacaccatgcatccccaactcaggttaagaaataaaactttacaaataggattaaaatctcagctgaatctctcctggactgcatttctccaatcctccctcttcataaacgttatctttaatttgattttatccttttcatatatgtctacactttctagtatatgtttctatcttgaggatgtagtatttttgtgatttttaacttggaataagtggtatatgtactaggatttctaaagaaagtcattaacaaaagtattcaagtgttttggatagaaagaggaattttatggtgtgctttttatgtctggaggccatgtttgagaataataatgtgtgtcaggatttgttggttggggaaattggacatatatttatgtgcctgtacatggaaggaaagacaatattcactttagtggtagattactaaagaggagggttttagatgtataacatgaaggtgtaggtagataagtaaaatgtagcattgatttgggataacaggttttgttggggcatctgttgattagaagagttcgggattggatacaattgcaggtccccatgcatgaagattgagtatgtgaattaaaatatgtagaagggtttatagtgaacggaatgaaggattacagaaaaaatttggaagttaacaatggatgcattctgaaacattttcatatatgagaagtgaaatttattattatttgtaaaatttattcgtatttgtagagatggggttttgctgtgttgcccaggctggtcttgaacttccggcctcaaatgatcctcccacctcagcctcccaaagtgctggtattacaggcatgagctgtcccacctggccagaagtttgttattaataataattatcagaggttgtatagggtcctatttgccccagttcagatgattgaggagggaatgctgcattttatgttttacttagaatctgcaggtatttagtaagtttgcttttaatgattaatagagggtgacagccctataaatagagtagagagaagatgccagtagcgatcatggtcctaacataatccctctttcccgtttatgggcaatgggccactttcttttctaccacagaggaaagacatctgtgtctgaggggataaagactaggtgatacagtaataggtcttatggacgcctggggttcagtttatagggttatgggttgcctgtagatttgcagttgaaggatgggaacaggacttgtatgtatatgtattgagtggcaaagacagtgaatttttaactatgactactagtatatgtctttatattatctgtatctgatataaaatgtttataaatacagtttaactggattaagagctatcagtatatacacaggctgggtaagtatttgctccctgtcagtatttaagagtgaagatttttgaagctctgagctgcgtgatctggcttttactagtctctctagtcttgtctccttatttataagttttgtgaaatggtccatttaattctttttcctaactacagtagttttgttctttcttggaatgcaccaattcgctccagtcatttagctaagtcttagtcattttcaagacctagagcgtatcttaacttcctgatccctttagccagaaatgactgaagccctaagcacatatggtcctattagtgtccattttagtaatctggcaggttagtattttgtggtattttttcaaccgtcttgaactatttaagtttaaattccattttatttagctttttgtaaatatatgaggtctgtctcatatttcaagctccttgtggggaggtactttgtttatttgtttatatatcccttccccaggatgcctaatatacagtgtgtgtgtatgtgtgtgtgtatgtatatatttatttattattattgtttctttgacagagtgtcactctgtggcccaggctggagtgcagtgatgcgatctcggctcactgtagcctctgcctccttggctcaggcagtcctcctgcctcaccttcctgaatagctgggattacaggtacacaccaccagacctggctaattttttttatttttattttttatttttagtagagacagggtttcaccatgttggccaggctggtctcgaactcctgacctcaagtgatctgcccaccttggcctcccaaagtgttgggattacaggtttgggccaccgcgcccagccctaatatatacagtataaactcgagtatttttgattggatgcatatataacaatgagtatattagtacttccttatatactaattgctaagtaaacacattccttgactttttttttgtttaaatatgtgtttcttttttagagcagttttaggttaacaacaaaattgagcagaaagtacagacagttcccatatgccctctatctctgtgctcacacagcctcccacccatcagtattctgcaccagagtggtatgttaccatccgtgatcttagcactaacaatcatcatctcccaaagtgcatagtttacattaggatttactcttggtgttgtacaggctgtgggtttggacaatgtatagtgacatgtatccaccattgtactatcataaagaatagtttcactaccctaaagatcccctgctctgcctattcatccttcccttccttttccccccaactgttccctcccctctccctgctggcaaccactgatctttttactgtcttcatagttttgccttattcagaatgtcatagttgtatttataccgtttgtagacttttcaggttgccttctttatctatatgcatttacagttcttccttgtcttttcatggcttgatagctcattcctttttagcgctaaataatattccattgtctggatgtagcacagtttatccattcacataccggaggacatcttgctggcttccatgttttggcaattatgaataaacctgctgtaaacatttgtgtgcaggtttttgtgtagacataagttttcaaatcatttgggtaaatactaaggagctcaattgctgggttgcatgtgagagtatgtttacttttgtaagaaactgacagactcttagtggctgtgtaccattttgtattctcatcagcaatgaatgttctacttcctcaccagcatttgggggttttatattttggccgttttagtagttgtgtagtggtatctccttttttaaaattgtaatttcctaatgacatgatgttgagcatcttttcatatgcttatttgtctctttttatatgtttatttgctgactttgtttttttttttttttgagacagagtctcgctctgtcgcccaggctggagtgcagtggtgtgatctcggctcactgcaagctccgcctaccaggttcacaccattttcctccctcagcctcccaactagctgggactacaggtgccccccaccagacccggctaatttttttttgtatttttagtagagatggggttttaccatgttagccaggatggtctcgatctcttgacctcatgatctgcctgcctcggcctcccaaagtgctgggattgcaggcatgagccacctcacccagcctgactttgggttttaaaaataaaaaagctacacaccacttgaccatactgttcatattactagatatgtccttcaccctagctattgtttgttcatgaaatttagcataatagttagaaaggagcttggttctggacacagatagcttgggttaagatcccagtgtcttaaaaatttttttttttttaaattcatcccattacacagaattattttaatttttaaacacctgtctaaatttttaaacaccttgactaaattatttaatatttctgttccagtttccttatttgcaaaatgaggataattgtactaattgtgagaattaagtgattatgcatgtaaagtgtttgcagcagtgtacttaccagacaagtgccccaaaaatgtttgtcttatctactttaattccctgtaaataccttgcttttggcctggtgctgtggctcatgcctggggtcccagcaccttgggaggctgaggcaggaggatcgcttgagcccagtagttggagaccagcctaggcaacatagtgagaccttgtctctagaaaaaaataaaaaaatttgctgggcatggtggtgcacacctgtagtcccagatactcgggaggctgaggtgggaggattgcttgaacctgggaggttgaggcttcagtgagttgtgattgtgccagcctgggcaacagagcaagactctgtctcaaacaaacaaacaaaaacaagaaaaccttgctttttttttcttttttacttaaagctttttttatattcagtttttggacttaaactgaactttgaacttcctaaggtttttttgtgatttaccactttccaccatcctacagaacccatctagattttgcttttttgtgagagtaagatattgttaaggtgttctcttacttaattactgggggtgatgatttctcttacttcctgaaataatgcccctccccagtgtagtacattttataccgtttgtcttttttataagcttttttgagattatgtggagagagcatgcgctttatgttaggtagtcctgaattttgaattttagttcttttatgaactcactacttaaacctcctgaacctcagcttcctcatctgtaaattaagattaatgtttaataggatggtggggaagactaagtggtcaaacatgttaaaagtgcctaacagtgcatgacaaatgtaaaataggggatgctcagcaaatgctaattcctttgagtctcttggctgcttggtcaatattgccacactcctcgtgattactttaaaaaatgttcactaaatgtttatacatagaggataggcagatgtagatggaaatataaatgtttgtaacaaatatacagtaatctgtgtttggataaatatcttttagtgtattggtgtggctaaatgtcagaatgaagttaagatagttgtattactagttctgtgtgtatacagatttgtttatgtagtatatatacatatgtaagtgaaggtatatgtgtgcaggtattaatcaatggatatggcagtatatgggtaggagacagtcatgtctcttcagtttccgaagtgaattccagatctgtgttgcagtgaagaagaaaaaacctgctcagtgtttttattttattttattttatttacatattgagatggagtcttgctctgttgcctaggctggagtgcaatggcgcagtctctgcctcccgggttcaagcgattctcctgcctcagcctcctgagtagctgggattacaggtgtgcgccaccatgcctggctaattttttttctatttttagtagagatggagtttcaccatgttggtcaggctggtctggaattcctgacctcgtgatccgcccgccctggcctcccaaagtgctgggattgcaggcgtgagccaccgtgcccagccctgctcagtgttcttagacaaacactccagttttacatttctttgtatcttttttcttttcctatatagatagtgacttttttttttccactgggtttttagagtcagtccctcagtaatacagataatgactttgatttgagaaatttgtatgtggtcataaataagaggaagatctttgtactttactgtagcttcagtgaggtttagatcgggtgttttttttttttttttctttcctgatgtaagagcttcttgatcaaacttcaggcccagagctgcctgctctgagaggtcatggtgcctgcatagtcctcaagaaataattttttttggctaaaatgtgcagtctcccagtgatggaaactgtaaatgattcaaaacagttctaattcctggctaacttcggtacatgcggcattcctactctcaactattctttgagagataaacatgatatagaattcggatctcaatagccctagaagatgtcttatgaatgcatttgagtttttataaaaacttaatttagcagaatctctttttgggctatgaatatgtactttggctctgtttctggtgactgactttagtgatattaagaaagaatagaatattggctctggagccagacaatttaagttccaggtgtgaccttatgcaaactgcttaacctctctctgtgcttcataattagtacttaactcactgggttattgtaaagattaaataaactgatacatacagaatactgcttgactcaccataaacagtcaataaatgttactttttttttttttttgagaggtcgccctgtcgcccaggctggagtgcaatggcgcgatctcagctcactgcaacctccgcctctcaggttcaagcgattctcctgcctcagcctcctgaatagttgggattacaggcgtgcgcctgcacgcccagctaattttttctatttttagtagagacagggtttcacaatgttggccaggctggtctcgaactcctgaccttgtgatccactcgcctcggcctcccaaagtgctgggattacaagtgtgagccaccgtgcccggtcctactttttgttttgttgtcttaaattatatagttcagttcaacaagtgtttgtctgccttatgtaggtaacaaggttaatttgaactaccttggccatgattcccatattttaaagtacaagaactcccagtttaaggtaaaaaaattagggccctattatgattggagcttggttgcagtattaattaattgagaaaatattgtaaaaacaactgcttttaagcagttttatttatttattttattttttaatttaatttaatttaatttaatttattttttgagatgaattcttgctctgttgcccaggctggagtgcagtgatgtggtcttggctcactgtaaactctgcctcctgggttcaagcgattctcctgtctcagcctcccaagtagctgggattacaggcacgtgccaccatgcccaggtaattttcgtctttttactagagatggggtcaggctggacttggactcctgaccacaggtgatccacctgcttcggtctcccaaagtgctgggattacaggcatgagccaccatgcccagccagcaattttaattattagacctcttttacctatgtatgtgagaaagaatacaacgtgaatgttttgggctttctttccctgctggcttagcttttaagatttttggggaggagaggaaacagattagttaatgcttttccatttgccctccaacttcaaaaattttgttgctattttctcttcacttgttctttttgtctttttggatttgttcaataccttctttattcctttactgtcttttcagtgggatcttgggagggagcagaggtaaatgtggatgtatgatattatttttaaactgaaaatctctagttgtaactatacttacattgttaaacatttagtagtctgtccttaggaatgttggctataagtatatatagaacttaaaaaaataatagatttctgtaatatagtatgtaagaacagtggggacgcaagcaggagtgacctctctgatatgtgtgttgtattgctgatggcttcatgaaaagggtgcctttggcaagatacttctctgagataccaactttaaaatgggctaatggcctgtaatcccagcactttgggaggcttaggtgggaggattgtctgaggccaggagtttgagaccagcctgggcaacatagtgagaccccgtctctacaaaaaaaaaaaaattagctgggtgtggtggtgcatgcctgtaggcccagccacttgggaggctgaagcaggagtatcacttgagtccagcacttcaggcagcagtgagctgtgattgtgccactgcactccagcctaggggagaaaggggcttttaatacctttctaaacatagaaattttttgcatactgtagaactgtagcacttcaaatgtaagggatacaaaaaagttaagataaacttgggtgtagaagagaatatcatatagagatacaaactgcaaaaagaaggaaatacagacaggagataatagagatacaaataaaaagaatacagtaattgctttataaaacagtctgtggcctggcatggtggctcatgcctgtaatcccagcactttgggagaccaaggtgggtgggtcacctgaggtacggagttcgagaccagcctgaccaacatggtaaaaccctgtctctactaaaaatacaaaattggctgggtgtgatggtgcatgcctgtaatcccagctattcgggaggctgaggcaggagaatcacttgaacctgggaggcagaggtttgcactgagctgagattgcaccattgcaatccggccagggcaacaacagtgaaacaccatctcaaaaaaaaaacaaaaaaacgaaaaacaacaaaacagtctgtggctgggacagcgctgttaaaaaaagtaattattaggctgggcatgatggctgtcgcgtgtaatcccagcacttgtggggccaggacaggcagatcagttcaggagtttgagaccagcctggccaacttggtgaaaccccgtctctactaaaaatacaaaaattagctgggtgtggtggtgtacacttgtaattccagctactcgggaggctgaggcaggagaatcgctggaacccgggagatagaggttgcagtcagtctagatcacagcactgcactccagtctgggcgagaagagtgagactgtctccctgctgcccccaccttccccccaaaagtaattatcatcaggtttgagtatgttaaatcagggatgcatcttagaggaggtaaatactatgtttactttttagaggaaatgaatttttgagtggggaagatgggaatgtcttcttcaagatttattgtgggcagcaggaatttaaatcttcataatttgtttatgtacttttactttgatttatgaagtaggagagacagaagactgggagatggcacagggcagtggttctcaacctttgttcatttagaatcatcaggggaaattttaagaaaatacctcgcttgggccccagtattctgacttaagtggcctggagtgcagcccaggcatactgttttttttttcttcttcttctcagaagtgtgccagctggttctaatgtgcagttaggtttaggagttcaaactccctggctgggcatggtggctcatgcctgtaatcccagcactttgggaggccgaggtggatggatctcaaggtcaggaattcgagaccagcctagccaacatggtggaaccttgtctctactaaacgtagaaaaaattagccaggcgtggtggtgtgcccctgtaatcccagctactcaggaggctgaggcagaagaatcgcttgaacccaggcggcagaggttgcagtgagctgaaatcacaccattgcactccagcctaggtgacatagcgagactttgtcccccacaccaaataaataaataaataaataaaaaataaaacaggagttcaaactctctaactccctagactttagagaagtttgtttagtgtgtctgggataaatgagagcttcccgcccctgtccccttttgaaacggagtctcactctgtctcccaggctggagtgcagtggtgtgatctcagctcacttcaacgtcttcctcctgggttcaagtgattctctttcatcagcctccttagcagctgggattacaggtgtgtaccaccatgcccagctaattttagtacttttaatagagacaaggtttcaccatgttggccaggctggtctggaacacctgacctcaagtgacctgtcctccttggcctcccaaagtgctgggattacaggtgtgagccactgtgtcattatggcattaattacctcttgatatactatagtaattaatgccataaggaaaattacagctgatatgaggatgatggtatattaaatttgtgcttttaggtagtcttgggaaggcctctttgaggtggtgtttgagtaaagatctgcatgatgcaagatagcatcagtacagatatccaggggacatttctgtttgtctgttatataatagacaaaaacagctagatagattttcatatttggatggaattcgagttgggctgacttaaaatgtaggctctataaggagtgatgaagatgtctgtgtgactaccattcaggagatatctggcatctatattaaacagaaaacagtaatttcaaatatgagctctaaatagaaattcgcaagggcacatgttccaaaccgtaggattattatattgattagtagctgagttgcttctcacattggcacctttgtgcagcagtagcaattgatttttttttttttttttgagatgtagtctggctctgttgctcaggctggagtgcagtagtgtgatctcggctcactacaccctccgcctcccgggttcaagcgtttcttctgcttcagcctcccgagtagctgggactacaggcacacaccaccacgcccggctaatttttgtgtttttggtagagacagggtttcaccttattggccaggctggtctcgaactcctgacctcaagtgatccgcccacctcagcttcccaaagtgctgggattacgggcatgagccatctcgcccggcgccattgatttacagacggttaagggttctcttgcccaacatcagttggggaagttagtcttcaaattttacttaactatagccagtttagccaggttgcacacctgtagtcctagctgcttgggagactgaggtgagaagattgcttgagaccaggagttccaggttagcctgggcaacatagtgagaccctgtctcttaaaaaaaaaaaaaaaaaaaatatatatatatatatatatatatatatatatatatatagtatgtatgtatgtgtgtgtatatatatgcatatatgtatgtatatatatgtatgtatatatatgtgtgtatgtatacacacacacacacacacacagcacgcacgggtgtgccaagttcagcatcctaaaggaataatataacttatgtgtcccaagacgttgagagatataactgtgataaattgaacaatgtatatgaagaaaccccacagcaagtatcttacacggagtagtaggtctttagagattgagccctctccatgataaatttttcgtggtgattatattttcaaaacaaatgatgtcagatactaaagattatagcaaagtaagtggtctgatgacacttttggttaatgtgaatgaagagaatcataacttggaactcttaattccagtaattttgtatcttttggagaacctcttctgtgcttaagtagatgttggttctcttgcctgaaacaacactgtccctgcattgtgttttatgttgtattttatcatgtgttacccctttctttgtggtgcagtcactgacctttcccaaacttgttttgcagtgagttctgcttcataggaatactcattttggcttttaatactatagtgttactaacattttttctcttattaaatgatttcatttttggttaattatatcaaaagctttgtgagaaccttacattaattttgtaccttctttttaaaaaattttaaaaattcttgtgggtacatagtaggtgtatatatttttgggttacaggagatgttctgatacaggcttgtatcttctttattgactttgaatgatctttgcatatagtaccttttaataggctattttaaaatagcgttgaagtctgatgagatgtcagtggaaatggagttttacagtgtattgtcagtttgaaaagataatgtatttcttgtaacatttttgcaagttttttagggttgtacattatttcttaaagtattagaattggtaactaattaaaatttctttcctttgaaattttcaattttgccatcctgggcaacatggcaaaaccctgtctctacaaaaaatacagaaattagccgggcgtgctgtcacacacctgtagtctcagctacttgggaggctgaggcgggaggattgcttgagcctgggaggcagaggttgcagtgagttgagattgcgccattgcaccactccagcctgggcaacagagtgagaccctgtccccaaaaaaaaaaaaaaaaaaaaaaaaggaaattttcagttttaaaagggacataccttataggatgttagacagactaaggaaaaagtaagtacgtataatttcattacctagagatgggcattgttaacattttggcatttctttttactttcttctattagtattatttttttttggagacagagtctcgctctgttgcccaggctggagagcagcggtgcaatctcagctcactgcaacctctgccttctgggtttaagtgagtctcctgcctcagccttccgagcagctgggactacaggttcatgccgccatgcccggctaattttttgtattttagtagagacaaaatacaggggtttcactgtgttacccaggctgctctcaaactcctgagctcaggcaatccgcccgcctcggcctcccaaagtgctgggattacaggcatgagctaccatgcctggcctcttctattgtttaatatatttttatagaatttggatcatagtgatgtgttatgaactaccccctccttagttaatagcatagttaataggctattgctccatgtgtacatgtttattctttttttgtttgtttgtgttttgagacagagtctcactccgtcacccaggctagagtgcaatggcgcgatctcggctcactgcaacctccacctccctggttccagtgattcttctgcctcagcctcctgagtagctgggattacaggtgcctgccaccgtgcccagttatttttgtatttttagtagagacagggtttcaccaggttggccaggctggtctcgaactcctgacctcaagtgatccgcccgcctcggcctcttgaagtgctgggattacaggtgtgaaggcattgcgcttgggtgtgttttttcctttacaatatcatttaaaaatttttattttttatagaatataaagtaaaattgtctattttttgtgtacttgtcatacaggtacacacatgcatagattgatgtaacccaccatcacagtcaggatacagaccagtttcaacacctgaaaaaattccctgtggtatcactttgtagtcacatcttccctttaccactaatcttttgggaccactgatctgttctccatactatggagttttgtgttttctacattgttactgaaatgtaatcattcagtatgtaacctgttgatgctagctgcttgcacttagcatgatgcccttgagattctgtcaagtttttgcatgtattaatatttcattccttttttattactgaatagtattccatcgtattgatgcatcattatttgttttgccagtcactctttgaaatatgtttggggctgggtgtggtggcttattctgtaatcccagcacttagggaggctgaggtgggcacatcacttgagaccaggttgggcaacatggcaaaactttgtatctacaaaaaatactaaaaattagccagacatcatggtgtgcgcctgtagtcccagctacttgggaggctaagatgggaggattacctgagccctggaggtcaaagctgtggtgagcagtgatttcgccactatattccagcctgagtgacatagtgagaccttgtctcaaaaaaagacaaagagaaagaaaaaaaaacatttgggtgttttcaatgtttgatgattataaatagagcgactataaacttctgagtatagatttttgtgtgaacataagcttttatgtctccagggtaaatacacagaagtgggattacagggccatttggtaagtttgtgtttaactttgtaagaaactgtcaaaccagtgtggctgtaccatttgtatttcctttagaaatgtatgagagttccagttgttctgcatccttgccagaacttcatactatctttatattgttaagatatctatactgccccaaacaatttgcagactcattgcaatttgcagactcattgcaattcctatcaaaatcccagtaacttttttctatttctgcaggaaaaaaaaaaaatctgttctaaaattcatatagaatctcaagggaccctaaatagttcaacataatcttgacaaagaacagagttggaagattaacacttgatttcaaaatttagtatgaagctacagtaatcaatatagcaaagtaccagcataaagatggacatatagactgaaggaatatagagccgagaaataaactattgcatatatggtcaaatgattttcagcaaggaggccaagaccattcattgggggaagcgacaatcttttcaacaaatgttgctgggaagactggatactcacgtgcaaaaagtataaagttggactttaacaccatatacaaaatacaacaacggagaataagtgttggtgaggatgtggagaaattggcactcttgtgcactgctggtgggaatataaaatggtgcagccattatgggagatggtggagtttcctcagaaaattaaggaaaaaatagaattaccatatgatcgctgttctgtttctgggtgtgtacctcaaagaattgaaagcagggaatcaaggagatatttgtacaccagtgttcatagcagcactcttcgaaatagccaaaaggcagaagcaacctaagtgtctgtccattgatagttgaatggataaaaggaaggaaattctgacataggctctaatgtggaggaaccttcaggacattatgctaagggaaataagccagtcacaaaaggaaaaatactgtatgattccttccattcatgtgagatatttagagtagtcgaattcatgaagacagaaagtagcaaagtggttgccaggctttggggagaggggataaaagtcagttactgtttaaagcgtacagagtttccctttatcctgatggataaacaacagcatgaatatactcaataccactcaactgtacacttaaatgataaaatggtaaattttatgtttattttaccacaattaaaaaaactacataattgaaaaaaatccaatggccatgtttatatagtcatatctcttgactctattttgttccattgagctatatgtctgtcctttgccagtaccacactttcttgtggtactgccttttcaaatacatttcagtcagtttatttatatggtgcaatcatagctcactgtagccttgaactcctgggctcaagtgatcctcccacctcagtgtccgagtagctagaaccacaggtgtgtgccactacacctggctaaatttttttaattttttttttttttttgtgacggagtctcactctgtcgcccaggctggagtgcagtggcgtgatcttggctcactgcaagctccgcctcccaggttcacgccattctcctgcctcagcctcccgagtagctgggactacaggcgcccgccaccacgcccggctaattttttgtatttttagtagagacggggtttcactgtgttagccaggatggtctcgatctcctgaccttgtgatccacctgcctcggcctcccaaagtgctgggattacaggcgtgagccaccgcgcccggcaatttttttaatttttaaattaagatagatacggggtctgtctcaggctggtctcaaactcctggctcaagcgatccttccgtgtaggcctccctaagtgttgtattatgggtgtgagccaccatgctgacgccacctgggattttgattgaaattccgttaaatctgtagatccatttggggagtgttgaggtttttaccagattgacttgttcagtccatgaacatggtattatttaggcttttgatttgtgtaatcagccttttatacttttcagcatacatatacaccttttgtgtatatgtatgtctaagtatgttttagagctattgtaaactggtattttaaaaataaattttggttttagattaatcagtgctcgtatagaaaagtatgattgatttttatctacacgggtaatcatttctgtaaaaagggacagttttatttctttttgatttgtttgccttttatatcctgattttttagtgcagtgactagatcttttagtatagtattgaataggaatggtaagagcatacatccttgtcttgttcctgatctgtatgggaaagtattcagtcttttaccaataagtatgttgacatgccaggcacagtggtgtgctcctgtagtcctagccactcaggaggatggcttgagccccaggcgttgccctgggcaacgtaacgagaccctgtctctaaaaaaacaaacaaacaaaaaaaacccccaaaaaactccagaccttgtgatccgcccacctcggcctcccaaagtgctgagattacaggcatgagccaccatgccaggccgaaaaagccaaattgcttgatacgtaccatagactgaggtctccagctgtggttgcgtgccatttcaggcacaggattcattttgtaaacagatgacatacatttaccgtattgataagtgcaatatagtgccgtaaatgtattttctttctctctcttttttttttttttgcaattcagctttttattgtaatcatatgacttgtccctgccttttgggaacacttcgagcatcactagtgttaccttttatgggtttcatagtgttattcagggtttatggtattgcactaaacccgatgaaaatacatgagatggccgggcgcagtggctcacgcctataatcccggctctttgggaggcccaggcgggcagatcaggaggtcaggagatcgagaccatcctggctaatacggtgaaaccccatctttgctaaaaatacaaaaaaattagccgggtgaggtggcaggcatctgtagtcccagctactcgggaggctgaggcaggagaatggcatgaacccgggaggcagagcttgcagtgagccgagatcatgccactgcactccagcctgggggacagggcaagactcggtctcaaaaaaaaaaaaaaaaaggaaaatacatgagaatcaggagagatcactttttactgcgattaccaattaacaattgagagatgaactgctcacctggatatgattagggtcacatggtggtactcataacacttgaactcactgcaataggaacaaaattatcacagttttataatatgtactacagctaattttatttagttatgatttaatactgtattttttacatttgtttacatttttcttgactggtgccatgtactatttgtgtgcgtaagttttgataattttaactttatagtagatttgtgtatattttatgtcagtaaatgatcaaatagactaatatctacatatattttatgcatcagtgacatactgttttcttaattttttagatatttctaggctacgtgttttgtctacatgttttttaaattgtcacaaatctctgaaatttttttcaatgtatgaattggaaaaaaatttatgtatgagtggtctcatgctgttcaaacttgtatggttcgagggttagctgggttttcttcttatgcatacctgtaataaagtttaatttaaaatgtaggcatagtgacagattaacaactaataataaaatagaacaattacaatatattaggagttatgtgaatgtggtctctcagaatatcttatgtactgtacttttggacctttgattgaaaatatcttattgtaccatacttacctgtttttgggcttctattgactgggtaactgaaactgcacaaagtgaaactgcagataaggaggggcactgctgtatctaataactgtccatgctgtctttatgcttattgagttttgcaaaaaatgacatccaataattcatttttaaaagttttgtttttgaacactttcattttgcacttacagaaaaattgcaagaatagaatgttacaaagaacttccctatataccctttacccagctctactagttttaaacattttactacatttgcttattattcccttaatatatatgtgtgtgtgtgtgtgtgtgtgtgtgtgtgtgtgtgtatacacatcatattttattctacttgagagttggttgcatatatcatgctcattttccctatactgttgctgtgtttatttctcagaacaatgatgttcttttataatagcaatttggttgtcaaattttaataatttcacattgatacttttatctaatttatggtacatatttgaatttaatccagttggcccaataatgttctttagagaagttttttccagtttaagatccaattcaggataatatattgtgtttagtcactatgtaaacatttatttttaatagaccattggcctgaaaatcttaagtgttgaatttttgttcttttaacagctaaaccaggtggacaggtgaaatgtcagtatatctctgctgtggataaagttatatttgtggatgattatgcagtagggtgtaggaaggaccttaatggaatcttgttgttagacactgctctgcaaactccagtttcaaagcaggatgatgtggttcagcttgaattacccgttacagaggtaagttgaaataagtatcaatgtggtcctctacttaatgtaatcttagacatattagatgttaaatgaaattaagtcatcctttaaggacgttattatatatattgctataaaaacaatttacttattgaccacaacttcatttaaatattaatactcaccttttctctgcataattaattcttgttgaagtggtgtttttaggtgtgaatggtgcatcagcacaggttaaacagctgtaaccgagacccaaaaaaacaatggcttaaacaggatagcttgtttccaataatagtccagggctaagtgtatggccatcattgccaacctcaacacttgggttagcttgggagtttaagacagctgctctaggtgtcattatttcccagtcacagggaaagagagggcaagaggctagaggagagcactctggcatctctctcttctctccttccctttccctgtcccttaacccccagccccctctcctactcatttgttcttgttctctttctgcctttcacaactcaaatactctctcatatagcctcatatttaccccattagacagaatttagtcacatgaccacaccaagctgagagggagactgggaaagaggtggttctttctttcttttttttaatattttaaaatgagagaggaatagactctggtaaaacagcagtaatttttttttttttctttgagtcagagtcttgctctgtcacccaggcaggagtgcagtggcttgaccttggctcactgcaaccttcatctcccgggttcaagtgattctcttgcctcagcctccctagtagctgggattacaggcatgcaccaccacacccagctaatttttgtatttttagtagagacgggtttcaccatgttggccagactggtcttgagctcctgacttcaattgatccgcccgcctcagcctcccaaagtgctgggattataggcgtgagccaccgcacccagccacacaaccagtaatttttgctatgcatcatgtctttcaataacttgagttttaagttttagccatatatacttttctgtagtgttaaattttctttacttaatttttaagtctagcccaacttaaattcttttgtgtggcttcatatcctgcagtttgaaagtacatttttcataattactggattttgcatcaccttaaatagaatgtaaaagattatgttgtgttctataataaagtgagatattatttgtgttcatgctaacttgttatgaaagttatcaaaaaagtatgtccaataaagtatattcacttagattttacatttagtgtcatataacagtagtctattatatgttaatattgaaagcatgttgctgaaagtttgagttccaaaaacagagaagctgtctttttctcatcagagtatttgggtctggaggcatgtctaaaatctttggatagagaattaattagttctacttgatttgaacaagtagaaactttgaaaaaccatttgaaaaaattgaacatttttccctaatttaaggaatataaaccagctgatatcaggatatataatcagcagcaaaaaaacactatcaaactatgtttaggtttaacaaacaattaaagaattacaataaaatacttgaacacttattaactctcaagtcagtgtttttcctactacagtgaaatgctgtttagcttctatcccttcctccacctagtttactgttaaatctactgttttttttctctttgtactttaatcacagctgtaactgttgttcagataatattgtttgtagatcttccagcattccaggcttcctttactgcatcagattagtttgtcactgtcttccctaaagtcttaggtttgatttgctcagtgtagatatattcttttccttatattagcatatatctttattacagtagttcatattgaatatgtggataacaatgcaaagggctttttcatattacttgctgacttagtgtcctctattatgactttatatagcttgagtatttaaagctcattggaggactttaagtttgtctcttcagattttttcctgtattatttttgcttatggtttcagcttgtccatttttctatcttgatttggtttacaataactactttgtgtttaaactttaccatgtagtatttctacactgaatacattgctttatctcatttaattttataatagccctttaaattattgtttaattaagtagatttgttaaaaggtaagtttagtatagtacctgtcataatcattgcatattaaaatatctgaaagaggatctgaatttaattttttgttgttcttgtgttgaattttctgtgatttttttattttttattttttatttaggcacagcagctcttatcagcatgtttagaaaaggtagatatttctagtacagagggttatgatttgttcatcacacagctcaaagatggtttaaaaaatacatctcatgagactgcagcaaaccacaaagttgctaaggtaagaagttaatagattgcctcttttggggttatattacaatggacacctccattcttttgcactttcctttcctctccttttggaaatgttctaattctagatttttcttttaaaaagcagaatgtgcttataagtcatcttaaagttgaaactggctgggcacggtggctcacacctgtaatcccagctgagggaggctgaggcgggcagatcacctgaggtcaggagtttgagaccagcctggccaacatggcgaaaccccatctctattaaaaatactaaaattagccaggcgtggtggcaggcgcctgtaatcccagctacttggaggctgagacatgagaatcacttgaacccaggaggcggagttagctgagattgcagagattgcgccactgcactacagcctgggggaaagagtgagactctgttgcccaaaaaaaaagaaaaaagttgaaactttgaaacttcttaatcgaagcttaacttcagtttgtgggaactattttgcttattgtgttttctgatgcttccttaaatctttcttagtgcctgatggacctggattggtcaagaggctgatgaaagaagcttccttgttaggttgtgagcttggatgcttggataagaatggactatgtctttggaaattgagccattttgtgctttctctgaaattttttggcatactgggatgtatatgagagacagtgctttcaattaaatccttgggtatatttttattaatttcctccagatttttcttttaaggccttttctaagttatactgcatatcaaacttccctgttattgaaggatataaggtagaaggtaaaagccattttcctataagtaacttgggcatttgcaaagatttttctcaagtgcagttgtaactatactaaaatatactaatattgtgttatgatataccttgctttttttcttttattttttcttttgagacagagttttgctcttgtttcccaggctgcagcgcaatggcacaatctcggctcactgcaacctctgcctcccgggttcaagtgattctcctgcctcagtctcctgagtagctgggattacaggcgtgcgccaccacgcctggcaaattttgtattttttagtagagacagggtttcgccatgttggtcaggcaggtggcgaactcccgacctcaggtgatctgcctgccttggcctcctagagtgctgggattacaggtgtgaaccactgcacctggctcttttttttttttttttttggttcgagacagagtctcactctgtaacctaggctggagtgcagtggtgtgatcttatctcactgcaacctccgcctcgtggattcaagctattctcctgcctcagcctcccgagtagctgggattataggcacacgccaccatgcctggctaatttttgtatttttagtagaaattgggtttcactatgttggccaggcttgtcttgagctcttaacctcgtgattcacccatctcggcctcccaaagtgttgggattacaggtgtgagccaccgtgcctggccaccttgctttttttcactcaagaatttgtcttggatatcttctcatatcctcagagatcatctatgttcttcttagtagttgcattgaatttttttttgtagatttgtcatgattgtattataccttactctattgatggggcattttatttaggaaaacagaaactgtcctatgagtttcaacagagataatttattgtaagaaattaactggtgtttgaaaactgaaaaagtgaaaaggagatcctgagataacagagataactataggaagcagttttcacctaggtctggaggaacaaagagtagagattaggggttatcagaacctagaaacttagagaataggccccgtggatctgggactaggaagtgctacccagttggtaactcaggagcttggacgagggcgttgcaaaactgggactcagatctctgaagagagatgctacttgactgatggtagtacctctgagggaactctatgaaactggatctcggaatgctaaaacaaccaaaccaaaacaaaatgctgaagactggaagaatcaactactgcatcatgtcctttgctgaaacagtgctgatggcaatggccagtaaataagaaggagcaagtctttcttcatctttctttccagtttccttcctgtgctgttgctgggagaacctaaaagccaggaaactggttgaaaagaggaaatacagtatgcagagtcctagccccaacctgatagagcagagaattaaagggtagatttggagctcagagacaacagtttaattaactgcacagtctacccctttggctactcagcatctccattcacactttatatatttgaactttcatataacaaaactattatgctttttaaaaaatttatttttatttttggagatggggtcttgtgctgttgcccaggctggagtgcagtggtgcgatcttggctcactgcaacgtccgtctcctgggttcaagcagttctcctgcctcagcctcctgagtagctgggattacagatgtgcaccaccatgcctggctactttttgcatttttaatagacatggggtttcactatgttggtcaggctggtctcgaactcctgacctcatgatccacccaccttggcctcccaaaatgctggggttacaggtgtgagccaccgcacgtggcctggtcctcagtttatttaattttttaatttaatttttttttcttagacggagtctgtctctgtcacccaggctggagtgcagtggtgtgatctcggctcactgcaagttccacctcctgggttcaggtggttctcctgcctcagcctcccgagtagctgcgattacaggcgcgtgccaccacgcctggctaacttttgtatttttagtagagacggtttcaccatgttggtcaggctggtcttgaactcctgaccgtgtgatctgcccaccttggcctcccaaagtggtgggattccaggcgtgagcctagtcctcagtttataatggtcaagaggatatattggtcaagaggatgtataatagtcaagaagatatctaatttcttttttttgtattacctgttccttattagctctgtcatcattcagcatctcaactggtcaggattctttacgtacatgaacgacccatcttcattcttgaagaatctgaatcctcactggtgctgtgtctttattttattttattttttgagatggagtctcactttgtcacccaggctggagtgcagtgatctcagctcactgcaacctccgccttctgggttcaagtcattctcctgcctcagtctccccagtagctgggactataggcacgggccaccacacctggctaattttttgtattttagtagagacggggtttcactgtgttggccaggctggtcttgaactcctgacctcaggtgatccaaccgtcttggcctcccaaagtgctgggattacaggtttgagccaccaagcccagctggtgctgtattttaagttgtaattgttacttcatctttactattggacttggaagtactaaggggcatcctagagaatctcttgggttctgcataagttctccttgcccctgttacttagcatcaatccaggtttccgcttgtcagttccagtcatacaaactagtagaacttctttgactatttattcagtggcaagaggacctcaaagttgctgggtagcaatctcaacacccacttcaatggaagtgttgttgtacccctgctggaacattcctcccttgggagtaagacctgtagagctgaaagctttaaaaaaaatctgtgaatgagtttattaaatataatagtgggcatgcccagagaaactgtatcatacatttttggttgattcaaagcatatgcttcatcttgtaaggtagaactccataacctttcagcatgtctctttcggttagcgttgaaaatgagtctttagtaggccattgagcttttctgccaggccagcttcatcaggatgatacacagtaagaccagtggaaaaaagatttttttttttttttgctttgaaatacttttcttgatcagaagcaaagttttctacaataccatgacattctgtcagtccacaggcaatggactatataatattacggcagaaaactatggacagaacaggtaaatgcatacctagaatatatatttgttatgttgaagacaaattgctgcctagtccatgactaggaatcccgtataatcaacctactgtcagatagctggctgttccccctgggaaatgacgtgatatttgccacccaactttggtaactgtttggcagattaggcaatcagcaacagctgtagcctggttagtattggtacagggaagtttacatttttgggcctgtgcatagcctccatatctgttgccatggtattttgcacacaagtccattgagcaagcactggagtgcccgtggagagaggcttactgtcatgtatataatgtgtataacttctcccatttcttctgaaatggatgccttttggtctgcattgacatatttcatacgtatttttaccctctgagagttctattcatagacctttgtttttgacctccttgctgctagtcttctagttctgtttcttccaagtgcctgaccatctagctaacaaattagcaactctgttaactagtgaggatctttacttctagccaactctaaatccatacaagaacagtcatacatactgactgaagttctatctattgagaagatttaccttcaccactctccttgtgattggggctatgattctgtagccatccacttcggggtagtaccagcatatcatgcagaaccatctgtaaatcagggccaagagtattttcccctcatattatttcatcataaggagttccccatgaagctattgatgtagaacaaggaggagacattatagtgggagtaggtattgaattctgagccacttgtttattcagtttttgccttttggactttgtgaagacagatcttttataaaacacttgatgaaggatacttgttgctggtgctcaatattatggttggtgtgtcagataacatttggacagctctgaatttgtagacattagtttcgtagatagatattaatctctatctgggactagtaaggaactaggagctgtttttcaaaaggagaatggttatttgcatgagagggtgtggctttgctccaagaccctagcattctgctgtgtgattgtcccaattaggttgccacaggctccttacagcatcattatttgctgtggacttctagtgtcagtgtcattgaaagtgctcttaaggtaaaagtggcagagcatcttgcagtacagtctggtcttgttgcagagtttcttgttttgcaccttactcaaaattggcaaccttatatgtttcttgatacttggattagagcacacattcaagtatgctaaatattggctcccaaatccaagtaggcccactaagtactgtggcttttgtttctgtggttggtgttacaagttggagcaacttgtctttcagtctggagggaatatcctgacatgaccagacctctggacctctgaaacttaaccatggttgcagaatcttgagtttttctggggactcttattctctggtttgcaccttactcaggcatttaatttccttgctgtttccttttcatctggaccaatcagcgtgctgtcatgatgtagtggaccattatgttgatctgcaggatgttaggatgatcaggatttctagaatgtgagatgtggtcttagggaaagattgcaaagatttattattgttcctgccaggtaaaagtggactttttgtatagtccttaaaagtaaagatagaaaaatattggatagaactgtaactacctaccagatatcaggggatttgttgatttgctttaataaagatacctcatttggaaaagcagctgcaatggaagtcgccacctgatagtttaccatccacagtcattcttcaagattcatttacaacagtccagtaaaggggacgaggtcatttgattacctctgtatcttttaagtctctctctttttttttttttttttccaatacagggtcttgctctgtcactcaggctggagtacagtggtgtgattttggcttactgtagccttgccgtcctgggctcaagtgattttcccacctcaaggcttctgagtagctgggatgacaagtgcatgccatcacgcctggctgttattttttagtagagatgagatcttgctatgttgaccaggatggtctcagacgtttaggctcaaacgaacctccatcctcagtctcacaaagtgctaggattataggtatgaaggcactgtgcccaacctcaaatcttttacagtggcattaatctaaaaaatttcttcaggaatgtagcattgctttagtttaatatctttgtagagaaggaaagttctaggggcttatacttcatgttttctatattactggcccacagagaagagcagagagctaatctggggattgttttcagttgcctgttttatattatgcattcaggaactggggaagtaactattacacaataaggatttacagacccatagaactctctgagacagctttgggctgaaactttattaatcgcttgaccatcctacgtgccctctttcttggaccacagtgatgttttaggtcagttcagtgccatgtttttgtaatgcctgaaagatcttttcccccatgcacagtcactgtagtgaatgcccataggtctttctgagggaaggtttggagtatgatttacagtaccaactatagttggggtatcataggatcctttctcaaggggagtcatcctccctttcaataaaaagctctgatctgtgaacagattaattaggtctagaagttttcattctccctcttttttttttttttttttttagcaattcaagtcatgtttttgtctacaagtttttccagtattgtatagataaataataatttactaggctgccttgagtatactagacaagagtagaaaccattcatgggtgaactggggacaggatataaagatgcaattacattatagacttatttctctgggagaatagtacttagcatttttgtggtctaacttcagtaattgttgtaatattaaataatcatggctaacatttatcgaatattgctgatggcgaagctgggcccagaatccagatgtgtgactataaggcctgtgtttttagttgctattgctggattatggtgacaacagcaacaaaaacaatgcatctgctaagctgaactaaatcctcatataccccagtaatggtaattgtctaaatatattcttatggatggaggtatttgagtgcctactctgtgcttaacattgtactggatgaataggaaaaatgacagatgattttagttgtccttaatttttggtgatatatataagaacatgtgttactgtctggttctgaattgtcttttccagaatagttagttgaggtttcatttaaaaaattaaaaaattttcattgataaataattgtatatatttatgaggtataatgtgatgttgtaatatatgtatacattatagaaagattaaattaagctaattaacatatctatcaactcacctacttaccatttctttgtgatgagaatgtttaaaatctattcttttagcaattttgaaatatacaatacgtgggccaggcgcagtggctcatgcctgtaatcccagcactttgggaggcagaggcggacagatcatcaggtcaggagatcagcctgaccaacctgatgaaaccccgtctgtactaaaaatacaaaaaaattagccagggatggtggcgcatgcctgtaatcccagctactcaaggaggctgaggcaggagaatcacttgaacccaggaggcagaggttgcagtgagccgagattgcaccactgcattccagcctggcgacagagtaagactccgtctcaaaaaaaaaaaaaaaaagaaatatacaatacatgattagtaactgcagtcaccagatcactaaaattaattcctcctaagcttcccaaagtgttgggattacaggcgtaagccactgcacctggcctttactgcacattttctttacccagtcacccattgatggatacttagattggttccatatcttggcttttgtaaaatattttatttttttttataactgcaagtttctgttttaaatgataaactaatgaagaaaactgacttgaaactgatgagtgttctttatttgataatggttaagttatgattttggttaaaactgttgagtacattttcctttgcttatactcccattttctttcagtgggccacagttacatttcatcttcctcatcatgtgttgaagtccattgccagtgccattgtaaatgaactcaagaaaataaatcaaaatgttgctgccttacctgtggcgtcctcagtgatggacagattgtcttacctcttacctagtgcacgtccagaactcggagtggggccaggccgttctgtagacaggtatgaaccttgctaacaaaggtgacagtgagatagaattgattagtttttgcattaaacaaggaataactagaaaatctggttatgatttttaaaaatttcacaatttctagcctaattttgaaattaaaaaaaaatcaatatgaattagaatctgaaaaccagatttaaagtaaactgctacttgaattgctatttttaaacactatattttagtacactaaaggtatttgaagggattataaagccacattttggaaattccagtttagtacttgcttagtaaatattttagtcaaattaaaattactataattatttaatgattaataactatttttccattgatgacattttgtgacctttgagataaattttgcctaacttaccatgccctaatgtgagtataaggaaagtgctatcattttataatgaaaaaaaaaaaaagaccagtttaaaaaataataggaataattttgagttaacaattttttatgctgctcgccctggatttaaacagtattacaaaaatcatacctaaaccatcattttctttggtagaggtttttttgaatgcctattttgtttaattaattaaaaaaccagtgacacattcatttaaatacttaaatgatttgctatttgaaatgacgattgaggttcttacaaaaagtaccaaggtttagaaatgctgtactgaaatataatacgcagcaattttgattagatttttgtttgccttttcatgtagtatttatttatttatttttgagacggagtttcactcttgtcgcctaggctggagtgtagtggcacaatcttggctcactgcaacctctgcctcccagattcaagagattctcctgcctcagcctcctgagtagctggaattataaccgtccaccaccatgcatggctgatttttttttttttttgagatagagtttcgctcgttgcccaggctggagtgcaatggcacgatctcggctcaccgcaacctctgcctcccagattcaagcaattctcctgcctcagcctccttggtagctgggattacagacatgtgccaccataccggggctaattttgtatttttagtagagacagtgtttctctgtgttggtcaggctggtgtcgaactccctacctcaggtgatctacctgccttggcctcccaaagtgctgggattacaggcatgagccatggcacccagccaaattttcttttttttatatttttgttttgagatggagtctcgctctgttgcccaggctggagttcagtggcatgatcttggctcactgcgagctccgcctcccatgttcatgccattctcctgcctcagcctcccgagtagctgtgactacaggtgcccgccaccatgcccagctaattttttgtatttttagtacaggtggggtttcaccgtgttagccaggatggtctcgagctcctgaccttatgatccacccaccttggccgcccaaagtgctgggattacaggcgtgagccactgcacccggcatgcctggctcattttttgtatttttagtaaagacagggtttcaccatgttggccaggctggtctcgaactcctgacctcaaggtgatctacccgtcttggcctcctagagtgctgggattacaggtgtgagccactgtgcccagctgtagtatttatatttttacattttcattggatgtgacttgtaatttcctaagcatctttctgaagtacatttataaatagtatgtgcagatgttatcaaaggcactactgaataaattcattttaaacttctattatttttagtatggctcttctagttcagtagcaatatttattaatttatcttttggtaaactgatttctgcgtaatcacttaccctctttttgttagttaagtgattttgttgttacatatataacttttattagtcgtattaacaattgggcagaatttttatattctgtagtagtaatctcttgggcaacatgcagactatcatttttaatcagattatctggtgatatgtgctatggctgtcattaaaatattctttgggatatgcctgagatgggaaaaaagaaaaatacgtaattagaacaagtgcttcttgtctgagatctatgcctattttgagattataaaagagtcagctctgcagagctattttctttgcaaacagttgcagtgtttctaaagaaatcagtgcaagctgtggtaaatgttatattttaggaaatgcagccattagatgggatattcagtatttttagaggtgttaaaaatgtcctaaaatattaattttgatacagactgtggtgtttttttcattaaaaatcaatctaggagcctctgaaggctttgatgaacttaggtctgtggaaggtttgagttagggtctattggatgctactgctgttttattgggtaatataacgaaatgagataggtcttctgttctaagactgatcctaaagacacatataatgtgaaactgagaatgcatttctaaccaaacagctatttgtttaaaaacctgaatacaactacgagtaaacctaaagttactagcaattttatagaaaatcatgtgctaatttaagggaagaatttagaagagtattttcctgttttctttgtcatgacctttaccactttttctttctgttatcagttgtaattttatgttaggatgaataagctttgcttatcaatcctttcttactaaaaatcttttggacttctcaaaaagtttactatcgtcctttaaaaaattactctggtactttctgttatagtttgactcttagtgagctgatatattttaatatgaaaacatatgtaatctacccctggaattgtttatcaactgcagccaccaatcaggttttctccttccctttctgtttaagggaaattcccaaaaattaccgtttttagtttaaagtaaaaaattgaacttgttcatcagaccatttgcagtttttgctgataacccagtaaaattattttttgcattgttaaatagaagtttcactgtgatttgatgcctaacttcaattacataaagtatgtttacttttagatcactgatgtatagtgaagctaacagacgggagacatttacctcatggcctcatgtaggctataggtgggcacaaccagatcccatggctcaagctggattttatcatcaggtaaaaaaagaatataaaaaaatacttttctcagtaggcctttgtagccctcagcaaaattatcacatttttttaactttttcagaaacttattttgtgcaccttgtatgcttgcttgtatgcatggatgcttgtttttttggcccaggctggagtgcagcgccacaatgttggctcaactgcaacctccgcctctcaggttcaagtgattcctgtgcctcagcctccttgagtagctgggaatacaggtgtgcaccatcacacctggctaatttttgtatttttagtagagatggggtttcaccatgttgccaaggctggtctcaaactcctgacctcaggtgatctgcctgcctcggcctcccaaagtgctgggattacaggcatgccaggccaggaaaaaaattgtttaagcaattaacaactgagtattttctttaagattagatacaacttttttaaaaaacaattatttttattttttgtctttgagacagggtctcactctgttgcccacgctggagtacagtggccctatcaccactcacttcagtctcaaccttcccaggcacaggtgatccgcccacctcagcctccctgagtagctgagactacaggtgtgtgccactgggcctggctaacttttgcaccaacctaattttttttttttttggtagacacagggtttctggtgttgcccagactggtctcgaactcctgctcaagtgatctacgcacctcatcctccccaaagtgttgggattataagtgtgagacactgtgctaggccataattttttttataaaatcaacaaatagtattcttcagatttggtttctgacaagtattctcttttgatgcatgtttatttccagtgtttgacatctgcattcataacacagtagtagatgcttagggtaatgcaataaaagcagttttacagtttcgaaattctcattttagttgggatacaaattacccatatactagataactacagaagcagcattacaggtagtgcattgcaacttgaatatctgtgcattaaagaactgattaagttgcataggtagaggaagaattagtcaagaaaaacagtcatagttttgtgtaggaaaagaggagagtataaagtgtaaggattaacacgatacagaggcataagaatgggacattataaaaagctttgctgaattagagggaagttaagaaaaatgattttagctagatgtaatatgttatttaataggaaacttaaactgagtggtatagactggcttaccactgttaccactgctaaaagaatctaagaaatctaatacttatatgtcagtttaaataaagcatggttatttaactttatttatttatttatttgggacagggtcttgctctgtcaacccaagttggagtgcagtggcatgatcacagctcactgtgccacagctcactgcagcctcagcttccaaacaattctcccaccttagcccctcaagtagctgggattacaggcatgtgccaccattcccagctaattctgtttattttttgtagagatgagatttcactgtgttgcccaggctggtttcaaacttctgggctcaggcagtttgcctgccttaaccttctaaagtattgtgattacaggtgtaagccactgcgcctggcctaatttaagaattcaagtacattttgaagtacgttaaagtaactgtcatttagaatctgaagattgattattccttcgttatcttcaagtattctgaacatctttactaaaattaaaccagaaaactatatatatatatatatatgaatattttattcaaagtttgtcagatttcctgttacagataggtaagtttggagactggctaatattagaatcagtgaaataatttctctaaattaaggattgaacatggaccatttttctagcaacttgtctttcttttaatttggtgtaattttctaagagtctctgttaagtgatgccttgattttttttttttctttctgttgagttattgttcattatattctgtctttgcagagaggtcaaataataggtttcctagaatactctgattctaggaaatgttaggggctgattattttaatcttctaaaatgtatagtaaatttgcatctataacgtaaatgttcacaaatattaatattagttttcaggtatatttcagttcaggttttgaaaatatatacatatatatataaattgtgcctggcccttgaattgaaatatatatagcattttgtcctatgttgtatgaattagattccatattatgtgaattagattgactactttgctttccctttttacttgcccttcttgttcagttgtatgtgattgagtatttaataataaacccattggctggtgcagtggctcacacttgtaatcccagcacttagggaggccaaggcaggaggatcgcttaagcccaggaatttgagaccagcctggatgctgtaaggagaccatgtctctacaaaaaaaataacagaattagctgggtgtcatgaaacacttctgtagttccagctggggggctgaggttggaggatcacttgtgcccacgagttcagggctatagtcagctatgattgtgccattgcactccagtctgagactctgtctctttaaaagagaaagttttaaagagactctgtctctttaaaaaaacaacaagaggctgggtgcagggctcacgcctgtaattccagcactctgggaggctgagaggggtggatcacaggatcaggagattgagaccatcctggctaacacggtgaaaccccatctctactaaaaatacaaaaaaaattagctgggcgtggtggcaggcgcctgtagtcccagccactcgggaggctgaggcaggataatcgcttgaacccggggaggtggagcttgcagtgagccgagattgcgccactgcactccagcctgggtgacagagcgagactcagtctcaaaaacagcaacaacgacaacaacagaaacaaatagtgtaaaccagccagactctttctcttatacttaatatttcagatgctttagtatagcaatgagaaaagtactagatcagggattgcatatatgtgtacctctctttgatttagtggtcattttctgaattttcaaataatgcaggcaattaataaatatttggaggtttcagtgtattgttggacctaatattataggctaattttcttattttcagtatagaattttacttaaaattatgaacttttaaaaataacttttattataaagctattttaataatgatttaccttttctgtctcttttctttataattttgcagcctgcctcatctggagatgatagagccatgtgttttacttgtagtgtatgcctcgtttgttgggaacctactgatgaaccttggtgagtcttgatgtttctgggcataataggctaagtcagtcgtgtaaataatgcttctaaattttacttttctgcttatgatataattttttgcctttttgccacctatatttttgtcattgtcctgagaatgagctagccctgtctatactctggcacaccacttggcatacagtgtctgtaagtttgactttctaaaaattgtacacaagggaagtaccaaacaatagaaccacgctctaacgaaaaccggaaagctatggtaaagtgaactccagcgtgagcttcagcagttgaatcttggtctgttgagagcatgttgtcagtagggaatccatggagagagccttatagtatacatttctaattttgaagtaattttagggagtctttgatgtctctgaattttagtgcatgaaattttagaacctggttaaacattagagatcatgtattgaaacttcatttttacaaataactattctgaggtcttattaatagaaataatagtatattattatagcaaatatttatataagatggtatactaggtaccattctgaatactttatgtatttttaaatcatttaattctcatgtttccctgtgaagtaggtactattgtaatctccattttataggagggaactatgaatattttccagtttaacctttacagtcactctatgagataggagttactatcccattttaaaatgaagagaataaaatttgctgaagggcatatggctagtgatagagccagggtttggttttaggatatgttgcttattttgtatgaaaattagtttgaagtctctgaatgttaaatcagctgatgtgcatggggcaaacttgctaaaacgtattgcagtgtacctatggagttcagattggaaaatactgtatgaaaaattcaagttgtatctatctgcaggcagagagttgaatacagtagtcccccttatttgcagggcatgcattccaggacccattggatacctgaaacagcagatagtactgaaccatatacatactatatttttttccctatacatccataacctatgataaagtataattcataaattaagcacagaaagagattaataacaataactaataaaattgaacattttttttcccttcagatggagtcttgctctgttgcccagactggagtgcagtggcgcgatctcggctcactgcaacctctacctcccgggttcaggcgattctcctgcctcagcctcccgagtagctgggagtacaggtgtgcgtgggccaccacacccggctgatttttgtgtttttagtagagacggggtttcgccatgtttgccaggttggtctcgaactcctgagctcaggtgatccacccacctcagccttccgaagtgttgggattacaggcgtgagccactgcgcccggcctaaaattgaacaattttaacaatatactgtaataaaagttctgtgactgtggtcagtctgtctgtgtttctctctctccaaatatcttactgtactgtactcatctattttgggaccatggttgaccatgggtaactgaaaccatagagagtgaagctgtgggccaggcatggtggctcacgcctataatcccagcactttgggaggccgaggcgggtggatcacctgaggtcaagagttcaagactagcctggctaacatggtgaaaccccgtctctgctaaagatacaataaattatctgggcgtggtggtgtgcacctgtaattccagctactcgggagggtgaggcaggagaatcacttgaactggggaggcggaggttgcagtgagccgagattgtaccattgcactcaagcttgggcaacaagagtgaaactccatctcaaaaaaaaagagtgaagctgtggataagagggggacctgttgcatgagcaattttcagtttaagttgagtttctgtttggaattgtctttccccgtaaaggctgtgtgtgtgtgtgtgtgtgtgtgtgtgtgtatatatgtgtgtatatatatatatgtatatatatacacacacacacacatatatgtgtatatatatatacacacacacatatatatgtacacacacacacacacacacacatatatacaccattttagtatatattttttaggtccctatgccaatcctcaaaaagttatttaacctatacctgaaaagttatacagtattatcaaatattattttctttgtaaatattttctatggaaagttgattaaaatttctaacttgggatactgaaaacccatgttttcttgacatggccagggattcagggagtctacctcttctttgcaccagcatttgggattcctcaaacactcaagaagttgatttggtctcttaagacctggggcaagtcttccaaatgggtaggagggaagaggattgatggaggctggggaacctaggcaccttctgaattgtaaaggggaaaggaaaaatttgaaagggcgaatgggactcatattttgactgtgcgagttgatagagagttactttggagggaggttgaagttaaaaacataaaaaatggaccataccctagtaactagcaattccacttctatttacgtaccctagggagttaattgctcttgtaggcacagaggcataaagtggatggtcactgcagttaaaaatcggaatccttttaaatgccaatcaggaggggaatagccaaatagaatgtgctatgttcatataatagactgtggtccaacagttaaggggaatgaacagtaagatctctgttaatcaccctcagtaactttcagatatgttactgtatcaagaaatctttcgtgttaatagaatggtagatgattggatacatgataaaatgtatatgtgtcatgtacagtgacaccaattgtttaacaatttaagaccctgtattttatttttaaaattttttttcatacatacttccacatcatgtattttctatatgtacatttatgtatgtaaacttaaaaaatattttagaaatgtatcacttaaatttataatggtggtttcctggaggtgggattggaaattattgggattagattttaaaattgatgtgggtctttagctttattttatatagccgcgtgtaacttatataaataaaattttattgaaaaagttaaaactcaggaaagagagagagacggaaaggggtaaggtacgctagatttagctgggagggaacctggcccaaatgtcatttgcttggaagtgcactgtaaaaggatttaggaaagacatctacatattaaaaattgcccaggatttatagatggatttatatatgtaagttgtaggtgcattgtaaaaagaaatacatacattttaaggagtagcatgttttatgtgtaaagttctttctttgccatggaaataaaacaatgagtttaaaaacaatggttctttaagaaacatttatttttaaaattttatttatttatttatttatttttttggagacacagtcttactttgttgcccaggctggagtgcagtggcgcgatcttggttcactgcaacccttgcctcccaggttcaagagagtctcgtgcctcagtttcccaagtagctgggactacaggtgtgcgccacaatgcctagctaatatatgtatttttagtagagatggggtttccccatgttggccaggctggtctggaactcctgacctcaagtgatgcacccatctcagcctcccaaagtggtgggattacaggcgtgagccaccacgcccagcctattttattttttagatacggggtcttgctatattgtccaggctgaagtgcaatggctatacacaggtgtgatcatagcttactgcagcctcatattcttgggcttaagcagtcctcctgcctcagcctcctgactaactgggactatatgctttaccatcacgcctggctcatgggttcttgttttggtagcaggatcctgacatttctaatgccttataattatagctaatagaaataaaaataaggaataaccagaaagaaatataaaggaatcataaagttgagcagataggtgctaagttgatcctgcttacaatatttgagataattcttaaagtcattataccagtcttgatatgaggtcctagtattttatttttatattttaatttaaatttttaaattttttattttttagagacagggtcttgctctgttgctcaggctggagtgcagtggcacgatcgtagctcactgcagccttgaacacccaggctcgagggatcttcctacctgagtctcccgagtagctgggaatacaggcacatgctaccacacccagctaattatttttatttttattttttgtagcaatgaggtctcactatgttgcctaggctggtctcaatcttctggcctcaaggatccaaccaccttggccccccgaagtgctgggattacaggtgtgagccacggtgcccagcctgtattttatatttcttaaacttgttatgtttttaatttaacatttcttctcgctcagtaagcatttatttgaaagaagtagtgtataatttatgaactttacattcctaaggctcttaggaaataaattttatttaaaagttatttgtctgatttgatcctatagtgaatacataaggtatatttctgtgttcttaatatatattattttattcatactagagatctttctgctttcagatcttttttttttttttttttttgaggtggagtctcactccgttgcccaggctggagtgcagtggcgcgatctcggctcactgcagcctccgcctcctgggttcaagcaattcttctgcctcagcctcctgagtagctgggattacgggcgcccaccaccatgcccagctaattttcgtatttttagtagagacggggtttcaccgtgttggtcaggctggcgtcgaactcctgacctcatgatccacccgcctcagcctcccaaagtgttgggattacaggcatgagccaccgcacccggctgccttcagatctttactaaaaaactttttagtaaaataatttagtaaaatatttagtaaaataactttttgtgttatgagtggcatttatcgagtttcagctgtatatcatttatagttgtggcccctgatagatatggagaattttaaattgaaacatagtagttaatcattcaaagctgtaggaaaccagtgtgaggaaataacaggagtttaaacaattttgtagtatgtaatatagcattgtattggtttttcagttttttctgagattgactttataatcagttaaagtgagtaacaactgctattgttgaatgtttggaatattgaatgtgtgaatttgtaaacggttgaacatgttagagtgatcttcataaaactgaatgatttggttatattaagtctttaatgatgaatactttaagttcagttaaaaaaagatgatgatcctggagttctgttttaatgtacaaactgaattgctttatttttagtaaacttttcctttctaaatctatgcaaaggtctgaacacgaaagacattccccaaactgcccatttgtgaaaggtgagcacacacagaatgtgccattgtcagtcactcttgcaacaagtcctgcacagtttccttgtacggatggaactgacagaatatcttgctttgggtcggggagctgccctcattttctagctgctgcaactaaacgaggaaagatctgcatatgggatgtttccaaacttatgaaggtatgtttgaattttgaagtaacaaattagtaattgaaaaaagatcagttgtaaacttaggcttttcatttgtttaggtgcacttaaagtttgaaattaatgcctatgatccagcaattgtacaacagcttattctatcaggagacccaagctcaggagttgattcaaggagaccaactttggcgtggctggaggactcctctagttgctcagatataccaaaattggaaggagataggtatgtgagtttgttttagtagtatttaatagatgttacatgttttcctaaattttatattctcatagttctaataattaaagaggaggaaaaaaaagttacgcagttaagagatcagagagtaaatgtttggttagaaatctgaaatctgtgattcttgaagaaaaatcttcattcagaaacaccgtagtttataaaatatgcttaactttctatcacaatctatgtcaattggaaataattgccacattgaacaatagatgatgaaaagtcaacattggaaagtctaaataatgaaatgaaattctattgtagtttcaccttctgctaaatcttttcatagagcattcgaactagatgatttcagtttccgttttttcattagcacctcaaattatggcagtgctaatgaataataataatgggatgacctgaggtgaggcaagaggatctaattgtttaaaacagtgtaccagtagtcagcagtgagttgagataccataattattgctatagaaatattttggtaaaattgctgttctggattctccttcactcaacttctctgagagattcctgatttttgtggtggggtgggagagtcaaagtatcaccctctttcacccacttgtttcctaagaaccactgtggttttgactgaactgggctagtaagattctgtaggtggaggggaagaagattgtgtaggcagccatgtgaaatggagctatttaactgtgatcagatgtcttgatagactgagaatatctgccatttcacttccaggggctccttatgttactgacatgtgatgggtgttactctgtagtcagtgatttatcattttacttcacaacccctttggtgggatgtcctttcattaaggaataatgtaaagttttattaatggaaattatttcattaatggaattagtggaaaatttacaatatatgtgttacttctgtctagttcctcttggtaataacatgttgattaaagccttgtggttgttctattaatataaatctctgtgaaagcttaatgggaaagcagcttaactgttgtctgagtttctgaccatattttgccaataggactagatattaagcatgcttaatttctgtgatttcttagaagttagtggaaaagtaatagaagataatgaaatttatatgtccttctaggcacttactttaatttgaactttgtcttgaagttttgtaatttggggattaaaaatggaatcaaaatatacttctaggattacatacacccatacacatatagtcacaccctcctaggtaaaatctgcattttagataaacatgtattctgtattattagtggaaatacttctcaacattatatggggtaatgtgcttgagttgaggtaatctctacttgcttttaagaaattcacaatctagggtcgaaggtcaattttctctgaagaaagtctcaaacaaatcatacaaaaacattaagttgatgtggtaggaggaagctgaagaggtgaaacttcatccctaaccttaagccccctctcttcacttcccctccccaagaagtaggagcagtcctgttggaattgatagtgaatataatgagccacactacctctcactttatgtgacacaagatccaatatgtttggttataaaatatactatgtgggtttcattagcttgaagaataatacattaattggaaaaatctaagcttatccaagaagtttaaagtaattagcaatatagtttgcttagaatagtttttgtaaaatttgtttttatttcttatttacattgaaggactaaggaattgtttttgacaattttttcttagaagactatatttgtcttctgaattaaggaagaagatatgctaatacatttaattttaatgaattaagatttcttctagatgattcacttgtcatttgtatatcaggtcaagttggtaaaaattccttgaatgtaaatgaaattgtttatgggattgctgtaaaccaaggtactgttacaatattagtatgtctgtttttcagaaacacatataatcttaactaaacatttttactttaaccataatatttattttgcatgtttattgctttgtaaaaggttttgcaaaatgtagaaggctttagtaaatacagtgcctattatataaatagtgcatgcttattgcaggaaaatgggaaaatgcaggagtggaaattgatgaaatatagagtagtcataatcacactatgggattatggtaacatttatatgtattctagtttctttttaaaatgtgtgtgtgtttttttttttttttggagacagagtctcaccctgtcgcccaggttagagtgcagtggcgcaatcttggctcacagcaacctctgcctcccaggttcaaatgatttttctgccttagcctccttgagtagctgggactacaggtgcccacgacccctcctggctaattttttgtatttttagtagagaaagggtttctccatgttggccaggctgttctcgaactccggacctcagatgatccacctgccttggcctcccagagtgctgggattacaggcgtgagccaccacgcccagccgcatgtgattttttaaaaagttttattgaagtgtaattttcaaaccatacaattcatgtaagtgtacaatttagttattttattcatataattttttttctttttttttgagagagtcttgctctgtcgcccatgctggagtgcagtggtgcgatcctggttcactgcaatctctgcctcccaggttcaagtgattcttgtgcctcagtctcctgagtagctgggactgacccgtgccaccatgcctgggtaaattttgtatttttagtagagacgggtttcaccatgttggccaggctggtctcaaactccgggcctcacgtgatgtgcctgcttcagcctccaaaagtgctgggattataggtgtgagccactgcatctggccttagccataaaatgtttttgtcacaaaatattttaaaagaatgtgattttacaaatatatatatataatttttttttttctcttgaaacaaggtcttgctctgtcacccgggctcacggctcactgcaccctttacctcctgggctcaagtcatccttctacctcagccttctaagtagctgggactaaaggcatgtaccaccatgcccagctaattttttatttttttgtggagatggggtctcactgtgttgcccaggctggtctcgaattcctgggctcaagcagtcctccctccttgtcctcccaaagtgctgggattacaggtgtgagtcactgtgcctgttgcctgattatatttttgagaactttcagaataaaacattctttgctaatttaaggcttttatctggcaactgtctttgaaatatcaagacacctgaattcctttaaaacatactactacttaattttattgttcatcttagtacagcaggttaatacttggttatttatttttctttaatgggcagccattctatacttaaaacctgttttcttggtttggacttcttcattcttgataattcccaattattaatatttcttcttgggattcatttttacacttactctgtttctctgaaaccagccaattaggctaatgaattagcagctgattttaaactttttttgcattttttgcttttgtaaattacagcattaaattggtttatgggcaactgttatcacctgaaaaaactaaaacagagaaactttttcaaaaatatataagtgaatttcccccagccgccgcaaaatatttcaaacattgccttggagtgcagtaatatccttaagcattttcagtgcggaataccacttcatattctgtataaaataacatcgtaggccaggtgcggtggcttatgtttgtaatcccagcactttgggagaccgaggcgggaggatcacaaggtcaggagatagagacaagactttgtcttgtcttgatgacccccatcttctgagttgtcatagttttcctatatgtaaaggagttcttagcctctccaaaacaaaatacagaacaaaaataaaattgcatgtacatgtgagtacacaaacatacacacttgcttatacaactattatgtttggttttaggctgtcctgaattcagtaatagaatagttcttaatgctttactactgcaagctggtgcttgattttattagttgctgctgtcttttatatttttgtttgcccaaactgtccttagtcacacagtagtcttcaaattcctacaaatgttattatggattcttggaggtttccataccctatttcagttaggcatttatttaatgatttaagaagatttttgtcagtgttgttaatcagttatgatatcaaactactctttatatatcatttaagcctattttaattatatggttgagatgtgtagtagtgattttaacactgtactttcaggccaggcatagtggctcatgcgtataatcccaggactttgagaggtagaggtgggaagattgcttaagcccaagggttcaagaccagcctgggcaacatggtgagaccccgtctctgcaaaaattaaaagaaaaaagtagctgggcatggtggcgtgtgcctgtggtcccacctacacgggaggctgaggcaggaggattggttgaggccaggaggaggtcagggctgcagtgagctgtgttcctgccactgtactccagcctggatgacagactgagaccctgtctcaaaaaaacccacaaaaccaactgttcttttttctttgctttctcatatgatgtatactttttttgaaattcaaattgtttactttgttttttgatttaagtgatgatttactggaggattcagacagtgaagagcattccagatcagattctgtgacaggtatgtaaaaagtattagataatgtatttaaaaaattctttacacagttgtgcatacagctaactaccacttaattctgaatttcttagttaatgctaactctaaatttttgctagtatacacagaagactgaaatattgtgtgtcagagatctcaaattagtagtatgtacatagtgttccatatttaaaatttaaatggtacctatttgagccaaaggaattacagtggatagttacgttaaagttttgtcacatatgtcaggtaattaaatgtttttatttgtataatgtattctgttaactaaaagtagtgtttaaagctctttattcatgtaggtgaataaagaactacattttaatgtgtgaaattatagacattaaaacatcaagtaaatgctgccttactagcttttaagatactagggcaaaataatatacttcgtattttaatgttattttgtaggaaaagctaatagtatgtttcaaaatagttttactatgtcagaatttaaatcctaactcttctacttaatatagtctgattgcatttcctgatatatagcatggtggtattaaagtctgttatttagagttttaagaattaggccaggcttggtggcttacgtcggtaatcctagcactttgggaggccacagcgggtggatcacctgagatcaggagttcgagaccagcctggccaacatggtgaaaccccgtttctactaaaaataaaaaacaattagccaggcgtggtggcgcatgcctatcccagttactcaggaggctgaggcaggagaatcgtttgaacccgggaggcggagattgcagcgagctgagattgcgccattgcactccagcctgggcaacaagagagaaactctgtctcaaaaaaaaaaaaaaaaaaaaaagaattagataagataagttcatataaagtgtagtgcctgggaagtacccagtatttttaaaaagtgaccattattaaattgtggctattgtttaatgttagatgctgtgtactatggacatatataacttaaatctttttagaagaggaatggttttgtatagtacagttcaaaaaaattatagttaacatttggtagtaaatattctttaaattttatcatcagatttttttgaaaggcactaaatggaacactggacaattttgggttaatctttagcagtcttttgaagcagttcttagcaatgaacaaaaaaaatcaccaaataaggcaggaaaatgcccttaaaaatgtgcaaatgtgtaattcgttctagagaagttaaaaattgtttttttttcttttaaaaaaacatagactgaggaagctaatgctcttttcctattttgttcttttgcaaaaacataagaggttactactacattttctttctttgtttctttctttcttttttttttgagacagagtcttgctctgttgcccaggctggagtgcagtggtgtgatctcagctcactgcaacatccgcctcccgagttcaagggattctcttgcctcagcctcgtgagtagctgggattataggtgcctgccaccacacctgactaatttttgtatctttagtagagatggggtttcaccatgttggccaggctcatcttgaactcctgacctcaggtgatctgcccaccttggcctcctaaagtgctaggattacaggcgtgagccaccgtgcccggccagacctggctctttcttttgtttttttgagacggagtgtccctctgtggccaggctggtctcgagctgctgacctcaggtgatccacttgcctcagcctcccaaagtgctgggattacagaggtgagccactgcgcccggccaagtttttgaactctttcaaaaaataactccttggtcttgttaaattacttaaactgtgggcttcagtttttcctttgtaaagtgtttgctgtgttaagttttttttgattgtcactggaacctttcctttgtgtgctatagttttgttattttccctgggtctaaggatctcagtacatgtttttacagttacaatactcgtatttggccaattttcttaccctttttctacctttattcttttcatctatgcctgtttgatttttcacacattttaaagatactgtaatcatgtttactttagctaatagtgtcttgaaaattatcatgtatttttgtcgactacatatagcacttcatttaggggtgtaaaaattgtctttatgtattaaacagtagctgtggtaagagaaaatatctttccagttcaaaatttttaattgcctcatttgaggatttgtaagtagcttattcattcacagtaaaagtatgtatcttctaaactaattttgttatattggaagaccattggtgactttatggaggcttatagagtagtcatgtatatatatttgatattaatgattggtgtcttctcttcctgaagtatctaaaaagtgataaggtaccatttcagacttatcagagcatatccaatttggtggaaatcacagttctaagtgattttcatcaaattggatgatacaatctgaagaattatgaaatatatttattttctgtttttttttgtttttgtttttgttttgagatggagtctcattctgttgcccaggctggagtgcagtggcacggatcttggctcactgcaacctctgcctcctgggttcaagcaattctactgcctcagcctcccgagtagctgggattacaggcgcccaccaccacacctaatttttgtattttttgtagagatagggcttcaccatgttggccaggctggtcttgaactcctgacctcaagtgatccacctccgtcagcctcccaaagtgttgggattacaggtgtgagccactgtgcccggcctattgaaatatatttcttaatttcaaaaatgtgagtgcagataaagagacatttgttttttagttggaggttatgaggtttgaagatatctaagaggactgcatagggaaaagtttggtatttgaaccacagatcagaattaagtatacatggcttcttgtgaagattgagaagaatgtttggtaggaagttaaagaagggctcaaattgaaatttgagttttaaaagagtgcctagataaaacctaattgcttacctgaggaagtttggttaacactacccaaataagcagaatagagaagggtttttaaaatgattgtctgaagaatattatgctggtgcttgtttgtaggtatttgtgtaaaaatttattttttggcctagtaggttttagaaattctgaaataggtagagttgacaagttctgcagggcgtttgtcagtcatcagtgtgctttgtcacccttctgagtagaatgtatagtttatgctgcttcccacatgttgaataaatatttgagaagcagcaaagtaataatgccacttgtaatattttcctttttaataaagtctcacctcacataccatttactttgaatattgactgaaatttgtgttaatatatgtaatttatggtttattttgtcatagtatatacatagaccaaaattgttttttcttggcagtttcctacatagattagaaagaaaacatttaagtaaatttgtcagtttagtccagttgggcatcctcaggatttattgtggtatagtacatgttataaaaatatctcagttgatcgcgccactgcactccagcctgggcaacagagtgagactccgtctaaaacaaaacaaaacaaaaaacaaaaccacctcagtcagccttcaatttccaatctgaattgtagagaaaatatacatgaatattgaatgacagaaaaaaggctgcatgtgactatagccaaatgagtatttaaataagtgaacagcttcattaatacaattaaatcatgtttatactgaaaatttttttctgctgtagctagaaaatatttccgttttagggggtagtagtcatgttatgtgaaatgacatcatccccagattatgggaaattctagatatgccagtgagcatgtagaagagatcatgaataaaatagtgtaaaatggtgtaaacagagctttgagttaccctaagtggttcttcatgaatctcagttgcttattgctctacttgggcaacttcttttttttttttttgaaatggagtctcgctctgtcgcccaggctggagtgcagtggcgcgatctcggctcactgcaagctccgcctcccgggttcacgccattctgctgcctcagcctcctgagtagctgggactgccggtgcccgccagcacgcccggctaaatttttgtatttttagtagagacggggtttcgctgtgttagccaggatggtcttgatctcctgaccttgtgatccaccctcctcggcctcccaaagtgctgggattacaggcgtgagccaccgcgcccagcctatttgggcaactttcaaaccttcatggagtcaccttgagttcattttttttcttttaagacggagttttgcttttttgcacaggctggagtgcaatggcgtgatcttggctcactgcaacctctgcctcccgggttcaaacgattctcctgcttcaccctccccagtagctggtattacaggcacatgccaccacgcttggctaattttgtatttttagtagagacgggagtttcaccatgttgaccagtctggtctcgaactcctgacctcaggtgatccacccgcctcaccctgccaaagtgctgggattacaggtgtgagcctccacgcccagccttgagcacttttatatttatttccttttctctgtttttccaatctaaatcattaaggcaattatatatatatatatattttatttttttatttttttttttttaattttctattttttgtattttcgaaaatcgcctagagtggttttttcttttgagacgggatctcactctgttgtccaggctggagtgcagtggcgtgatctcagctcagtgcaacctctgcctcctgggttcaagcagtttctcttgccacagcctcctgagcagtgggactacaggcatgtaccaccatgcctggctactttttgtgtttttggtagagacggggtttcaccatgttggagaggctgttctcaaactccagggctcaagtgatctggcctgccttggcctcccaaagtactgggattacaggtgtgggccaccgcgtctggcctaacctgtagtggtctttatggtattattgctaatgatgttgctgcctgactgaaagaagtttctgccattgagatagagacagatcagtggaaagaattttcagtttagcgtcaagagattatacttgatttgggagttgactgacatctattgtaagactttctttcctttttttgttttctggaaacggggttttactgtgttgctgaggctggtcttgaacggaactcctaatctaaaaggatccttccacctcagcctcccaaatagctgggattacaggcatgcaccacaacgcctggctttgtgattaatatcacaggtttaaaggttgagactgagaaactcagtcctgtgtttcagtatagaaactgagttctgagactgtactacttttaagggaatagtttaaagaaggcacaatagaaaaaaggtcagcagggcatggtggctcatgtctataatccgagcactttgggaggccgaggtgggcagatcacgaggtcaggagttcgacactagccggaccaacatggtgaaaacccatctctactaaaaatacaaaaattagccaggcgtggtggcaggtgcctgtaatcccagctactcaggaggctgaggcaggagaatcccttgaacctgggtggcagaggttgcaatgagctgagattatgccattgcactcccgcctgggtggcaatagtgagactttgtctcaaaaaaaacaaaaaaaaagaaaagaataaaggtgaataagatgatataatgtaatgtagttgtgtggctttaaatgaaataaagattagcagataatacagaagacactgaatgtttcacataaagatgatacagttttggaactttttcttcctagttatttttttttttctaaactgaggttagaattgtattttctgacattccactgataatcagcagaggatggggtgagagagaagaaatggtgcttataactccttcagagtggtgaaagaaaggaaactgagattacaatcttttttaatggatattttgcatagcgcataaatgacagatgcataagtagtattctctctttggtttagaattgaagtgcagaaattctgttactttgatattaatttaaagttatgtataaataatattttttaactctttaatcacattacttttttgaaaaaaggttttgctcacaaattgccaagagaatatattttgaattgaaaagacttttttttttttttggagacagtctcactcttgttgcccagactagagagtacagttgcgtgatctcagctcactgcaacttctgtctcccaggttcaggttattctagtgcctcagcctccctgagtagctgggactacaggcatgtgccaccatgcccggctaatttttttttttttttttttttgagacatagtctcactcttgttgcccaggctgtggtgcaatggtgcggtcttggctcaccacaacctccgccttctggcttcaagcgattttccagccccagcctcctgagtagctgggattacaggcatgcaccaccacacccagctaattttgcatttttagtagaaatggggtttctccatgttggtcaggctggtctcaaactcccggcctcaggtgatctgcccgcctcagcctcccaaagtgctgggattacaggcatgagccatcgcgcccagcctctaattttttgtatttttagtagaggcggggttttgccatgttactcaggctggtctcgaactcctgagctcaggtaatctgcctacctcaacctcccaaagtgctaggatgacagatgtgagccacctgcctggcctaagttgaaaataattttgagtcccttgaatacctttacggtttttctgagtaagctcatcttagatttgattatgtcttaagaaaaaaaaaaaaaagaaaaaaaacagcctggtatttatgggggattggttccaggaccctctctagataccaaaacccggatgtgctcaagtcccttgtataaaatggtatagttttgcttataacctatgcacatctacattttcctgttactttaaatgaactctagattacttataatatctactacaatgtaaatactgagtaaaaagttgttatgctctattgttaattggcaaaaaagtttgtacatgttgtacatgtttagtagagatgcagccatccatttttaaaaaaagaaagttttccggctgggcacggtggctcatgcctgtaatcccagcactttgagaggccgaggcgggtggattacctgaggtcgggagtttgagaccagcctgaccaacatggagaaaccatgtctctactgaaaatacaaaattagctgggtatggtggcacagctattcttgcggctgaggcaggagaattgcttgaacctgggaggcggaggttttggtgagctgagatcacaccattgcactccagcctaggcaacaagagcaaaactccatctccagaaaataaataagtaaataaaaaatgttttccatctgcagttagttgaatccgtggatgtagaacctgtgaatatggagggctgactgcactttaaatttttttaggccaggcgtggtggctcacgcctgtaatcccagcactttgggaggctgaggtgggtggatcacctgaggtcaggagtttgagaccatcctggacaacatggtgaaacccaggctctactaaaaatagaaaaattagctgggtgtggtggcgtgagcttgtaatcccagctacttgggaggctgaggcactagaatcacttgaacctgggattcagaggttgtggtgagccgaaattgcaccactgcactctagcctgtgtgacagagcaagaatttgtctcaaaaataaataaataaataaataaataattttacttgtgtattcataatgtgctgactggatgagtagaaacatatctaatgaatattgttcctttttaaagggcatacatcacagaaggaagccatggaagtaagccttgatataacagcactcagcattctccaacagccagaaaaacttcagtgggagattgttgcaaatgtgcttgaagatactgttaaggatcttgaagaacttggggcaaatccttgtttaacaaactctaagagtgaaaagacaaaggaaaagcaccaggagcaacacaacattccttttccatgtttattagctggaggtttattaacatataaatctcctgctacctcacccattagtagtaattctcacaggtcactggatggtttaagcagaactcagggtgaaagtatatcagaacaagggtcaactgacaatgaatcctgcactaattcagaactaaattctcctctggtaaggaggactttaccggttttgcttctttatagcatcaaggaatctgatgagaaagcaggaaagatcttttcacagatgaacaatattatgagtaaaagtttgcatgatgatggttttactgttccacagattattgaaatggagctggatagtcaggagcagttgttattgcaggatcctcctgtgacttacattcagcaatttgcagatgcagcagccaaccttacctctccggattctgagaagtggaactctgtgtttcccaagcctgggactttggttcagtgcttgaggctgccaaagtttgcagaggaggagaatctttgtatagactcaataactccttgtgctgacggaattcatttgttggtaggactgcggacatgccctgttgaatccttgagtgcaataaatcaagtagaggccttgaataatttaaataaattaaactctgcactatgtaatagacggaaaggtgagctggaatcaaatcttgctgtagtgaatggtgcaaatattagtgtaatccaacatgaatcaccagcagatgtacagactcctttaataattcagcctgagcagaggaatgttagtggtggatatttagtgctttataaaatgaattatgccactcggatagtgactttagaagaggagccaataaaaatacaacatatcaaagatccccaggacacaattacctcgctcattttgcttccacccgatatattggataatcgagaggatgactgtgaggaacctattgaggacatgcagttaacctcaaagaatggttttgagagagaaaaaacgtctgacatttctactcttggacacctggtaataaccactcagggaggatatgtaaaaatactagatctttcaaactttgaaattttggccaaagtggagcctcccaaaaaggagggcactgaggaacaggacacatttgtttctgtgatttactgttctggcacagacaggctgtgtgcatgcaccaaaggtaagttgtctgattatgctataaatcttataaaatccatgtatatatggcatttgtttatgtgcaaacctagtatgaattttaggttcaaatagatggggaggaattaatttttttgtaatgaagtggtaaatccttctttttaaactgttcttaaaacttttttctactgccctaggtaaggattctaactgtaaataagttagtaagtcacttagcaagtatcttctgctttaacctcaagaaaatcacgtgcttttatttcagtgagtccctgactctgcatctgctcaaatttatgaccttgggcaagttatgttaaattcattaaacctgtttttatttatttataaactaggataagaaagtccatttcctaggcttattagaatgaaattatgtaaagtttctggcacagttattggtccttatttccttctgaaataaaaatacttagcaaacaatttttagttttgctaaatacatttttttgtctgatttattcctgatctttggctagtagtgaattagttttgcaaattttgaagcactatatagattaagatagtgtgcagttattttttctttttttctcctttcttttccttttcctttcccctttccccctttctttcccccctcccctttctttccccgtcctctcccctcctttcttttccttttatttttgagaggaagtttcattcttgttgcccaagctgaagtgcagtggcccaatctcagctcactgcaacatccgctcccaggttcaagcaattctcctgcctcagcctcccaagtagctgggattacaggcacgtggcaccatgcccggctaattttttgtatgtttagtagagacagggtttcaccatgttacccaggctggtcttgaactcctgacctcaggtgatccacccacctcagcctcccaaagttctgggattacaggcatgagccaccatgccaggccttttcttttctttctcagggtctcactgtgttgcccaggctggagtgcagtggcatgatctcagctcactgcagcctcaacctcctgggtgcaagtagtcctctcgccttggtctcctgaatagctgggactacagtgcatagctgggactacgcactaccatgttcagctaattgttgtatttttttgtagaaatgggatttcgccatgttgctcaggctggtctcaaactcctgagttcaagtgatctgcctgccccggcctcccaaagtgctgggattacaggcgtgtggcattgtgcctggcctattttttttacttatatacattttaagttagggagataaagcagtttttgaaaaggattactgacaatatcaggcaaaatgaatagttctattgattgtctagcaggaatttaggactaggagatagttgaagcctaagtgactgtaactaaggcatggcagaggaattaggatctgagcagagttacgcatgcatctcatctgtggttctgatagtaattagactgtttttcctctctttaaatagatttcaagagtttagccaaggaacgtaatggtgaaatgtagtggttagattgccttttttgaactatatgtagtgaaattatttttttatttttattttttgtttttgagacagagtctcaccctgtcaacaggctggggtgcagttacgcaatcttggctcactgcaacttctgcctcccaggttcaagtgattctccggccttagcctcctgagtagctgggaccacaggtgcgcgtcaccacacttggctaatttttgtatttttagtagtgacgaggtttcactatgttggctagtctggtctcgaactgctgacctcgagcgatccgtctgccttggcctcccaaagtgttgggattataggcatgatccactgtacccagtgaaatttctgtaatttctagtgaaagtataatggaaaaaaatctttaaatatcataaaaatccaactagattaatttagaaaatgagcagtgtagtctagtaactttagactaatgaaacttggaattacagttgagaatttcagaacaaccattaaaattctgtgtggtatcagagataatttgaatttattggtcatatatgtgccagttcattgttgtaagaactttacctgtgttcgtttagtcatcacaccaactttaatatactattattgtctccgttttgtagataatgatactgaaggaaagaaaggttaagtaacttattaagtaatagagctaataaatgtcagagccagcattcaaacctgggagtctttcatcagagcactttaaatggcattatactgccataatacaacaaaagatgaagaatcttacactgaattctttgcattcttttaatctgaaagatttaaaaattgacaattatttaacttgctgtaggtcatctaaaatggagctggacttggaacctaggtgacatggcaccccggtgcacatctttataagaaactactattttccagaaatgcaataagggtttttaatgctttcaattatttgatgagctatgctttaggtaactcagaagagaaatagtatttacaccttaaatatttaagttattaagttttttagcatttaaataaaagtattggccaggtgtggtggtgcatacctgtaatcccagctacttgggaggctgagacaggagaatcacttgaacccaggaggagaaggttgcagtgagctgagatcgcgtcacttcactccagcctaggcgaccgagcaagattccatctcaaacaaaacaaacaaacaaaaaagtatttaaaatagatggtggttttcttggagttggtacagtccggaattcctagaacatgatctcatgtgatagggaatttatccagatgatgaaagataagaaaaacctgagaagttagttgctttcaaaatgagctcctaattcttcagggattgactgatgaaggtgcatttgaaaagataataacaaagcggaaagaaaagttgatgccttaaaatgtatgtacatgtatgatttttaaaaagcatctcagactgaatcaaatggatgtgaccctgtcttctgagtatattcaaataacataaaactatttttcttgtggagaatcaagtcttttcataaaaataaatctatagttaatatatgttttaagttaattttatataggattaataatatactaaatgtagatttgttaagctatctttgataattcaggaatagaatatatacacactacatataaaattttgtaaaaggcataaaataaaaaagtatgaatttcaaaaattgagagtttaaagtgaaagataaattggtattctgcttggtgcaaatacatttaaaatcaacaggaaagacttaaatgagaaagaagactaagatgtatcagtggagtataagatagggtgcagttatgatacttgacaaaaaatgcttaaaaaataaagttttttaaaaggccgcaattaatagggaacatatcatgaaatataacaatactgaatataaatatgaccccaacaacataaagcctatatacctgtactgatattcagaaggaggataataagttgagccataattgctttgaaagtctttaataatctcactatctgggattattggactgtatggtcacatccttgttttggtacttgtttcttgtggaaaacattcctttagtcttctgttcctgctttgctaagagtttccaataggaatgaacgtcatattttgtcaaatacttgtttacatccatggagatcatttggttgttctttttagttcagtatggtaaaatatattgattgacttttggatatcaaatcaactttgcgttcctgggataaaacccatttggtcataatgcattaccttatatattgttggatacagtttgctaaaattttgttcatagtttttgcatatcgttcatcagggatattatatgttccttgtaatctttcttttttagtttttgctttttgtaatctttatctggttttgatatcagtgtaatgcttgcctgatagaatgagttgggaagtattcgctcttcaattttgtggtaaagtttgtgtataattggtcttatttttccttatatatttggtagaattcgccagtgaagctctttgggcccagagattttttttagtgggaagattttgaatatacacattcaattatgtttatagagacttcctaaggttttttattttttattttttagtgagttctgacagtctttttgtcagtttttaagttatgaagttttagcgtaaagaatttcataatattccccacaatcattttatttactttttattttttttgagacagagtcttgctttgtcacccaggctggagtgcagtggtgcagttttggctcactgcaacctctgcctcctgggttcaagtgattctgtcacctcagcctcccgagtagctgggactacaggtacaccaccatgcctggttaatttttgtatttttagtagagatgaggttttactctgttggctaggctggtcttgaactcctgacctcaagtgattcacctgcattggcctcctaaagtgctgggattacaggtgtgagctaccatgcctggctccttacattccttttaatatttgtagactctttagggatgtcaccactctcatttgtgatactgatcgatgatttgtattttttttttcctgcttcatctgtctagaggtttatctgttttattgattttttttttttttcagaacaaccagcttctgatttaaatgacatttttttctttgttatttttctgttttcccatttactggatttccattttattgttattatttcctcccctctgcttgatttgggtttattttgctcttctctagtttctttctttctttctttctttctttttttttttttttgacacagagtttcactgtcgccaggctggactgcagtggctcgatcttggctaactgcaacctctgcctcccaggttcaagtgattctcctgcctcagcctcccgagtagctgggactacaggcccgagccaccacgcccagctaatttttgtatttttagaagagacagggtctcaccacgttggccaggatgatactgatctcttgacctcgtgatctgcccgccttgacctcccaaagtgctgggattacaggcatgagccaccgcgctggccttctttagtttcttaaagtagaagcttattggtttgagatgttttctaatataggaaatttaaagccataaatatttttggaagcactgtcttagtgatacctcctaaattttgatacattgtgtttttcctttttttcatttggatcaaaatatgttctaatttcccttgtgatttcttgtttggcccagagattatttaaaagtgttttgtttagcctccaaatacttgaggtttctctagatttctttctgttctggatctcaaacttatttccattgctgtcagagaatataatttatatgaagtcagtattttgaaatttattgagactttttcatgacccagcatctggtctgtcctggagaatgttctatgtgcacttgaaaagaatttgtgttgggcacccatggggtagagtgtcgtataaatttcacttgtatacgtgtatgttttttagttgttgaagtcttcctgattttatattgagccttcttctatcaattttgagagcaagtattgaaatccctaactatgtttttgttgaattgttcacttttaagtctgtttttgcttcacttgacttttggctcttttgttagactgtttcataattgttacatcgttctgatgtattggttcttttgtcattatgaaatattcctctgtctctattttgtgtcatactaataaaatcactctggttttcttatggttacagtttgtattatgtatcttttccacaattttactttcaactaacttgtgattttgaatctgaagtgggtctcttagatgcatataattaggtcttgcttttttatacagttggataacctgtaccttttaaatttgaatgactttacgcttaaggtaattattgctatggttgcatttatgtctgccattttgagtttttaaaatgttctttacattcctttgttactccttcactgcattcttttgtgttgaataaatatttttagtgtgccattttaatccctctgttgattttttttttagaagaaaatttacataacattagtgaagaataatttgttagggacacccagagacctactgtcaaaccaagaactaaagcagtatggatatcttgcatctatgaatgtgtccctcctcccctctcccaaactctgcccttttcctacagataattgttactcaataatttttatgtctttccttttataaagaaaactggttttatgctttggatgtgaatatttcaacatattttattgattttgcttgtttttgccctttataagaatgataccaaactctaactagttttgggggacttgattttcctctcttactatgttttaagattacccattttgttgcatgccttgtagatcatttaattttcacttatacttagtactccaatgtgcaaaaaacccacaaataatttatgcattttcctgtcagtggacatcttgtttatttctgtttttttctgctataaacgtcttgtgtaagttccttggtgcacatatgtaaggggctctctatttttttatttttgaggcagagtcttgctctgttgccaaggctggagtgcagtggtgccgatctcagctcactgcagcctccacctcctgggttcaagtgattctcctgcctcagcctcccaaggttagctgggattacaggcgtctggctaatttttgtatttttacaaaacagttggggtttccccatattggccaggctggtctctaactcctgaccttaagtgctccgcccgccttggcctcccaaagtgatgggattacaggcgtgacccactgttcccggcctgagactctcagttcttaagagtagaattattgggtcatgggttataattttttttttctttttaaaatgtgttaaatatatataatgaggtttactattttaactgttttacagcatgtaatgtagtggctgtaatacattcacaatgttgtataaccaccagtactgatttccagaactttcccatcatcctaaacaaaaactctgtaaccattaagcagtaacttcccattcattctaccctccgctgctggtaacctcaattctacttctgtatgactttgcttattgtagatacctcatataagtggaatcatgtatttgtccttttgtgtctggtttctttcactcagcatattttttatgtttttaatgctcacccatgtatcacatcttggttcctttttatgccaaataatattccattacagtagggcccatccacccccccaatccctgccccttatctgtggtttcagttatctgtggtcagctttggtctggaaatattaaatggaaaatttcagaaatcaacaattgataattattaaattactcaccattctgagtagtgtgataaaaatctcttcttgtcccatccaggacacaaatcatcattttgtccagcatctccatgctgtatacactacctgtctgttagtcacttagtagctgtcttggttatcagattgtctgtcactggtatcgcagtgcttgtgttcaagtaaccattttacttaataatggccctaaagttcaagaatggtaatgctagctatgggatatgccaaagtgaagccgttttgaagttttttctttatgttgaaaaggcgaaatttttgacttggaaagaaaaatattttatgtgcagatttctaagatttatggtaagaacaaatcttctgtttgtgaaattgtgaacagtatattgctatcattgtgctattttgttgttgttcatctcttcctgtgcctaatttataaattaaatttatcatatgtgtgtgtgtatatatatgaatatatatatatgaaaaaacaatatatatacatattgggtttgatactatccacagtttcagtcatcactgcgaggtcttggaactgtgactactgtaaggggtgactattgtaactcagcatttgggttgtttccacattttggctattgtgaataatgtccctataaacattggtgtacaaatatttgagtacccgttttcagttgttttgggtatatacctaggagtggaattgttgggtcacatggtaattctatgttcaaccctttttttttttttgagatggagtttcacgcttgttgcccaggctggagtgcactgacgcgatctcggctcactgcaacctttgcctccccggctctagtgagtctcctgcctcagcctcccaagtagctgggattaggcacgcaccaccacgcccagctattttttgtatttttagtagagacactatttcaccatgttgaccatgctggtctccaactcctgacctcaggtgatcctcccacctcgcccacccaacgtgctgggattacaggtgtgagccaccgcgtctggcctatgtttaaccttttgagaatcaccaagttattttccacagagtctgcaccattttgcatttccacaagcagtttggaagggtcccagtttttctacatcctggccaacatttgttatttttggtctttttgacaactagtggttgtgaagtggtatctgttgtggttttggtttgcactttcctaatgattagtgatgttgagcatttcttcatgtgtttattggtgatttgtatttctataatagacgtagaaatatctattcatgtccttgtccacttttgaatttttttttttttgattgagttgtaggaacatttttagaaattcaggattcatatcttaatagatatgatttgcaaatacttactttctcatattctgtgggttgtctttttactttcttggtagtgtcctttgatgcacaaaacattggcattttgaaaaagtccagtttatctttttgttgataatcttacattcatacatcattttcctgtttttctttagtttttgtccattgttccctttagctaattggctatataaagagaattcatttaacgtttttgactaataattccaatatctgggctttctcaggtatgctttctggtaattctttttttttttttttctcctgtaaatgggccatactttgctgtttctttgagtgctttgtaattttttgttgtagtcagaactttctgagtattgtaatgtggtacctctagaaatcttattctctcactctgggagattttgcttgtttccagctgcagccatccatttgtgacattttcaaactatttgtacaaaggctagagaaccctctccccactcttatccttccaaaaaagagttctatctctttaaatcttcctgtagatcctgtttcggctttgtccccttaaatcttctggtggctgctgcttggagtagcagctgcagtctcagaagggtgaaacccaggcaagagtctattctggtcccttagggaactgctagaccaaccaaaatgcacaaccctatatattgggaagagaaggtccctcctgtccgccctggcaccagccagctgcttccagcacatgtgccactttcccccacagctgtgtcagggctgagtatggaggggtagctggttcatttaggccaccctcttaccagaaatcagtctcctctgtttattgtagatatcctgttaggtcccatagttctgaaatagttgattccaatcatactttctagttgagtggttgctttggtggagggactgatccctagagcttcctactctgccatttggcatgaaatcactggtccccgtgttgattctggtttctttttctgatactacttttttttgagttatattttggtggtttaattaataatacaatctacttcagaataatactttattctagtaaaatatgtaggaactttgctcttgtctctccccaccccatacattacatttaagtatgttataaacccaacagaatggccgggtgtggtggcttacgcctgtaatcccagcactttgggaggtcaaggcgggcagatcacctaaggtcaggagttcaagaccagcctggccaacatggcaaaaccctgtctctactaaaaatacaaaaattagccgggtgtggtggtgggcacctgtaatcccaactactcaggaggctgaggcagggagaatcacttgaacccaggaggcggaggttgcagtgagctgagatcacaccattgtactccagcctgggcaacagagcgagactccgtctcaaaacaaaaaacaaacaaaacccaacaaaacatgttacaattattttatacaaccattatctttttaaaaagttggcaaagaaatgagaaaaacatttatttattatattcacctacttaccatttctgttctttattttttcagtgaatttgatgttgctttccttcctcttaaaggggctttctttggggctttctttgttacttatcataaggcaggttgctagcataaagttctctcagtctttgtttttctggaaatgtgttcatctcacattcatttttgaggattaatgctacatagagaatctgttgacagtttctttctgtactttaaatgtcattccattgcctctggtctccattgtttctcatagtgatctgttaatttgtgctgttgttttcatgtctgatgaataatttttatcttgctgtcttcatgatgttccctttgcctttgactctcaagagcttatatatatatgtgttatttctttgtgtttatcctatttgagggtcattgaacttgagtgaatttgtggttttctatcggatttggtaagtttttgcccattattttttcaggtggaattctcttcttcatggaattcccattacatgtatgttcttaatattttatctgtcctgtaggtctccaagcttcttttaatttttattttattttattttttttttgagacaaagtcttgctcttgtcgcccaggctggagtgcagtggcgctatctcagctcactgcaacctctgcctcccgggttcaagcgattctccttcctcagcctcctgagtagctcaggggattacaggcgcctgccaccacgcctgtctaatttttgtatttttagtagagatggggtttcaccatgttggccaggctggtatcgaactcctgacctcaggtgatccgcccgcctccgtctcccaaggtgctgggattacaggcgtgagccactgctcctggcctttaatttttttaaaaatatttttgtttgttgagtcgtttataccattatttcctgtaatctctatacccctggtttcctcttattctataaaaatatttacaatagatccttgaattctttgctaaatctgaagtccgagaagacattttcaggtgtgtgtgtgtgtgtgtgttttacatcttgaatgtgggtccctctttctttgcatgtcttgtaatgttttatttatttactggacatttaaaacaacactatagcaatctggattcgtatctccctaccttttgccaggtggttgttgctttgtttgttttgtgaaaacaaacaaactgttgaatctgtgaaatctgaatctgtaaaatctcttctgtattgtgcagctgctgatttctgtcatttattctgcctagttttaatttttaagacttgtttcttattttgtttcttttggggcagcagagcttagtattcagccaaagattgataggtttggtgtccaaatacctttagccagtaaggctgtgctcaagtgtgccctggcttttattttctgttgtgctttctcaggtctcttttgcataggcatagaggcttagttgactgaggatgtaataatggcttcggctccctctggtctttgctggacacgtgcacagcctctgatcaaggtgggatttgtggagagtttaccaggccccctgtgcttctctcactacatgtaattctgtgttaaatccctggtgtttccagtgctttgcttgccccacacagaattgtgacctcaagtagcagatctccttgtttgtttcccattgaaatcacctgtttaaactggacgctctccatcaatcaagtcccatctggagatagcagtgaatgtgctggttttcactgcttacctcaccctcgttaaattacagttttgtctagctttatagttgcctttcaggaaggggatttatcatcttccttcttctgctatgctggaagtgaatctccaaattagaatgttagaatatactattacccattaatttttttgtcttaattaaagctaaatttgctgtcagtttttttcctgtgacagagattttaaactagaaatttgagttgccttcatttcattgtgaatgctttaaaaaataagagtatttgttaagttttgttattgttgagattaagagatctggctgtggattccagtatagctagtgcctcatctgtaaaatggccacagtaatagttctaccacaagggtttttggtaaaaagtaaatgaattaattaaagcacttaaaatactgtctcataaaagtaaatactagataaatacctgttttcatgtatgtttatgtatttatcattttcttcataaaaatttggtttcaatttgtaattccttggcaattaaatttctaaactcttggaaatacatcacattggtagctttccttatctgcctatgaagtgacattcagttgtttcctaagtagtattacatttgaatatttgaatgtttacctatttttcatgtatctatgaaatttactacactgtaggtggtgagcttcattttctccaaattggaggaacctgtgatgatattgatgaagctgatatactagtggatggatctctttctaaaggaatagaaccatcttcagaaggttccaaacctttatcaaatccttcaagtcctggcatttcaggtatgatattaaatttttaaatgattttaaaaaaagaataggtagtatttatcatttttctagttgttggaagatgtaaacatattaaagtaagaagtgattctcaacctgtatggtatgttactcaatatttgtgaagtcatctaagaggttaaaacaaacatttcagccattaatgagcttttagtctaattagaggagggaaaaatcatataaaagagaattcattaagtaagaataaaattagtagactggctcatattattaatattcctactggaattgaaaaggtgaaaaaaaatactgtcactgaggatatatttaggtggtatattcacacatacgttgccccatcctgaatctctcgataggtttgtttatatttgtttgttgtttttgccttttttctcccatccttgacccacattgccctccagagctaatttttcaaaagaagttttgctagcatgctactccctgccaaaaaatcattatttgccttgtagacttttatgaaatcatagtagcctgcttctcaatctccagttacttgagttaaccaaggtgtcttggttaagtatacaacttggtataaaaagctaaaatactgaatattctcatattttataggttattggttgaatggagaagattttttataaagtacagaaaaatgctttttagtagaggaaagatgaattttgtaatgaagaaataaataatggaaagaaagaagattgacatgctgttaatatttacaaactaagcagatttaaaagggtctagactttgagaaaaagatgtaatttgaattaaacttgtaataattttatagaacttgctgtcatttttttattgtgaaaatactctaaacctaccagattttatattttagtattttattaattttttaaaatgggaacaatggcttagcattttttaatgttatacatttcactgatgtgaatacatgtatagcatttgtaaagaagcctaattagtatgaagcacgttattactcttataatactagcatgtatgcaagattttcttaactgccacagaaatagaaaaaacaatttaatttttcagtttgtaagtatttctttaccacatagcttttgactgttttagtgttttattcatatgttatgtacttgcttgatgtctagcattttattttttaaaaaatagggtctaaaagttaattattggtctgatgtacattggcttgcactttagtaccactgcttttcttgccatccttattagggctaaagttcagtaagcccttttctaacaggttgggtttgggtttcttcaatagcgagtattgtctctaattttaaatatttaagttagaattttcttctttgctattttttagccagagttagttatcttagttatatatagatacctgagcccactttattaactttcagaatatttggcaagtgttgcaatagaaaacctacccatgaattaaaacttcacttcattgtcttctttttttttttttttttttttccacacctatttcaaatactgctctcactaatgttaaggagttgatttattggtggaccagccattcacccttgaaatcttgacatccctagtggagctaacccgctttgagactttgactccaaggttttcagcgactgttcctccatgctgggtagaagttcaacaagaacagcagcaaaggaggcatcctcaacatttgcatcagcaacaccatggtgatgctgctcagcatactcgaacttggaaactacagaccgacaggtaaaagatattcccaagataattaattttaagtccatcttgtgtatttgtcagagacaacgtagaattcctaggtatattactgtttatctttttttttttttttttttttttttttttttgagacagagtctcactctgtcacccaggctggagtgcagtggcgcaatctcggctcactgcaaccactgcctcctgggttcaagtgattctcctgcctcagcctctcaagtagctgggactacaggtgcgcatcaccacgtccggctaatttttgtattttaggtagagatggggtttcactctgttggccatgctggtcccgaactcctgatctcaggtgatccacctacctcggcctcccgaagtgctgggattatgggcatgagccaccatgcctggcctgtttgtgttttaaactgtctaaaagatatacagtaatatacttaggaattctgtgttgtctctaacaaatatataagctaatttttgcatgttgatgactttgttccttctatttgtcatattgcttttggaaattgttatattcttattcttaattttaggataaaataatgagagtaatttactactgcaattagtttggtcacttagtccacagatttatttaacaaatactcaaatgcttgttttgtatttaataaaagcaggcactcttatagtcactagtaatgtgggtctcatggaatttgcctcctaatggcaatagaaagtaaacagatacatataccatgccatatgggcataaaagctatgaagaatgttaaaacagagtatggcaatagagtagtagttggataggaaattgcatgtaagagtgagagagtgagagaaaaagagagacaatgtgtatggtattttcaatataagggacctaagaaaggcttccatgataatagcaatacagaaccctgaggactatattttgtgagttctaggaaaagaaatatgaccactgttgttggagtgctgtgaatataagggagagtggtagggagggagatccaaagaggtagctgggtgccaggcatggtcgctcaaacctgtaatcccagcactttgggaagccaaggcaggtaaatcagttgaggccaggagtttaagaccagcctggccaatatggtgaaacgctgtctctactaaaaatacaaaaagtagctgggtgtggtggtgcacacctgtaatcccagctactcaggaggctgaggcagagaattgcttgatcctgggaggcggaggctgcagtaagccaagattacgccccactgcactccagcctgggctacagagtgagactccatctcaagaagaaaaacagaggtagaggtacctgggagctggatcatgaatgcctttataaaaggtcaggcatggtggctcacatctgtaatcctagcattttgggagactgacgcaggaggatcacttgagcccaggtgttcaagacccacctgggcaatatagggagacctcgtctctataaataataaaaaaaaatttagctggacatggtggtatgtgcctgtggtcccagatacttgggaaactgaggtgggagaatcacttgagcccaggcggttgaggctgtagtgagccgtgattgtgccactgtactctggcctgggtgacagagtgagaccccatttcggaaaaaaaaaaaaaaaactttcatgctacgtgagatgggaaagtgttagcaggtttgaatacaggagtgatgtggtataatttatattttacaaagattactttgacttctgtatttagaatgatggttgtggtggggagggcagtgatagattggttttagtttggttgctgttgtgctgattcaggaatgctgatggtagcttggaccattgtgatagtgatggaggtagtgaaaagagtcgttagattctggatataatttggaggtacaaggaatagaatttgctgatgtattgaacatattgtgtgacaggggagaataaaggatagctttcaggttttggcctgagttcactgaaaaatgaagtttctgtttactgagatttggaagtgggttttttcataatgagtttgagatgtctagtagacatttggatatgagccttaaatttagtggaggagtttggagattttcattttccagcatatatatagcatttaaaacccaagaatgaatatatataagaaatacaataaattgttgttttgaaatgaagattctgggaccctactcatagatctagggtgggtaccaggaatttgcacgtaattcacattaaattgttcacactttgaggaataagaatgtattggtatatgcaagtctcaaggcaggtgtagatttctaaagtaagattattcattgccctttgtttaaccttctccattgggagctattttctctcttgatcccattgagaaacactagattttgttggaagctgcaaagcaaaaagtaggaaaggtgaccttaatgataatatggttgtggctgaagaaagatttttgctttatttagcatttttccccttatttgacagcaacagctgggatgaacatgtatttgaattagtactacctaaagcttgtatggttggacatgtggacttcaaattcgttttgaactcaaacatcaccaatattccacagatacaagtgacactgctgaaaaataaagctccaggattagggaaagtcaatggtaagaatgtatcaaaatttatctttgaagattttattttgtggttgatttctgaaaactaattttcaccttggctaagtttcgtgtccctttctgtcccttgttgccatttgcctgctttactttttgtgattttatttaaaaaagtaattcagagaacatttcagaacttttcagtaacccagtaatgttcagaattgcataaacttgaatcatataattatacttttttggaagtgagattagttcctttgtaaattagtttgacttttagcattactagctttatgtatttcttttcctaggagaagacttaattgtgaatagaactgttatggaagttacttttaaggttattagtgaagccagcctttcatgtaatgctaaaaatacactcatttttatctttcttacaagttcagaatttgttgcattgagttattaaagtagattatacacatttagcatggttagaaactagatgttactactgagtgttttctccttaataagttagtttaagaggctggggataatttcacggtaaaatggcaacttaaccccagtttcaaacattgaaacttgaaaattttcctttttgaaaaattacatatacgcctggcactctctatctgtgggtttcacatcccaggagtcaaccaacctcagaaacaaccaatcgtggattgaaaatactttgggggggaaaaaataaaaaaaattacgacagtaagaaaatatacaaataaaaaatagtattagaccacatgtggtggctcatgcctataatcccagcattttgagaggccaaggcaggaggatcactttagcccaggaatttgagaccagcctgggaagtatagcaagcacatgtctacaaaatttttttaaaaaaattagctgggtgtagtggtgcacacctgtggtgctactcaggtggcagtactcatgaggctgaggcaggaggatcacttgagcccaggatttggaggttacagtgagctatgactgcaccactgcactccagcctaggtgacagagtgagactctgtctgaaataaataaatagtatttgcatggcattcacattgtattaggttttattagtaaactaaagatgattaaaagtatacgggaggatatgaataaggttatatacaaatattatgccattttatataagggactggaacatctgtggattttgacatctgtgggggtcctggaactaatcccccacagatactgagggatggatgactatatgtgtgtctgtatatttatgtgagtctgtgtgtatatggatatgttcatatgtgtgcagtcttttgacagattttgaattaattgggtggaggactcaggatttggtagtttcaaagctctgcaagtgcttgtaccaggcagcctagggtaagaacttttagtttagttgccagcagattgtttctttaggcaaatattttattaccgttaaaagagagaagaatgtataaaacaattgaatcaaaattttcctccaatcattttatagcatctgtgatgaaaatcacagaagttcccaagttaacaggaaattttagatttttcaggcacataaatcattgatattaaagaaaattaagtttactaatatttttatcctctagaaacagcagtagataggcagatcacctttcctttgtctccagctcttaacattgaagtggaacaaaatgggaaaccgtccctggttgatttgaatgaagaaatgcagcacatggatgtagaggaatcacagtgtgagttaaattatagagctgttgtccatgacagtaaaaggagtagtgatctgaatgcaacatgtcgggcaagatttccttatggcttgcaaaaacttggtttcaagaacacaattaaaaaataacctataattctgctttggcaatatgctttaactttcagctcatcttttgtgaccacagctgcgctaatgcattcttggtttttaataccttgggatttgaaatcaagtcgtggtttataatttttttgaaaataaaggtgaactgtaaaataatatgggaatggaaagcaacataacaaataattgattatagttccttagcatgacaattcttattttaacacattctaagtatgatattttgtgtggtggtattatatgtaaatgggatgatatttgcttattaaatattacattttaaatgaatgaatttaaaagaaaaatatgtatttttctttttaggtcttagattatgtccatttttggaggatcataaagaagacattctatgtgggccagtatggcttgctagtggccttgatctatcagggcatgctggaatgttgacgttaacaagccccaaacttgttaaaggtgaagtaatacattttacaaaagcagaattaataataccacagttgtaaaaaagacgaaaaaaaactgatctcaaaaaaaataagattgttttctttgggactttcgttcgaaatttcatcagttttctggtagctgaggtcatttcctgtcataaagtaactaactgtatggttatctgatcctactttttgtgtcttaagaggtctcagtgctttttgaaaaaacgttgaagaaatgactacaggatgacttagtgtgacataacagagctcttttgagtaagcagacataatgttctgccatttttacccttcccatcacatcagagtcccgtctcttcagagttttattatatattattacagtatcttcccttaaaagaggtattttgtttgtttgtttttgtttttttgagacagtctcattctgtcacccaggctggagtgtagtggcgctatctttgctcactgaaacctccgcctcctaggttcaagtgattctcttgcctcagcctcccaagtagcagggattacgcccagataatttttgtagttttagtagagatggggtttcaccatgttggccaagctggtctggaactcctgacctcaaatcatctgcccaccttggcctcccaaagtgttgggattacaggcgtcagccaccgcacctggccaagagaggttttttttgttttttctttttttttttttttttttgagacagagtcttgctctgttacccaggttggagtgcagtgctgtgatctcagcttgctgcaacacccgcctcccaggctcaagcagttctcgtgcctcagccttctgagtagctgggactacaggcgtgtgccacaatgcctggctaattttttattgtattagtggaggcggggtttcatcatgtcgcccagggtgatgtggaactcttgagcccagccactctgcctgcctcggtcccccaaagtgttaggattgcagacgtaagccaccgctccaggccaaaagaggatttttattagaagagcttcgccagtatcatatacaatgatttgagtgtcataaacaaatgcagattataatgaatgttttgagataatgggctatcatgttgataatttagaaatatcagtggtaggacgttttcagcttttgtattctgggggtaaataaaaaaaaccaacacaaaatgactagttcaattgttaaagaaatttggggtggggtgggatgtagagatccttctccaacccaagaaaataactgaccaactatatatcagctatttacatttgtgtacatttgcttcctaatgtttgtccacattcacacataaccatttaattgcagacatagtacaggtcaagtatcccttatctgaaatgcttgggaccagaagtgtttcagatttcagattcttttctggttttggaatatttgtgatatacttaactagttcagtattcctaatccaaaaatccaaaatatgaaatgttccaatgagcatttccttttagcatcatatcggctctcaaagagttttgcattttagagcattttggattttcagattagggatactcagcctgtatatatgcaagttttgtgctttcttattgtcattaggttttcgagatgttatgtgttaggtttcatgctgggatacagtagtgaacaaaaactaatctcaaattgtttagattataggttttgttcaatgagagtgtgcatcttaaatttttaggtggaaatagaaatattggtgtttttaaaaattttttattttttagagacacagtctccctgtgttgcccaggctggtctccaactcctgggctcaagggatcctcctaccttggcctcccaaagtgctaggattacaggtgtgagccaccacgtctggtcaaaaatactgattttgacaaaatggagtgtagaattacatggcatgtgtttggaaagtattaattttcttagaatatactaagatatttttttccataaaattctccccagcatctttgaaactgaataagataagtgctaagtttttttggacgagtaaaggggtaacattggccaaagaaattttgaaacagaatgtcagataccacaacacagagaatagtacagtagtgttaagaaaaatgtaacagtgtagtgctagcacagcaggcaggtagctaagtagagtgatagcatttataatcatgaaagatttaatacctggtaatgcaacaatagactgatagtttgctggcagatgtagtaatttaatgataattaagaaatgtattttatatatagattgtatagtatgatcccaatttggttaatatcacatactagtgataataattatttgagtgttctttttttttttttttttttgagacggagtcttgctctgtcgcccaggctggagtgcagtggtgccatcttggctcacggcaagctccgcctcctgggttcacgccattctcctgcctcagcctcctgagtagttgggactacaggcgcccgccaccacgccccactaatttttttttgtatttgtagtagacggggtttcactgtgttagccaggatggtctcgatctcctgaccttgtgatctgcctgcctcaccctcccaaagtgctgggattacaggcgtgagccactgcgcccggcctatttgagtgctttctttgtgccaagcacagttaacagtggtttagttgactctgaggtaggaaatattactcttattttacattagaagaaactgagccacagagaggataatttgtcatgtgcctaataaatggcagagccatttttcaaacccaggtagtgactccaaagcctgcatgcacatttttaaccgtcagtactataatgctatgtgtatatgtgcacatatatatggatgtgtgtacatgtatgcataagaagactggatggatatacgttctgttattatctagatgatagcttaatgacagttttgtgtgtgtgtgtgcgtgtgtgtgtgtgtgtgtagttgatgacatttttaccattaaaatgaataatattggggaaaaaacatgccaaatgtttatctcaattagtcaaagataatggttttatgctattcatatcattcctttgttggttgttttttgctgacagcgtgtgaaggtggttcaactttcttctgctcaaacagtataatttgaaagttctggcctactgtactttttgtggagttagttgttgatcttgttctatgaagatgaaaaacagtggaatttattggtgattcagttattttccccattctactccacttctctaggtatggcaggaggaaaatatcgttcgtttttaatccatgtcaaggcagtgaatgaaagaggaacagaagagatttgtaatggtggtatgcgtcctgtagtaaggcttccatccctaaaacaccagagtaacaagggttattcacttgcttcacttttggctaaagttgcagcaggcaaggtatgaaactgtcattttgaacaataacaatacagttttaaacattgtggatcagatttaacacactattagaagtagtatgacctttcagtgatgttttactatacgcttggtttgtttgtattttgtctttggagtgacttaaatatatttgggaagaagaatgtttgagttaactttattatttcattttatttattttagagttttgagacggggtctcactctttcccccaggctggaatgcagtggcgcaaactcggctcactgcaacctctgcctcccagattcaagccatcctcccacctcaacttccctagtagctgggatcacaggcgtgtgccaccatgcccagctaatttttgtctttgtagtagagacggggtttcaccatattggccaggctggtctcaactcctaacctcaggtgatctgcccaccttggcctctcaaagtgctggggttacaggcgtgagccactgcacccagcctgaattaactttaggcaaattacctagcttttgtaatgtatactgaatagggagtaattgttagcagatatttccctttataattattttagaccataatatttatttcttttggtatgagagtttcttcatatgccctctgttggcaactcacaatcttgtttttggtgactatttgggagtatacagaaagagaagttggggcgtaattttaagacaggttctaatcctcatggttgattttctgaaagtagctgtgaaccatgcagctccttacaattgacttatcttggatttcctggaagtcaggaaggaggttttgtttatcatcattatttataaggaatcatactgatactgatcagtaataccaggcattttacatatatataggtcttccagtttttcaaggacttctgtgtactttatctgatgtaatcttcattataactctgaagtaggcatagcaggttctgttacctcccttttttaaatactgaaagtgagtgaaccttagcgattggggagcctgacatatctcacgtagttattttattttattgtgtttattgatttattattattattattattattattattgagtcagagtcttgctctgttgcccaggctggagtgcagtgatgtgatctcagctcactgcagcctccacccactgagttcaagtgaatctcttgacttagcctcccaagtagtgggattaaaggcacttacccatgcttggctaacttttgtattttttggtagagatagggtttcactgtgttggtcaggctgttctcgaactcctgagttctgtgatctgtctgcctcggcctcccaaagctctgggattacaggcctgagccactgcacccagcggaattagacccaggactttggttttatcatctgtaatcattgggttattgcctttaaaatagtggctgtgtctgtctttttttcccctattataattctggagaaaattagtcatttactgaatatgagggtacaagctatcattttaacttgagatttatattttgatggccacaattcagttattttcctttattttataacttcaatggtaaatgatttttagtttagtttattttttaaaattcattattatttgtaatgtttaggaaaaatcatctaatgttaagaatgaaaatacaagtggcacccgtaaatctgaaaacctccggggctgtgatttacttcaagaggtctcagtcaccattcgaagatttaagaaaacctcaatttctaaggaaaggtaatttcattgcattatcttgttattcttacagtaatgaaagtgcagagcataacaccacacacatacacacacaaataaaaaatcttttacctgaaaattttttttgtccatttttcttaaataattataattttgatgagaatatgagttgtctttatacttcattggtttatctctagtgtccgcacagtgcttgttgtatagcaggaatggatgatagttattaatttgacacgtactcgtcaggcaagggagcatgtatctatagtcctagctactcaagacgtgggggtaggaggatcacttgaacccaggagtttgagtccagcctggacaacagagggacacccaatctctggagaaaaaaaacaaaacaaaaagaaattatacacattccatgttacattacaacacattattgtaaatgttattaaaaaattttctacaaatgaaatacttgacatatagctattgattgtttttaaatgtacttgagatgttcatgaattaaaattaaacattgcctttccagccaggttgtgatagctttagttgttctgttttgtttggtaatgtgtttatattttctttttttgtagagtgcaacgatgtgccatgttacagttttcagaatttcatgagaagcttgttaatactctttgcagaaaaacagatgatggccagatcacagaacatgcccagagccttgtgttggatactctctgttggttagctggagttcattcaaatggacccggaaggttaataattaaaattttgcttaccactgttgattgccttttagatgttatgattgaaagttcaggatgagtctaaatgtctgctattgttttgcagctcaaaggaaggaaatgagaacctactttcaaaaacacgaaaatttctgtcagacatcgtacgtgtttgcttctttgaggcaggacgaagtatagcccataagtgtgcccgatttctagccttgtgcattaggttggtatgtttttaagttgaaagcatactttctaggtacacctgcaatttagtgggtgataccttgtttatagtgtgatttgatccttgtttaatgtatgtataatttaagagaatttcaaaagttgatgaagattgttgataatcttagcaagaattttgggttcttaggggaaagtgtcatgttaaataagtctatttaacttttaagaaaagaagtctgctgagcttctctgcctgttagtagcagtttggagaatttggcaagggaactcttaaacccttttcactcctactttccttggttgtcttttcttgccctaaagtgttttctctgttatgtaacaatcttaccgacttttttttgtagcattgtgcagaccctttttttctaaaccctgaaacaaattagaacagtctgccctgatccccagggcatgtgtcccaagacccctcccctccccagtggagacctgaaactgtagctagtactgagccatatatatagtattgttttttcctatatatacatacctgcaataaagtttaatttataaactaggcatagtaagagattaacaataactactaataaaatagaacagttataataatatactatgataaaagttacatgaatgtggtctctcaacatgtcttattgtactgtactcacctgtgtttagactgcacttgaccatgtgtaactgaaactttagaaattgaaactgcatatacgggttcttaatgtttaaaggttcctacttgctactgtatctaggaagtgtctaagagctaatggtcagtattgactgttgtaaagataagggtttaatgcataagaaaatatttacaaccctccttagtataatcagttcccgctatcttttggtattttatatagctttaaggcaggtttttcttttaatcggtatagaatacattttaaagatttttaggtaccacaccaggtttagggttgaatttagaccttgagtaatgtctttacaatttttctttttaaaaatttttcagtaatggcaaatgtgacccatgtcaaccagcatttggacctgttctgttgaaggctttacttgataatatgtcatttttacctgcagcaacaactggtggtatgtaaaattaatttaatcacaaatagttatagtcatatggaacatctcatatgtatacttaggattatttcataactactttttctctattaaagttcacttttctgtggcttatctgtattttttgaagggatcgatagattgtagctgggtggtcatatactccgtcaatagtactccaaggaaaaggttcatggagcagttacgttaatatcaagtcatctcaattcataactatttttctgtacttcattacaatcattgagttgtttggttgtttactgactgtaacagatcagatgccagaaaccagaattccagcatgtgccagggaggtgacataaataagtaaaacggtccaggtgtcattgcacatgcatatgttttgtgtgattggtagggactatggcaaactggaatttcctaaaagggaccagtggttttttttttttttttttaaagcacctgaggactctgtggaaatgcctttcaagaatgaatgtaattggaggtagagagtagaatgatggataccagagtctgggagggtgagtgggatttgaagagaggttgataaattagtatgaacatatggttagaagaaataagttctagtgtttgatagcacagtagggtgactgtaatttgtggtatatttcagaatagttaaaagatttaaagtgttcccaatgcagagaggtgatggatatcctaaataccctggtttgatcattgtgcattgcatccatatttcaaaacatcacatataccccctatatatgtgcaattattatgtatcaaaaaagaatgaaggtagttatcaagtaggaattcataaagcagttctctaaaatagcacatatataaggtaatgaagatttttaaagattcttactgtttttgctagtacatggtgttactatgaagggctactaacttggccttttaagccaaattttatttattgatagacatttttcacaatctgttttattaaaaaacaaaccattcaggctgggcacagtggctcacacttgtaatcccagcacttcgggaggccatggagggaggattgcttgaggccaggagtttaaaaaaacaacccattcaacaagttacctcagtgagttatatatttcataaagatttcatctttgtgttaaacaaaaaaaatgcttgtttagagttgttgaaaagttatatcattttcttaatttaggtaaagcgtgtttatatttacattgaacatattttggctacaaccattaactctatggaatagaacattttgactcagttgctcattacgatagtctctaatgtttaaaagcttcttaaggatagttttaaagttgggacgcttaagttttggcatgtatgtagcagttaataaaagtaaaaatacactgtcatgataatcttttaagcaatgtcgatctgtacctaacgcattatagaataattttattccccattcattcactaaaatgggctgtttgaagctcactgccatccactattttttaaagtttagtacagagaaacagtatgttggtaaggatgatttgaaggaccttcagtctcctcactttttcagctatttcgaagtgtccctcagaggcatctcacattattatacacctaaataaatacacattattatacacctaaatgactttataaaactctccagaaatatttgaaattcttagtgtaagactgtgcctcagtgtgttgtttatattttaagtgtcctctttgatccctccaaggagttatctttgtaaattgcctataagattgtctttccagaaaagggagtatctttctagcaaaaggaagtattctgataaataggtaatcttaaattctcattgttagaggaaaaggaggaaaaagaaacatttattttgtttttattgtttccaggttctgtctattggtattttgtcttactgaattatgtgaaagatgaagatctggctggatgcagtacagcttgtgcatctttgcttactgcagtgtccagacagttacaggacaggctaacaccaatggaggctttacttcagacaaggtattttagtatatctaatgactaataataggcgtctctgagtatgatcacgcttttgcagagaactgttatttaatatatatatgctgataacagtctttttcttacaaaaatgtttagtttataccttactttttccatacgataatagcctgaggttttactttcttctgttttgtcagaaattactcttttttttttttatcgagatggagttttgttcttgttgcccaggctggagtgcaatggtgtgatctcagctcaccacaacctccatctcccgggttcaagcgattctcctgcctcagcctcccgagtagctgggattacaggcatgcaccacaggcctggctaattttgtatgtttagtagagacggggtttcttcatgttggtcaggctgttcgcaaactcccaacctcagttgatccgcccgcctcagcctcccaaagtgctgggattacaggcatgagccaccgtgcccggccagaaattactctttaacagtttgataaatccttatgatggttattcagagggctaattttatttaataatgaaaagtggtatgccctgctaatggaagaagaatgtaatgtgtctgtttctctgtgcactttataggtggaattatgtgagtcacttattgtcccataactagtattcttctacctgctacttgtatttcaaaacttctaacgtgatgaattaagcaatagcaaaaggttagatttaagttcttgcctgattgtctacgtttgaagtaaggcgttcctttatttagagcagtgattttataatttcctaggttagatgttctgattttgatgacattttactcaaagcctttgtacttgaggctatgtcgtaatgattcacgggagagaatggtgcctgatacccctcgcttcaatctgcaggtggcagtcttagtaccttagttgccagcttattggaatcacatttgttgagtctctggacagtgtcttttagagtatagattgcagggaacatagttgagattcactgaatttgatgggtcaaatctagtcagcatctccctctgcgctggtttttttttttttttttttttttttttttttttattgatcattcttgggtgtttctcgcagaaggggatttggcagggtcataggacaatagtggagggaaggtcagcagataaacaagtgaacaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcaggagaatttttcttagtacagaacaaaatgaaaagtctcccatgtctacctctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggccgggcagaagcgcccctcacctcccggatggggcggctggccgggcggggggctgatccccccacctccctcccggacggggcggctggccgggcggggggctgaccccccacctccctcccggactgggcggctggccgggcggggggctgatccccccacctccctcccggacggggcggctggccgggcagaggggtcctcacttcccagtaggggcggccgggcagaggcgcccctcacctcccggacggggcggctggccaggcggggggcttgatccccccacctccctcccggacggcgcggctggccgggcaggggggctgaccccccctcccccctcccggactgggcggctggccgggcggggggctgaccccccccacctccctcctggtcggggcgactggccgggcagaggggctcttcacttcccagtaggggcggccgggcataggagcccctcacctcccggacggggccgctcgccgggcgggcccccctatccccccacctccctcccggacggggtcgctgccgggcggagacgctcctcacttcccagacggggtggctgctggacggaggggctcctcacttctcagacggggcggttgccaggcagagggtttcctcacttctcagacggggcggccgggcagaggcgctcctcacatcccagacagggcggcggggcagaggtgctccccacctctcagacgatgggcggccgggcaaagacgctcctcacttcctaaatgggatggcggcggggaataggcgctcctcgcttcctagatgggatggcggccgggcaaaaacgctcctcactttccagactgggcagccaggcagaggggctcctcatatcccagacgatgggcggccaggcagagacgctcctcacttcccagacggggtggcggccgggcagaggctgcaatctcggctctttgggaggccaaggcaggcggctgggaggtggttgtagcgagccgagatcacgccactgcactccagccttggcaccattgagcactgagtgaacgagactccgtctgcaatcccggcacctcgggaggccgaggctggcggatcactcgcggttaggagctggagaccagcccggccaacacagcaaaaccccgtctccaccaaaaaaaaccgaaaaccagtcaggcgtggcgacgcgcgcctgcaatggcaggcactcggcaggctgaggcaggagaatcaggcagggaggttgcagtgagccgagatcgcagcagtacagtccagcttcggctcggcatcagagggagaccgtggaaggggaccgtggagaggggagaggggagaggggagaggggagagggagagccctctgcgctgttagtcagactgcttttaaaactaagtaaaggtaatttgttaattagatggctgaaaggaaaattgttagtgcattattttatttttcagatatggattatatagctcaccatttgatccagtcctctttgatttggagatgagtggctcttcttgtaaaaatgtttataacagcagcattggtgtccagtcagatgaaattgatttatcagatgtcctttcaggtagtgatttcttttattaaaggaaattctgaatgttgtatcttggatttaagttgccatttgacttaatagattatagtcatgatgttttgtctttagaaaactaaaattccttagaacttatcatatgaattattaaaatgtttcctagaagttcttaacttcctctttccctctgaagaaaatcccagtatattaaagtcatatttgaaagggttgtgactttaattttttgtttttgttatgcatttcatttcagtgtgattttaatgcttatgagactatttaaaatgtatttgttgtagccttttcagttttatttgatgtatctttgctgcctctataaagttaaaaaagatttcctatttcaaaaatacaaaattagtaatatatacttactgtaataaggatgcacaaacaaaagataattttctgcatctgtcactttcttgaggtaagctttgtatacattacgtatatccttttatactttctaaagaatgtgtttttcggatgtatgcatgacactatttttataatctttttaagtgctaaaatttgctgtttatttttgttagataaaagagtgaccatttcatttttttcttccgtctaattgtacttattgcagatgttgttaggatacaaaaatgttagaaaatttgcaaacagattaaggtaataaccagatataagtaaattttgagagagaagttcaattttgttgaaaagtaacttatgaggtgtaataaaagcaaaattaaaaagatcaaatacaaaaatataaatgaaatgtaaaatgcctcaaccccaacctttccaccctcttaggttactattgttaactggatgtttagctatttaaacttgtttgcaacctgtattcgttaatatagtttctaatgaaagagcatactacacatactggtctgtcacttgctttttaattgcttatgctgccttgaatatatgtgttattactatttgatgacttaggctcttgattgccttacacgcatctcaccattttctgtcttctctatccaagtgatgcatcaattagaccattgtaatttatgattggaactagtaggagagactagaactggagataccaatgccttcagtataccaaaagaagcagtgaaatctgttagggtgaaagcgtaagggaaggactgtaaggttcattccaagctctgaggtcatcaagtttgcaaatgagtaaagaagactcagaacaaggaatttagaaatcatgatatgtcggccgggcacggtggctcacgcctgtaatcccagcactttgggaggctgaggtgggcagatcacgaggtcaggagatcgagaccatcctggctaacacggtgaaaccccgtctctactaaaaatgccaaaaaattagccaaatgcggtgatgggcacctgtaggctgaggcaggagaatggcgtgaacccgggaggcagagcttgcagtgagctgagatagcgtcactgcactccagcccgggcgaaagagtgagactccgcctcaaaaaaaaaaatcatgatatgtctccactttaatgtctcattgtgttgttcctcattattagtctctctacagcattttttgttgttgttgttaatggcatcagtggcacaagacagaaatgtaaatgtcattcatgatacttatatctttcttatcacccacattgaggatatcaccatatggcacctatttttccaccagtgtatgcagttgttcctctctatccgtggggaattggttccaggactcctcgcagacaacaaaatctgtagatactcaagtcccttatgaaaaatgatgtagtgcagtttgtgtataacttacacacatcctgctgtgtgccttaaatcatttctacatcacttataatacctaatacgatgttaatgctacatgagtacttcttatactgtattgtttagggaataatgacaagaaaaaaaggctgtaacagactcagccattcatttttttcccctgaatattttctgtctgtagttggttgaatccatggatgccaaacccacagatacagagagctgagtgtatgtcaagtttgctcactctgttacctcccatgatcacaagttacagtcatcttgaacccatactacaatcatagctttcacactggtctgcctacatctgttcttgcctcactttagtgcattctccacattgcattgagtatgatctttcagttactttacctttctccttagagtacttttcaggtcttcccatcttctgaagttcaaagtttctaatacagcatataaaatcctaaatgatttggctctcttttccttgccactttatcttgtgtcattgccccgtttagtcttttttggccctgtgattctcaaagtgtgttctatagacccccaaagggttcctgagatcattaaggggatctatatggtcataactattttgatgatagtagaatgatgttatttgtctttttgatttcgttgacatttttatcgattgtgaaaaagcatggtgttattcactgtgcacttgtaataaaaatgtcggtttcattttaaaatgcccttgacgttgcagtaaaaattattaattttattaaaattttaacccatgaatacacatcttttattctgagatgaatgatacatatgcatagagtacttctgtggcatgccaaagtaccatgcttgtttcagggagatgtgaagttcagttacaagctgaactacttgcttgtttcttggaataccatttttatttgcagtaatgactgacagacaaactacgcccatttgcactgcgttatttgacagttgttttttgaaaagtgaatgagaaacatctcccatagtgagcttgatagcttcccagtatgtagacttttctcatggagtctgatattagagagtgtaattttccaatactggataatgaaatgtgtcaacatttggaatatttgtatacagtggtgaaccaatattttccaaatgatcaatgcatgatgtttcaccagtatgcatgggtaaagttctttaaaagtataaaatatatcagttgatcttaatgtaacagagtttgagaagttcattggtaagatttcagataccacattgtaacctttaagaaattaccacttgtcaagtttttgaatatgcaagcattttaaaatattctttttccaactacatatttgtgttgggtcagatgttttcacccacttctgctaaaacaacattttataacacgtcgaatacggaggcaggtaggagaatccaagtatcctctgatacttcacattttaaagagatttttaaataggtaaaacattgtcacttttttcattaaattatttttttcttcagaaaacagttatttttcatcaaattatgctattttaacatttaatgggtttattattaaatgaattaatatttaaatttcacaccttgaaatttctactatggtaaataccagtaaaacaaggaaacaaaagctcttcagggtgcttaatattttaaagatatgtagagggatcttagaattgagaactgttcctctaggcatattgttctttcagttccttaaatgtgccatgtttctttgctatggggatttcactcatgttctttctgcatggcttttctgccacttcaagggagcaaatgtatgaaactctcttattcttcctatgaatcccctcattttgttagagaagcattttattatcccataacttaggactgattgccccttgacttactagtcctttaaatttctcttaagtaaaaccttgcagcttaaaaaaaagttgcgttaattcctaataaccactaacatagaatatagtcttcgtgaggactgggacttaccttttattcttctgtctcccaattcttgtattgagtaagtgtgcaataagcattttttggagcatgtgtcaggccctatgctgacccccaataagacattggaaaacaaggttatgacagtttattcttgtgtttgatagtccttcagctgttaatgacagtttttatacctccccattcttttcatctgtgaattctgttttgctttgtgatttaaataattctgtttaaatgagtgctaattccaaaaaaaaaaaaaaattgcaaagtagtgaatataatccttgccttcccaagctgcatacgcagtccctgtgaattcatttgtgttcttccctctagacttcttgctgtggttttattggtcatatagttgtggctacatggttttttcttttaaaaactacttatgctagcttaaactatttttatgaccatgaagtagtgtgcctcattctataaaactgataatatgaacaaaatacaagaaacaatgtgtagataaaccttgttaatattttgaaatgttcatcctttgttttgtgtcttatatttatgcagttgacatcttagaatgtattctgattttacatatagccaacagattaggtgatagctaatgtgactagctgatttactacttttttcaccccatttgagattgaaatttttcaccccatttgagattgaaatcacttgttactaaatgtaagtttcatgttacaggaaactaccactcatgtttctgttaatgtgaggagctactaagttgcttttatccaaatctgcttttgtagcagggaaactcgtgcctgctgttttgtcagttttcttaataccatgcccatgattcaagcactgtgtaagagttgtgtatttatatgttctaattaaaattgaagttgcagctataattattgttgtgactattgctttttaaaaattatcttcacgtgttataaaacttgtcttttgccattaggaaatggaaaggtcagtagttgcacagctgctgagggtagtttcacatctctcactggacttttggaagttgaacctctgcactttacttgtgtgtcaactagtgatggaaccagaatagaaagggatgatgcaagtacgtttactggtatataccttcttttattatatactttatgcagtaataaagtgatatttatatatttaaacattatttctaattatgtaattttcattgctgttaagtggaaatttatttgtgggaggggcatttgggggaaatataaatcgttttatattctttcctaagtcaattcacagggttatttttccccctgtacccacttagaacagtgtcttaaatcattctgtttttatgtgtatgcactttcagaaattttttaatttgaaaaatatcaaatatgttggaaatggaagagtaaaaatagactacgtgtttctactactgaatgatgtttttgagaaggttgagatgagtaaagagggaatactgtttctcgaactagtttaaaacaaccttgaatatgtgaggaactatttgggtttgttgaatatgtgatgttcttggtgtgttaaataccttcacttaaaaattaagtttttgaccatcaatcagtggaaacttgtttattttctttcttgttttctgtgattttttttttccttctcacgtaggaagatcggtatttatttacagttacttctattgcagcataaataatagaagtctttcagttaagattggtttatgattttatatctgtattagtcactgaagggtttgactgttgtcttaacgtgattcttctgttgatggttttgtgtcattgggtaccatcttagtctcctcaacagtttaacaaaaagcaaaaacggtttgctagagaagtcgtgaaaaatataatcttagctggttccagaatagcaggaggttttaaaaggaatttatcagttctttatttgagtgtctttttgttaggaattgccttatatatccaattgtggaggtagctactaagtgaaattcacagtttatgtagtgaatatgagctttttagattaaaaacctaatatttcctttatatggtgattctagaaaggtcagaattaatttgtatttgttttcttggactatatagtcattttgtagaaacttttacatttacactagaatagaaacatgccatgacaaaaaatttgaactttcagaaaattattttattataaatcaggacctttcgtggaactgtattgaaattaattatcctgggcctggcgcggtggctcatgcctgtaatcccagcactttgggaggccaaggtgggcggatcatgaggtcaagagatcgagaccatcctggctaacacagtgaaaccccgtctctactaaaaaatacaaaaaaaattagctgggcatggtggtggtgcctgtagtcccagctactcaggaggctgaggcaggagaatggcgtgaacgtgagaggtggagcttgcagtgagctgagatcgcgctactgcattccagcctgggcaaacagcaagactctgtctccaaaaaaaaaaaaaaaaaaaaaaattaagtagcctggtttgagacaagcctggtcaacatggcgaaacctcgtctctactaaaaatacaaaaagtattgctgggtgtggtggcaggcacctgcctgtagtcccagcttcttgggaggctgaggtacgagaattgcttgaacctgggaggtggaggttgcagtcagctgagattgtgccgctgcactctagcctgggtgacagagtgagactccgtctcaaaaagaaaaagaaattaagtatcctggatttttattttattttacaaaaattcatgtgtttgcaaaaggcacataatttttaaaagataaaaggttaggtttgaaaaagtttttctccacactccccacccatttctccccctgcaaagcaagcaatggaacgagtttcttgtctttacagggctagtctgtgtatatatatgccatcacctctttatttcacccaaaatgaaactgcctaaagagagatttttattaaatgttgaggcaaagtgctgactagtgattataaggagctgaaagatgattgtagtctctcaatcctgtttacttttttgaaacatgttaatattaatataatatctatgcggaaaagtgcagaaaataattgcatagctcggcagtttatcatgatacacattgtctgtgtgatgaccaataagtaaagaaagaacatttccagcaccccaaaaggtgtcttcgtgaccacttccatttatttcttcctcattttctccagaagctaaacatcatccttttggagtagttactttttggtttttgtttatttctttgaataaccacttaatgatgcattcttgaacagtggttgagtaaggtctgtataacatagaattgcacatgtatgtatatttggtttgccttcttttcaatcctatgattatggcattaatctatatcattgcatatagacagttggttctttttcattgctgtttaggattcttttgtccgaatgcaacaaaatttatgtatccactattggtttgtatactgctgatagacatttgagttgtttcattgtggagctaatagtactgatggatatatttttgtcttgaatatgaatgtggaagttgattcactgcttcatagggtattcatatattcagcttcagtaagtaagtaacctttttgctactggttcctctttaaatactgtggagtcaaatactcagagtattgatcttgcaaatttgttgagaattgtagagggtcaaattctataaatattccatccatacttaataatgttaactctgcacttgttggtgaagtgtactctatatatccttttggtcaagtttgctagttgtgttcttcaaattctctatctttattggttattttacctgtttgttttttagttaatgaggccagtatgttaaaaaatggtagatttgtttattttttgtcatcaagttttatacactttgagaccatcatataaatttagaatggttgtgtctttcttgggaattcttcgatcattatgaattatcttttattattattttttgagatggggtcttgctatgttgcccaggctggtcttgggctcgaatgtccctcctgcccctgtctcccaagtacctgggattgcaggcacacaccactgcacctggcattagttatctttttatctttaagtttgctatttctccgaggatttacctcgtctgatgtttacttagctaacaccagccttctttggctgctatttgtatggtatatatttttccatctttttactttcaacttttcagtgtttccttatgttttagatatactttttataagtggcatgtagttgcatttattaaaaatccagcctgacatttttgtctttcaatgggagaatttaattcagttacatttaatgtgattagtgatatattcctgtttaagtctgccatgattttttatatgtactattctatttctcattgtcctgatggttggttacatgcttctttttcctccttttctgtttttagggctgattatattttttactggtcaatttttccatttttttcttgaaccgttcttttagtaattgtatcattgagatcacagtatgtactctgattccagaagtatatgttttttcccataatacattattaatgctcataatccagattatatagtctagattccagaagtatatatgaattcccatgatacattattataattttttatattcagtattcacttggatttacctcataattccattttcattgatttttattcctttgtctttgagcttttatctggtatgatgtttcttaggtctgaaaaatactcttaagatctctttttgtacttatctactgatgacacattcaattaggttttttgggaaaaagttcaaagttttatgaataatcaaatgaacaaacagcatagccattatccagattccaatatcattgttattttttcacatttgtctattcttttttctttgccaaaatacttcaaaacagatctaatatctgataattacctaaattaattataatttattatgaaaccagtgttgttgtaaacaatcagttttgcagtgtcatctgattttcaatacatgattaaacaatataatatagaattctatagggattctaagttactagttatttttactggtgatttaaaggtaatctttccttgtctcttagcttagtttgtatttgttcgaagtcatctgtcagtcttattattgctttttaaaggtcatttctcaaactttctgagattgcccttctgccctttttttgctttcagaatttttctgtgatgtttctacatgtggtttcatttgtgtttattctgcttcagattgataggacttcttgaatctttagttgatagcctcctgaagttttagctgatacctttcacagctttagggaaatagccagttaactctttaaatattgcttctgctctattttgtctcctgtctttttgagtctccatttttatatatgttgtatctcatcatcataactgatagaattttcaattgttttatctctccttagttaattatggatattttcttctaatccatcttttttttatacttgttctatcttctgctatctaatcatttatgggaaaactactctgctcccactttactgcagtgttgcctctgtagtaagtatctcatatatatatatgggtctgtttctgtttcattggtcatttatttggccttttgttaatactctattgcctttttttttttttttttttttttttctgatacagagtgagacactctgtatcccaggctgaagtgcagtggctcaatcttggctcactgtagcctcacctcctgggctcaagtgattcttccacctcaacctcttgatagttgggattatagacatgcaccaccatcagtgaatttttttatgtttagcataaatgaggttttgccatgttggctcagctggtcttgaatccctgatctcaagtgatttgcctgcctcggcctcccaaagtgctgggattacaagcgtgagccaccgtgcccagcctctattgtcttagcgtaacaatagtcttagtgtttatatctgatagtaaaaatctaccaacgttctttttaggtaggttttaaaaattgattttctaatttttttttaaaataaaactcacagtgttatgcagttatcaccactatctaattctagaacatttccatcactacaggaagaaactcttcatccattagcgttttctcccattccccccaaacccttccagtcacttggcaaccagtagattggagtttcatccatttagcctgtatcagtacattactcctttttctggctgaatattccattttgtttaggcattcatctacgggtaaagatttaggcgatttcttctttttggctgttatgtctaatgctgctgtgaacatgtttgtgtaggttttgttttgttttgttttttgtttttgttttttggtcaatgtgtgttttcagttctcttgggtatgtacctatgagtacaacctacaaatattctttttattaaagattgttgttgctattctaggtcttttgtatttctgtttgaattttagatttcatttgtcaatttctacacaaaatacttgtttttaaaatttagggcctttatgtaaatcagtttaggagaattggcatcctaatattgactttttaaatgcattaacacttgtgtgtgtgtttttctgtccccttaaatccagaatacacactggcggtatatattctataatatatttaggtctttgatttctcttggttatgctttgtggttttcaacatagttttacatttttttttttagattcttagttatatatttaattgttatgttgttataagcgatcttcctcttaatcattccattcatttggtatttgtgtataaaactataattgatttgtatatattactgtcacatctggtgacagtgctatattattaattttaaaagtagtttatagtttgcagtttcttagagaatttttaatatgttgcaatcatgttgtctattaatagttttacttttttctttctcatcattttatcgtcgttttttccttgtgttattttgtgcttcctaggtcttcctatatgttgttgaatagaaatggtaatagtagtactcatcttggtcttgttcatatatgtattatattatatatatgatatatctgatatagatatatatatctcatatgtgatatatatcatatatgatatatatatatctcatatgatatatctcgtatatgatatatatatatatatatatatatatatttttttttttttttttttttttttgacatggagtctcgctctgttgccaggctggagtgatggcacaatcttggctcactgcaatctccgcctcccgggttcaagtgattcttctgcctcagcctccccagtacctgggattacaggtgcccaccaccacacccagctaatttttgtatttttagtagagacggggttttgccatgttggtcaggctggtctcgaattccggacctcaggtgatccacctgtcttggtctcccaaagtgctgggattgcaggcatcaggcaccatgcctggcccagccctatatttttttataactagagtttttgaggccctttgtagtataaaaatagaaaaagatattgaaaactcggattgtgcaaaagatttctgattagttctatagtatcaggatggcttatttttccttggattgtttacgtcttctgtttgcttgtagtgattcacttagttttccctgtgttatttgggcgttagattttaaaatcaattaaatgtaaatgttcacagtattaaaaaccatatatattaccccaaaatacaagcatggtatgaatgatttagcaagtctaacagtttccccttgactgttgggattaatagctgtcgatttgctgtggaacacttgaaggagcagatgattttattttgggactacgcatgttttatgagatgcaattgctctgctctgctctgctctcttctcttctcttctcttctcttctcttctcttctcttctcttctcttctcttctcttctcttctgttctcctctcctctcctctcctctcctctcctctcctctcctctcctctcctctcctctcctcccctcccctcccctcccctcccctcccctctcccctcccctctcccctcccctctcccctccccttcccttttttctaactccatcacccagactggagtgcagtggcagtatctcagctcactgcaacctacacctcctgagttcaagtgtttctcatgcctcagcctcctgagtagctgggattggaggcttgtgccaccatgcctggctagtgtgtgtgtgtgtgtgtgtgtgtgtgtgtgtgtgtgtgtttagtagagacaaggtctcaccatgttgaccaagctggtcttgaactacttacctcaagtgatccacctacctcagcctcccaaagtgttaggattacaggcgtgagccaccatgcctagccaattgctcgttgaccaagcttacaatgttgaatttgtgtccactaaatgaagggcacagtatgactgcactgtaatgagtggtgtttttttttttttaacataaggaaatttaattataagaggatatgtgcagtttttgttattggtatattgtttattttagcttattttttaattttattagaattctggcacaatatagcccttgtttgcttttaaaaagatgggctgttagattgcctggattttcccctttatccactacctatgagcaaattacttccctcagctttagtttcattttgtagaaaatgggattatttttgtacctcatacgtataatagtagcaacaaaaactttgcctagttagtacttaatacttttttcttgccgagattaaataagctgatgtagcttccatgcttaacactatgcccttcattggctttggcttcacatacgctttggttctgatcctagttctactgtgagtttacaggttaatttctctgagccttctttacttaatcagcaaaaaaataaaaataaaaaaaaaaaggtgggggggatcatgatgcctgggccataaagttgcccataaagtgaattgtagttattctttaaaacaatgccacatggtaatgcatactaaatatttgctattcttatagcagttatcttttccctcaatgtaactttgtagtaaaggcctgttagaaatatttatgctgttattaaacttggcaactaccttttgttttgtgctgacatattggattaagttgtgaaatgaagtttttatcccagcttttccaatatatttctcataaatattggaaaacaatgcagaaagaattatttataatgttgtttgaataacaatgaaatggaaaatcaaagaaatctgttgtagggtttcacagagcctttattactgataatgttcatgggtaagaagtgtgtgctagttttactgtgtgtgggatatgcctctctccattttggtgttctggggtccttttggtaggtgaagtggggtgtgttgttgcaataagaaaacttagtaaagcaaatttatttcttaccctcaaattgtgtaataagattactttcatttttaatgatcactttactataacaaagatatttgcaaactcatcattgctgggctgggcgtggtggctcacacctgtaatcccagcctttgggaggccaaggctagtggatcacttgaggccaggagttccagaccagcctggccaatatggcgagaccgcatctctactaaacatacaaaaattagccaggcatggtggtgcatgcctctaatcccagctactcaggaggctgaggcacaagaatctcttgaacccagacgtggaggttgcagtgaaccaagatcacgccgctgcactccagcctgagtgacggagtgagaccctgtctcaaaaaaaaaaaaaaaaaagtcattcctgtatttcctagatcttgaatgatagtattatcaatatactttattttaccattgtttccttatttatactttccagatttcttttttagaatgaaaattaactatagttttagcatcataatagtgccaaaatatttgaacatgttttgtctttaaccttttcttcatcctggtgttttttgtttttgtttttaccccttgtcttatgccagtgagttccttcggggttactcctgcagtaggtggactatcatctgggacagttggggaagcctcgacagccctgagttcagcagcccaggtagctttgcagtctctctctcatgcaatggcttcagccgagcaacagctacaggtgctgcaagagaaacagcagcagcttttgaagcttcagcaacaggttggagactatttggctctttgttcatgctgtctctaaacttcaaaagctgaaaaagtactttaaaaatgaccattattttcataaagaaacgtaggttgactgatctgagctaatcagtttcaacaaaaattgaggtaaagtctttgtgatatttaaattggttaaaattgtatgaatacatcttatttgatacatatttgagggaatatgattgatattttttgtgcaatcttgaagtaaatccattctctacacactcgatcaaagaatatgtacagttactagttactatttatatggagtatagttcctaaaacaaaattttatagaacagttaaatttaatgtgacttaaaattcactaataatgacagatgcttcataaattttattgtggcctaaattaggggtctccagtccctgggccatggaccagtaccaataaatagcctttcaggaactgggctgcacagcaagatgtgagcggtgggcaagcaagcaccacctgagctccatctccttttagatcagcaggggcatttgattctcataggagcatgaacattattgtgaactgtgcatgtgagggatctaggttgcatgttccttatgagagtctaatgcctgatgatctgaggtggaacagtttcatcccgaaaccagtcccctgcgcctctgccacatctccccgcatccgtggcaaaagtgtcttccatgaaactggtccctggtgtcaaaaaggttgaggaccgctggtttaaatgaaatctttggcaattccaggtgacaaattgtattacattagtcaacatgagaattcaactccttataatattttgttttgagcagatattccttatttacattaattgttctgcttccttttcaccactaccttgaaagagtcctagttcccaaatgcacaggaaattttgtgttaaacatttaaagtgtatatagcaaagcaatgatccatttatatcgagtccagttttgatttaatttcatctttaagtatgatcaatttaatcatgtttatcttcataatatatgtccatgtggtattctgccacaatttaggtaggcaggattagtctatatatgttgcttttacttcttttgcagaaagcaaagctggaagccaagttacatcagacaacagctgcagcagctgcagcagcatcagcagtaggtcctgttcacaactctgtgccttccaacccagtggctgcccctggattcttcattcatccatctgatgttattccacccactccaaaaacaacacctctttttatgactccaccactcactccacccaatgaagcagtttccgttgtgattaatgccgaacttgcacagcttttcccaggctcagtcattgatcccccagcagtcaatcttgctgcacataacaaaaattccaacaagtccagaatggtaaattatgttttaaataggtgttggcttagacatttaaaaatatcttgaaatatactctaactttagaaggcaaaatttttaataccaactagatgtatcaagttattttcttttataaaatattacagtacatacattaagagaagaaacttattaatttgctattatggttagtagtttttatagaactatagtaatatcaatataaagttagattttttttttttccctgctctagaatccacttggttctggtctagcccttgcaatttctcatgcttcacattttcttcaacctccgcctcaccagtccattattatagagcgaatgcattcaggtaatcttttactttcttaaatttttttttttttttttttgcttagtctgccggccttttaaagactcattattcttcagttcgattttttttttttttttttttgcaaatcgcgtttcctcttgggttaagtacattttatcaagaataagcacttacatgttcaagctttgtgctcaccaaattgcataaagagtgctgttgagtaatggatttgatctatatatgaatcttgcctgctgatacattattgacataaataatttattgtagttggtcaaatcaccattatactagaaattacactcaaaatattcctaaaactagccttcttatagtagaactctttcttgagaagagcaaacagaactactgcttactgtaataactggataagaataataacatatcctaggctctgaatagtttgaatgttacctgagtttgtcttctgcttatatgctacagaactgacattgggatagatgctttcaatcacaacatatttgtgaataaactctaggcaacttttctcttaaaacagttggttttaactaccaccaacatttttgtgctttagcagcagtagaattcaacaaaatcctcagggaaataacatggttatagtatacactgtagcatgtatcattatatgaagaattaaatagtatttgcgttcttgcaatgtggttgtttcctctttgtaagagggagtttgaaagctaaaataaaagtcttacagtattttctgcgcccaactaatcattcattggtaacaacattagtgttgatgacatttagagtggaaatttgttattctgaagtcttatgggagatgagcagttgtttacactgtagtttgtttttttatacatagcaatgactgtagtacataagcctcctgaggaggataactatgttctttctttttttttaataatttttcttgttagggaagtattagtaactgccttgttttcttttaaactagctctgtcgagaatagcactattcctagaagtttaatttagttgttttccttcactataaaatgtagctggtaagattactagctgacccaccccaaaacaataaggaagaaaaagaattatgacattattaatgatctgccttctgttttttaattgaacttattcttgtaatgtgggtgaaatgagggatgtaaatctgctttttctttacctatttcatctggcattgagctgaagagactgggatatgtctatactgggaaaaagcattgtttgagatccattagaggaccttcccaaggcctttttcagtggtattttgattatatatgattgtagtcctgctttcactttggatctaaaccccaatgaatgcaatatgcaacttcacaggaagttaagcagggcttaaggaaactaaatcaaataatactatttggtatttaaatgcatctagttgtgaaattaagaaaaaaagttgccaatggctgaaagaagagcagattgatcctttacaaaattaactaatatactgcatttgctgatttaattttttaaaactctgatgttttaaagaagcttgtttgtatagtggttgattgccttaactgtaacagtagcagtcttactgttgtttttttgttttgttttggttttggtttttgttttttaaagagacgggtggctaggtgcggtggctcatgcctgtaatcccagcgctttgggaggccgaggcgggtggatcacgaggtcaggagattaagaccatcctggctagcttggtgaaaccctgtctctactaaaactacaaaaaattagccgggcatggcagcgggcgcctgtagtgccagctacttgggatgctgaggcaggagaaaggcgtgaacccaggaggcggagcttgcagtgagcagagatcgcgccactgcactccagcctgggcgacagatcgagactccgtctcaaaaaaaaaaaaaaaaaagaggggtttcgctgtattgcccagtgtggagtatagtggctattcacaggtgcagtagcagtctagtgtattgcagcctggagctcctcggctcaagcaattctcctgtctcaggtcccccagtagctgggactagaggcacttgccactgtgcccagctactcttaattttctacttacgtcttggggttcaaaactaacacagactgggatttcagaaaatttttgaatcaattgacaaggccatttttacatatttacttttcctcttatttatagtttagtgagttgctttcatattttaagatgagtgctccaaattatttttgagtgtatcatttggttaattgatatatttttggtcaactgtttcttctttctctcataggagcaagaagatttgtgaccttggattttgggaggcctatattgttgactgatgtattgattcccacttgtggagacttggcctctttgtcaattgacatttggacattaggagaagaggtggatggaaggcggttggtagtggcaactgatataagcactcattcactaattcttcatgacttaataccacctcccgtgtgcagattcatgaaggtaaagaactttaagaaagtaaattgatacgctttctatgtttctgacaagttatgaaaaatgaatatataattaaaaaatataactatctttttaaatacattgctcagatttttattgtggcagatgtgtatatatgtatatttataatttttcatttcagatcactgttattggacgttacgggagtacaaatgccagagccaaaatcccattaggattttactatggtcatacctacatcttgccttgggaaagtgaactgaagttaatgcatgatcctctaaagggagagggagaatctgcaaaccagccagaaattgaccagcatttagcaatgatggttgctttgcaggaggatatacagtgcaggttagtacagagtgcaaattttaatgttattgaaactttgtattttatataatgtcttgcttataattctgtcaagaaatgtcttttcataggtgtacagataagagagcaagaggaagtaggagattagcacgttacaataacacttaatgcgtgaaaatattgtgattaattaatgggctccatttattagtacctatcaagtgggtaattctttttaatggttgtatgttaacaggtttaagagatttaattcttagtatttgtacatgtacataaagaggacattacaagaattattttgttcaatctttttttactttaggtataacttggcttgtcatcgtctggaaacccttttgcaaagtattgatcttcctcctctaaacagtgctaacaatgcacagtactttttacgaaaaccagataaggcagttgaggaagacagtagggttttttctgcttatcaagattgtattcagctacagcttcaactaaatttggctcataatgcagtgcagaggctcaaagtggcgctaggtgcaagccggaagatgttgagtgaaacatcaaatccagaagatttaattcagacatcttccacagagcagttacgtactatcatcagatatttactggacactttgctcagcctgcttcatgcttctaatggtttgtatttggcttacatattttaaaggctgggaatatacttgatgtgatttcgctgcatgttttaggatctgtgtcaatattttctattgtaaattttggtattttaaaaaatgtcagtatttatgaaatgtctctttaggttaatctatttctccctgttattttaaacatttcttaaatgaagttgtgtgtgttttttttgggtttctggtattgacatgcacatcattgtgctactggcaaagtattaagtattgcattgaagttgaacagtgaaacttttcataaattgctaacctaatatagagctatcattttctagccaggaggtatttttgatcattacacgagctcacacattcactgacacagccatctgacacatccagctccataggcaagaaatgtaatttacttaagtgctaaatattttcgtctccaagtatgtaacagatttctacatacaaggagtaaatacattgcagaataaatagaatataattatctactgattactagaaaagaggaaagtgtatttaggcatgcgtattttaatattatacaatacatttaaataggaaagtttactgttttctttcttgtaataggacactctgttcctgcagttttgcagagcacatttcatgcccaggcctgtgaagagctctttaaacacttgtgcatcagtggaaccccaaagatacggttacatactggtcttcttcttgttcaactgtgtggtggtgaaaggtggtggggtcaatttctttctaatgtccttcaggaattgtacaattcggaacagcttctcatctttccacaggataggtaggtcagaaaatgttggaggtatttgttattaatgatgtgtacttttcacagttactggttagcttttgaaatctttgaaatgtggatactaagttgtgaatatgaagcagatctcagagtttgtgaaatgaccagtgaagggcaccagcactgtgtatcgaagaagataataagtgataattagagtctactctttagttttctaattgaacttgtggacttcatagatctgtgtttataagtatttctattagattatgttgctttatatgctaaatgtgtttgtttgtggctaataaaattctctcattcactaagtgcttgatttcttgttaataacattagaaaatgtaaccagtagttagaaaaaaaactaattttagcttcatacctccagatacaaatcttgctttcccagtctgaaatatggtatgttttaagaaagcaaatattctatcattactctgttaaatttctatgtaaattattttaaaaattgaacaatcgaattgattcttattcttttcttttttgtttgttttgtttttagggtcttcatgttactttcctgcattggtcaaagatcacttagtaatagtggagtattagaaagcttacttaatctcttggataatttattgtcacctcttcagccacagttacccatgcataggaggacagaaggtattaagagaaagcagtgttctttagtaaaaacaatattcctgcaaatatttcttttataaaatatcttctctgaaatactttaataattatttgcagcacatttaatatttttatgatgtaagcttttaagaatgagcaaccctcatgtgattgactgccatatagttaatacttttaaaatttattccttttcattatttgaacttagtatagtatgtttttcctgtactattataactaaagtcaaactcccttacataagtttgagctgtaaggcacagttgttgttcccatcaacaataatgagttttgtttgaacacacttttttataggaataaaaacattagaacctagtttagtgctatatgaattataagttgagagttagatgttttatttcagttcctgtgaatctaagaatagtatcttataccttgctttctagtttatatagtccattttggattcagcctgcacttaatctgttcttataccttgaagtctttgtctttcattagatttgatgttctactcagtttctggctgttggtgtctattttttagacttattacatataaatattagtgttagtaatgataagatatgttttggatttatagaatgttttgtttcacttatattatcagatctaattaggaatcctaaagtcatctggatgtttttcctttgctgtcatctctctccaggagtactagatattcccatgatcagttgggttgttatgctggtgtccaggttgctggattatgtggcaactgttgaagatgaagcagcagctgcaaagaaacctttgaatggtaaagacagggagaggtttctgacaggtatcagaagtttataataatatgttggtggggattttgagtgacttcgcagttgttccagaactggctattggcctggagctaccagctgtatgtaatttaaggaaaatacaaatgaacttcactacaattctgtttaaagataacatttatacttggtggactttatagacaagctcctttgtctggacatgacttttagtttctaaatgcagctatgacttttgcaaggtgtcttccctcaggcttgtttaaagactttataatagcatgcatgtaagtgagttatgaaagggaaatcagagtttttattttttcttagtatgatgtgtcatttcatttagcattattggtatctactaattaactacaaatggcctgtatttttaaatacagaaattctcagattttgagttgtaagctttctttataggttcaaagcacagaaaaatttaaaaattaaaggaaatcaacctgcaacattattttattaccctcttcccagttaacaaggctttttatttttctttatttttatttttcctcagagattcttgttctgaaaataagggtttttaaataaaggatttgagatacctaaatccagtatgtaagccattgagatatgtaagcctacatatgcttacatatggcttacatgtagtatgtaagccattgaaatccataaaatttggaattctgtacattgtcaggaactcagtatttttaagagttcccttgagatgttatagtggaatcagttgtttatagtgcatattatgtttaggaagatgatggggaattcatatgtataaggaatttgctttatattgatttttaaaaaataatgtatatctatgattagtttactcagttgtaggatatagaggtaagaaatacaattaacataaataaaactacattcatattgagaaagtcttgtctcgttctgtggcccaggttgaagtgcagtggcacgatctcagctcactgcaaccaccacctcctgggttcacaggattctcctgtctcagcctcccaagtagctgggattataggcgtgtaccaccacgcccggctaattgttttgtatttttagtagggacgaggtttcaccatattggccaggctggtcttgaactcctgacctcaagtgacccacccgcctcggcctcccagagtgctgggattacagatgtgagctactgcacctggctgagaaacagtcttgaaaaaaagaaaaatataaaataaactgtaatgtaatcttggaatataacagtattgggattgtgtttatacatgtggctactatggaaacattggtggaagagttttagggtttgaagaacttgaactaagatttgataagtaggtaggaaagagagaaaaatgtttttaggattaggaaaagatgttttgggattggaaatgggtgtaaagtgtgttattgggcccaaattgaatgaaacagaatagtctggaaatattccaaaaaaggagagtaagtatagttagacagttatgcgttctgaactatttaaccttattttggtagttattagttaaattattgagtatccttttttggttcctgattaaaagcgtctgtgtttgaaataggcaatagtagtatttgttgttgaaattgaatgacatcatcaaagttgtatagagattaatcttaattgtggaggaaaatagctattatctaaatgaaagattggagacagagggaactctggttttaaaatgatttagggtctacattagataattgacagttatccagtctttatagaatcagatcttctagcaatttctttacaatgtttttcttattaaaactgcttttcatgattgacacatgtataactgtgttttttgttttctgggtaggaaaggtactttaaaatcacatttaacagaattattaatacaagttttccttcgcctgtaggtaatcagtggagttttattaacaataatctacacactcagagcttaaatagatcttctaaaggcagcagtagccttgatagattatattccagaaaaatcagaaagcagcttgttcatcataaacaggtaattgtcaatatatttaaaaatttttaatgtttgagaatattgttttggagtttgcatgagacagatgtgccatcagatgtgaggtataacatttaatgggctcttagcttaggaaaatcatctaacactttggagacttcaatttccttaattgttaaaatgacgacaatgtatagtttacagactttgttgatgttcctttaacatttactgttatacatctctattactactattctaaatgaggttgtcattatcttttgcctagtccaaaaacctctcttcctttgttctgctttaattcaatccattttccttcatgtaattctctgtggcttttgtttgacctttggatgaaggtcaaactctttaacatggcttcagggtattcatcttctgcccctctatctagcttccagattttaattttggtttctttttccatgtcttttttctcctttttcgtgtgtgtgtgtgtgtgtgtgtgtgtgtgtatttttttttttttttttttgagacagggtctcattctattacctaggttggagtgcagtggaacaatcatagttcactgcagtctccaaattcctgggctcaagcagtcctcccgccttagctttccgagtagctgggattacagctgtgtgccacagtgccaggctaatttgtaaattgtttcttgtagagatggggtctcgctttgttgcccaggctgctctcaaactcctggctctggcgattcttctactttggcctcccaaagtgttgggattataggtctgagccactgtgtccggccacacaatatttttattattgctttaagatgtaagaagattctatatgaaaatccttagctctggcatgttgtgaaagctttgggcttttcaaattttttgttttgttttttatatttaaaaaattttttgatttatggggcttttttttaaaggtagacttggcaatacgttttttatttttcacttctaagtttttcagctatgagctagttcaatcctttgcaggaaaaatgagaagcattttcctcaattaccttttctttttgagacctttaaccaattttaggtagtagtaatttgtatcttttaatgtttatactcagtgcatttaattaggatacaaaacaaaacctagtgtgtctctgagtgaatatttgtctgtaaaatatcattatttgattcttcattatgaatgacagtattgggacagttggcaaaacttaaaaggtgccttgagggataattggtggtcaggtgtcagtattacttctctcattttgatggttgtaactgtgatttgtagaaggtttttatttctaggaattataaacgaaagtaatcagggcgattagtcatcaggttactaacttactgccaaatggcttagtgaaaactagttgtatttgtacaataattaaaactggctgtttcagaaaaaattaaaaatgatttttttcttgattatatttcttgcatacgttaatggtagaactttggaaattattttctgaaaatactgatttgtagaaattctcagttaacgttttaaaaattatgtgtacatgctagttttaatttaggatagagtttttttcatctatggagataacagccaagtggatttttaaaaataacgttagtgatgttttttttcctgataccaaaaacaggtgtcaggcagggctcactttgggaggttgaggcgggtggatcagttggcaccaggagttcaagaccggcctggccaatgtggtggcgtgtgcctgtagtcccagttactcaggaggatgaggcaggagaatccttaaatctgggaggcagaggttgcagtgagctgatatcacaccactagtccagcctgggtgacacagcaagactatcttaaaaaaaaaaaaaaaaaaaaaagtgtcaatagtagtaatttagaaagtgttctctgagaaggaagacttaataagctgctaactcaattattattcatttataattgtggctatacctttctagtactttatatttaaagtaactttctgtgtacatgctgtatggagaacacagtcaccagattgtaaggtctttatgaacagagagttttttctcttctttggtctgtttgttcattgttgtcgactgctgattgctgttgtttagggatgggggagataggataggagggaagtgtggatatacttataaaaggatatgagggaaccttgtggtggcattttttggtattgactgttgtggatacatgaactaacacatgtagaagtgtatccaactaaatacgtacacagacaaacacaaatgagtgcaactaaaaatggaaaaataaggttggcaaattctgtcaatgtcaataccttgtgatattatcctatagtttttgcaaaatatcattagagaaaattgggtaaagtgtacaagagatttctgtattatttcttaatttatttatatatagcttaattatttcttaagctacattgtagcaaaaaactacaatgatctcaatccaaattttaataaaaaatatagacataccaaaatgtgtactactcttgagatttccataaaaacaaagctaagaaatattaagcaataaaatatttttctcatttatttaattaaaagtaaatttttttctctctattaaaaaatatatatcgctcgattatgttagtggcttatataagaaagtcttccagttatttcttactcccatgggtaagggagattttaatgaaaacagggagagatctcaaagtcaggatttgaaatgattttttaaaaaattatcatcacagttaaaattatactacatctttcaagataatgtgcattccattagtttgatgtatgaattctgtgaggagtataataatttttttgtttttaacgttgttaaagattaagttgtttatttgttttataaagcaacttaacctactaaaagcaaagcagaaggcattggtagaacagatggaaaaagaaaaaatacaaagtaacaaaggatcatcatataaactcctggtagaacaagcaaaactaaagcaggccacttcaaaggtatgatctatacttttcaatatagttatctcagaaaagtcaaggagttatgatctttaattacgatcgagaaacttaaatatacattactctgcttaacagagaagccaacctactctggacttttttttggtggggtagtttaactgaaggaaatgtatgataaatgtggtatttaagtattattgtaatgtattaccttcattgtggattgagttccagtaaattgaagataaaggatagtggaatgtatagttttgctaatgtggcattgatagagcagtttatttccattttacaatacaaaattatacaagatgattgcaaatattattgtatcagcctcacaaataaaatgtatatgtaaagtgaaaaatgtggcattctctttacccttagtattgttattggaatattttggtggctgagtttagaattgaaacttctttgggtccagtggtgctcacaaggctcaaatgtagtatgtcttttgtaagtgaaagtgaagttcaactgatttgtaagttttaaaaccttggtgtttactttttaaaattttgagggataccgtgtatgtatcaaacaagtttgtagtctttctataacatgaaattatgattattccgccagattttgaagtaactcgaattaatattttgtacttgatgttatattagttttctttaccttcaagcttttacaaattatgtttaggatgttacggtaatatttatgttgttagatttgacttaataacttaatatattatctacattgaatgtctgtagaatttcacttttctgaaactctgttacatatctgatactttactccaaataggaagtaaggtatattggtcagtttagcttttaatattcttacttttgaaacttacagtgtatctaaaaattttgctctttagaagttgtaatatggagtggatattttcattacataaatctatactgaaaaaattttcattaagtaaacattgatttaaacactatacatttttgtgtgcagcactttaaggatttaattcgtttacgtcggacagcagaatggtcccgttctaatttagacacagaagttacaacagcaaaagaaagtcctgagatagaaccacttccatttactctggcccatgagcgttgtatctcagtagtccagaaacttgttctgtttcttctctccatggactttacatgtcatgcagatctcttattgtttgtttgtaaggtatgtaaactataagtgtagacttacagggttggccgggcgcagtggctcatgcctgtaatcccagcactttgggagactgaggtgggtggattatctgagtctaggagttccagactagtgtgggcaatgtggcaaaaccccgtctctacaaaaaaaaaaaaaaaaaagtgacttataggttaattaaaaactagcaaaggatgatgtttttagtcaattttcattaagagaaatgatgcctcttttggttttgcttttttgcagttagtttttttattgtgtcttaaaagatgaaaaaaattcttttcaaatttttccttaaggaaatctgatttatattttaatttatttaaaacttgagggtttgaaatgtaagtaatgtggatatgtttatctccaacctgcctttcttatattaattaaaataggaaatacacaagtaagtgtcaaattatattaaagaaggacttttgactgggtgtggtgcttcacacctgtaatcccaacacttcgggaggcggaggggcggatcacaagttgaagagattgagaccatcatggccaacatggtgaaaacccgtccttactaaaaatacaaaaattagctgggtgtggtggcatgcacctgtagtcccagttactcgggaggctgaggcaggagaattgcttgaacctgggggcgatgaggttgcagtgagctgaaatcgcgccacttcacaccagcctggcgacagaccgagactgtctcaaaaaaataaaaaaagaagaaggacttttaatgtcatgattgcttttctgtggcatattcactgttcgtagaaatttaattcttaactatacaattagatcttaaaccagattttaatatttgattcatgaaattacattcttttttgcattccatctcaagcaattttttttgataccagactcatacatcattgttgaaacctattgttcagtgctaaagtattggtagacttctgttagtgtttgaaaaaacatgtaattgctatttaagtgtatgattttataaaatgtattacaggttcttgcacgcattgcaaatgccacgaggccaactattcatctgtgtgagattgtgaacgaaccccagctggaaagactgctgttacttttggttggaactgacttcaatagaggagatatatcttggggtggtgcttgggctcagtattccttaacttgcatgctacaagatattttagcaggtgtgttaggatttttcttcatagagtatgtcaaaattaccttgtcattgctcaactaagaatcttcaaagggatctttaacccctagagggatctttaaccccctaaaagcataaaggtctgtttaatcggtgtgatgttatagcagtagcaaccattgaaaattacttttgtatttaagtatattgatagtcgcgataaatgcaaggctttagaaaggctttgggttgttaaagtgcatgaatattggagctagcctgctttattattaacatcagtggtatgctgcttactgggtggggaaatcactttgcctcattttcttcatatataacataaggataataaggataatctttgtataaggttgtttttatgaataagcgtgttaatgtatgtacagtaattaaaataactctttgtacatgttatgtgtttactggatacttgtctctagcatttgaaagtaatggagtgagtcctagcattccttacgggggtgggaactcatttgcctcagattcttttatagttagtagagcatttattctgtcagtgactaaactggaggaaaaaaatgtgctgtaatacattttcgaaatctgtataaattattaaaacaggactatccccttacatacaggagaattactggctccagtagccgcagaagccatggaggaaggaacagtgggtgatgatgtaggtgcgacagctggtgactctgatgactcccttcaacagtcctcagttcagttgctggaaactatagatgaacctttgacacatgacataacaggtaaagttttacattatgtttcttctttattctattaaatggaaacatgtttcaaaataaagaatgttagagaaaaataaagttgatttttatatttttctattagttctttggccttataaactagatccattattttcctggtaaatacattttatcttggttctcattacaacaaaatgctataatttcataatatcctaattatgttgatatagtgtgatttggcaacgatgaagaaaatgcaatgtagaaaacatgtaaaaatacaaagtgatgaagacagcagttttaaaagctcttattctttaagatccagcatgtgatttttttggtgtatttttttcttactttttctttttttttcctttttaaaaagtatctttataaattagcatgtataatcctttatcatctccataccccttacttttcaaaagtctgttttgggtactaatctgtatatgtcagatgctgcagtcattttcaaccatttgtcattccttaatcttatgtttgctcatgattttctattttttacttgatattctctttatctggagtagatttcctgtgtgcacgatgaacacttcgttatcgaaggttcacataaagcgtgcctttctctaagaggctttttctgtcattcccagcagagttagggactttgccatctgtacttcccttgcgctctcaaatatctctgctagcacatatcatgttgtagtcagttttaattatagtgcacccccacctctgaatttctcttaatttattggattggagagttttattaatcttcatgtacttatactcaaaccctcatacaggctggcatttactaggcattctataaagttatgttgaataagaggataggaatgatggaaaagtaagagttatagaggggtacttataagggttataagaaagctacttaaaaatttggagacatctgagagacaataatttctaattcataacagaaaaataaggtaaatggctttttttttttttttttttttttttttttttttttttgagacggagtcttgctcttgtcacccaggctggagcacaatggcgtgatctcagctcactgcaccctctgcctcctgggttcaagcgattctcctgcttcagcccctggaatagctgggattacaggcggccaccaccacacccagctaatttttgtattttttgtagagacagggttctgccatgttggtcaggctgttctcaaactcctgaccttgtgatctacctgcctcggcctcccaaagtgctgggattacaggtgggagccaccatgcctggccggtaaatggcattcttacaacttcagtcctgtttgcttttctctttaatactgggtaacattacctgtaataatgaattacatgttagatgtaatagaatgtatattatttagtaatgttggtaattatttttaatagcaaagtttatgcaacttacttcaataagagctaatactgtggtcttttctctaggaaagcaaatatcaatgaatctttgtttttatcgtgtattatggagcgaaatgtttgcatacatagagtttttttttttaggcatatgtaacatgcaagtaaaataactttttttaactaaaagcattatgtcatctaaattttatgtgatacactccaccaataagatcacttttaattatttgaaggtgcacctcctctgtcctctttggaaaaagataaagaaattgaccttgagttacttcaggatctaatggaagttgacattgatcctttagatattgatttggaaaaggaccctcttgcagccaaggtttttaaggtatgatacatgagaatagtctttgaaaggaggccgggcgcagtggctcatgcctgtaatcccagcactttgggaggccaaggtgggcagatcacaaggtcaagagatcaagaccatcctggccaacatagtgaaatcccgtctctactaaaaatagaaaaaattagctggacgtggtggcgggcacctgtagtcccagctgcttgggaggctgaggcaggagaatggcatgaacccatgaggtggagcttggagtgagccaagatcatgccactgcactccagcctgggtgacagaacgagactctgtctcaaaaaaaaagaaaaaaaaaaattctttgaaagggaagttttcagtctcatacttttggcttagtaattacttaaaagaggaaaatatacatacttaaccactaatgcaactcattattcagcattttcaaaattaaattgctataggtactactattgtagtttaaaaacaatcaatggaatagtataaagaaaacttacatttttattaatgtagctactcataattatcatacaataatgagaactacatttaagtatacagaagtatagttatagatcaccaacatttcagacagccatctaaacttcatccgagctgtgttcattgcagagtctacttgtatgttagcctacttttttttaaaggagaatcacctgtaataatttatggtggtacagttctttggtccataagagattttattagggatgctactttcagtttctaaacatataaggtatttttagattttggcagaaagtgaggagaaaattactggaccattcttataaatcattaaaattataaggggatttgggaaatttaaagggtggatagaatatttattttgtagttctgtttgggtttagataatgtaaataacgtgtcattcagccaagaggcaaaaataaaccacagttttttttccattcttttaagccaataagcagtacatggtatgattattggggtgctgattatgggacctacaattacaacccttacattggaggtctgggaattcctgtagcaaagccaccagcaaacacggagaagaacggatcacagacagttagcgtttcagtctctcagggtaagtgtatgtttatattttaagacatatgctattcttaaaacaagtctgtcatttatgtatactttgtcccttgagaagttgagcctgggtgtatgccagtgggtttagtatcacagctgtgccgtgagtaccattcagagctgtttctttgtagtcactttagaggaacttctatctttttggttctctgtcagaataacacctagcaagtgttgtatgggattggcaatgattttaatgaactgtgctgtattttaattgttgactttaatagtaaacttgtattttatttataaagagaatgaaactacattaaataagtattatttttgcagtttttttttttttttgagatggagtcttgttctgttgcccaggctggggtgcagtgatgtgatcccatctcaccgcaaccgctgcctcccaggtcgaggggcttctcttgcctcagcctcttgagtagctgggagtataggtgcatgccaccaagcccagctattttttgtatttttagtagagacagggtttcaccatgttggccaggctggtctcgaacttgtgacctcaaatgatctgcctgcctcggcctccaaaagtgcttggattacaggagtgagccaccatgcctggctttatttttacacttttttagtcatgtagaatatatgagatgtgtttaattttttaataaaatacattttttcccttttcaacgctgctccttctgttataaaatattttttaaaaatttgaaacacacatttaccagaatgtttcaagttaaatgcggagaatgtttattctctagaaccatttgagagtacgttggtaatttgatgtcatttttgttttgttttgttttacaaatcaggacattcttccatatatacatatcaagaagtatattccctcaaaatcaggaaattaacgttactgctgtcaaatactgagagcccattcaaattatagcggttgtcaaaataatgttccttatgcacaagagcccagggaaaataatgcattgcatttaatcgtcacgtctctttagtctcattcagtctgcagtagttcctcatagttgaccttcatgacattgatacttttgaagatggcaggccagttattttgtagaatggtcctcagtttgtgtttgtatgctatttccttgtgaatagaatattgagttaatgcatcttcgaaggaatattccacaaataatgctcccccccaacatttcattcaattagggtggcccatgattttgatctctctcattattggtgatgttaagtttaaccacttgatgaatgagttgtcttctgggcttctcccttgtaaagttattcttttcccctctgtaaaaatgttttgttctcattgggttttttgggggtacacacatggtcttgctctgtcactcaggctggagtgtagtggcatgattttcagttccctgcagtcactgcctcctagaatcaagaagcagttcaccattttgaccaggctgttctcaaactcctgagctcaagcagtccgccctcctcagccttccaaattgctgggattaaaggtgtgagccattgtgcccggctgctgtaaaaagttttttgggggctggggagcagaatggtactcggaaactataactatcctgttcctcacaaagtttctttttgaaaaaattactggccaggtgcggtagctcacgcctgtaatcccagcacttgggaggccgaggcaggtggatcacctgaggtcaagagttcgagaccagcctggccaacatggtgaaaccccatctctactacaaatataaaaaaattagccagacatggtggcgggtacctgtaatccttgggaactgaggctgaggtaggagaattgctataaccctggggcagaggttgcagtgagccaagatcgtgctgctgcagtccagcctggacgatagagcaagactccaactcaaaaaaaaaaaaaaaagaaagaaagaaagaaaaaattactgtaatagtttattcgttcagttttgaacggactcatggttgcctttttttattcagtgaattataccttaccatttttttaaattgtggaaaaatgtaaataacataaaatttttcttttttatttgttgagatagggtctcactatgttgcccaggctggtcttgaactcctgggtgagcccagtccttcaaccccagcctttcaagtagctgagattacagcatgctgtaccacacctggcaaatttattattttgaccattttttgtgtgtgtatagttcactgttaatgaagatattcacaatgttgtcatctgttttttgatgttcagattgtctcaaatttgaccaataggatcccccttgagattttctcatcattttagcacttccttgttctctggcaaaacatgatagcccaggctcatcctttactttaatctgccccaccccgggaattagtcacttcttaaaggagcatggtatttcaaaaccttttaaaggagaaatgtggttaacaaaccatgatttcgtcatggatatatgtgttgctattttgggactgttttcatttcctcgtggtggacagagctagggagtatgtgtttgtgtgtgcgtgtgaacacacacacttggcatctatatttctgtatctgtctatctattctgaatatgatgaattcacatcagtgtatctggatttaatctaactccatagggttcattttagctttcttcttgtctgtatttatagcactttattctgacagtgagaaacctggttctcattatccttaatgtctttgtttccattattgttacttcacttatttaatatttctgtctctatataaccaatcgcctgtctctaccctcctttccacagatattcttcccctgctgtggctccgatactgcatgttaggtggctgttctgtaagaacacactcttcatcctctcttgggttcagatgtcatcattttattgtaggaggtaggacatgagtaataattgtcaatgttttctttttctttcaattgctttttgtagccctggatgctcgcctagaagttggacttgaacagcaagcagaactgatgttgaaaatgatgtctactctggaggcagattccattttacaggcattaacaaatacatctcctacatgtaagtaaaatgaccatttttagagtattgcagtgaatgattcagctcttcatcattttcaggtggattcatcaaggacagatttttaaattccatgatgtgagtctgaggggacttagtatgtagcactttcctggctccgagttagtagcaagttgaaaactaagacaaaggattaacaaatgcagagagtatcatgcaaaatacttccatgtagtgctgtcagttcagtgcagaaacctccattgtgttttgtttactgtattgttgtaaggttaataaaattcctacagaagccttcatacctgcctgtgagttcattgcactattccaaatttatgatgaagtagattttttgtagtaacatctttatcatccttaaagactaggatagagaatatagtgtaggatgacagccaaataggcctgttagttgaaagccagaattgagaggatttactacctaataacctacagaaaagaaaggccaactttttcgtaaaggactaatagtaaatattttaggctttccttgccatatggtgtgtattgaaactactcaactctgacttggttgcaggaaaacagccatagacaatatgtaaatgaatgggtatggctgtgttacaagaaacaggtagcctgccagagctggccatcacattacggtttgttttccttgatgaggtctacacaagtctggaactgggtagacctcggaggagtacagttgaaatagcacggtgtttttcaaggacagattggggagctgtgcttagaagagggtgctggtttttgttttcttaggcctgcatattgcttcaccttctctaggtcagagtgaagaaggggtagagatagtaggtagaaccgaataaaattacagatgcttctcttatggagagttcacaacccatttcaatagagaaatttgagtttttacatcttccttatgttaaattgaattctttcagtctgcaatcttcatttgtttcttgctttagagggtatcaaaagaagggaaaaaagaaaaacagaaggaatggtctagtgttctataatctcagtattggtacacaaatattcttgtatcttatctcccaggcaatatggggatcccttttgtagggtccagtgtctgcatgattagagataactcggtactgcccaaagtaacccttttctttgttagacatttcttatttaaaagcacttattagaatatcttttcgtaattctgaaaggatatttgaaaaaaaaaagaataaaaaagaaaatctgtttgaaattggtgtctcctctttatcttttgattatcctgcacacagctgtctctctttttagtataataataaaataaggctctaaatatatgataaagctcttagtatccttgtatttctctggttcccatgaatatattctcatttaattagttttgtgtgtaacctgggcatcagaacttctgaaagctccccagatgattctaatctatagtcaaggttaaagatgaatgaactagaatctagattattctaaaactaccttatcaataattagtcaggagtcttatttctttccctttactttccctcctttattaattggaaaaaaatgcaaataaaaattgctagaaaagttctttgcctttttttgttggtttgagtcctatgaatttgggaacttctctctttggtcattgtcttttttactttcaagtaatgttataaaaacacgtttttcaaatactaaatattgttttgaaccattctaaagaatgcagttttaatttttaaaaacaatttaacctatttatacatatgaataaccagttaacacatatcctgatactttatgtataaaattatacttgtgtttaattttcagtatcacagtctcccactggaacagatgattcacttctagggggtttacaagcagcaaaccaaaccagccagcttattatacagttatcatctgtcccaatgttaaatgtttgtttcaacaaacttttttccatgcttcaagtccatcatgttcaggtatgacttcaggagaaatggtgtatttttacatattattgttagcctggtaaaagatgaaactaattgggaagttcattctaatcctgtcagggatgatttctttattatattcagttggaaaaatattagaaatactttgattaccaaagtaatcacagtttctcaatgatggaccattgataattttaatgattttaagcttcagtactttaattcctactacacatacacacagctgtgatttagagacttgaatcacagggcatggtggcttgagtttgtagtcctagctactcaggaggctgaggcaggaagattgcttaaggccaggagttcgagaccagcttgggcaacataacactagatcctgtctctaataaagtaaaaaaaattaaccaggtgcagtagcacatgcctacagtcccagctactcgggaggctgaggcgggaggatggcttgagcccaggagttcaagatatagcagaccttgtctcaaataaaaaaaaaaaaatgacttgaatcacctgttttaatttagaagaatctttttatgaggtaatttctaacatttaattcaggtaaattttgtttcttcaagaattttaagatgtgtttgctgatcaactaatttaattaactagaagatgcttttaagtgtgaagaagtgtttaatagaaaaggttatttactcgtgacaagaatttaaacataagatttttgtttaaattgtatttcatattataataggtacatttttctcctgttgattttcattctttttcagttggagtcacttctccaattgtggctcacactgagcctgaattctagttcaactggaaacaaagaaaatggagcagacatatttttatataatgctaataggatacctgttatttcattaaatcaaggtaagatttattaggagaaaaacattatagtctaaatagcaagcttaaaacgtaattattaggttaaaatatacctaatctttgtcattaggggttataacattctagtggggaaaaaacagaatacctttttaaaaagatgcactaacttaccgattagcaggaaagatacagggagaccttgttgagaatagaagactcctactctctggtctgtggtatgcctgtatgcaactaaaatttacaatgttctgttactcctttatattttcttgaagttttgtctgatctgtaaaagcaggtcagttttttattatttttttttttcattttttaaaactatgagttagcccctggaggagttagtcagctggagaaggtggtcagtttcctgtggaagttgtgtgtgtttcttggcaaaatatgagtatgggaatggtggtagtaaaataatacaacaggaaaagaattagcgttcagctctagctacaggaatctattttagttatatttaaagaaaaataaaaatgagaatctgttcctgatgctttctctctatagtgaggcatcctgtagcttgcttgggtcttacatggtgtattttccaatgtgagtgccagctccactgagtcacgcacggattctacttacatctgcactgtctcagcaccagccagcccttctttaatttataggtttccatctcttcaactatattattattataataaaatttgttttcatctgtttttaattttattatgagaaatattaaatatatataaaaaataaaagagtaaaaaatagttattcctggctgggcacagtggctcacacctgtaaaaccagcactttgagaggccgaggtgggcagatcccttgagggcaggaattttagaccagcctggccaacatggtgaaaaaaatacaaaaattagccggctgtgttgacgcatgcctataataccagtttttccagtatctgttactgttttcagttgccagttttgtagagtgtgaggatttttagtaaattgtattgaagtagaaatgcctatggtttggaaagtacaacatactgagagtgataacatgtcatttcaggtgttgtgggctgagctttaaaccttatcctaaaatgttactgattcttaatgcgttagttgtatttaatggagaattccttttatttgcatgttttgaagacactggttaaggagcggatttaaagaaatagtgtcttgtttttaaatttattcttttgacttagttcttcataaacattgtttttctgaaaaatattttccctttctcttttctgcatagcatcaataactagctttctcacagtgttagcttggtatcccaatactttgctccggacatggtgccttgtgcttcatagcctaacactcatgacaaacatgcagcttaattgtaagttcataaatttattcatttaaatctctgacatatactttagtgttctactattggattcttaaaacagagttttccaaggagtggtatacttgtcaaagtggttgagttggccagatgtggtggctcacgcctgtaaacccagcactttgggaggccagcacgggtggatcacttgaggtcaggagctcgagagcagcctggccaacatggtgaaaccttatctctactaaaaatacaaaagttagtgggcgcctgtagtcccagctacttgggagggtgacgcacgaaaatcacttgaacctggaaggcgaagtttgcagtgagcttagatcacgccactgcacaccagcctaggtgacagagtgagactctgtctccaataaaagtgactgagttttttcttctaacatgtctcttctgaattagttcttatatatcctttgtgcttgtttactttgataatatagtctcatatgtctcgttggatgttcaaatcatattttttaccttttaaaaactgattaaaagaaaattgattgcttttagagtacaaaggcaggtttttacatttcatctaagtttttatgttattcttttaagatacctttgtacttaaaaatgatttattcattattatattcataaacatgcataactagattcctgggttttgtttaataatttaaatcattgcttagctttaaaatgctattatcttttttcatttggaatgtattttccaaaaatgagatcaaaagcatcactgtgatactgaaggtggatttcatgcaaaggatattttattcatctcagaaaactgttgtgttacctgtacgttagttcacagttaacctgtatacaactaacatgcaaaaaggaataattttgctacaacttattttagaaaacttgattaaagtttacctgaaaagtagatctctgactgtttctggaagggggagttagttagaataggctttccaaataagagtcaggacctagttatatcttttctgtttgactgtactaaataagatgtacattaagctcgaggtgttttcagaatcagaagggggcagaagagatagatggtagatagagagggaagtcctgcttagtcaatatagtagaaactgaaacccctttaataaactgtaattactaggaatgtatgaattttccttggaactaaaagatgctttcagatactgcatttccattatttcatggtccatttcttaagaggtttttaaaaaatgttttatagctggttccagcagtgccattggaactcaggagagtactgctcatttgttggtttcagatccaaacctaattcatgtattagtgaaatttctttctggcaccagtccacatggaacaaatcaacacagtccacaggtaatatgatgtttagcctggcatatgcccagactattcaataaacagtattcgtaatgtaaagctatgtaacttttttattgctaaagtattaaataatagccttttatgtatcaatataataaaaaaggttttgttatttgtaataatagctatactgacactaaataatagcaggtggtaagttaacctcttagaacagtgatactaggttttcatatagatacatatttttggcattaattttggataattggaaacattctgagtaaatactgcaaaggtagagaagcatttcaaaaattttggaatcaataaattttaatatgtcatatttgattacttctactatcaagattatcaattcaccttaatcattttatgatgttaatgattttgcttagcaaaagataacaatattgctcaggacttataaacattttctgtttcactgtaaattttcctttatatcaatttaatttcttgttatgttgtactgcttctgtgtaaatatttgtacttcattatatttcttttaaagtaaaaatatatttagcatttataacatcttttaaaatcaagattattcaagattatcttgcaagtttatcattttaaacttcttggatttgccgtcagataaattctaatttagttgtcctcaacagcccagtttctctattaattcacttattcagtgtttaggaggcttctgtgtgcttgttctaggtactagacatacagtatttaccaagatcaaatatctgccttcatagagctttagttaatactctaatacttaatatattttaattttacagatcttaataaaataaatgagacaaggaacaagtaagagagaagaaactaacttacagttagattgggacagggttttggtaggggcagagacatgttatcaagtgattattgtacttaaagattgattgaatttcaaacaggaagactcctcgggatcaccaattctgacttaattgttttacatgtaagaaaacatgcatcagctatattgccccaaattacataactagttatctgtatagctaggtatcagtgaacaaggcattgcaaaaaataatattttctttctgtttttgaataaaagaaaggaggaaataactttttaaaactttttaagttactgaagatcaagctttcctactgataccttggttttatataggaagttctgatacgaaagctataatttgtatgctcagtatcagaaattaactttatttaactctaaaatagtttggaggattatattgtattttatttttccagaactactccaaggttttatgagttgttcatcaaatcaaattaggatcaaataaaataatatgtagaagtgttagagcacacttctacctcaggttacttaatgtagtgttcactatcatttctttcattgatgaattagaagtttgggaaagcagttttttttttttttgacttggtataaatttatttttatttagtttttgttttgtttttcacttagcttaatgcttgctttgctagttgttagaaacatgaccttttatggatcattttacctctctgctcctgagttatttgattttgaaatggggtaattaagaaggttatttgtgaaaatctatgttgaagttatttatactctaaaaagcattataaaagtatttattgtgtaattcaggtgaactttttttagtattgagttcaataaacctaatatagttgtggtgtataaactataatgaaaaagtattaacagtatttttatttgcaattcaaaataaatacatcaagacctaaaaaattcatttcctgctatcattgttaatacttttgttttcctcgtacgaaaagttacagtgtatagcttttgactttctacttgataatttttaaatgaatgattttttacatgttaccagtaagcagttttcagtgaatatacatttctctttaggttggtcctacagctacacaagctatgcaagaatttcttactcgattacaagtgcatctttcttcaacatgtcctcagatattcagtgaatttttgctcaagctaattcatatactttcaactgaaaggtaaatttttgtgtactaatttgttcctgatatagaagtaacatgtaattctccaaatatacttttctttaacatttgttgggaatttatctgtgaacaaataagcaggaggacggtagtaattaagggggaaggatatattggtgtgtttcctgattgtttccatttcatttcattatggttttctcaagtccttatacctctactctctttaatatgaaaggaatacagttgacttgcttttaatggttttatagattagttattataagctttttaaaaggtgaaatttattttgaagctgtttaaactctaaagctaccagtgattttgtatgtaagaaaacctgaaaaatagagcttataaaagaaaattgtatactaatcttgtgtagaaattctaaataaatttattaacaaaatcagactccatgttataagaataaattttgaccataatgggttgattattataatgcatgaatgcttcaatatcatatatctcttattaatgtctttttttattctatatttcttaaaatccaacattactttctgatgaaaacttttttttttttttgacacagagtctcgctctgtcgccaggctggagtgcactggtgcagtcttggctcactgcaacctccgcctcctgggttgaagcgattctcatgcctcagcctccccagtagctgggattacaggcacgcaccaccacacccagctaatttttgtatttttagtagagacggggtttcactatgttggccagggtggtctcgatctcctgacctcgtgatccgcccgcctcagcctcccaaagtgctgggattacaggtgtgagccactgtgcctggccgaaaagttttaatgaattataaagtgttattttgtttttgaagttacaataaaactgagtatttcaaaaaaatccccattaatataaggaatagggctgggctcagtggctcacgcctgtaatcccggcaccctgggaggctgaggcgggaagatcgcttaagcccaggagtttgagagtagcctgggtcacatggcgggaccccttctctaaaaaaaaagaaaaagaaaaagaaattagctagggtgtgggtatacacctgtaatcccagctactgtggagcctgatgcaggagattgattgaaccagtgagcccaggaggtggaggctgcagtgagtcctgattgtgccactgcactacaacctgggtgacagaacaacactctttctcaaataaattaatgatcaggaataagtcagtagtgactattgccacttttttatctaattttattcaaataaacagtatttatacatactttgtgaggattttgtgaaattttgaatgacataattaaaatcccgtgaggaataaagattagtcatcatttgttttatttttcttttaactaggctttttaattttaactctgcaggctttagcataatccgatccacagagttcacaacagtgaagattttcatactaaacttttaatatatttgctctaacattttctaaaggattattaatcttgtttgtagtttagtcacatctaatatttaagcagagatattttgaggtttatacgccacagaaactgtttaggaattttctccacctcacttcaccacacatataccctgtacatttttgtggcctagtttatttaagagggtccacaaagctgtggcccaagaagaatgttagtttatgtttgtttttaataaaggctctggtattctgtgaaagatccagcagctctttagttagattaatgatataataatatacactgaaagaaatactcggtataaagaaggcattcagttttatcagatgagtgttttgcaaatactatctattggtctttggactctgttttcactttattaagtagccttcaaaaagcagaagttttaaaattctagatgtaatctaaattgtcaacttttatgtattttttgttgttgttaccctcctcacacaaagtcttaaataccctcctcacacaaagtcacacagaatattatgttttcttctagaaattttacaattttatgttttatatttaggcttgttattttttgctttcaggatgaagtttttttttttttttttttttgcctgtggatgtccaactgttcctatatctttgtttctttttttgagacggagtctctctctgtcacccaggctggagtgcagtggtacgatctcggctcactgcaagcgccgcctcctgggttcacgccattctcccgcctcagcctcctgagtagctgggactacaggtgcctgccatcacgccctgctaattttgtttttgtagttttagtagagacggggtttcaccgtgttagccaggatggtcttgatctcctgacctcgtgatcagcctgccaaagtgctgggattacaggcatgagccaccgcaccccgccttcgtagaccattttttgaaaatactttccttttttcattggattccctttgtagtttttcaaatatcaatcaatgatacttgttttgatctaattcatacacttttttttttttgagacaactttgctctgtcgcccaggatggagtgctgtggcgtgattcagactcactgcaacctccacctcctgggttcgtgcaattctcatgcttcagcctcctgagtagctgggattacaggcccatcaccatgcctggctaatttttgtattttcagtagagatggggttttgccatgttggccaggctggtctcaaactcctggcctcaagagatccacctgcctccatttcccaaattgctgggtttacaagcgtgagccaccacacccagcctcatttgttcatacagtgtattatatagaatttatgtttttgtctgttttttatgcattacctcactgtcttagttcccttacagtattttttgaaatttagtagtgtaggctctccacctttgttctttatttttagagttattttggctgttttaattccattcctttttccttataaattttacaatcagcttattgattttccagaaaaaaatcattttgagtgagattgcatcattctgtagatcagtttgggcagatgtattgcttgtttggccatattgtcagagaatacggttagtttaatttcctcctttcttatgcatatgtctcatgggttcccctccccccatccagttgtactcgttcggacttcaagtatgctgttgagtacatatggtaaaagttactcttccttctttttctcaatcttaagatcttatgaaacattgtctttcataattagatatgttactagctggagctcttttttagatatgtgatagtaagttgaggaagttccagtttgtttctaacttgctaagaccttaaaaaaattatgaatgtctctggattttgttagatgtttccctgcatctgttgaaatgaacatagattgtttcttctttcatctgttcatacgttgaattatattggtgttttctaaagagttgagatctcactatgttgcccaggctggctttgaactcctgagttcaagcaggctttcagtctcattctgttcttagctggcccaatcggcatatgccactacaccaagtttgattttttttgctaagtgtcagttaatgtgcattctcaaggtagacacccttggtcataacatatcagtccattttataacttgctgaatttattctctgaatttattctgaaagaggttgtgtaatatgtgtattgtcacttacttaagtatttggtagcatttgccattgaagcatcctgtggctagagttttctttgccccaaaaattttcaacttattttctaggtcttggactattcaggttttctcttcttgattgagctttggtaattttgtgaaggaagttgttcctttacattgttgtatttgttagtggaaatatgtatatgtattaatgtttataggatctataagtttccttcatttctgatgttggtaatttttatctttttttggggtcattctggctagaagttcatcaatattatttcaaaaaaaggcagcttatagattatttcttcttttctactttctttgaatttaatttgatctttatggcttagataattgattttagacctttcttttctaatacaagcatttgacaaagtcagaattggtctatatagactatatagactacatacatttaatgtaattattgacatgctggattaaaattgatcattttgctatttttctatttatttcatctatttttgattccttttaagaaatctttttctgttgacttttgaattaagcaacttttaaaataatttcatttccatccttatttataactgaatttcttatttatttttgagacagtgtttgtttgctctgtcgcacaggttggagcgtagtggtgcgatcttggctctctgcaacctccgccttctgggttcacgtgattttcgtgccttaacttgccgaatagctgggattacaggcttctgctatgctactacacacggctaatttttgtatattttgtaggcgtagtttcaccaggttggccagggtagtctcgaactcctgagctcaagcaatccacccgtgtcactggcattacaggcatgagccactgtgcccggcctataaccgaaaatttttaatattagttgtcctagttttacaagatatacctttatttaatcacattccactttaaaatattattccgttcatgtataatgtcagaacttaacagtgtagtttcagttcctttcttccgtcttttgtgacatagttgtcatgtttttactgtttatatatgctataaacacaatactgtgcaaccttttttttattttttatttttttgctttagacagtctttgtttgttttttgaaatagactttcgctctgtcacccaggctagagtgcagttgtgtgatctcgactcactgcaacctcctcctcctgggttcatgcaattctcatgcttcagcctcctgagtagctgggattacaggcccatcaccatgcctggctaatttttgtattttcagtagagatggggtttcgccatgttggccaggttggtctcaaactcaaaagtattcttttgccttagtctcctgagtagctggaattaacagtcacatgccatcatgcctggctaatttttgtatttttagtaacaatgaggtttcaccatgttggccaggccggtcttgaacttcctggcgccacaagtgatctgcccacctggggctcccaaagtgatgggattacaggcatgagccactgcacctggcctaatttgcctttttcttgctgttagactgacttgctgttagacttttcagcattctatatcttaggcataaacagaatttgaagagcattcaattttgatacttgagaatgatttgattgaatcttaatttttatgtatcattatcagtaggaaatgtttacaatagcgttatttgagaatggaaaaaattagaactcatttcattataagaagtgccttgtgattttgaagtatttttgtctgtagcttcaaaatcacttccggatatacttgtcccttagttttgtatttggaagggaggttgtttttgagtttgtctaaaatggaggcaagaacaagaattccaaaagagatgaaaactattagctacctaatgaaatagtgaatatcaagaatttgtttaactttcttgtattgtgataagttactactttcagaactacttaaaatcgtttaatttttaatcctttctcttgttgtatctctctctctctctctttttctgtctctctctctctctctctgcaggggtgctttccagacaggccaaggacctctcgatgcccaagtgaagctcttagaattcactctggagcagaattttgaagtcgtttcagttagtactatttctgccgtgatagaatcggttacatttttagtgcaccactatatcacttgctcagacaaagtaatgtcaagaagtggatcagatagctccgtgggtgctcgagcatgctttgggggactctttgccaatcttattcgtccgggtgatgcaaaagcagtttgtggcgaaatgacaagagatcaactcatgtttgatttgttaaaacttgttaacattttagtgcagctgcctctttcaggcaatagggaatacagtgcaagagtgtctgtgaccacaaatacaacagatagtgtttcagatgaagaaaaagtctcaggaggcaaagatggcaatggaagcagtaccagtgttcaaggatcgcctgcatatgttgctgacttagtcttagccaaccaacaaattatgagccagattttgtctgctctgggcctgtgtaatagcagtgccatggcaatgataattggtatgtattgagaatattaatcttaccattgtctctgatactataactggtttttttttaagcaatatatggattcattttctttttactttatagtgtaaaactgctttaagcttttcatgactgatttttattggtgaggacttctgtttaggggcttcaattaatgaatgaaagtgaaatattgacaaatgtcatgtcagtttggtttgttttctttttattgagatgcctcccaggttcaagcaattctcgtgcctcagccacccaagtagctgggaccataggtgcctgccaccacacccagctaattttttttttttttttaccccgagccagagtcttgctcccacgctggagtacaatggcgcgatctcggctcactgtaacccccgcctcccagattcgagtgatactcctgcctcagcctaccgagtagctgggattacaggcgtgtgtgccaccatgcccctgctagttttttgtttttgtttttgtttttttttttttttttgagatgaagtcttgctctgttgcccaggctgaagtgcaatggtgtgatctcggttcattgcaacctccgcctcctaggttcaagcaattctcatgcctcagcctcccaagtagctgggattacaggcatgtgccaccaggcctggctgattttttgtatttagtagagatggggttatgccatgttgggcaagctggtcttgaactcctgacctcaggtgatctgcccacctcagcctccgaaagtgctaggattacaggtgtgagccactgcgccctgccaatttttttttttgtacagacgggatttcaccatgttagccaggctggtcttgaactcttatttcacatcattttgtgttgaagacaagtattatttgttcacatttgctttaaaaataaaatgtaaaattttactcatactgtaacattttctatgacacaaaccagtgttaaatttatatgctgttgcttaactcttttacctcttggaatgttaatacattacattaaatttttaaaataaatgaacatttgtatactgtggcaaaatccttttctaatatatttttgcctgttggtatttttttctttgtcagtgtgtgagaaacagccacatcttctgtttgattagattaaaaagaatagttacatgctggtatcacatatttttctattcatgtcctctcttcttgatgtatgtagagtgatgttctcagtcatataacagaacaacttatttttattgttggtgatatagaggtattttcatgtaagaagatagccataaaccgtgctctactgaatattgtcattgatattttaatctctaagagtccattcgggttatgtgtagagggtttagacagctattatatattcattcttcagcagttttggaaaaagtgacttttcagcttctatattttaattattatttgtttcaccatgttggccaggctggttttgaactcctgaagtcaggtgatccacctgcctcggcctcccaaagtgttgagattacaggcatgagccactgcgcctggctggatatatatacttttaatgtggtatcttttatttttcttaggagcaagtggattacatctcactaaacatgaaaactttcatggtgggttggatgccatatcagttggggatggattatttaccatactgacaacccttagtaaaaaagcttctacagtccacatgatgctgcagccaattttaacatacatggcctgtggatatatgggcagacaagtaagttcaagccaacaacagttgcagtgattcaaataaatttattgcgatgtaagtggaaaattacaggacaaagataaataagtatatttattatatatcggacaatgaaaagcatcagtacaagagggctgtggattattaataaaagttggagaataaagtttctttgaagtggtattttcagagatgaccacagtgatataagagtaaaacatttaatgtgttcctgagttttagattttttaatatagtctcaagaagttcttctctttttcctaaaagtagcatagtgtaatactgaggtgttctccatagatgttatgtaagaagaagtaatgtgaaatcttttgaaatttatgttgtgtattcagcttcttttttttccattaaaagagattaggctaattaaagaaaataggttacaaaatttttcctttttgtatttcatttttacaaatgaaattgtaggaaccagattattttactttcttgtccatttcccattttgaaatgcagatattagaacagtttcttatgtcttttatatagcagtgtataattatcatttttgtaaacatttgttgaatgtgtatatttctctattagaaaatacaaaggtactttaaatggttcaaattttaaatgaaattggtgtctaaatgcatattaagagaaaagataataatggatgaagacacatgctttaaaaaattctctgagttcagggagatggtttttttattcaggtaagatttcttatgtattttggcagacattttgtatttagcgtatttaaggctgtcagtttacaaaaattaactaggaaggaatattacatgcattgagtttagttcttattcacaggaatatataaagtcataatatgcatatttcattttttagggctctcttgctacttgccagttatctgagccattattgtggttcattttgagagtattggatactagtgatgccttgaaagcatttcatgatatgggtaagataatatttcaataactatcatttaagtgtagttatgtgatagtatgttacattttcatttttgtagtcttttgtggaagtttacttttgatgttgaaccatctgtcctgagatcgatttcatttcatattctttataaatttaggtggtgttcagctcatatgcaataatatggttactagtacaagggctattgtgaacactgcaagaagtatggtatcaactattatgaaatttcttgactctggtccaaataaagctgttgacagcacattgaaaacaagaatactagcttctgagcctgacaatgctgaagggattcataactttgcacccctcggtaagaaaagtgttactaaatcttacttatgtgaaattatctagtttattagctggtatgaaacaaaattagttgaagtcagttgatgatgttatatatcactattttaattacaaacagtttattttagaggtagtggatatctcgacattctacttatgagagggaatgctttgtttgtttgtttgtttgtttgtttgttttgagacggagttttgctcttattgcccaagcaggagtgcaatggcgtgatctcagctcactgcaacctctgcctcctgggttcaagcgattcctgcctcagcctcccgagtagctgggattacaggcacctgccaccacgcctggctaatttttgtatttttagtggagacagggtttcaccatgttggccaggctggtcttgaatgcctgacctccagtgatccacctgcctcggcctcccaaagtgctgggattacaggcatgagccaccatgcctggccgagagggaatgttttaacagttctttagcagtaaagtttgtttttatttgtgagtctaaatagaagcacaatttaagaaactaaacagagattcttccgtaagttttctctttaaatgttaatcaattttaaatctcattttccttcttaaagtggtgctgtgttttgttttgagagagtctcactctcacctaggctggagtgcagtggcacagtgtctcccgggttcaggcaattctcatgcctcagcctcctgagtagctgggattgcaggcgtgtttcaccacactggggcggggggtgggggggtgtttgtgtgtgtgtgtgtgtgtgtgtgtgtgtgtgtgtgtgtgtgtttagtagagatggggtttcaccatgttgtccaggctggtcttgaactcctggccccaagtgatcccccaccttggcctcccaaagtgttaggattacaggcatgagccactgtgcctggccttaaagtagtactatcttttttaaaagttttgaatttaggtatttacttttttatctagtttacatagtttcttttaaatttttcttttcatatttctaaatcatagacattgacatcttagaataaagatgatttttttaaaggtgaaggatatattggacattgttttttacttaaagagtttgaggctgggcgcggtggctcatgcctgtaatcccagcactttgggtggccgaggcgggtggatcatgaggtcaggagatcgagactgtcccggctaacacggtgaaaccccgtctctactaaaaatacaaaaaattagctgggcgtggttgcaggcgcctgtagtcccagctactcgggaggctgaggcaggagaatggcctgaatctgggaggcggagcttgcagtgagctgagatctcaccactgcactccagcctgggcgacagagcgagactccatctgaaaaataaataaataaataaataaataataaaaaaaatttaaaaaaagtttgaaaattattgagctacgtttattgctgtgtctttagttttcgtgtatcatatgagtacaaagtagacagcagttaataatgaacttgtcaccttgccagttgacaggatttcctcatgttttgtgaatacctttacggtcatgcttaggatactaagtgcattaccagcatcaattgttcatgttttcaattaatttttctagtttaattgtatttgtatagattttaaagctttattatgtttcttttgcaagttcttataatttatgtaaaatatcttctctaggtacaatcacatctagcagtcctactgcccaaccagctgaagtgctattgcaggccacacctcctcacagaagagctcgctctgctgcttggtcctacatctttcttccagaggaggcttggtgtgaccttaccattcaccttcctgcagcagtgctgcttaaggagatacatatccagcctcatcttgcatctcttgcaagtgagtaatattttataaagaagcatcatgagaacaagctttaatttagaaatatttgaaaataaaaatgtttagtaagcggaaatacacttaggtgtgattaccagagagtgtaacttctgaacagtttttattgaaataattaatactaccaagtcattttaggagaaatgactgttaacctcagacaaaaagattatgtaatgaagtctaaacaaatatgttccagttatatattatttcgctttctcttttctctcaaatttactaagcttcagtattaagctgaaatgagttcactacacacccattttttaccatgttagttttttcagcccagacctcagtcctagccttgtaatgtgaaattagcatagatttgtgtgcctgccctccaacttctttacaagataactacctttttgaataatattatattttgactacttcagtgtgattttaagattcatactgtgtttattgtaatatgtcagtatccttgtaatattgtatcattcgtttgttgcatgttcattgaatacattttattgaactttgtaaggcaaataattcaaaataatttttacaaaatactatcacttaagagcgtgaactctttcaagtatttataaagaatatgaaatactcatttgcttttttttttgaggcagggtctcactctgttgcccaggctggagtgcagttttgatatatcactgtagccttgacccctgaggctcaaatgatcctctcatctcagcctcatgtatagctgggaccacaggcatgtaccaccatgcctggctaaatttttgtatttttttgtagagacggggttttgttatgatgcctaggctactttcaaactcctgggctcatgggatctacctgccttggcctcctaaagtgctgagattacaggtgtgactactgcacccagcccattttgtgttttatatggttcacaaatgctttcaatatagttataattttgccagaattgtttaaattaatacacatgcttacatttattgattgattctcattgctatcaaatatcactcaataattgcatgaggagctgtgggaaatgttgtagattcctggcatctttggagaaaacaatttttttctatgtgtttgcaagattagactgatatagcttaattacttgtggcatccacactccttagataaaaaacagataatataaaggtagaaggaaaatatgctagtacacggtgttttaggaggtcaaaaataactatattaaaaggcaaatataagtcaatgtaagacttaggctacctctaaaattggaaagagattgcttttatttggaaagcaaaggagtttggtcataagtggtggcttttgaagttcagctggatttttcatatgggaattgaaacaggaagcatattatgaagggggaacccctgtgaaaaattaattggtttaggtgttccctacttaagtgtacttgattacaaaatttggttttattattggattagagcagaagttgaaaatatgttgtgatacagtggaaataacagtctttagaatcaaacatggacttgaatctaaggtgtgacatttcttgtgggagcgtggattacttaatctctttttgctatgtctgcttgtgtaaaatgtagataatactttcctcaaaaggttttgaagtagaaatttaaaaattaacttgactgtctagtaatcagtgtaaagctggcatgtaattccttctttttttaccactgaaattaaaaataaaaccaaatttcaaaagttttagttgacatatttattagatggggttccatgttaagctagaaataaataattttctggtagttcattggggactccttaaatttcagcaagaattgattttttaaaaaaaatcctgtggatatttggtttaatttgaaaaggaggctgggcgcagtgggtcacacctgtaatcccagcactttgggaggctgcggcaggtgaatcacttgaggacaggagttcaagaccagcctggctaacatggcaaaaccctgtctctaccaaaagtacaaaaattacctagatgtagtggcacctacctgtagttccaactactctggaggctacggcaggagaatcacttgaacctgggagttggaggttgcagtgagctaagatcgtgccactgcactcactccagcctgggcaacagagcaagactctatctcaggaaaacaaaacaaaacaaacaaaaaaaaatttctaaactcagctgtgaggttaaactcaatgtttaaaaaaatcacaatctagtagtaatagaataattggtagataaacaagttttattacatttttccccaaattatttaaaatagtaaaccatagcatattaatcaaaggtagttttgtattatttgtgataattttgagtaaaatagaaatgatgacataattacctatttggctggttttattcatagggagcatcaggtacatgtgcatcacacatctttggttcctctttttttaggtgaatattagactgtttaagtataatttttattgtagatcaaatattttgtgttgaaaaatagctccaacattaattatggtgaaagtcattgtcaaactatattttgttgtataagttttccttttacaagttcatgatgaatacaactgtgaaagctgctattttactgggattttaataaactgttcaatctagtatactttgtcttttgtgatgattcagttttctctttttatagcctgcccttcctcagtgtctgttgaagtaagtgcagatggggtaaatatgctacctttgtccactcctgttgtcacaagtggcctcacctacataaaaattcagcttgtaaaagccgaagtagcttctgctgtctgccttagactacatcgtccacgggatgccagcacattaggcctttcacaaattaaattattggggctcactgcttttggtaccacctcttctgcaacagttaataatccattccttccatctgaagatcaggtatccaaaacaaggtatgttttgtttgtcctttttttttttttttttttttttttttggcatggttgggagataggggacttaattattttgtgggttttttcttttttaggtcttaggaaggtctttgttccataggtatctgtataatacaattttattaggtgtaatagagacagttttgtggaaacagaatgctgacactgattaaaattaaggtgtatatatgtttagtctttgagatgatctgtatgctacatgtaggtgtacattgtaattttctggcttgtaattttttgtatcatactctgtttcgggaatttgcaaatgcctatgaccagcctatgacatctgaaccataccaactgaccttagaaacagcgacctagtcttatatggtaattcctaaatgttagttaacagaaggattatgtctgaaccaaactaacaaggacccaaatatattttttaatcaacatttttctgataaattttgacagctggatgttttatagatggattttattgaaagttctgcctgataaaaatgaatttaaggcctggctcagtggctcacacctgtaatcccagcacttggggaggccaaggcgggcggatcacgaggtcaggagatcgaaaccatcctagctaacagggcgaaaccccatcactactaaaaatacaaaaaattagccgggcatggcggtgtgctgcttgggaggctgaggcaggagaatcgcttggacccaggaggtggaggttgcagtgagccacgattccaccactgcactccagcctgggtgagagtgaaactctgtctttaaaaaaaaaaaagaatttaggatttctattttcaaggtgctaagactacacagttttagaagtctatgatagtaatcagtttatcagtatatataattgcatgtaaaagaaagtttctggatgattgcctaaaaaagcaaacccatggtgtctaagtgctatgaatacaagtacttttgtatgtgatttatctttctgtttgttttgagacagagtctcaccctgtcgcccaggatggagtgcagtggtgcagtctagactcactgcaacttctgcctcccgagttcaaatgattctcctgccccaccttcccaagtagctgggattacaggcgcccaccaccatgcccaactaatctttgtatttttagtagataaggggtttcaccaagttggccaggatggtctcgaactcctgaccttgtcatccacctgcctcggcctcccaaagtgctgagattacaggtgttagccaccgtgcctggccatgatttatcttataggggaaacttactgtctgtttacttaatttgcagcattctaaaaaaacatgtcttagattggttaatgctgtttatgaaacacaacatgctgatctttaaaaagttatgttctaccccgaagtgatttgagcgacttatattgatcatacaagtcattttgtattttcagtattggatggttacggttattacatcattgccttactcacataagtgatctagaaggaatgatggcaagtgcagctgcacctactgctaatctgctgcagacttgtgcggccttattgatgtcaccttactgtggaatgcattcacccaacatcgaggttgtgcttgtaaagataggactgcagtctactagaattggcctgaagctcatagacattctcctgagaaattgtgcagcatcaggcagtgatcctacaggtgataattaactttgatatttaaatgtttacatatctgtaaagtaacagcagttgaactgtgcgatcttcgtgcttaactctgttttgggaattattttttcttttagtttatgtttatctctcctctcttctctgatggagtctcactctgttgcccaggctggagtgcagtggcgcaatcttggctcactacaacctccacctccctagtagctgggattacaggcatctgccaccacacccggctaatttttgtatttttagtagagatggggtttctccatattgatcaggctggttttgaactcctgacctcaggtgatccacccaccttggcctcccagagtgctgggattacacgtgtgaaccactgcacccagcctagtttcattatttttagagtttgttctgtgttgttggaatttatggaagcctcatttttaatgaataacttaattcaattaagtaaatcttcccatggttaacttgcttatttagcaaactttttctttggattctttgttgcaagatttgaatagtcctttactttttggaagactaaatggactctcttctgactctacgatagatattctttaccagcttggaacaactcaggatcctggtacaaaagacaggtacgattttatttttcatttaattaagcacacacatgcacataatcatgctatagtaaatgtttctgacagtttttccttagatgatctcataaaagacaatactgtgatatattgtatgtttaccatatgcctcacacgatgtaacttctgcaagtattcatgaacattagacatacatttgtatgtgtttggacatactttaagcaaatttgaacttaaatagaattctttgttaatactgcttttgaggaatggaataaaacatatatttttaagttggctacgtgtgaaaggaaccttgtaaagtgatggtatcagagtcatactgtcttaggtagtactttatatgtgtatatgaatgtagggatattgtgtctgtagttggtacttcaactgtttttataatggttctgtttatttattattgattatcgtattcatcgaaatcttttcatgactttctgcaccctttcctgctgtttacagaatgaaacaatatcataacatgtaaatgacatttgaacacattggctaaatatttagtgatttttttcttttcttttctttttttttttttttttttttttttttacatttaggtaattttaatgagttgtcctaatgtcattctaccttgatgtcttctacttccaaattgataccaacttgaatttttgtttgttttgttttgagatggagtcttgctctgttgcccaggctggagcgcagtggtgcaatcttggctcactgcaagctccaccttctgggttcatgccattcttctgcctcagcctcctgagtagctgggtctacaggcgaccaccactatgactgactaatttttttttttttttttttttttttttgtatttttagtagagacggggctttaccgtgttagtcaggatggtctcaatctcctgacctcatgatccgcccacctcaggcctcccaagtgctgggattacaggcatgagccaccgcacccggccaacttgaagtagttttgaaacatatttttgttgataaatttttgagcaaatatttggcattctctgtttttatgtgtagcatccatattagaaaaacagagagatttcttcctgatttatgttactttttaatattttgattaattatgtttaaaatgaagtcatttgatgttttattaatatctttataaattattaaaattatggattacatttaaacatagattgcaattgtttttgatgaagtgaataacaatttgtgccaaatttgaatcataatcgttagtagtggttaaaatatatttaaaatatcagtgttaaatatttttccagaacaggttgcttgaaatctgttaggattatttaatttttaaatattgttgtggctttttaataagaagaaaattaagcttaattcattttctctgcatagtactttttaaaacatgaatgtttgttatataaaactgacattaatgacaaggttgttagactgagaaaaatgtcttccttgtcttctgaattctctttattccccatcatgtgaaattgaaagtcttatctttcagaattagtattatataccttcctatccctgtttcttttagtgtgaagccaagaatcttatattctgaaatagaaattgaaggaaaataaacaaaatgtaaacacagtgttttaagaacttgagaaatctaaaagtctttcgctcccaggttgtggttcaaaattgggtgtgttttactggttcccaactccaggagattgggattagtggggttagttgacctataatcttgttattaatgttagttctaaatgacagatacctgtatttttaaaagtactatgcagagaaaataaattaagcttaatttccatcttataaaaattatacttaaaaaaaatatgtaagtgttgagagtgtattctgttgtcagaatgaatgagtgtgggtggctattactagtatttaatgctagggtccagggatgtgaaacgtgctgtatttcatgagactttgcacaatgaagaattagtcccagatcactgttctagtatgttatctcaaaccttttgatggttgaaattggtaaggttattggaaaattggaactggaactagtatgtctttgttgccgagagatttcctttttttcctattttagattaaaataatcaaaaacaattagtgcattattctcataaataccctactcaccatgcagagatggtatttatctatatgaaatgccaattgcactatatagttggttatatgaattcgttttcttcgtttaagaattcaggccttgttaaaatgggttagtgattctgcaagagtggctgctatgaagagaagtggcaggatgaactacatgtgtcctaactcctcaacagtagagtatggtcttctgatgccatctccttctcatttgcactgtgtagcagccattctgtggcatagttatgagctgcttgtagaatatgacttaccagcactcctggaccaagagctctttgagtaagtatgatttgtgaaatcttttttatcccccagtactagatcagttagtgttcacttgataaaacaaaatattttacatgtttattaggagaaacataatattttgaaagtagcaaatataatcaagtatacttttgaaatgaattgtcaaatattaatttatctttgtgttttaagaagatatgttagcagtactgccttcttttttttaacctaaaattatgcttaatgtagatgttgctgtggttcatagtgtttattctcagttgcaaattttcccaccagattatctttaatgtacaactctggcaggatagtacagctagacaactttgggggtgggcatggtggctcacacctgtaatcccagcactttggaggccgaggtgggaagatcgcttgagtcaggagttcaagaccagcttgggcaacatgcaaaacgttgtctgtacaaaaatgcagaagtcagaaagctgggcacagtggctcatgcctgtaatcccagcactttgggaggccgaggtgggcagatcacgaggtcaggagttcgagaccagcctggccaacatggtgaaaccccgtctctactaaaaatagaaaaactagcccggcgtggtggcgcgtgtctgtaatcccagttacttgggaggctgaggcaggaggatcacttgaacctgggaggtggaggttgcagtgtgctaagattgcaccattgcactcaagcctgggcgacaagagcaagactctgtctcaaaaaaaaaaagtcagccggacacggtggtatgcacctgtcgttccagctacttgggaggctgaggcgcaagaattgtttgagtctgcagaagttgcagtgagctgcgctcacgccactgtaccccagcctgggcaacagagcgagactctgtctcaaaaaaaataactttggggagctgagatgggaggatcacttgaaacgaggcgtttaatgccagactggctaaaatagagagaccaaatctctacaaaaaaattaaaaattagccaggcatggtggcatgttcctctatccctaactacttgggacgctgaggtgggaggatcacttgaacccaggagttagagcccacactgacctatgatgatggcaccactggcactgcagccagggcaacagagcaagacgtcatctcaaaaaagaacaaaaatgtaaagctagaaaatttgagacttttctagattgtccttttgacaagtagtttttatttacccacatttcttcaccatatttagctaagtctttgctgaacttactgatagctaactattaagtctgcagcagaatacatttttgaagagttcctgtgacacataaaaagtaggcctattgttctctggtaggtcatcatatttggccttagcgattggcataatccatgacttaattactgagcctcactggtagttttttatttgcaaacatgaatttaagccatttgtcatgtggaatttaacgtaaacatttgtttggcatgatttttttgtttgtttgtttctctacatgaccttttcaggtcacacagaatgatagaaccattttaaaataatttacttgattttctgtactcattgacaagtctaactcaacttgcattgtacctacattcttcaattttaaatatatatatgtgtgtctatatatatatatatgcagtcttaaatcttacaatgttttattattcaatgtcaaataaagtatataatgtcagagtatactttgaactataacagaaatatttgaaatagtttcttctaaaaatatacttgtatcattaatatgatatcttttattttttaggttactttttaattggtccatgtctcttccctgcaatatggttttgaagaaagctgttgacagtctactttgctcaatgtgtcacgtacacccaaactatttttctttgctcatgggctggatgggaattacccctcctccagtgcaatgtcatcatagactgtccatgacagatgatagcaaaaagcaggatcttagttcatctttaacagatgactctaaaaatgcacaagcacctctcgcattaactgaatcacatttggctacccttgcttcctcttctcaatctcctgaagctattaaacaattactagactcaggtttgccttctcttcttgtgaggagtctggctagtttctgctttagccacatttctagctcagaaagcattgcccagtcaatagatatttcccaggacaaactcaggcgccatcatgtcccacaacaatgtaataagatgcctatcacagccgacctagttgctcctattcttaggtttttgacagaagttggcaatagccatattatgaaagattggcttggtggttctgaagtcaatccactatggacagcacttctgtttttattgtgtcactctgggtccacttctggaagccataatttaggtgcacaacagaccagtgcaagatcagcttctctttcttcagctgctacaacaggactgactactcaacagcgcacagcaattgagaatgcaactgttgcgttctttctacagtgcatttcatgccatcctaataatcaaaagctgatggcacaggtaagacaaaaaaataacttacattttagttgttttattacataagaaagggccatgtataaaggccaggtaataataaatttagtgagggttgagtgcctttaaggatctgaatttaagctataaagtactgatatctcctttctccccctcaaaatatgctgtcactggaatcacttattctttatgatgagatgactagcagatgcattgggatgctagctagatcatacaacccttattttcaaaaatttctacaaacaaaaagaaaaagcccaaaaaaacatttcagctgctggaacagtatggacactgatcactgagtactgtatgtgccttgaggcattgtgtttttgtgtaacgagattgccatactgatagtttgcttctctttacatgggcattagattaggtttcagataggagactccacataaatcacatacaaaatgtggaagataggctggttgtggtggctcatgcctgtaatcccagcactttgggaggctgaggcgggcagattgcctgaggtcaggagttcaagaccagtctggccaacatggtgaaaccccatctctcctaaaaatacaaaaaaattagccgagtgtggtggcatgtgcctggaatcccagctactcgggaggctgaggcaggggaattgcttgaatcagagaggtggaggttgcagtgagctgaaatcttactactgcactccagcctgggcgacaaagcgagactctgtctcaaaaaaaaaaaaaaaaaatgtggaagataatttatcatactgcactccagtctgggtgacagagtgagactccatctcaaaaaaaaaaaaagtggaagataatttatcatatattatgattatcataataagctgggtgtggtggattgtcatatattatgataatcataatttattatttatcataataaattaaatcctgaaaggtagaattatttcaagagtaattctagttggctttttgccaaattttgcttttggttacctcacgtgaccttgggcatattggttaatcttataacatggggctagcaatacctgcctcaaggattttttgagacagttaaatattttaatttgtgtaacatacctagcatagagcctatatgagatatggtagacactagtaaataacttttctccttgttatttaatagtgctcattcaagtcaaactttagtagtacctagaaaaatagataatataatttttataaaatattgaaggagttagttttattaagaagaagggcaggtcgggtgctgtggcttatacctataatcccagctctttgggaagccaaggcgggtggaacacttgagcttagaagtttgaggccagttttgacaacatggcaaaacctcctgtctaccaaaaaaagaaatcataaccaaaattagccgggcatggtgatacgtgcctttggtctcagctactcaggaggcttgaggtgggaggatcacttgagcctaggaggttgaggctgtagtgagctgagatcacaccactgccctccatcctgggcgacagagcgagaccctgtctcaacaaaaacctaaacaaaacagaggaagaagagaaagatattttactgcctgtagtaattaattactgggaaaatatctctgctaaatatgcattaaaaggaaatgcttaaattaccaacttcacccgagggcatgattctaggtatttgaaaatttggtttgtgcttctgggtagcatgaactctttgtgtcccattgatttctctcttggtttcttagtaaggctttatatacattttgggggtgaggtggggcaggatctctctctgttgcccaggcctgtagtgcagttgcacaatcagtgagccgtggctcactgaaactttcgggctcaagaagtcctgcctcagcctcccaagtagctgggactactggcacatgccaccatgcccagcttatttttttttggttgggggagtgggtagagacagggtttcaccacgttgcctaggctggtctggaattcctgggctcaaatgatctcttctcttagtttcccaaagttctgagattatcagcatgaccttggccttgttatatatttttaatatgctttttctcataatttttattttaagataaccacaccaatattgactaaagttaacgggagttcgttatgctaggtattcattatgtgcaaaccgtttagtactaattttttctaaccctggatacgtttcttacacttttatctcctttggtattcatatattttaagataaaatcatttctttcctccttaaaaaaaaaaaacttaactactagacccccagagacatttgttctttagctactgatttgatatgttaaaataaacttattcatattttctgtttcctttttatctttcaaaataaaaagctgcatataaatcttgcatttaactttttaaatattttgtcttgccaggttctttgtgaactatttcagacatctcctcaaagagggaaccttccaacatctgggaacatttcagggtttatacgaagattatttttacagttgatgctggaagatgagaaagtgacaatgtttcttcagtctccatgtccagtgagtatttaacacttaatcattggctgtgtatacatgtattttacaattttgtatcagagcctgcagttacctcctatgttctaacttcgagtatagcaaagtgaaactagcacagcctttatacctaatgacagaacttgacaatttcaggatagcgctctccctcatgcctaggaataacataattttaccttagcctgagaagtatagtttgatttgtggaaaaaaatgaaaaaaggtacagagtgataatgcaaaagttgaccaacaaatcatggcaactatgccatatctaaattaattatatcttgtaggatttattgagtattttattcttagatgcttttgagattattttataacaatatgtattccaaaaagttacttcctgatttctttgatttcttgattttcagctgtacaaaggtagaattaatgctactagccacgtcatccagcatccaatgtatggagcaggccacaaattccgtactcttcatttgccagtctcaacaacattatcagatgttcttgacagagtgtcaggcaagtcagatttaagtattagtttttgtttaactttatgtttgatgtatatggaggtttattgtttttataactttattttctgcatccactttgcaaccattgatgactaggaaagttcaagacatctttatagtttgaagcataagaagccagtcaagtggacaaaatgtaaaatacttttaggcacccctaattttttggtttattgtgtcacagtgagaaatgggcagctagaaatacagacaaataattgatggcatgttctcacaataaaccatctggtcattttatactagattaattgcaggatatttggttgaatagcaagattctaattaatacacatttactaaattgaaggtggtgatcagtgatcaagacataaatggagtaggtagaattgactggtcacctcattgtttatcgtagtcagtgaagaaagcagacagaacattttcccctaggttcttgcctgtattttataggatgatacctttaaacaacatatgggatagttttttaaaaagcagtttttgatggcaaaggcatatcaactttttattttatttatttatttaattttgagaggggggtctcactctgtcacccaggctgaagtgcagtggaacgatcttggctcaccacaacctgtgcctcccatgttcaagcaattctcctgcctcagcctcctgagtagctggcattacaggcatgtgccaccatgcccagctaattttttcatttgtttagtagagactgattttcaccatgttggccaggctggtctcgaactcctgacctcaagtgatccgcccacctcggcctcccaaattgctgggattacaggtgtgagctaccgcgcctggcccatatcaactttagatagttggagtgtattgccactgtgaaattctggttaatcagtgagtgaacttgctgagcatctgcaaagtgcaatcactataatttgtcctaagattataaacatgagcaagacacacattccacctcacaagatagttgtgatcttatgtctgttgtcaacttctaaaataaactagaaatgtctgtttgcattataacatgaatataagtagatatatttctatctgtatacataagaagggacctaagtttttaatggaagctgtgaactgaagcaagaataggagtatctaagaaaaaagttggaaatgtctatcagttaaaaatacaaatctaaagcccagagtaaaagagagagttaaagagatttgggagttgttaccacacatagatggtaagtgaaaccatgtgaatggatataatcattataggtaggaaagattgttttctgcttcacaatcgctgtgtctaatatgcatgtgcataaaatcgtaattctttcctaccgttttacaacttatacaataggttgttagcatactgttataaatattaaaaaaaatttatttgaaaatgactgccttatctgttacagagaaacttttttgaaaatttgatgttagacagtattttctatcagtttcctgaaattgtccattctacatgatgaagaaaaatgaaaattaaaaagtaaataaatgggccaggcttgttggctcacacctgtaatcccagcactttgcgaggccaaggcaggtggatcacctcaggtcaggagtttcagaccagccctgccaagatggggaaacacatgtctactaaaaatacaaaaattagttgggtatgatagcgtgcacctgtagtcccacctatctgggggactgaggtaggaaaatcacttgaaccctagaggtggaggttacggtgagccgagattgcgccactgcactccagcctggacgacagagcgagactctctcaaaacacatacaaacaaaattaaataaatgaagaaagtggggaggagcactgaagctcagttattgatattgatatttcatatgtttaacttgaagtgcaaaagtagacattctaatacaaaataactgaaaattgaacattttaattagtctttactgtggaagaatgctattctaaaacattctagcattcaaaatattttacaaaatagttttctgtattgcataaaaataaaagctaatcgctttggaagtacacgacctcaaaagttatatgtgctgaatgtaacctacttagcgattttttttggttctttaaagtggatttatactctttagccatattttctgatatatttacttgtacgtttatattagatcaacatgtataagaataagtaattcagaagtattgcctcagtaaatttacctgctatctgtagcttttgacagtatactttctttttttttgtttgagatggagtctttctctgcattacttgagcccatgagttccagaccacctgggcaacatagcaagacctcatctcaaaaaaaaaaaaaaaaaaaaaaaaaaaaagcaaagacaacaagagaatattaaaactggccaaaaaggaagtgacctattattttttctctctctctgttttttttgttttttgttttttgttttgagacggagtctcactctgtcccccaggctgtgcagtggcgcgatctcggctcactgcaacctctgcctcccaggttcaagcaattctcctgcctcagtctgcagagtagctgggattataggcacgcgccaccacactcggctaatttttgtattttttttttttttttagtagagatggggttttgtcatattggccatgctgatgtcgaactcctgacctcaagtgatctgccttcctcggcctcccaaagtgctgagattacaggcatgagccaccacatcaggccgacaatattactttcaaataataacctttatgtgtcagtctgtttgcttttacaaatttctgtcactggttttaagcagtatgatgattgtgtgccttacaattttttcttcacatttcttatgattagagtttgtcgagtttcttgaatctgtgtgttttagatttcactaaatttcgaaatattttggcaattatttcttcaataattgcctcccctttttttataattacagttacttattaggctgtatgaagttgtttgacaccccaaatctgtgtttcctcttttcccccccatcattttttttctctatttttaaattttggataatttcctgtgtctgatctgttagacgttttatatctccttgtccttacttaaagtgtataggttttcttcagctttcttgaacatagtagtctgtttgtactatttttctcttccttatggattgtatgttctcgcttctttatttgcctggagaattttcttggatgccagacaatgtaaattttactttttggggtgctgaatattttgtattctaatatatatattttattttttcatgaaatataatgatattatttgaaaacagtttgttgcttttagacttgcttttaatctttgtaagtaggatcagagcagcttttaatctaaggcaagacttactgtaattattggtaatttttataaaccaatgttgtctagtttggtaactgttaagcacatgaaatgagactaagaaactaaatttttagattgaatttttaattttaatgaattttacctttaaatatgtacctcattagaatagaattaaggtaccaggtttgaaaatgcagttctaaatcccatttgaccccactattaaggctctgtccttatgagtactctgttaggaattcactagatgtctaagagcacaaagcattttattccctgaaaccctggggttgcttgccctgctacttttcgatagtacctttcctggccttcagtggtttgctcacataggttcgtcagtacatgttgaagtcttgaagaccctgtatagatctctggagatccagggatctccagatctctagatgcaaatctgcatagatgcaaatattttcttcctggatttccggctcttacatcctcagtctagggtgacaactaggttgtgctgagctgtggcctaggaattcttttccagacagctcacacaatcctaggggtcacctcattggtttccacttacccaggcatcactgccctgccctgcctgatactcagtgtctgaaaagtattgttaatatatatttctagttaaggttatttcacgtgggagatgaacctgatccttataattccagaagtggaattctaaaacagagcagctttttgcatacgttcaagtacagagaaaaaaataaaacagaaatttgtattaaaaaataaaaaagtaaattaatattagaaaccagagcatttttaaaaggaagttgagaaatttttttttagtgtttgaatggcatttattctttatatttacttttgaaataagggtaataaatgaaaattggctaaacttctaattgcactaagtaaattattacctaatattctttgtgtgcttttcttacctgattatgctatgaattaattttgtgaatttcttattatttaaatgtttcactctgacctgtgtcagtatgtttgccatttttagttgcttggttgtttttgttagaaagtaaaatgtattgttgcaccatgcatttgttatgtgtataaaattttttacttcacaaaactgtctataggcaattagcaattagtattaagaagttgtataaattgaaatcactttcatatactaaaaactgtaaaatgagagttattacaaaagatgttgtttattgttttattgtctcaacctttttaacataaaagaccgggtcataattgtgctaaattagggaagtaaaaagagaattgagctagatgcagtggctcatgcctggaatcctagcactttagtaggctgaggcaggcagatggcttgagcccaggattttgacaacagtctgcacaacatggcgaaacctcgtctctcctaaaaatacagaaattcatggcatgtgcctgtggtctcagttacttgtgaggctgaggtgagatgatcacttgagcctgggatgttgaggctgcagtgaaccgcgattacaccactgcactccagcctgggcaacacagcgagaccttatcttaaaaaaaaaaaaaagagaattggagacttgataacagttatatagtgaaaaaaattaaaatttcaaatcaattcattcagcctttaaatttcttaataactaaatcacattatatgatcacccatttattttataatttttagtggtgtgctgtatgccacagtaatgaaaggaatattcagagtaataactatctatgagagcccttaatactcattttttaaagtaaaacacattaaattttaaaacatattactttgttgtctaagattcctgtttttgtcctaaataaaaattaacagaacaggaaatctgttacagaaatttgttcttttatactttcatttgtaatataagcagaagtctagtttaatgctatagactgaatcttgagcttgagtcccatatttgccatatacagattatatcagtagcctttctaaggctgtttcttcattttgaaaataacattcatttctatgttgcgaggactgaattagatgcagttgccaagcacattgaactatggctaaaataaagcaagttttcatgctactggtttttcattgtttctggaggtggtaccattaaaatactgtatataatactttacagagattagaacttaaatattctggcttaagtacagtggtgagtcttcctcatcaatgtcagtaaagattgggtatcaggcctttacctcatgccatttctcctaaattcctttatattgccttagtattaaggataatattatcttgcataatcttcctctgaaatatttattacttcccttcttaatgatttggaaaagcagtgtattttagataatatcttcttacagatactccaagtatcacagctaaattaattagtgaacaaaaagatgacaaagaaaagaaaaaccatgaagagaaagaaaaagttaaagcggaaaatggatttcaagacaattacagtgttgttgttgcctctggtatgctttctattttttataatcttgattttgtttgggtttctataaaatattagaattttagttacaggaaatttatgtaatacattgtactaatataaaaagctgactcgtaatgatgttttaatactagatttttatctttttatttttattttttttcactttccactaaataggttgtcatctgtatttcagagattatagcagctagctacagtttttactttttaggaaaatagttacagatgcaatgccaaaattatttatttgttgtcatgaaggacgaatagaattgggagattagatattggattagaaggaacatttctgttttctgacattagctaggaatgcatgccttattaaaatattttaggaacactgttttccttcatattagtgtgttgactatgtagaatcttactgatccttttcttttagggctgaagtctcaatctaaacgtgctgtgtcagctacaccacctcgcccaccatccaggagggggaggacaatacctgataaaataggaagtacttcaggagcagaggctgccaacaaaataattactgtcccagtgtttcacctgtttcacaaactcttggcaggtaatattcctcaatgaataaacgtcaaagaaattttagtagccttaaaactatgtaaatcagaggcacagtcaccaaaatcattttaatcaggtgccattgatgagatcagtgagttagtgagacttcttccatacagttcctccgaagagaagtgagagcaaaggaggagtaatctattacatatcctttttaacactatcaagttatttatttctactttactggttttctaagtttttctgtcagtgtgccatgaaatgattgatgaaatagacatttagagagttcatgacaagttatttaggaaacaccgtggggcaaatttgtaggactagttcaagcagtagaactcttagaccactggtagttaagccatatgttcttcccagataaaacacatttattgagcaccatcctgtctgttgttcaaggtgataacaggttgagcatccctaatccaaaaattcagtatctgatactttttgagtgctggcatgacacaagtggaaaattccacatccgacctcatatgacggttacagtctaaacacaggcacacaacacagttttttcagtgtccacaagaggaaaaagatcttccagcccccttcagatattttttgagcatgcccgattcctccctacatatccacagtgggtaacaaaactgcaaatgtgcatgccagacgtgccaacagcaggtttcccacgatgccccacatgatgccaagatgtgtgtgcattactgtgtttttttgctctgtggtgttggaaatttaaaaaaggccccagatacccttatgggtaacaatgataaaaagaggaagtatttatgtttatctgtagcacagaaaaacaagctgttggagaaactggacagcaatgtaagtgtgaaatgtctttcaagagagtatggtgttggagtgaccaccatacatgacctgaacaaacagaaagataaaccattgatgttctgtgctgcaagtggtgaatagaggttaatgaaaaatagaaaaagcactccatgaagctaaaaatgaagatattgattgtgtattgaaacagtgaatccatcagtgttggcagtgaacacgtgcctcttaatggtatgctgatcatgaaacaagtaacgatctatcatgatgaactgaatgttgaaaggagctgtgaatattcaacacactggttgcagaagtttaagagaagatacgacattacatttttaaagatttgtggtgataaagcatctgatgatcaggaagcaatggagaagttcattgataaatttgccaaagtcatggctgatgaaaatctgccagaacagtttataatgctgatgaaatatatccctgttctggtgttattgtctcaaaaagacactgggctacagttgatgggacagcccctccaggaattaaggataccaaggacagaataactgtcctgggatgtgctaatgcaactggcatacataagtacaaacatgctctgataggcaaaacctttcacacttgttgttttcaaggagtgaatttcttaccagtccatggttactctgacacaaaagtatggatcaccacagacatcttttctgattggtttcataaacactttgtaccagtggcttgtatgtactgcccataagctagactggatgatgtaggagtttgttattccttgatatcacccaattcatcctccagctaaaattctcaaaactaatgtttatgccatgtactttccctcagatgtgacttcattaattcagccatgtgaccagggtatctttagatcaatgaacagaaaatataaatccactttcttgaacagcatgctggcagcagtgaacagaggcatgggtgcagaaaattttcaaaaggagtttagtataaagaatgccatatatgttgttgccaatacttggaacacagtgacaaagacacagttgtgcatgtctggcacaacctctggcctgcaactgtgtttagtgataatgatgaactgtgtgtgtgtgactttgaaggattctgtatgtcaagtgaaaaaaaatgatgtctgacctccttacatatgtaaaaaatataccttcagagttcagcagtaagctggaagaagtagatgtcaaagaagttttgaactttgataataatgcttcagttattcattcattgactggtggtaaaatagtcgaaatggttttgaatcagggttatgatagtgatgaagaaggtcaagataacaccacagaaaaggtgcttatagaagaagacatggtgaaaatgtatggtgggcatattgaaggattacggcagcgtgcattaacaacagaatgaaaaaccatgtcagtttttaaaattgaagagagacttctgagctaaaaaccatgttaatgaggcagatgactccacaagaaccatttttaaaagccttccagcagaatgtctcttcatcccccgtaggatccacttcctggtccctcagctgcttctgatgtttcttcttaactaaaaaacacagtttatagtaacctttgaataaaaacacagcatcataggtgaagactgaaagcctgctgttgtttgtagctgctttttcctttttttttttttgagacgtagtttcactcttgttgcccaggctggagtgcaatggcgtgatctcggctcactgcaacctccgcctcctgggttcaagcagttctcctgcctcagcctcccgagtagctgggattacaggcgaccaccaccacgcctggctaatttttgtatatttgatagagacggggtttcaccatgttgaccaggctggtcttgatcttctggccttaggtgatccacttgccttggcctcccaaagtgctgggattgcaggcatgagccactacccccggctctgtggttggttttgtttaatagctgaaacaggtatcctggtgatgctactatgctgcttagttgtcctgacacattattttttcagtgttaatggtatgtcatatttttactgttaagtacttaatgtatgaataaatgtaagaaaacaattgcctattgttagcatgtagattaagagtcaggaatgatgactcttgttgacatgggtggctgagatagtgacacctttgctttctgatggttcagggtacacaaactttattacaggcacaaaattatcaaaaatacggtataaaattaccttaaggctatgtatataagggatgtgtgtatgtgtgtatacacacaaaaataaattttgtgtttccacttggatcccctccctaagataactcattgtgtacatgcaaatattagaaaatgcaaaaaaaagaaaaaaaaagaaatctgaaacagttctagtctcaagcattttggatgagggatacccatcctctattttatcaccattttcatgctgtattaaaatgaaattgccaactcagttcaaaggaatttttcttcttagctttacattgttgattcatggtggaggcgaacaaactatcgactggtgggttggataccttggtccagagaggtccttgtgacatatctcatggcccattacctaggtgatgtgagtcttgccttctgcctgcaataaagttttgttggaatgcagctatgcccatttactagtgtattgtccatagctgcttctctgctacaatgtagattagcagttgtaacagagactatatggcccccccaggttaaagtatttattagctgtccttttatagaaaaaaatgtcccacatcagatttatggaaatgtctgttcctttgtttacgttttgcccatgactttttaacactttcacagacattattgttcattattatatgtcagaaataaactcactttttgtaaactttccaatggctgttgaattttttaattgttttgaaattggtttcagaatcaaactcttgcctgtaatttagtaaaagcagataataattaaaccaagtaaatgtttctttctcggtttccagatttaacttagttatatcattttaggccagccattgccagctgaaatgacacttgcccagcttttaactctcctatatgaccgaaaacttcctcagggttaccgctcaatagatctgactgttaaattgggatcaagagttataacagaccccagtctatcaaaaacagattcttataaaagactacaccctgaaaaaggtatgtgcataatactactttaaaaattacagactgtcatacaaagaggcagagatttctatagctaatgacttaattgacttgtgtttttattatatcaacataagatataatttttttatgactgaatttttgtaaatataaaaaatggccattatttcatttggaaactaagttgcattatttcttataacatcatttgttttatgagcgcatgtactttaatttctgatatttctgtgagagctatgtgaattgtcattttataataaaagtgagaaactcaacttacaactttgttataatttatattgagtggcatttcttgcatataaacatgttttctcatataattgggatcacatatttttgttttttacttatatattccattaattttttttgagacagagtctttttctgtctcccaggtcggagtgcagaggcacgatcttagttcactgcaacctccgcctcccgagttcaagtgattttcctgcctcagcctcccgagaagctgggattactggcacccaccaccatgcctggctaatttttgtattttttgtagagagaaggtttcaccatgttggccaagctactctgtaactcctgacctcaacttatctgcccgcttcggcctcacaaagtgctgggatataggcatgagccaccgcacccggcccttatattccattaaatatttttgaatatccatttttgaattggctattttttcataaaaatgtaagaaaatttatttgttccccaatcatcgaaacattgtggttgtttccaattttttactcctataaatgctatataagtagttttcatagtgtgagtatgatatgaacttacttaaactttccatctttctcatgactaaaattcagtctttagttattggtcttttgtattcttcagcaaattttggtacattgtctttgcccagtttttcagcacgattatttctctcttttgttttaatgtttaaagggtctggttacgtgaccttttggttttctttggtgagtaattcagagttaaactaatatggtataattttttgttttaagtaagggaagtctttgtcattaatttttcttaataggatactttagagcatattatttgctatgagaactttgagaacttatttattttaacataggatatacgttaaagtatgccctaaaggacagtgcttctcaaacttcagtatgcttacaaatgaccagcatcatactgttaaaatggagattcttcatttcaaactagcttgcaggtgatgccaatactactagtccatgaaccattcttccaataacaagactaaagaaggcagtatcagaagtcatttaaaggtcattgtaccgtctagccataatacagctatatctaaataaatgatgttttgtgctcttttttgagtagcaagaaagcagtaatacctgcttttgtaaatgaaagaatattataaaaatataccctttcttacctattcagttatttgtaatttattgtctagatcatggagacttacttgctagctgtccagaagatgaggctctcactccaggtgatgaatgcatggatgggatactggatgaatctttgcttgaaacctgtccaattcagtcaccattacaagtttttgcaggaatgggtggactggctcttattgctgaaagactacccatgctatatccagaagtaattcaacaggtaagataagatttcctaatcgagtatatcattccatagctaagcccttcattctttttaatgtttgttttttaatgtacttggattaactttgtagaaataccctttgctttatattttttgaacattatataactctttcaatggtcagtctgtacagagcttcatgaccttcagtaggtatggaagaaatgttgaagatcaagcacacttgccagacttactacactgttgcatttatcttgatttcatggttgtaacactagcattctcttttctatgctgctttaagtgtgatatttattagagatattattggaaataggagaagtaaaatagcagtgtatactgccaccaatatatgtctttttgtttaccttttattcctgtttcaggtgccatttccatttttggtggtttaaaaacatgacctattcccgtgttcatttacgaagctgtcaatgtctgtgctttccatgctcttgtatcaatcagtaggaagtatggtgcatggagagttgtaaaaacaaaactttgtgtttgttgaatgaagtaggggaattattctctttgatttcatgtcgtgtgtgtgtgtgtgtgtgtgtgtgtgtgtgtgtgtgtgtgtgtgtggttattttggtatagtagctctagactctattatagtttcctgagctgctgtaccaaaataccacaaacgggctggcttaaaacaactgaaatttattctcaatagttgaggaggctgtaagtctgaaatcaagatatcagcagggccatgctccctctgaattcaggctgtagggaagactccttccttgcttcttcctggcttctattggttgccagtagttcttgctgttcattggtttgtagctgaatcactttaatttctgcctacgtcgtcatatggccatctttcctgtgtgtccttgtatctctttctccttataaggacaccagtcatttaatgtagggtcctgcaaaccattatctcctcatcttaacttgattacatctgcaaaggccccatttccaaataaggtcatcttcataggtgctaggggttaggacttgaacatatcttgggaggacaaaatgcaacacacaataatacttattcatgttattgcttccctagtattcaaaaatataagatgatataactatgttataaggtgattgacacagaatgagcaaaattttcttactagacaatgacataattactcaaaagtttgaagcagaaaagaccccaacattttcagcattattattgctcaacataaatgattttttctaatttagtattcagtgtggttcactatattgattagtaactggaaatggggtcctggtaatacatacctaagaatgtgaaagtgactttagaattgggtacttggcagagtatggaataattttgagtagcatgatttaaaaaaaaaatctagattaccttgaatagattgttagataaaatgtggatgataaagcttctgccagtgagggcccagaaggaagtaaggatcataggggagaaaacctacagtgtcttagagaatatctgaattgtcataagcagacttggtagacatacaggtgtttaaagtgctgacaaggtggtttagaaggaaatgaggaacatgttaccggaacctgaaggaaaagggatctttgtcatatagaagcagaactattaactcatttgtgtcctaaatatagaaagcagcacttctgctgtaatgaacttggatgtaatgaacttacatgtaatgaacatgtaatgaacttggatgtttagctgagatttccacacaaagtggtgaaagtacaacctgtctttttcttgctgcttatagtgaaatgtgcgaggaaagatataaattgagagaagaactgttgaaaaacaagcaatcagtgcttgtcaatttgtgaaattacctatccagatcacagaaggtgctaaaatttagatatttgctatcagaaaagcatgctccaaagtataagccaagagtgaggctggacaaccttttgctagtgccttagaaacatcaaaagtcagagtattcagtcacatagagggctctttgaagagattaggcatgtaactcatggatctcctcagccgtctaagcataagcgaggaatagaggatatgatgtgatgatggaagcatccaagagccatggaacgtaagtagcctctggaagctggaaaaggtgaggaactgttatttcctaagagcctccagaagcaatgcatcctttgattttagtcccataagacctgttttggatttctgacctctggaattttaaaataataaattgtgctgttctgagccactgagtttgtggcaatgtgttatagcagcagtagaaaactaatacagagtttggtctgtagttgtaatgcctttgtctggttttggtgtcaggatactactagctatatgggatgggttgagaatttctaatatatcaaattaaggatactgttaggtgtgtttaataagagacactgtctgggcatggtgtaatcctagcctgtaatcctgtaatcacacttgtaatcccagcactttgggaggccaaggcaggagggtcacctgaggtcagcagttcgagatcagcctggccaacatggtgaaaccccgtctctactaaaaatacaaaaattagcccggtgtggtagtgggtgcctgtaatcccagccgttcaggaggctgaggcaagagaattgcttgaacccgggaggtggaggttgcagtgagccgagatggcttcattgcactcaagcttgggtgacaagagtgaaattccatctcaaaaaaaaaaaaaaaaagagacactgcagattgcaacagtagtgaactggaagatgtatcaaaagaaatcattcggcttggcgcggcagctaatgcctgtaatcccagcactttgggaggccgaggcaggcggatcacctgaggtcaggagtttgagatcagcctggccaacatggtgaaaccccatctctactaaaagtacaaaaattagctgggcgtggtggtggacgcttgtaatcccagctactcgggaggctgaggaaggagaattgcttgaacccaggaggcagaggctgcagtgaaccaagatcgcaccactgcactccagcctgggtgacagagcaagactctgtctcaaaaaaaaaaaaaaaaaaaaaaaaaaaaatggttcaaatggaagcatagaaagtgtaaggaatgagaagaacataagagctgtatggactgaagtgaaaaattctaacttacatgaatttatagtccgagaagaagagtgagttgaaacatggacagaaacagtattgagaagaagaaaaatttcccaaatagatgtaaaacttaaatctcaattcaacatgtaagaaactgttaactcatgcaggatatgcatgcctggaactgtcatggtaaaagtggttaaaaacaaagacagctggccactgcagtgcatctctgaaatcccagctactcaggagactgaagcgggaggattacttgagcccacgggttccagaccacctgggcaacataacaagacctcatacccccaaaaaagcaaaaaaaaaaaaaaaaaaaaaaaaaagctaagacaatgagagaatataaaaaccagctataaagaaaatgacctatattttcaaaacagcagcaataacactaacaactggcctttcaacagaaaccatatgagccagggaattacaactttattttattttattttttaaattatacttttagggtacatgtgcacaacgtgcaggtttgttacacatgtatacatgtgcaatgttggtatgctgcacccattaactcatcatttaacattaggtatgtctcctaatgctatccgtctcccctcctcccaccccacaacaggccccggtgtgtgatgttccccttccctgtgtccatgtgttctcattgttcaattcccacctatgagtgagaacatgcagtgtttggttttttcgtccttgcgatagtttgctgagaaagatggtttccagcttcatccatgtccctacaaaggacatgaactcatcattttttatggctgcatagtattccatggtgtatatgtcccacattttcttaatccagtctatcactgttggacatttggcttggttccaagtctttgctattgtgaatagtgctgcaataaacatacgtgtgcatgtgtctttatagcagcatgatttataatcctttgggtatatacccagtaatgggatggctgggtcgaatggtatttctagttctagatccctgaggaattgctacactgacttccacaatggttgaactagtttacagtcccaccaacggtgtaaaagtgttcctatttctccacatcctctccagcacctgttgtttcctgactttttaatgttcggcattctaagtggtgtgagatggtatctcattgtggttttgatttgcatttctctgatggccagtgatgatgagcattttttcatgtgtcttttggctgcataaatgtcttcttttgagaagcatttgttcatatccttcgcccactttttgatggggttgtttgtttttttcttgtaaatttgtttgagttcattgtagagtctggatattagccctttgtcagatgagtagattgcaaaaattttgtcctattctgtatgttgcctgttcactctgatggtagtttgttttgctgtgcagaagctctttagcttaattagatcccatttgtcaattttggcttttgttgccattgcttttggtgttttagacatgacgtccttgcccatgcctatgtcctgaatggtattgcctaggttttcttctagggtttttatggttttaggtctaacatttaagtctttgatgcatcttgaattaatttttgtataaggtgtaaagaaggcatccagtttcagctttctacatatggctagccagtttcccagcaccatttattaaatagggaatcctttccccatttcttgtttttctcaggtttgtcaaagatcagatggttgtagatatgtggcattatttctgagggctctgttctgttccattggtctgtatgtctgttttggtaccagtaccatgctgttttggttactgtagccttgtagtatagtttgaagtcaggtagcgtgatgtctccagctttgttcttttgacttaggattgacttggcaatgcgggctcttttttggttccatatgagcttgatggggatgacattgaatctataaattaccttgggtagtatagccattttcatgatattcattcttcctacccatgagcatggaatgttcttccatttgtttgtatcctcttttatttcatcgagcagtgatttgtagttctccttgaaggggtccttcacatcccttgtaagttggactcctaggtattttattctctttgaagcaattgtgaatgggagttcactcatgatttggctctctgtttgtctgttactggtgtataagaatgcgtgtgatttttacacattgattttgtatcctgagactgctgaagttgcctatcagcttaaggagattttgggctgagacgatggggttttctagatatacaatctgtaacaccccattgtcaacattagacagatcaacgagacagaaagttaacaaggatatccaggaattgaactcagctctgcaccaagtggacctaatagacatcaacagaatatacattcttttcaacaccacaccacacctattccaaaattgaccacatagttggaagtaaagcactcctcagcaaatgtaaaagaagagaaataataacaaactgtctctcagaccacagtgcaatcaaactagaactcaggattaagaaactcactacaatttcaaaatgctagaagacaacaagcaacaaaataagcaaaaaaatctgtcatcctagaattttatactcattggagaaaattttctacaattcttcacccacctcgcccatcgcctctcaaaaatcagtgatggcagaataaaaagtatgggattaactctgttgtctctatatagttaaaagctctaggcaaaatatattttaaaacaattatttaggccgggcgcagtggctcaagcctgcaatcccagcactttgggaggccgaggcgggcggatcacgaggtcaggagatcgagaccatcctggctaacgtggtgaaatcccgtctctactaaaaatacaaaaaattagccgggcggggtggcaggtgcctgtagtcccagctactctggaggctgaggcaggagaatggcctgaaccccagagggcggagcctgcagtgagccaagatcgcaccactgcactccagcctgggcgacagcgagactccgtctcaaaaaaaaaaaagcaaacaaaaaaaacaattatttaaaggctttaagagcaactagaagcaggcagaaattaaagaggattttaacacaatattaatagaatcaattcagtaatattagcgtctatactgcttttttctgggggtattcctcagtctttgtggggtgggacaggtagaactcagacttaagccacagtcatattggctggagtttgattcttccctactggctggaaaataggaattcagaaaggaggaagctgaagctgaggagctccaaattctgcacatccatagcttgctccagaattattaaacataggcattttgagagcaggcatgaactagaatgctgaaaaagctgtgcagagatttcagctgctgtctgtcaccgagaggatacaatttacagttttagtcctgctcagagataaaaatgttggcttttccattggaattccaaatggcccatacattaggaataaaggctacagcctaataaagattcacttgagaaataagggaaaaatcaaaatagactcttctaataaattacaaaagcctctaagttcagggtgatctcccaataatttacgtatctgctaaacaaaactaaacacactgcaaggaagattttcaaatcaagagttgatagaagatctcatcaacaatgtacagtgtatggctgggcatggtggctcatgccagtaatcccagcactttgggaggccgaggcaggcagatcacctgagctcaggagttcaagaccagcctggccaacatggtgaaaccctgcctctactaaaaaatatgataattagccagcagtggtagcacacctctgaaatcccagctacttgagaggctgaggcaggagaatcccttgaacctgagatcgtgcccctgcactgcagcctgggtgacagagtgagactccatctctatgattgaacaaatgaatgaatgaatgaatgaatgaatgaaagtgtattaaataccccatttgaaaagcaaacgtttgtcagaatagaggaaaaagcaaagcccaagtatatgctgcctaaaagagatgtgcttgaaagaaaaaagctgctacccctattttttaatgtatcacaaagttgaattatagaccacctgataagaaataaagaggatcattaaatcactatgaaagtattaattcagaataagtcataacaatcctaaatttgtgtgtatttaatagcttcaaagtacatgaatcagaaatttatagaactgaaggaagaattagataaatctacatttcagtaatagattataacatttatctctcagtaaatgaaacaaagtgaggaagtaggagttgttgggggaaacgcccaaaacttctagatggacgtaaccaatatttatggaacaaagcatttaccaactacaggatgtacttctttccaaagaaagatagacagtatgctggcctatacaaaaagtctcagtaaatttaaaaacattaaaatcaaacccagtatgttctgtgaccacatcagaattaaattggaaaccaatagcggtaagatctagaaaacctcaaatatgtgtaacctaagcagtatagtttttagtaacacatggatgaaagaagaaatcacaatagatactacaagatatttcaaaacgataatgccaacatgacatgggatatagctacagcagtctatagagagattttatagctttaaatgcatataattaaaagaggagatttatcagtggtgtacactgccacctcaagaaactagaaaaacaggagtacaattaaccaaaaatcagaagcaaggaattactacagtaagagccagaatcaattaaatataaaacaaaaaaatcaaagagaaacaagaaagtcgtacattttgtcttttgagacttctagtaaaattgataaactatgaaaaattttcaagaaaaagggaaaaccacacaaattggacatccacaaatgatagcaagcacattattataatttctatagaataaaataaggtactattataaccaactttatgccaacatatttgatacttagatataatggataaattccttgaaaaacacaaccagaatcagtagaagaagtgcatgtatacgtttgtatgtatacacttatgcagaattgtaatcaaacatacagaatttttagtctgttttcatttttaagtaccatggttatgattttgaaatcacattaatcccatgtttctccaatttaaactgaaactcattttttgttcttaaattggagcatttgactactttagaaagtatcatgtcttctcagtttgctgtgacatataatgagtatcagaattaaagacatcacatggttggaatatcgtaattcctaaaagcctgtgatataaatcatatcctgttcatctaatttaaaataatttatttgtgttttagacattattcaaagtgagcacgtccttattagagtcttttctttgggaaattgagctgttttatcctagtatatcagaaataaaatttctttgttgttaattgagcaaaaagcatgttttcatatacttttcagttttgactttcaaaatgtgaaataatacaagtgaatataatactttaaaaaattaaatccacttaatattaataccctaaaacagttctgtttgaatcgttatacttgtgacatttatgtaaatatcagtttatattctactgtttggtgcttttgctgaacctgtattttgaaattaatctttgttgatgcctaagcctgtggtggtctcatttgtatagctctagcatacttgctgtatatttaactataccttattgtgtgtattagtcttaatgttgactagcatttttatttccagttgttagctataatgaaaaaagttgtgaagaattgtatacatatctaatataagacttaaaaatttgtatctgtataatgggtgatgggaaatatatgatagtggttttaatttgctcttctgattttcgtgaagttgagggtctttcacttgttaaagaatttgaatgctataaattgagagctctttgattttgctgtctttttgctttcattgtatttgttttgttttgtggcatcatatgagaatagtcctttaagaaaacaattatgatgaggtaaagttctgcttctgtaacaatgttctattatataggtacttttatatgaaactatcttctgtgcagcataaaataataaatatagaggatctttaaaaatttgcctataaagggtttcaaaatggtttagaagtgaaaagtgcctcaaattcctatgttcttacaattaggctatttcatattgtcattctggcctaagcttcagtagtgaaaataagctggcatcaaaattgcacctgttttattcagtgtacagatgcatgtagtgtagccgtagatcaacttaagactgatctaagctgtagatcagcttaagacttctacatatatatgtaaaagaaggaagaaatagtgaactaatcacagagttacctcaccattcatttaaaaatcaccccacagagttacctatcagtctactaaagtcatacaggaagcttaggaatcatcctgatgtttgaagtgaatagtgagataactctgtgattagctcactattcatttaattatatgtttgagtgtggaacttcaaattagtatttagtgaagtgcattattcatggtcaagcaagataagtagagtatttctaaatgcaatgagaagtttgtagggcaaccatgctcagaattggagtttttctttgaattattaagattaaattatagacatgatgctcctttattcctaagttcagaaaacttctcttggataaccatatacagttatacaaatcagaagttcacactgactctgtactataaactgcaaatcttattcagcttttgcctgtccttctaatgttctttagggccaaagaaaaatcaattttcttttgcgtggtttgaggatactggtagttcaggatcatatattgcattttgttgtcttgtagtcttgcatatgtaacaattctgctatctttatttatctttcatggccttcatggccttgacagttttgaagaatacatgctagaaattatgtctatatatatatatatatttacacatgtatacatacatgtattttctaggtatgtttgctgataggacccagaagcagactccccctagtgatatatgcatatatatctcccatattgtcattttaaaaattttctactaaaggaaatcagggctccttggagaaattctagtactgaggaagagtaggtagaacatgagcctagaatgttttgctgtgctagaaagcaaggaagtgctcaaagaacgatgggggacaagttataaggaagtaggatcctgctttaatggcgtctcagagacaaaatcttattcccctcaggcatcaaaattaataatgatagtaacagtgtaataaagttagaatctatactgataaaaattaatggataagaagagaatatttttccttatagcttggtgccaactaataaatgtagaaagaatgacagaattagaaagttctccttttcttaaccactttagtaataattgtttcaggcacaattataaaaatgctaagactgatcaaaagtttggtgagaaataagatgtttaaatagtctcaagaatctgcatatagatacttaactaattataaaggtggaattaataactaatgtagagacacttggcagacactgccatacttctgctgtcatgtgcgtcttgatgtttggaagcttgtttttatttttatttatttttttgagatagttttgttgcccaggctggagtgcggtggtgtgatcttggctcactgtgccttccacctcctgggttcaagtgtttctcctgcctcagcctcctgagtagctgggactacaggtgtgcaccaccacacctggctaatttctgtatttttagtagagacggtgtttcaccgtgttggccaggctggtctcgagttcctgacctcaagtaatccacctgcctcagcctcccaaagtgctgggattacaggcgtgagccactgcgcccggctggaagcttgttttttaaagcaagcagctttattaatccttataatcctatattttaaagagatcatttaaagttaagtctttactttgaatctgatgttgaaaatgtgaatggccaagccaacacttttctttttctttaggtgagtgctccagttgtaacatctaccactcaggaaaagccgaaggatagcgatcagtttgaatgggtgaccattgaacagtcaggggagttagtttatgaagcaccagaaactgttgcggctgaacctccacctatcaagtcagcagtacagaccatgtctcccatacctgcccattctttggctgcttttggattatttcttcgtcttccgggctatgcggaagtgctactgaaagagagaaaacatgcccagtgccttcttcgattggtattgggagtgacagatgatggagaaggaagtaagtgtttagtattaaatttatcaacacatatgtgaataggttgtgtaaaggtatccagatcattgcctattattcatcatttatttccttcatagttaagctgttagatgatttgtaagtggtagctcacttccagtattagttatacataataaatcctaaagaatcttcattttcatctctgtgttcattcaaaaattattttccttgtgctgacaaaactgttgggcatcactggggggatgtaaacatgaagcagttatttagagctacccccaagtagctaatgttctccagtaatagaaacaagggatgtacataaacatgtatacttagcaagttataaaatcccttcagtactcttgagtgcagtattatggagaaacacacatgtgagattatttctttactactcagcaatgtgaatgaagtggcatggtagtttttagtggggccttgaaggacagattagatttaggttgggatgagttatctcagaaaataaatggaaagagcagtgttttgaggttaaaatgtatgagaggggataagttagcagatgaaaatttgcacaaaagggagcattgtgagcattttaaaagctaatattggtaacagatcatggaaaaaacgtactaaaaactttagattttattttgaatagcaataaaggtttattaaaatgtgttaagattagtgatgtgttgaatatagtttttttcagaaaatgaatctggtagcaatacttagattaaagagaacagaattaggaaaatgatgccataatatgtattaatgataacatagaataataagagaaagctgtgatgattgtttccattgggttggcattgttatttaatagaaaaactgaagaattacaggatagcctcacaagtagattttcatttgggtgacgtctgcattttcttttttctttcttcttcttttttttttttgcattttcacttactatttattctattaatatttattagaaaattaatattccttatgttattttaaaatcacatggttttgattagggtcgatttctttcacatgccatttagaaagaataaaatgttaagttctgtactacaaagtatatttaatctaataaaactatatgaatttatgtgtagatctcaaaactctgaagctatcaaatattcaaagtaaatattttttcctttatattttcctaacaacaaaaatccctcataaatgttggcatataagtgggcccatgtagtttaaacctgtgttattcaggtgtcaactgtatttattttagtaggtcaggaatttctaattacttgatctgatttttttttaagtagatagaggggtaagaaccatattttttattgatacatagtagttgtacatatttatgttatacatacgatattttgataaagacatagaatgtgtaataagaaccatggtatttcaacactgttaccacagagtgttaaagtaggtgtaaccctaaacagaaaaggaaaaaaaaatggctttctgtaatttcacactatttttagtgcatatacaatgaatttttattaaaaaggatagttatgatatctctctctctaataattgtctcgtgtaccatccatgtagcattgctttctttgcatttaataccccttcctggctagaacacagtagaacactgttgggaaaaaaatagttttacttgttcattatctgttcttggttaaagctactcccaagaaaagcagttactttcttactgttgtaagatactactaatgcttcttttctattgttcaggttttagtttaaattctagttcgtaataattttgacataatctatagctatgatcatacatatgtttccatttttttgaggtttatgtataccgtgtctgacagagtttttcctgatacttattcgttattaaattttaagatattactgttgtatttgtggtatttggttttctaaataatttagtggtatacttttgtattacagtgtcattattaatttatgaccctgtatgtaacttcttatgtgtttttaactgtttttaatcttgagtcctcttctttcttcaatctaggtcatattcttcaatctccatcagccaatgtgcttccaacccttcctttccacgtccttcgtagcttgtttagcactacacctttgacaactgatgatggtgtacttctaaggcggatggcattggaaattggagccttacacctcattcttgtctgtctctctgctttgagccaccattccccacgagttccaaactctagcgtgaatcaaactgaggtaggttcacttttaattatttcagttattaaaaaaactagatttaattagggagtacagaataaagtttttttctgaattaatctttcagagacttgggtgttccattttcacatctaaaaggatatttaaaacagaaattgtaaattaattgttttctctattagtcttcttcagtaaaccaaaaagaaacctatctacttgaaaagcagaaaagatttaagcgcttaataagctttcccatttaccaagatacactgaatttatactgtgatccttcttcctttcctttttgaacttttaagaataatactatagaatgggggttgtgggtggggatctagccagtgcaataagacaggaaattcaagaaagaaagaaaaaaattcctcattatttcaatatgatttaattgtattgtagaacataccagaataggctaggtgaggtggctcatgcctgtaatcccagcactttgggaggttgaggtgggtggatagcctgaggtcaggagttcgagactagcctggctaacatgctgaaaccctgtctctactaaaaatgcaaaaatttgccggacatggtggcgtgtgcctgtaatcccagctactcgggaggctgaggcaagagaatcacttgaacccaggaggcggaagttgcagtgagccaagattgtgccattgcactccagactgggcgacaagagtgaaactgtgtctcaaaaagaaaaaaaaaaataccaaaataattaatggcataagtgagtttattaataatacatcatggggtcagtctataaaaattagttaatttctacatactagcaacagacataaaatgagctttataaagatatattttagaatagtaccaaaaatagaaaatatctaagagtaaatctgaaaaatatgtataatacctctttatgaaatttttgactgggcatggtagctcatgtttgtaatcccagcactttgggacatagaggcaggcagatcacttaaggtcagaatttcgacaccaccctggccagcatagtgaaactctatctctattaaaattacaaaaattagccgggcctggtggctcacacctatattcctagctacttgggaggctgaggcaggtgaatctgtctgtgctcatgtatatcttcagtgggttagatatgatagtgcaataatattatttcttcccagatcaatccttaagtttgatacaattccagattcattttggaggaagtttacaagccaattataaaatgtatataaacatgcaaagggtcaggaatagctgagatatccttttgctatatttatcctaaaaagatctgctcatatctgtattcttttcactgttttctcaattcaattttgagtcattgactttttaggctctaaggtggtttatcccttcttttcttgataaatatttgaaaatttgtatttatttatgtgtttattgattcattcattcttaaatataagcagtttctctccatttaccccttcccccagcccctggcaattaccagtctgcattctgtctccatgcatttacctattttggatattgcatataaattgaatcatgtaatgtgttgttccttgcgtctgtcttctttcatttagtataatgttttctaggtttattcgtgtagcgtatatcagtacttcatttcttcttatggctcaataaatatcctgtttgttgatccattcatcggttggcatctaggctattttcatcttttgttttaaatggtgctgctgtaaacgtgtgtgtctatttcagcaccagtttttatctgttttaatactagaagtagaattgctgggtcatacagaaaatctgtgttcaatttttttgagcagccaccaaactgttttccatagtagcttcatcattttactttcccagtgataaatatttttgaagataagcaaaaacaaattgtaatggattttcattttttgttattttaagccacaggtgtcaagctctcataaccctacatcaacagaagaacaacagttatattgggccaaagggactggctttggaacaggctctacagcttctgggtgggatgtggaacaagccttaactaagcaaaggctggaagaggaacatgttacctgccttctgcaggtatatttgtaaacttgatattgttcatgataatggctttttttttgtatttattattttaaaatattgataactaatccaactttcctcagctatgtttatgcccacttgtggtccttcttcccagtgcattctaagataccactggataaagattgttcttgcttacttgtgactctgtatttcttccctctcaactagcttcttcactgagaggaaagtggcagggatgaaattatccagtagctggaagatgcatcttcctacaggcattttcttgtttaatgtgttgtatctggccttttttttttttttaagtgttatttatttatatgcattttggttgcttacttttttttttttttttttttttgagacggagctcactctgtggcccaggctggagtgcagtggcgtgatctcagctcactgcaaccttcacctcccaggttcacggttgcttacattttttaaaataacttttcagccgggcgtggtggctcatgcctgtaatcccagcactttgagaggctgaggtgggtggatcacctgaggtcaggagtttgagaccagcctggcaaacatggtgaaaccctgcctctactaataaatagaaagattagctgggcttggtggcacatgcctgtaatcccagctactcaggaggctgaggcaggagaatcacttaaacccgggaggcagaggtcgcagcgagccaagattgcaccattgcactccagcctgggcgataagagtgaaactcggtctcaaaaaaatgaatagataaataaataacttttctagattcaggcaagttggacaagaatagaaagtctttataccacagaaatgtataggggaaataatgaaaaggttagctttgcttcctgcatcagctaattgaagttcgtcagtgctttgaatgtgtcttctgcaactctagaatgctccttctagtataaagttctaagattttgttaccttcaaactgtgaattgagtctattcaataaaatatgtaaataatacagagttgctactacattttttatgttcgtagttgtattgcttttatatgtctagtcatatgtagtgtaccatcctttgtaagcaacactctcagacaaaacagatccttctcttttgaaaatttaaacaaataattattttaaaacatagtataagatactgattaagtagaaaatatgtactcttagtattcagattgaatttctaacctacaataaaaacttttgaagtatgtgaaactgaaatccaaattaatttcaacaatttttaggttcttgccagttacataaatcccgtcagtagtgcggtaaatggagaagctcagtcatctcatgagactagagggcagaacagtaatgcccttccttctgtacttctcgagcttctcagtcagtcctgcctcatcccagccatgtcatcttatctacgaaatgattcaggtaaataatccctgtaaatgtgtctgtggatgaataattttgtttgcttattttatcattgtctaatagtaagtttcagttgaaatagttgatggatttatttcctaaaaagtattctggaaatatttagttggtttttggtgcccttaatttgatactttgtcatcacttaccatagaacacagaataataaaagtttcattattcctttgtctttatctgtgaaaggtgaaagtaaactttttttccttttaatcatctgtaactgaaaatgataggacaaaggctaacaacttcatgacatcattctgatctgaatatggtcaaatttctatggattttaaatatttttgtcaaacactatcgcagacaacagttatttttgaagaaaggcagatacatgaatcaagtccataggtacttgataagatgatgattaatttcttaaaattcaataataaaagtactgtagctacttgttttgccagtatacaactgattattgattgaataatatagtttattatttccttggttatggaattatctaagaaatgtgttcttttcctaagaatagaaagttacatgttcagaaatgtatagatatttccaagagaaacaagcagttaacatctatttctttcagccaaaacctttattatttattgtttcaactctgttttactcatattcttatctctgtctttatcttcttatgaaaatttacatgtatatttcattaatttattaaggaagaatagataagggaaacaatggaaatgaatcttggtagtctattttgtggttggtagcagctaagtgacacagttggatgtctggtaaaaatattagtatttcaagggattattgcccgtattccccagtatcaggaagattgttgtcctttaaaaatacgctatttcccagtctgtctcagactccttcatggaagtattagattgatttttttgtttgtttagattgacctgtttgatacatcagactggtcttttttaaaaagtagatgtcaaatgcataatttttttttattaaaatgtttgagactatacattttaattttagattatatagaacaattgaatagggtgcgataggtttctttttatctcacttctctattattaaactattattttcttaatccttatactgtgaagatatgacctaccaaaaattttaaatttctgttttggtctgaaattgactctcttataacactgagcttttatctttatggttcattgtcaaaaaggaaatccaggattatttacataatatttacagtaattgttgttcatgtaagtgcacttcctgggaaggtgtgtatgttaaactgatttttggtaaatgtatggaattgcagagacttagatattataccttggaactgttttagaaatttaatgtgacagatcgaagtttgacctttcttttatgatgtattattttcctggaaaaaagaaatttctttcatcaggctttagatgttcttgaatttggtaacttgtccagtggttaattctaattgatatatttggatgtggtaacaaatacttattttgagataataccttatattaagataaaatgatgtaacttatagtcagtaggttaaacggtagcatgcctcctaaatgatattaaatatggattgttttcaggaaaacacagcttaatataagtatataagtacatatataattaagtaaacataaatataaatatataaatatataattagttatcagttttggttagaatagtaataattttttaagtggctactatttatttatttgagacagggtttccctctgtcacccatgctggaatgcagtggcacgatcttggcttactgcaacctccacctctcaggttcaagcaattctcctgcctcagcctcctgagtaggtgggattacagacatacagcagcatgcccggctaatttttgtatttttggtagagatggggtttcaccatgttagccaggctggtctcaaatcctggccccatgtgatctgcccaccttggcctccaaaagtgctggaattagagacctgagccaacacaccctgccttaagtggcatttaaaaacctgaacaaattatctagccagagtcttccttagacttagtaaaatttctattttggaaaattagtctaaagtttattttccaattttttcatttgcgtatatagtattatttttggcaatgtgggagttgaggtaatgtgataggatccactccaccattttttactacatttagttgtcatgtccttttcttctgtaatctggaagagttcctagcctatctttatctttcataatactgatatttttacagaatgtaaccatttattttatagaatattctacagattggtttgtaagtgtgagagtagtcctcataattttgcctgagacattgtattcaagggatgatttgcttatattgctagcagatgatataaaaaaacgcaggcctaacataatagccttttctgagaactttagtaaaataatgcacattttctttctataacatgtttttaaatgattggtgagcaagacaagaaaatataggaacacactagtttatgccttcctttcagtgcagagattggtctgccattaattttaaatgtcaattgtggtttcttattactgtcccacaccctttttgcccttattttttggctacaggtatacgttagatactttgtaatctttaaactttaatgtttaatgactgttaaagattgagatgaataccagagtctgctcctcattttaataaaaccttcaagttctcatattaatgagtttactatgtagctggttagctaagtctgttttatttcaatagaagtttaaaaactggcctgaacatattaaatgataatactaagctgaccataaggatcaacaataattgcacataaaattgatcttcagttttagttctgaacatctttgcatcaaaggtaaaaagagaatattgttagttgtaaaattattaccagaatagagggagcatataagctccttagaggaaaggacaaccttttttccattactaacttgtcacaattctgtaactgagacaccgatcctattctccagaggtaggcactgattatgtttagtgatttaatcattaagtatattgtatttagtcattaaataattgcgtaagaactttttacttgcatgagaggtggaggttgcagtaagccaagatcgtgccactgcattccagcatgggtgacagagggaaaccctgtctcaaataaataaatagtagccacttaaaaaattattactattctaaccaaaactgataactaattatatatttatatatttatatttatgtttacttaattatatatgtacttatatgcttatattaagctgtgttttcctgaaaacaatccatatttaatatcatttaggaggcatgctaccgtttaacctactgactataagttacatcattttatctctactaaaaaaaaaaaacaaacaaaaaacaaaattagccagatgtggtggcacatgcctgtaatcccagctacttgggaggctgaggcaggagaatcgcttgaacccaggagggggaggttgcggtgagccgagatggcaccactgcactccagcctgggtgacaagagtgaaactctgtctcaaaaaaaaaaaaaaaaaaaaaaaaaaaaaaaaaaaaagataaattcctgatatttcatctttttgaatttactgtttctagcaaaagatttttgtgactaacagtagttttcctactcttttgacctctttttgtagatcttaaaatgggtggagaggaaaatttagatacgtaaatgaatggagacttatttttttattttatttttgagacagagtctcattctgtcgcccaggctggagtgcagtgatatgatcttggctcacagcaacctccgcctctcgggttcaagcagttctcatgcctcagccacccgagtagctgggactgcaggcacccgccacccaccctgctaattttttttgtattttgagtaaagacagggtttcaccacgttggccaggccggtctcgaactcctgacctcaagtgatccgctcacctcggcctcccaaagtggtgggattacagacaggcatgagccacaacccagcctgtaaatgaatggagactttaaaaaaaagcgtttggtggcattacagcagaaacataaatcttcatatttaggctaaattaatcagatttatcaaaggttaacattatggttccagttactcaaaatagtaagtttgatgctttaataatttgtttcttattgcttactaaaataaagacatctgttagtgttctagataggaaaatatattatttgttcattttaatttctttctcaacattttcacttccacttttcataagaaatggtattctgaaagttgcgttttgtaggccacaatcattttttctctagcccttgtatagtatggagttacccctctggccactagatggagatcctgtttcattttaagaagtatttggtaatattcacatgttaatgttaacaggcagaatgttactttagagaccctcacctattttagaaaatagtatgttccttttttgagaagagagcatattaagtctcagcacacattaaattatttgccattaacttagtggggtatgctacaaattcttattgaaataaatctttacctttttaatagtggtcttattatatggggatgaatattctttcagattatcaagggaaattgctgttatctgggttaatctgacaattcacagattagaaaagaacaaatgaaatctagagaaatgtattcagttgctcaagtttaactggttagtaacgtggtgattattaaactcacttattttcaagttgaaaagcaagatataaatggattttgtcattatgaaaaataaaaatgagtaagtgatgtgttagagtaaggtagacatgagagagcaggcacaggacttcattgggaaaattataaagtatctactgaattggctggttatcttagttaaatgatgttatatactaggattaaaatttttaatttccctaatattggtttgacagttttataacaaactataatgtgtcaaaacccattactgcattttgatataccatctgatttttctcacagtgtattttgtatgtttaaagctcttttttttttactttatgttacctttggatatgtttctttaagagtaggtatttaatttcataagtatactgtttgagaataaggttaattctgttgtcacgacaaatatcttaatttaaatatgaccatatttattaaatttgaattacttagtagttacatcaaagtaaatgtgcagttggaaacctagccatcttgctaggtctcagggctctccaaattaaaaaggacatagaaattgtattagtgctcttacaggaaaagataaggtttgataccaatagaaaatacataatttttattatttataaaaatactttattttgttgatatacactgcctgagaaacaaataatgaaaaattgtcgagctgtcgtaacatgatacttaactgtatatccttatttatagttttcatggtaatagttcatatgaaactgtcaaattatgccatttctttgtactgttttaataaagagtctgggagctgtggtggtggttcatgcctgtaatccctttgggaggccaagatgagaggattgcttatgcccacgagtttgagatcagccttggcaacacagtgagacttcatctctattaaaaactaaaataggccgggtgaagtggctcaagcctataatcccagcactttgggaggccgacccgggcagatcatgaggtcgggacatcgagcccagcctgaccaacacggtgaaaccccgtctctactaaaaatacaaaaatagccgggtgtggtggcgcatgcctgtaatcccagctactcaggaggctgaggcaggagaatcgcttgaaaccccagaggccgaggttgcagtgagccacaacactccagcctgggcgacagagcaagactccatctcaaaaaaataaaaaaataaaaataaaataatctatcagattattctactaattagagtagcaggccaggtgtggtggctcacatctgcaatcccagcactttgggaggctgaagcgtgaggatcaccagcctgggcaacttagaccctgtctctacaaaagaacaaaaaatcaacactcgcctgtagtcccaactactcgggaagtgggatcccaggagggcgaggctgcagtgagccgtgatcataccactacactccagcctgggtgtcagagtagaccctatctcaaaaaaaaaaaaaaaaaaaggtagagtaacctgccactttatttttagcccaaagtatattttaatagtattttaatatggctctagtttttgtgacagttagctgagcagtaccaataaaaattaaaacacttgcctatgtttaatgtatttatttctatatatggtcactagcaaggcatgttgatagcgactcagagtatctataacgtaagtgcttatcaacaaatgttaattccttttatttagagttttcatttttgtcaagggcatccaatgtggaaatgactttggtatagaatatatgactctgtgttaaataattatgactggtaagttttataaggggaggacaggttgcttaaattaaaatttagatgggttttgaattgctttgatttgtacagatttgtaaagttaaagtattagttcacatctcagacacttcagggataccattcttgactacccagcgtagtcctttctctcctatgagctgctcacgtacctaatccttatattgtcacctttcacactgtagtccagctattaagaaaagcttaatcagatttccacataactacctaccagattagccataactctccatttcttctatgaaacatcccagttaagagtgagctgtgtttgtttccagatttgtttatgccagttgtatttccgctatataattgttttgcaaactagatgtttttatggtaaatcatgaaatgctttaaaaaagtcctacaggccaggctcggtggctcaagcctgtaatcccagctctttgagaggccgaggtgggtggatcacctgaggtcaggagttcgagcccggcctggccaacatagcaaaactaaaaatacaaaaattagccgggtgtggtggacgggcacctgtagtcccagctacttgggaggttgaggcacaagaattgcttgaagccgggaggcagaggttgcagtgagtcaagaacgagccactgcattccaacctaagtgacagagcaagactccatctcaaaaaacaaaaagaaagaaagaaagagttactccagtttacttagagaatatattaaaatgttaacaatggtagttttattttgtattacccacatttatcagagaaataatgtcaatattttattgaaacaagaaagtttcttttctatgtagtctttatttttctatgtggccttatctttacaactgcttaactaccaaaagtcacgctaaggctcatttctttggagttactaaaatataatttccaaagacagtttttaaaatattcagtgttcattaatgctaactaaaacttcatttttctaaacattttcatagtcttctttcctatactgactaaatttccctttcctgtattcagtagattactagaggcttaaggaaaacacaaacctaaatgcagttttattttaattaatgtgtattttatatgtactcttagaaaaatggttgtagcatttttgctgttgtgtcttgtatacgttactaaatcttgtatgttttggagtagtccatcttcagtgtccatattcattgctttgtcctgtttttttcctctgtgtaaagttaaaatttacctgtttgctttgttataattttattcctcaaactggaagcatcatatagtaattgctcttagagcaagggagttaccctgggatgtatgtcttaatattctggaggtgtgcttttaaaggatagtttctaaatctttcttgttagagccaggttttgccctgaatgcagtcccttgaacgagaccttcagagtgtggtatggatgtagaccaaaacaatcactaagaggttaagtactgttccagctatacctaacatagtcaagatagattcttctttttcttctcttcttgcttcttaacatcttctgctgtagtgatgacagaagtaccagttttcccagaaaatgtcttcatctagagaaaaagagaatgattgtgaagcaaattgctagaaaatgtatttattacaaatactagtacatactagaaaattgctagaaaatactagtaaatactagaaaattgctagaaaagaaatactagctagtaaatactagaaaatgtatttactagcagagagctagtaaatgtatttattatacatgttgcatttcttgcgtagtttttcagtgtgcagtcctactttagtctgttaacgtgttggaaaatgatagtaaatgagtgtattttaatagaatttaaaatctgttatttttaacatttgggctgaagagccgaaaatataatgaaaatgtagaagttagattctgccatttacgtattctgtatttacttagatacttaaaaatttttacgtatctaactaggctgatgtatttaatgtgaactgcaatttatatacaaaaaactacacatacttagtgtatacaattcggtaagtttagaacatcaactcctttttaaagcaactcttttggggagcagttgagcagaatagggatttaaataattttttcctttgaagattagaggatcattgtgtcattaattttataatctagtattgaaattaattccattttactaatattttgaaaaagcaattaatagcagagtttatctcttaataaaagatttatttccacagattaaacacatcacatatttaagcttaaaataatggagttactaaatgtcagagttttaaaataattaaaagagaagtgctgcttaccctacattgcatcaggagtaaagtgttatcagatatgttgctttagtccacaatagtgatgaatgaaccttttctcttcacggagggcttgtgaacaaaagctgaacaagcttcatatcaaagatggcaaatgttttcagtatatcctgaagggatgtatcttcgctgttagtaatctgtggtaaatttcactgtaactatttgatgtaaattgctagcctctgcaagtaagtcacactgtaaataggctctattttttagtttttttaggttttttatatgctgaatcacatatttcctccaaaatgctaatgtttatggttatttcttttgaattttctgtctgatgaacctttacactgttctttttcttttcagctgtttgaagatacttttccccattgaaatgttttagttccaaatgcagaaagtgattttattcctctccctactaccagttactactataaaaatgaaaaaaattgtttattggcataagttttgtaatgtcacacacccgcatctgtagctgttgatgacaattccaagatagtcttcaagctatgcataaatcagcaaacaggcccttttgaggattggaaggatagtgacttcacttgcctggttgtaagctgtaacactgattaaacatgcatttggtgcttgctgagtaaaggagctgcaagctgcacttggagacatggtgttgcataacagcgtgttgtgcctctgttctttgtcaggcaggcgcacattgaatcctgtaataacaatgaagtatgtgtaaaggagctaaatttgaagacatctaagggttttctgatgaagctcttcatggcaaaaatagaatgaaagaattcaagattgaagtagtttttatgttgttttgtgctttaacaggcaggtttttattaagggtttattatctttatccattcttgttgcttgctgaccaccggtacacattaatttacaataaaagcacatgtcttaaaaggagagcataaatcagctctacattagttttccaagttctcctcttggttgggggggtcttcaaaatctttaaaaaaaaaaaaaaaataaggccggcacagtggctcacacctgtaatcccagcactttgggaggccaaggccggtggatcacctgagttcaagggtttgcctggccaacatggtgaaaccctgtctctactgaaaatacaaaaaaattagccaggtgtagtggcgggtgcctgtaatcccagctgcttggaaggctgaggcaggagaattgcctgaacccgggaggcggaggttgcagtgagccgagatcacgccactgcactccagcctgggcaacagggtgagacttcatctcaaaaaaataatgacaacaataataataaatccgatataaataacacatgtcaggttccagacataggcatagattgtcatatgcattaatatagaatttgacttaaagaaaagcatacttacgtaactaatggttgtcaagaaaaatacagaaatacaaaaaacttgatatttttagtttaaaatgaagaaatttgatatcttgagatattttttaaagtacagtaatgaaatttaaagttctttttaaaattttaaagatttttgtaaaataaacacacaattttatctctcacattttttggactattcccagtctcgtgtgccagtgcttattattaccttgttttgctagcttttgccttcatactccttgatatgaagagaatatcttcttctatttccataatgtaagattcccagttggcctctcctaatgctaactcaatagagtaaaatatataccagttaaataagagggaatagcatgtttcatttatttcagaggagctgtgttgttttctctatgcccttttgtttacatgtgaatataatgtaactatatattttttcttttttcttcttcagtcatagtcttctctgccacccgggctggagtgcagtggtgtgctcatagggcactgcagccttcaattcttaggctcaaacatcctcctgattagctgggactacaggcacctgccaccatgcccagctaagttttaaaattttttgtagaaataggttctcattatgttgcccaggctagtttcaaaactcctggccttaagcaatcctcttgtctcagcctcctgagtcactgggattgcatacataagccactgtgcccgacttttttttttttatgcaacatctcgtgctttataaattgacctgcaagtaggccgggggcggtggctcacacctgtaatcccagcactttgggaggccgaggcgggtggatcacgaggtcaggaggtcgagaccagcctggccaacatagtgaaaccccatctctactaaaaatacaaaaattagccgggcgtggtggcacgtgcctgtagtcccagctacttgggaggctgaggctggagagtaacttgtacccgggagacagaggttgcagtgagccgagaccatgccattgcactgcagcctgggtgacggagtgagactacatctcaaaaaaaaaaaaattgacctccaagtaacatacttttttttttttttcttttttctttttttgagatggagtctagctctgttgcccaggctggaggacagtggcacgatcttggctcactgcaacctccacttcccaagctcaagtgattctcctgcctcagcgacctgagtagctgggtctacaggcgtgtcagcacgcctggttaatttttgtatttttagtagaggctgggtttcaccatgttaaccaggcaggtctgcaacttctgacctcaaatgatctgcccacctcggcctcccaaatatctgggattacaggcatgagccactgtgcccgctcatgagtgatatactttctaattagtattcattaattatgaaatttgaaatcgttcgatttcattttattttgatttttttttagttgtaaattatattcaaggttttttttgaacctaaagttttttttaaagtttctgggattatcttttatgtttatatgaagaaataatgctttaatcatgtatatatatatatatatttatttatttatttctagattttgctgggggcagtggctcacgcctataatcccagcgctttgggaggctgaggcgggcggatcacgaggtcaggagttcgagaccagcctggccaacatggtgaaaccccgtctttactaaaaatacaaaaactagccaggcgtggtggtgggcccctgtaatcgcagctactcgggaggctgaggcaggagaattggttgaacccgggaggtgaaggttgcagtgagccgagatcatgccattgcactccagcctgagtgacagagtgagactccaacttaaaaaaaaataaaattattattatttctagattttaacaattggaattatcagttatatttgtgcttgcaaatttgtgggatctctttttccccttctcttccttattgaactttagcatgctagactgtcttcattattcatgtatggagaagaagattctcattttgtggttttggttgttcttaataccttcataataatttaatttttaaaacataaacatatcttgtattacttgtattcttttataattttatctaaattgctgttgagtatttttaggttcacagaaaattgagcagatagtacagagttcccatatatgcagttcctactcacagtttacttattcatattttgcattagtgtagtacatataattgatgaactaatagtggtatgttatttttaactaaatttatagttgaaattcgagttcgctctttatgttctacagttgtgtgggttttgacaaatgcgcaattttatgtattccaccatgacaggatcacacagaagagtttactgccctaagaaattctattaatcctgcatcccttcctaatccccagacctctggtaaccactgttctttgtactgtctccatagttgtgcctttttcagaatgtcatatagttgtaatcataagatctagccttttagattggcttctttcatttaataatatacatttaagttttgtccatgtgttttcatggcttggtggctgcttccttttttatcgctgaaaaatattccattgtatgaacatgtaagtgtttattcattcaccttttgaagaacatcttgattgcttcctttttttggcatttatgaatagatctgctataaacattcacatacagatttttattcccagttttgtttcactgatctatttgtttattctttcgtgagtaccacattgtcttaattgtcgcagcattatagtcaggtggtcaagtcatatagtgtcagtcctctgactttgttcttcaatgttgtgctggctatgctacgtattttgcctttccatagaaacttaatcatttgattgatagccacaaaataacttgctggggttttggttggaacaatgtgtcctctgttctgtttctctttgtatgttacatgaagagggttgagaacggtgaaatactatgtgcactactttgctaaatgagtttataaagcagtgcaaatggtaatctttgggtacctggctatatttttatcagtataaattctgatttttcaaatatttcgatgtagacagggaaatcattcaaaactgtggattccattccagcagatgtagctaaaatgggggggcaggagaaaactgtggaatagggaaggttttttctaaggcttcattattgtgccagtctcaagttgaaaagaggctacatgattgtacattcaagtcttatgttttcctatatttgaaaaataaaaacatttataaaatatatgcaatgtttactgggtgcttttcctcgtattagtgttttaaagcaattgaagaaaataaatatttcagtataaaaaggagcaaatgtatatgaataagtacttaagagaaaaaaattttagtgacagctttaatggttgataattcggtacccttcagttcacccatttaaagtatacaattcattgatttttattatagtcacaaatgtgtacaactgttaccaaagtgaatttgataatttttttttttcacctcataaagaaccctgtacccttggccaggcacatttgctcatgcctgtaatcccagcactttgggaggcccaggtgggcggatcacttgaggtcaggagttcgagaccagcctggccaacatggtgaaccttgtctctactaaaaataaaaaaatgagccgagtgtggtggtgggcgcctgtaatcccagctacttgggaggctaagacaggagaatcgcttgaacccgggaggcggaggttgcagtgagctgagactgtgccattgcactccagcctgggcaacaagagtgaaactctgtctcaaaaaacaaaaaacaaacaaaccctgtaccctttagttatcatcttccatcccctcatcttctctagcactaagcggctgataatctactttctatccttatatagagttgccttttctgaatattttatgtaaattggatcatataatatgtggtctttttaaattggctttttccatgcagcaaaatgttttcagggtttattgatgttgaatgtatcagtagttgataacttcttcgggctgaacaacattccattttatggctgtgtactacattttgcttttccatcagttgatgtctatttgtttttgcattttggcagttgcaaaaatgttgcagtgagcattagcatacaaatatctattggtgtttctgctttgaattcctttggtaatatacctaggatggaattgttgagttacatggattacctgacttttaaaattacaataatcttactgggtgtgagatggtatctcattgtggttttaatttgcatttctttgatgactaagtatgttaagcatattttcatgtgttcattgactattcacctatcctttccagagaaatatcttttcaaattctctgccccatgagtgggggctggctagaagaggggattgaatgtcaacttcttagccatgtgtaccttctaacttagcagcaggaggttgctgtggtaggatgggaaatgctgacatcctgcccctcaccccgctaggaaggcaggctttcagctctgtactaaggcatagctttccaacttggacctctgggagagggaggcctgtgttcttggctgtagccagctagagtggtttttctttctcattgagctgagggtggggaagaaaggagcagcatcttgattcacataccacagactcttgcttttcttactgagttttagtacattttcttgaataaacgtttcttcatttgctgcatactgttaggaccacttccagagattttagatagttgtgttcttttaaagagtatgtaccagtttcactggggatctgatctgcagggatcttccctctcatgctagcaagaaaaattgagttctcataaaccaagtaaaatattcaagctttcctactaattaaatgttttagaaccttacagtggaatattttgtatccatcaagttcttgaaagtagaaaccatctatcttgatattgggtagaaagaggaagttagacactatggagtatctagtttttataaaattcaacacatacctaaatatacaatatcatgtacttctcccctataagacatattttattaattaaattacatcaggtttttcttaagtattctgttctccacattttaaaattcaaaagctttaaggtggtatctaataaatagctgttttcctgcctctgtcctaccaataacagctcattagggataaactatagttatccctatagtactaatctaactaatagtactaatagttacagatagtactaaccagtgctactaatttcttatatttctttataggaaatctatgtataacaagtaaatataaatacatattagttcattgtcacactgctataaagaactgcctgagactgggtgaattataaaggaaagaggtttaattgacttatagttctgcagggctggggaggcctcaggagacttacaatcatggcagaaggggaagcaaacatgtccttcttcacatggcagcagcaaggaaaagtgcagagcaacgcagtgagagccccttataaaaccatcatatctcgtgagaactcactattatgaggacagcatggaggtaaccacccccatgattcagttacctcccactgggttcctcccatgacacatgggggttatgagaactacaatgcatgatgagttttgggtggagacacagccaaaccatatcacatagtctccctctttttatgtttttgttatttgtgttttgttttatgtttacccaaataatcatttattttttattaacatttatgggttatgtttaccatataacccatttttataccttactgtcctatccccaccccaaaatgacattatagtacttgcgaatttgctccagtacagcataaagcatattctaattttttatggctacataatgggcatttagtaattaaaacagttgcatattaataaacataaataggttcttttttgagataaggtctcactctatgtcccaggctagagtgcagtggtgtaatcatgactaactgcagcttcccatgcccggctaattttttaaattttatacagacaggatcttgcccaggcttggagtacagtggtgtgattatggctcactgcagcctcgacctcctggactcaagtgatcctgccacttcagcctcatgagtagctgagactactggcgggcactaccacacctggctaatttttaaaattttgtgtagagattgggtctttctgtattgcctaggctggtcttgagctcctgggctctagcgatgcttctgccccagccttccaaatcctgggattataggcatgagccactgcatccagctcacatatttttttaattgacatttttattctgttgtatatgcccattgtaaatatgatatacctgtttattgagactatcatctctgtcctgcagcatagatattttcatcataagtttttttgtgtatttttgttgtatttcctattgtgcagtttctctattttacagttgattgttatataaaattaacagtattcatttatgtgaattttgcatccacatactttagtattctaatagtatttctgtggatttaccgtattttccaaatagagaatcagttttctgagaatgaagacattactcttttcccacttctttttttgtttgtttgttttgaaacagagtctctgttacccaggctagagtacagtggcatgatcttggctcactgcaacctctgcctccagggttcaagcgattcacctgcctcagcctcccgattagctgggattacaggcgcacaccaccacacctggctgtttttgtatttttagtagagactgggttttgccatgttggctaggctggtcttgaactcctgatctcaggtgatccacctgcctcggcctcccacactgctgggattacaggcgtgagccaccacacctggtctacccacttcttatgcttttttaaaaaaatgtttttcttttggggaatccccatatccacatacctttcctggcttgtatttataaaacagaatgtcaggaatttgtctcttgaagatgctactttccaaaagaattttttgttgtgatgaaaacactctgtatctgtgccattcattaaggacttgtgtggctatgggacacttgaaatgtggttagtgcaactgaagaactgaattcttagttttcttacattttagttaaaatttagatagcgtgtggccagtagctgccatactggacagttcaggaagtatcatgggataatgggaaaagcactaaagctaaatgtaccaagttttcactgttggtcttcttacttcctatttagctgcttgtgcaacttagtaaatattagtttctcatacacacagtggggatgataatacctaatccacataatagtacacacagagaaacatcatcatatagaaaatggattagatggatgtataccaaaatgatgtaccaggtaaaagagtggggaaggaggccgggtgtggtggctcacgcctgtaatcccaacactttgggaggttgaggtgggtggatcacgaggtcaggaaatcgagaccatcctggctaacacagtgaaaacccttctctactaaaaataaaaataataattaaaaaattagccaggcatggtggcgggcacctgtactcccagctacttgggaggctgaggcaggagaatggcatgaacctgggaggtggagcttgcagtgagtcaagattgtgccactgcactccagactgggcaacagagcgagactccgtctcaaaaaacaaacaaacaagaatggagaaggagagaaatagtcaaaagaaactatagccttaaaaggtaagttttatctttttttttttttttcaggataatctatttgaaatattaatcactgtaatcgtaacacgttaggaggccaaggcaggtagattgcctgagcttaggagttcgagaccagcctgggcaacatggtgaaaccccaactctacgaaaaaatagaaaaaattaactggacatggtggcatgtgcctgtaatcccagctgctctggaatgtgaggcaggaggatccttgagcccaggaggccaaggctacaaagtgcaatggttacaccattgcactccagcctgggcaacagagtgagaccttggcgcaaaaaaaaaaaaaaaaaggaaaataatataaatattaatgtaaagttattttttagaagttcaccttttttggctgggcgcagtggctcacgcctgtaatttcagcacttcgagagttcgaggcgggcagtcacttgagatctgtagttcgagaccagccaagccaacatggtgaaacaccatcttgaccaaaaatacaaaaattagtccggcatggtggcatgcacctgtaatcccagccacttgggaggctgaagcaggagaattgcttgaaccctggagacagaggttgcagtgagccgagattatgtcatagcactccagtctgggcaacaggagcgaaactcagtctcaaaaaaaaaaaaagcacacatttcttgcacatagtgtgaagtctggggttttagtgtacccatcactggaagagtaaacattgtacccagtagatatttttcaaaccccactttttggaggagtctcccatgtctctctctttttttttttttttttgagatggagtctccctccgttgctcaggctggagtgcaagtgcagtggtgcgatctgggctcactgcaacctctgcctcccaggttcaagtgattcttgtgtctcagcctcccgagtagctgggtttacagacacccacaacgaggcccaggtaatttttgtattttagtagagatggggtttcgccgtgttgaccagactggccttgaacttctggcccctagtgatctccccacctcagcctcccaaagtgccgagattataggcgtgagccaccgcacttggcctgtagttattcttatagagaccttttacttccttggttaaatatattcctaggtattttgttttagattttattattttatcttatttttaattttatttgacagggtcttgctccgtcgcccaggctagagtacagtagtgctatcagagctcactgtagcctcgacctggtaggctcaagtgattctcctgcctcagcttcccaagtagctgggactacaggaatgaaccaccacacctgactaatttcctttttggtttttgtagagataaggtcttactatgttgttcaggctggtcttaagcccttggacccgagctgtcttccagcctggacctcccaaagtgctgtgatttcaggcatgagccaccacacttgttcatttttttttttttctgtagctattgtaaatgagattgctttcttgatttaatccttggctagatgattattggtgtatagaaacattactggttttcatatattaatcttatatcctgaatctttattgaattcatgtatcaaatccaagagtttctcatggagtctttagggttttctagatcatatcctcagcaaacagggaaaatgttgacttcctgctttttgagtttgaatgccttttttttttcccttgcctgattactctggcaagatgtccagtacgatgttgaataagagtggtgaaaatgagaactcttgacttgttccagttcttagagggaatgctttcagctttttcccattaagtatagtgttagctgtgggtttttcatatatggcctttattatgctgtgtgttccttctatgcccagtttattggggatttatatcaattttatcacatgctttttcaacatttattgaaatgactatagagtttttgtcctttattatgttgttatgatgtgtcacatttatggatttgtgtgtgttgaaccatccttgtatccctgggataaatcatacttgatcatgatgtattatcttttttttgttgtttattttttaaaagttatttatttatttattttgagatcagcttgtgagactggctaatttttttattttgggtagacacagggtttcaccatgttggtcaggctggtctcgaactccttgcctcaagcaattcactcaccttggcctcccaaagtgctgggattacgggtgtgagctacagtgcgtggccatttatttgtttgtttgtttgtttgtttgttttgagatggagtctcgctctgtcacccaggctggagtgcaatggtattatcctggctcactgcaacctccactttctgggttcaagcgattctcctgcctcagcacccccaagtaggtgggaccacagacttgcaccacaacacccggctaatttttgtatttttagtagagatgggtttcaccatgttggccaggctggtctcgaactcctgacctcaggttttccacccaccttggcctcccaaagtgctggagttacaggtgtgagccatcacgctcggcctatttgtttatttttaagggttgaggtcttgctctgttgcccaggctagggtgcaatggtgtcatcgtagcccactttagcctcaaactcctggtctcaagcagtcctcccaccttagcctcccaagtagctgggaatacaggtttttgccatcacatctggcttattttattttattttattttatttttgtggagacaggttttcttgctcttttgaccttgcttgtctcgatctcttggtctcaagtgatcctcctgcctcagcctcccaaaatgttgggattacaggtgtgaaccaccatgccattattgtattatctttttgatgtgctgttggatttgatttacttgttttttgttttggatttttgtgtctgactttattagggatattggtctttagttttctgcttttattatatctttgcctggttttggtatcagcatattaccggcctcataaaatgagttagagagaataaactcctccttaatttttttagttttgggaggacttgtatcagtatgttgtttttatatttggtagaatttggctgtgaattcatgtggtcctgggctttttttttttttttttttttttttgttgggagatgttttattatgattgaatctcactgcttgttattagtttgtttagaaattcagtttgtttcttgttcaatctcaggaggttgtatgtttccaggaatttacttgtttcctctaggttttctaggttgagtgtagagttgatcataatagtccctgatcttttgtatttctgtagtatcagttgtattcctttttcatttctgattctgtttatttggatcttctctcttcttggttagtctagctaatagtttatcagttttgtttatcttttcgaaaaccagcttttcagtttgctgatgctttgtatatttttgttgtggggggctgtatttcatttagttctgtgttattctaactttgggtgtggattgttcttacttttctagttccttgaggtacatgtaagattgttgatttgttacccactttctgatgcaggcttttaaggctatacacttctctctctttgcactgcatttgctatatcccacagtttttctgatgttgcgtttcattttcattcatttcaaaaaatttttaaatttgccttaatttctttgttgacccagtgatcattcagtatcatgctgtttaatttccatgtatttgtactgcttccaatgttcctgttggtattgttttctagctttattccactgtggtcttgagaagatacttgatatgatttcgattttcaaaaattttgttaagactccttttatggactaacgtggtctgtctaggagaatgtttcatgtgttggtgaaaggaatgtatatactgtcattgttgagtagactgtcctacgtctgttaagtccatttagtccaaagtccaatttaagtccaatgttttctttgttaattttctgtctcaattatctttctagtgctgtgagttgggtgttgaagtctcccactattattgtattactgtgaatgttattgtttgattatggtattactggtagatcatttccagctttccctattgaaaacagtattgtattgaacatttctttgtagggtagacagtaacaagtgctattattgagtcatagaatataggcatttaaaattttaatagataatgccagttggctatacctgtttgcgcttttacctatatgtgagtctagcttttccacatcctcacaagtactgacattgtgttttatgcctatcagttagtaacttttggatataattttgattttcctgaataacatagtatcttataatactataaaattatagtaagtaggatgttgtgacattgttcatgggttggaaaatgggctttcatactcaagtatatgtggaaacaaggggaaacaaggaaagaatggcagtcatactaccctgtcctctgcatcatcactggaaggtgtaaaatgaccttctcttccatcactttgaacgtcactccaagtagcctcactgtcattaagctctgatagtctctattttacatcagttgtagagatctctttcacatcagttaccatacaaagtacaggatgctaggtgatgccacatcctgttacaacttaatccccatatagctctgtgggcactgaggcaattcctacctctagttggactcccacaattctcctcccctgctttagttttctatatagcattcagaatacttactagcttctgaaaagaatgtaactcatgtccttcgcctagaatgttagatacttgatggtagagatttttgtttgttttctttactgcttattcccagcctgtccagcaacaggttttcagtaaatgttttttgtttgtttgtttttgagactgtcttgctctgtcacccaggccggagtgcagtatgtggtctcagctcactgcagcctccgcctcttgagttcaagcgattctcctgcctcagtctcctgagtagctgggattacagacctgtgccgccatgcctagctaattttcgtatttagtagagacggggtttcaccatgttggccaggctggtctcgaactcctgacccccggtgatccatcagcctcagcctctcaaagtggtgaaattgcaggtgtgagtcaccgcgccctgccagtaaatgtttatggaatggctgttcagtaactgtcattggaagagagatgttagatccttatctcacgttattcacaaaagtaaattccagttggtatacaacacaaaacccaacaaaacaacttataaaagccttagaagcaacgtgtgttcctcgagtaaggaattcactcttagatacaaataattttaatacaaaattcatttgatttatagctagtaattggaagttaacataggcaatattttcttttttactaaaaagaaagttgatttattgaaatagactctggataaattgcaattctgtcattcgttttcacaaaagataaaataacttcatcattcaatttagtttaaaaaagtttccacttcatactgataaatatgtttccagccataatatattatctggtgtatttaatcatttctatatgtaatataactagatatttagttacatttcttgttctcccctaaacttgatactttacttttttttgttttccaaaagtgcctattattatagtttgtatattggtgcttcttaaatatctgctgcattctttcatttagcagctaacctattaagttgacccttgaataatgcaggtattaagggtaccaacccccacatatttgagaatccaagtataactttttctttttttttttttttttttgaggcgggattttgccctatcacccaggctggagtgcagtggcatgatcttgtcctccccagttgcagggactacaggtgtgcgccaccacgcccagctaattttttgttatctttttgtagagatggaagttttaccatgttgcccaggccggtctcaaactcccaggctcaagtgatcctcccaccttggcctcccaaaggtctgggattatgggcgcgaatcacagtgtccggccccaagtataactcctgactcttccagaacttagctcctaatagcctactgttgactggaagccttactgataatcaattaacacattttggatgttgtatgtattatatactgtaaggtaaggaaaagaaaatattaagaaaaaaatcatagaaaatatatttactgttcattaaatggaagtggatcatcataaaagtcttcatactcagagtcttcatgttgagtagcctaatgaggaagaagtgatgaggttggtcttgctgtctcaggctggcagaaaatctgtatataagtggactagtgcagttcaaacctgtgttgttcaagggtcagctgtaatttttttgagacggagtttcactcttgtggcccaggctggagtgcaatggcatgatcttggctcactatagtctccgcctcccaggttcaaacagttctcctgcctcagcctccgagtagctgagattacaggcatgcgccatcccacctggctaatttttgtattcttagtagagacagggtttctacatgttggtcaggctggtctcgaactcccgacctcgggtgatctgcctgcctcggcctcacaaagtactgagattacaggcctgaaccagcgtgcccagccgggtcagctgtggaccttggtaagatccaggtaaaagctacattcctgtggacctacttttatattgtacatttgctcattttgtgctttttcttcttctccttatagttctggacatggcaagacatgtgccactctatcgggcactgctggaattgcttcgggccattgcttcttgtgctgccatggtgcccctattgttgcccctttctacagagaacggtgaagaggaagaagaacagtcagaatgtcaaacttctgttggtacattgttagccaaaatgaagacctgtgttgatacctataccaaccgtttaaggtactatatacaatgttcatttctcttgagtttgcctctaacaatgtttttaaaataactccatgggtgtttttgtttttcagtgatatgtgctttttaaaagcatatacaccctcggctgggtgcggtggctcacacctgtaatcccagcactgtgggaggccgaggtggatggatcacgaggtcaggagatcaagaccatcctggctaacatggtgaaaccccgtctctactaaaaataccaaaaaattagccaggcatggtggcgggcacctgtagtcccagctgctcgggaggctgaggcaggagaatggcgtgaacccgggaggcagaggttgcagtgagccgagatcacgccactgcactccagcctgggtgacagagcgagactccgtctcaaaaaaaaaaaaagaaagaaacatgcacaccctcacacacaagcaataaataaacatacaaagaaaaagtatccacccaaattatacacttagaaacatttattcacaattgcttattcagtatctccctgtgtgatctcatagctataggtatgaagtttttcccaaatggtgtcccattgtacctgttagacaaatagatgctagtttctcacataatgttgatgtcagagacatctttcagtgtcaataaataccactgacattgttctaaatacttcaaattcacctttgtatttaggtgctatattttatttaactatttattagtagattttaggttattttcagttcataataacctcatacatacatcttttggtgcttgcagaaatctctgcagatagaatcttagaagtataattcttaggtttatggattacttctgttttattttagaagtcaaaggattcagtatttgatggaattaaaataagtcttaatgcttatctttaaggaaaactgaattgttatttttagtttgtttacaccttagtagattcagaggatgagttctgtcaaaactcttttttaaataacctaggagaccttttcctttcccttggcaggatctgttcagtgaccttttcctttctcatggcagaatctgttcagtggttgtcagtttattcctcaaagatggcctaattctgaattttgaagcatttatactgttaatggaagtttactcctttttcagttaccttttgagtaaattaatgtcatttaccgtatttactgtatttactttgctttttctcacttattttttaagaacctatgacttaagaaatagtgtagatcaaaagatcatagagaattggtcactggaagaataattcttgttagtctttgcctatgagggagaaatcaccttgtgaaggaattctgactttgttggcttaatgtgttgtcattatcactttattcatttattttaatagcttttggcatacaaatggtttttgattacatgggtgaattatatggtggtgatggctcattgccaggcagtcagaatcataaattatagaaaagatgaaatgaagagccagttggtagagataaaaagttgtagactcatacaactctgttactagtaatggaaaatgtaaaggtatattttctttgatagtgtgatattttttcttttgtagagaagagaatagtgttgtatttggtcccctcctatcttgtggccccccccagaatctttctcactggtaaccaaggaagctagtgtaataatataacaatagtgtggtatcataattgaactgaacatctgattgtctcattgagctaatgcctccttgagaagtgtctactaaaacatcttattcccttccctggccatctgtgttgcttattcttgtagaataaacatagttttcagtatatcaatatgtataatatatactgagctttgaaactgccatcatgtctttttaggggaatcttgccctgtatttctgtaccttacatttctgtgttttgagatgactctgttagcttataactaaaattgaaaatttataaaaccttgagtgttttttacccaggtatattttgtcttttagatgaaaaattgcataatgatttggaatgttgttttaggtttagccttgattaaaaacagtatcacacatttatagtgttacaaagtgaaaataaaaccagtaaataataatatccttctttaaactgtgtatttccttatgctataatttctattagatcctgcaaaaatggagttatagagtattgaattctaaggtaattatagaatattcttattgcaggaaatttggacacctatagtgcctctttggtctatttgcttttcttagcttaatctatttcctgttcacataacactgtataattttttgagaaaggaatcttctttataaaaatacaccagttaattcaccatgaaaatttaatttcagatagaggataactgagtttcaattaactggagctctttatttttctatttgattaaccggatgaaattattccatttaaattcttttattcttcagccagagaacattcttcagacttataaactatgtaccaacaaaatatgcatgtgaagatataatgagtgttcgtaaagctcatttcattagattattttatctttacagtgaccgtgtgcagtacatatttttagtaattctttttactgataaacattattatattttgcattaagacttgaatatactttttcgttgaaaccctcatggtctctgctaatctgtgcagcctctgttataagacggcaccggtaaagactaataatgttactacatctctactttcaaggtttaccatatagagaattcattttcagcttcacagagagagtaaaatctattcttttccagttgtcacaacttaagatgtatttttttttctaacagagttcacaaaataatccatttttcccttacagtgtatacccacagaaagtggccttagtttaattttaacactgactcaaagctccccaccccacctgtctgcctcattcccaactgtatttcacaaaaatcctagaatactctgagaagagaatgattcaggaaaatgtgttctgttaatgtatcactttcagggtctattttagtgttttttgagggtttggagctgtaactttaaaaatgctgtgtatcacggccgggtgcagtggctcacggctgtaatcccagcactttgataggctgacttgggctgatcacttgaggccaggagttctagaccagcctgtccaacatagcaaaacccatctctactaaaaatacaaaaattcagctgggtgtggtggcacatacctgtaatcccaggaacttgggaggctgaggcacgagaatcacttgagcctgggaggtgggggttgcagtgatcacaccatcacactccattacactccagtctgggcaacagagggaaactctgtctcaaaaaatacatacatacatacatacatacatacatactatgtatcacacactcagaaacattttacaatatttctgtctctattactgtgaaatccaagggtgaataaagtacatgtatttggtatggttctttttttaagtaagagaaatcgtagtttactacttatttttatatacctaatatatatatacacttaatatatatatatacctaatatatatatacctaatatatatatgtatacctaatatatatatgtatacctaatatatatatattagataaagaaaatagattcattgtgtattctgcagatctctaggtagtgattgtggttgcatataatgattttcattgaaatgatgtgtatgttgtatttgtaatagaatttttaccttccttttggggatgagagaaattaaagaaaaaggtcaagtgtaaagaggatgttaactgtgactgctgagaatatcctgtctatcttgaaatctatcctgaggccactgcctaaacccaattaattttgatctgataattcagagaatggaggagattccataggtttgtgcgcccccaagcccaaaacccttacaagaggagataaaaagacatcattaagaatctggatcccagtgccagcactttgggaggcttaggtgggacgatcacttgaagccgggagttcaagaccagccttggcaacatagggagaccctgtctctacaaaacataaaaataaattagtcaatatcgtgggctgcacctgtagtcctagctgctcaggaggttgaggtgggaggatcgcttgagactaggattttgaggttacagtgagctatgattttaccactgcattctatcctgggcgacagagtgagacccactctgcatgtgtaagaacaaaaataaagaaaataaaaaagaaagctggaaaggcttatcatttaccttacatttatctaatttgtaacatattcatgattataagaaattcatgattaacactgataggtgagatctggcctggtcacaaaatcattactgatgcattcacttaacagattttttttttaatgtctgtgggcacataactagaaaattggtcttctttctaaggggctgacatataaatgggggaaataataaccaggcaggtttttttttttttttttggacagagtctcgctctctcggccaggctggagtgcagtggcttgatctcggctcactgcaacctccgtctcctggtttcaagcaattctcttgcttcagcctcccgagtagctgggattacaggcgtgtgtcaccacgcccagctaatttttgtatttttagtagagacggggtttcaccatgttggccaggctggtcacaaactcctgacctcaggtaatccgcccgcctcagcctcccaaagttctgggagtacatacaggtgtgagccactgcgctgggccaacctggcagttgtaacaacatagtatctgacatattagtagaattcaagacactacaggaaaatcaatccagatttggaggcctaaaggatacataggaattaaccaagaatagagtacaaatgaagaggggcaagggattggtgtcccaagggtatgaaaacaatgttagcagtgaaggaaagcatcacatattcaggggaccttgaaaagtttggtgtgcctgagcatagtgtagctggaaggtagtggtgggagatgagcctggagaggaaatcaggggctagaagataaacaggaatatatcacagagttacttaccttaaaagtaatgttgagccactgaaaggttttcagcagctctcatcaggtttgcattatagaaagatggtcttcaggtgtagttgaatggttggaggggaagttggaacaagaccaaactaccatggaagagactttcatctgttttgtctcagcagatagagctgtatatgtcttctccctgtcctactgttttgggggactgagattttggtactcatcagcactcttgctctcatattatggacttaatagatagttagtttccaggtagaaatatattccatgctccagatatttgtcttaaaaagcaatctgtgttcatattggcaactgcagatttatctctagggatctccttcaatagagtacaagtgccatagcataaatggatctgggaacatggcttcctttgttctcatatacgaatccgacgtctacaatgttaggcagaaattttccaacactaatcctattacttggttatttgacggactcaggcagaaagctatgatccgtcgattgatagaagctaagtcgttaagtcaaaaagcatcttaaatcttttgtattaaggtcctggaatggcagggtgagactccatacatgttcatgtcttcctgttcctctactgtttgcttaaagctgtcacccagctaaagttgtagacatggaacacttatacaacattaaattttgtgtcctatctacccaaatctaaaagagaactcatatgatggtgagatattattaattttattaaataagtcagttttcttgattgaaaactgaaggaaattttcttggtagaaattctttgttagaatgcagaaccttggcatttgtgaggaagaacttttagatgttataccacctatgctactgtttacttaaatttttctttgccttttttttctacttagaatttttcttcagatcaacttaaaaaattaaacaagtttttcttaggcttttaaagaggaaacttcaaattacccccatagcggatggaccattatcatttgccataaataggagacagtgtaaacatgagtgaaccatttactgtgaataaaatagtgtttacttattaatccttgaaatatattagaccatgtgtgcaaagcagtacaatcgggaataatcattcagattttgtttgttaaatgaaacactggaaaaataaatgcatgtccatcaaaaggaggattgtttatactacagaatattcatacatgtaaaattgtgcaacaatggaaaagaaaagtgatctatattttattttatgtatttatttattttgagacggagtcttactctgtcacccaggatggagagcagtggtgcgatcttggctcactgcaagttccgcctcctgggttcaagcaattctcctcagcctccccagtagctgggattagaggcccttaccaccacacctggctaatttttgtatttttagtagagagggggtttcaccgtgttggccaagctggtcttgaactcctgacctcaagtgatctgcccccctccgcctcccaaagtgttgggattacaggtgtgagccaccgcgcccggcctgatctataatttagatgtaaaaacagccagctcttggatgtatcattgaatttttaaaaggaagctgggctggatatggtggctcttgtgtataatcccagcactttgggaggccaaggtgggaggatgattgcttgagcccaggagttcaagaccagcctgggcaacatggtaagtaaaaccctgatatattagttgagttgccttgtacactgtactccttttaggtggtgtgctgtggagtagagtaggtagaaccaatattgcagccatatcactgaactttctgttcatccaaaggttttggtaagaatgactgcttagctgggcgtggtggctcacgcctctaatcccagcactttgagaggccgaggcaggtggatcacctgaggtcaagagttcaagactagcctggtcaacatggcgaaacccgtctctgttaaaaatacaaaacaattagctgcgtgtggtggcacgcacccgtaatcccagctaccgaggcaggagaatcacttgaacccaggaggcagaggttgcggtgagccaagatcccactagtgcactctagcctgtgggatagagcaagactctgtctcaaaaacaaacaaacaaacaaacaaaaaaactagaatgactgcttaaagaaggaactcaggattaacactgtgggattttcttttatgtcttgtagttctcttattatagagttttcactattatatatagtaatgtatcaggtacataattatatataatatctctaatatacatacatacatatatctgaaaagtagcctctgaatttttatttttgaaacagtagactttaagccgtgttttaagttgtcctcaattacaccttaatactaagtgattaatctcttacagtttggtgcatgataattacagtactctgatgggattgatatttagtgtaaactagcgcactgctcaaggaatgagtgtactttttagttaatttcatcttttctgacttacctgttagagtaacctattgacactgtaaggtggcagctaggggtgtttaatggtgatttagtctgtgttttgaaagttgacaattctttaggcagttgttgggtattcactgtacagattgttttaagagcttcataaagatgatgttttaatattttttggttcagggctctgtgtttctgtaatttactatctttcctaataccccctttcaagagtcgtgatttgtaataactgcatggtgttaagtgtaaaagttaacacagataaactgatgaatattgatgttggctggtttactaataaccagaatttgaattaaggccatttctgagatagcattccttctggaggaacaaaagattaggccagtattttatgtcaaaatagagattttacattcaacactttgcattttttgaactagaagacaaggttagagttaagtattctcaggattttcttcagaaattaaaggtgtttttttaaggaatatatgtgacatttggtacattagtttaatagcattttgaatgtgtactttacctatacctataatgctaaaacgtattgtaattttttttccccctgagacagtctctcactctgtcgcccaggctggagtgcagtgacataatcttggctcactgcagcctccacctcctgggttcaagtgatttttctacctcagcctcccaagtaactggaactacaggctcccgccaccacgcccggctaatttttttgtatttttgtagagacggaggttcgccatgttggccaggctgttcacgaactcctgacctcaggcgatctgcccatcttggcctcccaaagtgctggcattacaggcatgagccaccttgcccggcctgtaaatttcacttagaccattcttctaatatcatctgtcacttaaaacctaaagaataggctgggtgcggtggcttacacctgtaatcccagcatgttgggaggttgaggtgagaggattacttgagcccaggagtttaagacaagcctgggtaatataacgagacccccatctctcttctttaaaataatatttaaatttaaaaaaatttttttggctgggtgcagtggctctcacctttaatcccagcccttcgggaggccaaggcagacaaattaactgaggtcattagttcaagaccagcctggccaacatggtgaaaccccatctctactgaaaatacaaaaattagctgcgtgtggtggcgcacagtgggtgtaatcccagctgcttgggaggctgaggcaagagaatcgcttcaaccggggaggcggaggttgtagtgagccaagatagtgccattgcactccagcctgggctacagaatgatactccgtctcaaaaataaataaataaataaaagttttttaaaacctaaacaataaaaagtggagcatatcaggatgctggcattgtatgtttttcttgttcaattaaaattatttttaataatagtttgaatgaaaatggttgattaaaccctaaatattggttctttttaatttatttgcctgtataatgttaagtagttctttattttatttcagaggaattgtttaagaggcttatttcctctacttgcctactatcatattaggcagaagaaaaaaacttagtattcacccatcaaggacttgcactctaggtgagatccattccctgggctagtgtttgaaaattcctgtaaccataaacgttttatttttttagatgcccttaggctggcaatattcaatcgctttgtgattgaaacccctttctttctggcagaaaaaaatataccagattatcattaattctatccccaaagccttagattctggcttacttctttagttttataatttagtcatttttgtatgtaatatttttggggtttaggcctataaagagtgggaggaaatagtttcctaaggaccaagacagaaaaagagacttgaaaagtagcaaagggtatatatcaggtgcaagcaatgttgcacacgggccaaagacaacctgtgaaaagatgtttattgatgcacagactccaagcctcattccataccgattgtgaggactcaaaatttggtgaaaatcaattttagaaatgttctgattgacgacttaggcagatacaaaacaaaattatttcatgcattccttttgttctaccaattaaattttgattagtacaatatttggttcttttgtttttttttttttgagacaaagtctcactctgtcacccagtctagagtgctgtggcgtgatcttggctcactgcaacctccgcctcccaggttcaagtgattcttctgcctcagcctcctgagtagctgggactacaggcgcgtgccaccacacccggctaatttttgtatattttgtagagacaggattttgccatgttggccaggctattcgtgaactcctgacctcaggtgatccacccaccttggcctcccaaagtgctgggattacaggtgtgagccaccgtgcccagccgattagtacagtatttcttttccagcctctgtgctttcatttttttctcttcttgtttcttgaaaataagccaatctgccctaaatcaagcatgcattgtaataaatacatagttgcgtatagttatataagaatataaggagttaataatacagtcctaacttttatgtaggatttatagtttctgaattgcttaggtatatattgatttttctgctctatgtagtgggcaagaaagtatgtactattcttatttgatagaaaatgaatctgttgcttagaatgttacattacaaacttagtaataggtaataaagctgagatttagcttctaagccttctgatactgttgatgttcatcatggaaaacagtattgatgaagaaagatagtttgattgacccatagtctagctacttctatttttatataccactactacccactacccaaatagttcattgatcattaggattcacgcttgtataatggctaaatttaagccttaattggttgttggaaaacactgattaaatgcctaaatacaacttactctgttacttaagtgatttaaaaaaaaaaacaacttaaaaaaaaattataaattgacttagtgtttctgcctcagaagcataacatattagtataaaatgatcactttattctttatcaaatggcattatatgagctttatgtttcacgacagttttcactgtattatctcagacaaaatctcaagcagtccttttttttttttttttttttttttttgagacagggttaaactctgtcacccaggctatgtggcactatatcggctcactgcaacctccaccacccagagcgatcctcccaccttgacccaagtagctgggactacaggcgtacaccaccactcccggcgaatttttgtgtttatagtagagatggggtttccccttgctgcccaggctggtcttgaactcctgagctcaagcaatccacctgcctcagcctcctgaagtcctgggattacaaatgtgagccactacacccggccaaaatctcaaccagtcttaattactgaatttgaagtctgttgctaagtaaaatttacttcgtagcaggtctttctgggcacattacatttagtaacttgttcatattatctatagattttagcattcgggtagttcaaattccacctttttataaatgagaaaaacaaagttcatacagactgttatttgttctcagttctctgatggttagtgacatagctatgataagaactcatacctcctaatgtctcaaaacatttatctgctaaattaaacttcactcccaaataataattaggtttgtgtgtaaatgattaattaaaaatcagagcatggagcttctgagctggttctaatatttaggatatttaagaattatttttaaggggccgggcattgtggcttacgcctgtaatcccagcactttgggaggctgtggcacacagatcatgaggtcaggagatcaagaccagcctagccaacatggtgaaacattgtctttactaaaaatacaaaaattagctgggaatgatggtgcgcgcctgtagtcccagctactcgggaggctgaggcaggagaatcatttgaacccgggaggtggaggttacagtaagccgagatttcgccactgccctccaacctgggcaacagaacgagactccgtctcaaaaaaaaaattatttttaaatgatggcaatgaagtaaaatatttttagttgaaaaaaatctgcttttgggctaagtgtggcggttcatgcctgtaattccagtgctttggcaggccaaggcaggtggatcacttgagactagcctgggcaacaaggcaaaaccctgtctctactaataatacaaaaattagccaggcgtggtggtgtgcacctgtaatcctagctactcaggaggctgaggcatgagaatcgcttgaacctgggaggtgaaggttgcagtgagccgagatcacgccactgcactccatcctgtgcgacagagcgagaatctatctcagaaaaataaaaagagaagaaaataacctgtttttgataatttaaaaaatacatagaataatgtgcattttacagaattttcttactgttttccttttactcatgtgttttcactcccctgaagaatttgtaatatcctatgataggagattaaagggcagcatatttcactaaatatccatagtattctagtcacgtctaattactagattaccaaactaaactgagactcattgtgtttggttatctctctagtatgagcaggtagcaactttataatcacttttatgaagagtaggtcagctttagctgtcgatgtttttcttgcagtattaactgaataagaattaataaggctgggtgtggtggctcacgcctgtaatcccagcactttgggaggcaggtggatcacatgaggtcaggagttcaagaccagcctggccaacatggtgaaaccccatctctactaaagatacaaaaatctagccaggcgtggtggtaggtgcctgtaatctcagctactcaggaggcttgaggtgggagaattgctggaacctggaaggcggaggttgcagtgagccaagatctgccattgcactccagcctggacaacaagagtgaaactccgtctcaataaataaataaataagatttttctgaaattttcttaattattgatggatgtacttttctactgtcttttcaagatgatttggtatccactttcgtagattagggcaatgtcttggtgataaaatggcattaccaaaagaagccccctgctcccacacacacagtattattttccatttcctgcattttattgtggtttaatgtaccctatatttctaatatctttagctcctttgtcaagaagagatggttaaaggatttatgcagcagtacttgatatttaaagagtaagcaaaaacactccccatttatgagtattgttcaacattttattttagactgttagaaaagacagaacttgaaagtaactctcagttacctccactaataaagggatttctggcgtggataacataatactttaaatctgtacatacatattgtttttacttgaatttaaatattattatctattgtgaaaattcattctgttacccacaaaatagtcactctgtgaagatgggaccctttagcatttacaagttagttctggtgaaatttatctcctgctggtcattccagctggtattatcttaagatgaaattaaaatatagccatagtagttttacttttgaataaatatggtatttcatagcttccttcaagcaggaacaaagccttttttttatatctgatcttttgtgcagactttttctgctgtactccaataagcaaaaatcgtatttagtgtagttggtatttgatggtttcaccaaaaatttgagagagaaacttattgtgaataaaaaaatcttatttgctgccagggcatgacacaaatgactctatgttcagtgtaaagtgttctggatatttaacttctctttgaacagcattgaagcaagcatcttttattgccgtttttcctagctatctcaaagtttcttcctaatggaaagttgttcatcatagttttaaataactgaagtcacttgtacaagtaccccacttcctttttatatacctaagcaatgggagatcacttgatttacatctttcaaggcatattttctaccagactcttttattttaacccccataagctggatcttctagcactttagttaaaaaaaatttcagttccagccctcctactttgatttctgttgaaaaacactcttttacctctgcttcttatacctaaaaatgaaaaagtcctgatttcttagccagatagcatttgttatacccatatatttctttaaacattcctgtttttgatggtggtaaacaagttcagttgtttgtcagtcttttttcacacagataggcaaatatttattttaacatctcttctttgactggctcagttgggttgtcccctggtaaactgctgaaacatattatttgtggcaactctatttaacagtagcatgcagtaccttccgtatgtctggtgatgtttaatttggcctaaaaattagtatatttgtgtctagtatagaaatcaaggttttatttttaaaggcttcttataactattttaagtattcccttctttcatgctcacttatgctaccaaaatatttttctttcaacattcatttaaatcattcaaaattaaactggtacttccacttagagattaagtaaaaacaaaaggggatcatagagttaaaaactaagctttaaattaatcacagaaaacatttatagtacggagatcttcgcccgtttactggtgcatttcaagaattatttttgtgcatcctggagatactagaagcagtttcccacagtaatatttttatttactctttcagtttacctctaatctaaactataattactgtcaaagagctttagaactgaggagcacagtgtgatcagtgctttttggtaaatgtagaagtttcattctcttatagttttagaatcttcttctgcagtgctaattcttaatagttgtgaatctacatttcagcatgtagtctccagataacttcttcaaatggctctccttttttaaatgtttattgcaactttgcagtatgtttagcttagatttaggagtgcaaagggttaaaggggtcttgttttatcaaggaaatagctgtattaagctgttttcagtttttggattataaaataccataattctgacatggtgtatttagtcttactaatactcaactttatttgggcggtagatactggtagaggcagttcaatataattgaatgttgaggtatgggtttgcttttttgttttgttttcaggagaaagatttgcccattttgctcacatcctacttcagatatgtgtcacagagccaaaatttgtttaactaattagctatttagttggaattcacagcatagtggaaaatgtttgcagataattctgtgcaatagtggaaacttcagttgcttcctcgtatttcttcagggcagtgatcacaaccagattcaacgtatgcacaaagcagcggataccatggtagcggccgtcgctgattgcttttaccatgttggatccattgtcagtctcaaagacctacttccagctaggtgccttgaactcaaatagcttttcacacagacttcaggatgtgagctaaggtatggccttttttcatgagctgggcctacatatgggttgacagtaacctgcaacttttatagaaaagagactactggctatagtttaatgtcagacaatgactagttagaatcattgataggcaggtagtgtgtgttcttcatatattcaaagtattctcaccatttagagattttctttttttcggtgtgtttttgtcagactattcaagtaaagatttctcattagaacctggtcaaaggtctaatatatatctgctttatgattcaaccattgtcttcaatatgaaatatatatcatttctttcacacatttgatgtaaagaatttttttaaacttctgaggattcttgcacaattatttttcttttactttttcttaattatggtaaaaaaataaaatttatcatcctaaccttgtgtactattttaataatctcttactaatcttctttttaaaagtggatttaggaaattggcatgaatagagcttgagatttagaatcagtagttccaagggtaatctacacactggggtggtaaatacaataaagacctaaactggattgatgcagttcatgctccatgctaaagattcttgtttcatcaaagagaaaataacctttctggaaaaagagcttcactttcatatcttccttctctgcaagatatgtttctttaagtgaaatctttattgagagtacagtgggttaactcattgattataggcttaggaaactatattttattatggctgtaatcataactgctttctgaaacaagttactgttgttttcttattcagtggccctgttacttaataatttgtcaagacctggtaatagagaatcatttacaactggggagtaagagtctttgtaaattcaaagtgggtactgtcaagcagcttatgcacttctcttcattctcagtgtttgacactgattgttattagctattgacaaatgcagaagttggtaatctgtttgagttactctaccagaatcatgtctttattaagaagtgactcactgttaaactacagtctcaccttaatttcatagctgtaaaagacacagtatagtagttgactcgagcagtaaaattctctgatatttcagtcttcagacgtacactatactctccttatatatgcaaaaacatatattcagatacatgtacatagacgacagttgatgactgaaatggtgtacagtataacatctgccaagtcatttcctgagtggtaaaggaaagtggccatgtgttctctgacttcttataactcagggaagataagaagagagcacaggaaaaaaggcagccattcagtgacatattatacctcttcagttaagtcaggtgacataagtttttaccttctagttaaagatatctgtagaaactagtttttgtttacacattgtaggaaccaaattcaaaacacatgcatgatactattttcatttattcttcctacccacttgagtggcttctgagtttactgtttatctaccttgagttaaggattgaatagcttctgagcagatttttgtttttgtgacaaggaaaggttcatttgtatgtagatgacatagtattatttgttaaggattctttttttttttttctgggagatggggtttcactcttgttgcccaggctggagtgtaatgacgtgatctcggctcactgcaacctccgcctcccaggttcaagtgattctcctgcctcagcctccccagtagctgggattacaggcatgcgccaccatgtccagctaattttgcatttttagtagagatggggtttctccatgttgttcagggtggtctcgaactcccaacctcaggtgttccacccgcctcagcctcccaaagtgctgggattacaggcatgagccaccatgcccagcctatttgttaaggattcttctactgtctgttactctttttatagttctctaaggctccatgaccactttgcgagatagtattttaatgtaatgaccaagtccctttttaggtaggtatacaactaaaaaaataagtgatgtatagtttagatcataccttagcataaatattttaaacacttttatttatatacgattttagtttgtttcaaatgatctatttaaagaattataaagatgtagatttttgaaattctaagcagtagtgtaaagatgtttgtgatgtcaataatgtgctgagagttggaatagagaaaaggaaataatgtttagttgtgttttcagtgactcttgtattaaactactagtacatttatctagaaaatttaaataaaaatgtaatgtcctatatacttaaaccttgctgtaatacatcctattgtgataacaatgtgaaatgaaattgggtacattttagatcctgataggaaataacagaataatatctttaaaatgaatatgccctaaaacttagtgtctcattaaaagatccaatgtatagaaacacattgtattaagacacccagtaatgaacctacattttactctaaaatatgtttttttttcttggaaatttaattctgagtgaaatacaaatagtattaaaatttaaaaactgcttgtggtcctttaattctcaaatattttaggtgtagaagtgatttctgtctctgaatatttataattatgtgtgtttttaaaagtgtgtctctgaggacatcaggtatctggatcttttacagtatgacatttatataatgtctgtctcttctctgattttatattagaagggaaaacctacccataactttactagccagtggcttcaaaagcaagttaatatagatcatgtgtgtgacaaatgaaatgcacacactcatttgtatattgatttatggaggtgttttagtcctaaaatcttaattttccttgcttttctttccatattaaaaaaattcagatctaaaagggaaaatgttaaaacaggagtaaaaccagatgcgtctgatcaagaaccagaaggacttactcttttggtaccagacatccaaaagactgctgagatagtttatgcagccaccaccagtttgcggcaagcaaatcagggtacaaaacttttcctattatgccacttttcatttgatgtaaagatgtttcatttacttactgaaacctgcctttgtgtttttgctttatgttaatgattttaaagcaagttcatttacctaaaaattttgttctctgttagattttgttctttatctgatttcaatcatgtatagtctaatttttaaacatttctactatatatgattgctaaatttagtaggctgagaacatacattataaatatttcttccccctgaaattcatgaaattgaaaaaatgcctttatattagatagaaaatagtacattaagactatgggtgagaatttagtttaaattgatatctctggctggcgcagtgactcacgcctttaacccccccagcactttgggaggactaaatggatagatcacttgagctcaggagttcaagatcagcttgggcaacatggtgaaaccccgtctctacgaaatacaggaaacattaggtgggcataatggcgtgtgcctgtggtcccggctacctggaaggctgaagtgggagaattacctgagcctgggaagttgaggttgcaattagctgtaattgcaccactgtactccaagcctgggagacagagtaatactctgtttccagatagatggatggatggatggatggatggatggacggatggatagatattttcctatgttagctgaagaaagtgatctgaattatctattgtttcacttcctcttttcataaagatgattatgtttttgctttattgttatgtttatgttattgttatgtttatgaaatagaaattttttattctcagagcggttgtaataagataattgtgaagaagttgacaattttttggaattcacaatttgaactctagaggtgaattctttttagttttattttttaaaatatatacttaaaatgtatatgttatttatcttgaaatattaaataacagaaaaaaaactgggtgaatactccaagaaggcggctatgaaacccaaacctttgtcagtattaaagtcacttgaagaaaaatatgtggctgttatgaagaaattacagtttggtaagatgaaatttttgatttgcttaagatctcactttccatttttttttaacagtgctattgaaatgtgttttagcaaattaaagatttttaaaattgcttgtaacatgaattttacttcatacatatcaacattttttatcatctttgcctcttgaatttatgtctgtatttttagttataaactgtgacttcaatagaaggactgtaagagcctagaaaaaataaatccaagccaagtgtctacaaaacaggcagaaaatgtttttccttatttacctcttcatttctgtacatcctggcctgaaggaagccaagacccagaactttgaactaagtctgttactcttgccattttagatttccttgcaattcacctttagaaaatgtagttatacatagttcagttctagcttttcccattccaaaactcttgacaagtaagaactggcaaaaagattatatcagtaccctttatatggttctgatttatgagaaaacacataccaaattttgatgaccattattaactattattgtctatgctgctttttcatccttgagaaacaacctaaaaatcttggactgtatttttttaaatgctaaagtaggattcagaaaacagatttttgtcatattgtctttgaaacctcattataaatcatttagcttttgctctacttactttcaggtttgccataaagagcacaagagataatatatatgaaagtgatttatacttttgttaagagttttggtcagtgtctaatgatattacagccttttgcctgactcagcttggcaatctagtctgttaacttcactctaagtaataatattaacttggtttttaaataataaatattttattgaatttattattttattgaaaattcctttgtgtattaaagtactaaaaccaaatactttatttcatttatatgaatttaattagcaattaccaaggttttttatggcttattttatcaaatagttctatattatatattgtcacataaattacccctgtaacttatttgctttaaaaaactgacctggccgggcatggtggctcacgcctgtaatccagcactttaggaggccgaggtgggcggtcacgaggtcgggagtttgagaccagcatggccaacatggtgtaactccatctctattaaaaatacaaaaattagctgggcatggtggcaggcgcctgtaaccccagctactcaggaagctgaggcaggagaatcatttgaacccgggaggtggaggttgcagtgagctgagacactccagtctgggcgacagagcaagtctccatctcaaaaaaaaaaaaaaaaaaaaatcatgacctttattatctcactctttacatgggtcaggaattcagaaaaagccatagtgcctgttatgaccttgtcttagaaagtgtacagcatcactcactaagtccagccaacactcaaggggaggggaagagtgtcagaaaagagtttccagacatatgtttgtgtatgtgtgtttctgttggacataaatattttattgggctttagatttcgttccgcttcctgggtcatcaaaaatatgtcagctaatggcttttaaaaatacatggcagtgttcttgtacttgaaggcgtttagtcatatttcatatctacaaattctttaactagttctttcaatccagaaagtcatttcatgtatatgaatgtgtttatggatccttatgtgtgagagattctggtttaaagttactacctgtcagaaatttagaatcatatgtccagaccccttcattaatgttagctagctagaagagttctctcatactacataaaatcataaactctccaagtatgtgactttaaacataatcaagtttgctccccattggctttcaaaataagtctgaaaacatgcaagttttcagttgatgctttcataagaaactgcattttcaaccatatgtatcaaacattttctagtatcattcttttacaacttgatacttactaactgcctaaaattccataatatgattggctgccatttgtttaaccagtaagtggaactttagtttgtttccagtatttaaatatcatatgcaacatctcagtggctttcattacctgtaaatatttgtgcatatccaggattaattctgtaggatgaattaacagaagagaaatgattgattaaaacaggctgtgcatgttttatcaagtagccattgtctttgattgaatcatttatttaatgaaatctttgagttaatagaccctgtcctctatatgatataaaattttcccactgggcatagtaatgggcccatttcttgcatctgttagattgttttttataaaagttaaagaaaatgtatccctatagcatgtgaaagacaagagtccatccatctggcagtgctaatccatctggcagtgctaatatataggtgttatgtaaacatttacacttttgctattcttccatggttggaagttctctccagttgagtgggagaaggactagtgattgtttgtgatttttgtcattataacaattttttgcagttctgggttttattttttcttctccttttagatacgtttgaaatggtttctgaagatgaagatgggaaattgggatttaaagtaaattaccactacatgtctcaggtgaaaaatgctaatgatgcgaacagtgctgccagagctcgccgccttgcccaggaagctgtgacgctttcaacctcactgcctctgtcttcatcctctagtgtgtttgtacgctgtgatgaggagcgacttgatatcatgaaggtaaaaaataatgataataaagcactctcccttatctccttggctcatctaattactcaaatttttatacaaaactggaaatactatacaaataaattatacaaaacactagaaattttggtgaccatttttagacggcagtgaaaggagcctccccacccctcccccccttttttttttggcgacaggatctcacttttgcccaagctggagtacagtgatgtgatcacagctcactgcagcctccacaaagagcccttttctaatgttagttcagagtgtgtggatcacgctgctgttgaaaaaaacatttagaaaatatcaaaagagccatcatccttgagcaaagattgtgtgaagctggtcacaatatcaaaggatttaatgctgatcagttaaaaaatgttacaggatttccattttgtcatccaagatacttctctcatgttttttagtgtcactcttcaaaacttagtcattttctgtcttttctaggaaatttatgttttttttaaattcctaacatctgtgaattataggtaatacaataatatataatctctacttttatgtttaacacgtgataatctggccttaaattccaagagtctgctgcatcaagaaaatgttaaacatttaacccgaaaaagaaaactttctttatatttatgatttaattcatgggttaaacattctgtcttccatagatacgcagctaaaactattggcccattgacttgtagaaagttttatttgtttgcttgcttcttttgattttttggataggctcatgcctgtaatcccagcactttgggaggctgaggtaggcagatcacttgaggtcaagagttccagaccagcctggccaacatggtgaaaccccgtctctactaaaaatacaaaaattggctggctgtggtggcaggcacctataatcccagtacttggcaggctgtgtctggggaattgcttgaacctggaaggtggaggttgcagtgagctgagatctcgccactgcactgcagcctgggcggtggagtgaaactccatctcaaaaaaaaaaaaaaaaaaaaaaaaaggcctggtatgctggctcatgcctgtaatcctggcattttgggaggccaaggtaggcagatcagttgagatcaggagttcaagaacagcctggctgatgtggtgaaacctcatctctactaaaaatacaaaaattagccaggcatggtggtgcatgcctgtaatctcagctactcgggaggctgaggcaggagaatttcttgaacccaggaagtggaggttgcaatgagccgagatcacaccattggactccagcctgggccaccaagtgagactgtcttaaaaaaaaaaaaaaaaagctgttcttattttggccaggcacagtggctcaagcccgtaatcccagtgcttagggaggcctatgcaagcggatcacttgaggctaggagtttgagaccagcctggacaacatggggaactggtctctactaaaaatacaaaaattaaccgggcatgttggcaggcacgtgtgttcccagctattcaggaggctgaggcaggagaattgcttgaactcaggaagcggaggttgcagtgagccgagattgcgccactgcactccagcctgggcgacagagtgggactccatctccaaaaacgaaggttgttcttatttcatgttggattgtatttttctaaatatcagtgtttaggaatgttaacatagacttttgtatgtttatatatatccaggttctaataactggtccagcggacaccccttatgcaaatggctgctttgagtttgatgtgtattttcctcaagattatcccagttcaccccctcttgtgaatctagagacaactggtggtcatagcgtgcgattcaatccaaacctttataatgatggcaaggtaaattaattgcaattttttgtttcaaatgccaatgattgtatacaaaggttctttgtaatttgaagaaaaattttgttttagttatctgctaagagggcatgggtttctttgtacttctcttccctacgtccagattagcttaagcaatagaaggaactgaaaagagcagaaacagttaagtgttaattaagaagcacttacagtcttaagaagttactcggggacttaacgtaaagttctatgatacatgctattaggaacttattttaaggtgtaccttatattcaagtgtttttacattttcttatattaaaagtaggaagatgcatttccatttacaaaaaagctgaccaaaagacataataaaaatcatctcatatgaccataaaccttttaaaattagatttaaaagagtaatctgtttttcagaggtattttggatactttgatagaatttcaatggtaaattctgtgctgagtattcaatgttttaaaatctagaagagaagaatttcaaaaggtacagcctgcctcagatatgtggcagatatgtggttgcaaattatcattagctcaaatcataaaactagaattagttttttgggtttgttgcaaaagatttgaccagaggcagaactttctttggaagaacaaagaacaggttttctgtagctgagtagggaagaggaaatagcaacattgactttacttgagacactggaacttgaatagagtgtaagtgtaaaatattaagatgtatttaagaaaataattctcaaggcttcgttgcatagagaagagggtaagggcttgggaatcttaaattaatggtcttttaccatcatacttaccgatgtgttccttgatacacacaattgtggacttatttttaaagtttacacactgttagcatttaatcttaggtcctatatctacagataggtatgaggctacatatctgccattgttagtcccaagaatgctctaaagcagggctgtccaatgttttggcttccctgggccactttggaagaagaataattgtcttgggccacacaaaaattcgctaacacaaacaatatagctaatgaactttaaagaaaaatagcaaaaaaatctcataatatttttaaaaactttacgattttgttttgggctgcattcaaagccatcctgggccgcatgtggcctgcgggttgcacaagcttgcactaaaggtcaaatggtatatgtatgacagcactttgaataatacacaagacttcacagatacaactcattaaattattaatcaactacctgttgaatgaattaacgtattttgcgttcttgctttcacagagcattgaaagagtagtaaggagacagacctttctgcatttacgagaaccacctacgccgggcgtggtggctcatgcctataatcccagcactttgggaggctgaggcgggtggatcacctgaggtcgggagttttagaccagcctgaccaacatggagaaaccccgtctctactaaaaatacaaaattagctgggcgtggtggcacatgcctgtaatcccagctacttgggaggctgaggcaggagaagtgcttgaacccgggaggcggaggttgcggtgagcccagattgtgccattgcactccagcctgggctacaggagcgaaattctgtctaaaaaaaaaaagaaccacctattatccaaatctgttggccattatataaaattattaaattattaaaagtgtacaaaatctgatgagtatattttatgttgatagaatatatgccagaagaacacatgtgattggcccagttttgtttttattacaagagtagttacaggtgcagattaagtgtccccagttctcttcctgctaagtgagtaagtatctaatgttatctttaagtatattttgaggaaccctgggaagcctgaatactcttttagggggtctgtttgcgtgaggctagatttgatccatatacttgaatcaaaggagtatattgcaactagttgaatgtagaggcagataattaaatcaaggtctcttctgttaagctattttgcattttcagaatttagaaagaaatacacaaaaatataaaatagtaccacttttattaaaaatagttattttagtaaaaatagaactagcatatgatctatcagtcccactattgaatatatatccaagggaaataaatcagaatctcgaagagatatttgcactgctgtttattgcagcaccatacagaatagccaagatacagaatcaacttagcggccatcaacaggtgaatggataaagaaaacttggttatacacagtggaatactattcagccatgagaaggatgagatcctttctttcatagcaacatagatgagcctggtgggacattatgttaagtgaaatacatcaaacattggaagataaatattgcatgttctcactcacgtagaagctaaaaaaattgatctcaatcaacgtagagagtagaatagtggtactaaagctgggagggaaaggtagagaggagggaatagggagaggttggttaatggatacacaattacaactagataggaggaataggttctgttgttgtatagcacagtagggtgactgtagtaaataaaaattgtattttgtcaaacagctagaagagaggatgttgaatgttaccaacactcaaaggtttgaggcggtggatacaataattaccctattttgatcattacacattgtatacacatattgaaataccacactataccccataaatatgtacaactatgtgctaattaaaaatgttttgctttttaaataatttagttttcattaaaatgttatttgtgttgacatataataggtgctggtctgttttgcattatgaaaaagttataatgcctcacaaatttgaatcacatctgaagatgccaatttgttttaacagacaacccttagggttttatctaggggacatataaaactgagatattttgacaggatagcattttgtttttacttctcgttatgacagtttgtttttaagcactcttttttcaattctgtttatgcttttttcgttcgtcaggtttgtttaagcatcttaaacacgtggcatggaagaccagaagagaagtggaatcctcagacctcaagctttttgcaagtaaacaaaatttctctgacattttcacttaagaaataaagaactgtgtagtattttaaaaaatttttagtgaccaagaataaatatagtaaacctaaaaaaagatagattactaggaaatgcatattaaatagcttataggtgagaagttagcataatggagtctcatcttatgtgtaatctaaaatctcaagttggggcataaaacaaaaattgagtttagccaaaactcccatcaaaaaaaattccaggccaggcgcagtgcccaccgttacctgtgtttcttgatttctgttcctgaacagattatgagagcctcttacagttgtgcagatgctaacatgaagctgaaaaggagagggggcacaggtgtgttggcacagcactttgggaggctgagatgggtggatcatttgaggtcaggagttcgagaccagcttggccaacgtggtaagacccgcatctctactaaaaatacaaaatacaattagccggacgaggtggtgcgtgcctataatcccagctactaggaggcgcctctgaggtaggagaatcgctggaaccccggaggaggagattgcagtgagccgagatcacggcactacactctagcctgggtgacagagggagactctatctaaaaaataaaaatcaataaataaaaacgaaagggacagtaaatttggcctgtgaataaaagtctttactctgaaaatatcaacaaattgactcaaatcatgagcctacattatggattaaaaataaatatttattattacatcaatataaatatatgtatatatatatcatatatactgtatgtttttatgttaattaccaattgatttttaactcagattctaagaaaacactttagcttggtataagtaaaataaatactactttttggtttgatccaaatagctttttaagtgacgttctgttgatcagacagttcatgctggctgcttttttgcatgcctctaatatatttatagaaattatttttagtgtagaattgattttgttctatattataaagttatgtaattctctcattcatcctgtaacacaagtagatcttatgccccttttacagatgatgaaaatataggttctaaatgtacagataactttactgtgatccctatgacttcaaatattgtacactgtttctcaggcctaaagttttattttataatactgaaaatcagatttttttaaaagaggaaatccttcatgccaagggtttactgtttctctgcttatttccggcctacagtaaaatgtagtgtgcattaaaatgactgtgtccagttcagacaatccagtggtccagaaattccctaaaatatgtattatagctattaaatagctaagttcactattgaaaaataaagtggcatttatactcttccaaaaaggtaatgtctgctgggccacccagtggtaagataacccatgtcataaagtattttttgaatttaattgcaggaagtattgatctctgataatcttttgttgttattcttatcaaatacaaactttatatttttctctcagcagacaataaattatagccacatttatttctcagatgtaattttttgttccttttttctggtacacaaaacactcattcttttttgtttaacttttatgttaggttcaggggttccactgcaggtttgttatataggtaaactcacgtcacaagggtttgctatacagattattttgtcactctggtactaagcgtagtatgcaatagttatttttttcttttttcttttttctttttcttttcttttcttttttttttttttgagacagggtctcactctgtggcccaggctgggcacaaccttggcttactacaacctctgcgtctcgggttcaagctgtgtttccaccttagcctcctgagtagctgagatcacagacatgcaccaccacacccggctaatttttgtatttttagtagagacagggtttcaccatgttgaccaggatggcctcgagcccctgatctcaagtgatctgtctgcctcagcctcccaaagtgttaggattacaggcgttagccaacgtgcccagccagtagttatttttttctgatcttttccctcctcccacgtttcaccatcaaataggccccagcgtctgcaaaatattttatgcttcctttagtgggctttgctttgctgttttaaacaaaatacgccgtgaatctaaagtaatttttaaattgttataactgactgagatctataaaaccatattgtgtctcaaaggagatgaggttaaataaataaaagagtccttttttataaatttgtaatgaatatttaatttctttctgtgcttttgtacaaaaatgcaattataccctacttatattaacagaagaggacaattatttaagagggaagaggacagtaactaataactatgcctttgaaacttacctcagaagtgtcagtaaatgtgagatgtctggccgggcgaggtgactcttgcctgtaatttcagcactttgggaggcaggcagatcacttgaggcctggagttcaagaacagactggccaatatggagataccccatctctactaaaaatacaaaaattagcgggatggggtcacgggcacctgtaaccccagctacttgggaggctgaggcagaagaattgcttgaacccgggaggcagaggttgcagtgagctgagatcgcaccactgcactccagcctgggcaacagagcaagacactgtctcaaaaaaataaataaataaaaattaaaaatatgagatctttatctcagaaataatatgaattaaagtttttcccatagttgagcttggcatcagtatggtcactttctattttgggtcaaatacgttactttcgagtactcatttttaaagttctctttaactttgacttataagatgcatatccatgggactgtttaatcgttgtgcccaacaaaagtgtaattgctgttctttttcatttatgaattgcgtagataatatctgatgttttcctgccttcaaagatgttactttattgacttctatagatacattaactggaagtactgtattcgctagaaatcacctctcttaatatatgttacatctgggacaagccttctagtaaataagtggtggtttggaagtggtcttagaccataagaccatcttgtcaatcagaatttctggccgggtatgatggctcagacctgtaatctcagcactttgggaggccaaggtgggcagatcacctgaggtcagaagttcgagaccagcctggccaacatggcaaaaccccgtctctactaaaaattaaaaaaaaaaattagccctgcttggtgatgcacgcctatagtcctagctacttgagaggctgaggaaggagaatcacttggacccaggagacggaggttgcaatgaaccaagattgtaccattgcactgcagcctgggcaacagagcaagactccatctcaaagaaataaataagaatttctaataaggtttttgtgatactgtagcagttaattgtccttggaataaaaatttaaaatggtctcaggcatagtttttttataagtgagtattgttaagagtgcatggctaggccaggcacagtggctgacgcctgtaatcccagcactttgggaggccgaggcaggcagatcacctgaagtcaggagttcaaaaccagcctggccaacatgatgaaaccccatctctactaaaaaatacagaaattagtctggcgtggtggcaggcatctgtaatcccagattctcgggaggctgagacaggagaatcgcttgaatctgggaggcggaggttgcagggagccaagatcatgccattgcactccagcctgggtgacaagagtgaaactcagtcttattaaaaaaaaaaaaaaaatagtacatggctagttttatgctccttaagaacagtttgagcagaatgttgctatgagttgtttaaactcataaaacaactaaaaaaaaaataaactaaactaaaaaaacgaaatttttttagcattttttggaaatagattcttcatatctattattattattatcatctatcttcatatctattattattcaagaattcaagagtaaaaacagatgtgtaagtattacttatggctctattgtgcctaattttattttgcctttataatgaaatatttcaatgttataatcataaacattgattttattgtgatagaaatttgtggaaacacatattaaagaagagtctttgtggataaagcaggatatcagttaacccacagtaaaaatgtcccatcatagctgttcttttcctttattctttaggtgttggtgtctgtccagtcccttatattagtagctgagccttattttaatgaaccgggatatgaacggtctagaggcactcccagtggcacacagagttctcgagaatatgatggaaacattcgacaagcaacagttaagtgggcaatgctagaacaaatcagaaacccttcaccatgttttaaagaggtatgttcaataaaattagtgaaatactttgttaaagacattttacaatataggctgggcatggtggctcatgcctgtaatctcagcactttgggaggtcaaggcaggtggatcacttcaggtcaggagtctgagaccagcctggccaatatggcgaaaccgcatttctacttaaaaaaagaaaaagataaattagccaggcatggtggcaggcgcctgtaatctcagctacttggaacgtgaggttgaacctgggaggcggaagttgcagagagctgagactgcaccactgcactccagcctgggtgacagcagagcaagactccatctccaaaaaaaaaaaaaaaaaaaaaaaaagacattttaaaatatagtttgttagtattctatttgcctttatatgtatctagtatatgaaactgcaggttttagagttaatcccaaagatcattaataagtctggacaatatagcaagaccccatctctgcaaaaagtttaaaaatttagctgggcatggtggcacctgtagtcttagatactcagtgggctaaggcaggaggtttgcctgagcccacgagtttgaggctgcagtaagctgtgttcacatgactgcactccagcctaggtgacagagtctcagaaaaaaaaaaaatggtagtagatagtacagatgaagtataaaactatctatattctaaaagacatctgactaaatttttgagaagtttttttcctttcctttccttttcctctcctctccctctgctctcctttcctttcctcctgtcccatcccgtttcgttctcgttgcccaggctggagtgcaatggcatgatcttggctcactgcaacctccacctcccaagttcaagctattctcctgcctcagcctcccaagtagctgggattacgggcatgtggcaccacgcctggctaatttttttgtatttttagtagagacggggtttcaccatgttggccaggctgatcttgaactcctgacctcaggtgatccacctgccttggcctcccaaagtgctgggattacaagcgtgagccaccgccccggcctattctttatttttattagttacccttctactagcaaactctctaaatatgtttctgatatatttctcattgaactgttttttattgaagatggtttctaaagttgtcttgcaaatagaaattttgcccttattctaatgtgtatatataaggagaatgccatttcttttttttatttttttgagataggacttggctctgttgcctgtgctggaatacagtggcggaatctcggcttactgcaccctccgcctccccggttcaagtgattctcatgcctcagcctcccgagtagctgggactgtgtgcgcataccaccgcaactggctaattttttttgtattttttagtagaggccagttttcaccatgttggccaggctggtctcgaatgcctgacctcaggtgatccgcccgcctcggccttccagactgttggaattacaggcgtgagccactgcgcctggccacgtttccttttctttaggaaaaaaattggatgatatgagtttccaaaacctgtattaatacactgaagtggtttttttcacgtcatcctgaagtgtggctctgtgtgtgtgtgtgtgtgtgtgtgtgtagctttttgcctgtgattagttgtctctccatagtatacctaaatagaattatacttttcacctgccatatcaaatgacgttagcatcacaacttgctgtgattgtgtccagaaacatttttctttcttaaaattgtttcacttgatcattaatttcttaaattgtgctggaaagttaacattttagaggaaaaaatggtatatttacctgatataaaattgatctttaatataactatgcagatgttctacatgaatactatgaagccacctccttcatcagatagcactgatgaatatttctttttctttggcttttgctgttactgagtaaatttatattccagtgtcctttgaatgacaaagttggatactttacttttgcaaagatcgcgccacggcactccagcctgggcagcacggtgagactctgtctcaaaaaaaaaaaaaaaaaagtaatttgttttatgcatatcatttttttcaggaaggataaacacagggaactcagagaaggggatgacttttacaaaaagcaaatatgtataatttgagacaatcaactttctcattctttagaacctagcttgcgttaaaggggccactccttggccatgtatgctttcccagttttcctaatcaaatgccactcgctactctttgaatgccctgggctttttgcttttgtttattgttgttctttaaaatatatttttttggtacactcccgtcccatctgattctgttgttaccactgttcttcatttaaagctgtgtcatacttacttctgtatcccagaggcttcaaacccaataactattaaatgtggtgggatcgtattggtgtttgacattcattcccagagctttctagtgattttccctttataggtttgattgtctgttctttagggcagacatgctccctgggcaatgctcaaccagaatacagagcaatgtttccaaattgataattgttttctaatttaaatttgtcagaaatagactcttactactatatgttggtagaaattttactcagtttttcaaagatagaattgaaagatagaatttaaaaatcgcaaatgtaaatcacagtaataataaggaaatttaacttcctaaaataaaatcccatctataaattaaacagaagataaaattaagcaagtaagaatagtgccatttctggggatttctgtgtgaatgcctttggcatttagaatatacttatctaggtgttctttgagttatcttttaaaggcagaaatttctctgttgtcaatactttttaaatcttttcgcctggttacttatttagcatttgccttctgagtatattgtatcatatgtgtcttgtggtctctggacaggattaattttccaagtgtctgaccacaattgtacactcttttctgctataaatttgttttctcttttctctcctcccctcctctcttcttttcttttctttttgatggagtcttgctctgtcgcccaggctggagtgcagtggcgggatctcagttcactgcaacctctgcctcctgggttcaagcaattgtcctgcctcagcctcccaagtagctggcactacaggtgcctgccaccatgcctggctaatttttgtatttttagttctgaccttgtgattcgcctgccttgatctcccagaatgctgggattacaggcgtgagccaccacaccgggccataaatttcatatatttcaacacgtcatatcaaatcatgagcttgatttttccctgctaatattgtagagttgattaaattgcctttttttttttgtttgagatggaggcttgctctgtcgcccaggctggagtgcagtggcgcgaccttggctcactgcaagctccacctcccgggttcacgccattctcttgcctcagcctcccaaattgagttttatggatagaaaaacattgcagtgtctgtatatttatttcattaaatgtatttataataatattctaaatattaatttaaatgtatttatagaataaattatttaaatgtatttataatacattttacttctttgtaatgtcatttactgtgtcttttaaatttgactgtaaacactgcttgttctcctgtttactttttctcaaggtaatacacaaacatttttacttgaaaagagttgagataatggcccaatgtgaggagtggattgcggatatccagcagtacagcagtgataagcgggtaggcaggactatgtctcaccatgcagcagctctcaaggtgagtaagcctctctaacaggagccttgttgctttaagagttgtgtaattattgacagaaccatgcctaccagaagataatgggagggagggaattaaagaaacataatatgtattttcagttcagaggaataaattgttactcagaagtctatagaaaagatacatttttttttggtagtagattgacagttcctaaaataaaaagtgggtccaaggactgagacaacagagttttgtaaagttccttgaagataatgatgacaagatgtgctccatgaatgccttttcctttttctttttttcttttgagactggatttcattctgttgtcccagcctagagtgcagtggtggcatcatgactctctgtaaccttgaactcctgggctcaagcagtcctcccacctcagcttcccatgtagctaggactacaggtagctgccacagtgcccagttaaatttttttattttcaattttgtagagatggggtctcaccctgtttcctaggctaggctcaagtgatcctcccacctcagccacccaaatcactggaattataggcatgagcaaccgtgccagacttgaaggacttcttttattcccttagtctttccctaggcctcctgccttccagaattttattacttggagtgatgagggagatttgagttgcagattctccctcagctgatggtggcagtggctgtgttaggggagaaagcagttgttttcagtttggacgttcatagaatggaaatgtgaaatgtgattggtttggaagattttctgtctacccacggagatctttctttgtaacagccttccttttttcctgcatctgaatgtctttactcatttcatcctccaccaatatcctcccttttctatcttcaggtttttccatttctactggcttgttatcttctaactttaaagctgtcttcacttcaaacaactagttgatgataaggatttgttagttttttaggtgtgatttttaaaaagatccctatcttttcaggacatgtacagaaatatttgtgaatgacaaagtgtatgatgtctgggaattacttcaaaataaaatgacaaggggaaagtgtgggaatatagatgaaagaagatgggccatgagttgataatggttgaagctgtgtgatagattcatgggacttcattgtactcttctgcccacttctgcatatgtttgaattttttcactataaaaatgttttgaaaaagagagaaaaacacttgcagaaaatttccctaagctagttctattttgcccctattattatgaaacagattgtcttctttcaccgtcagactatagcagttgacacttcttgcctccattttttaacctttgtctcactaatcaaccttatgcagtttgacttctattttaccaaagttaccatctctccagttctcaacgccagtgaccctggctcacttctccattcacttcatctgctctccctcctccaggcctttacacatggtttccattttcctctacttttcagctcttctgcttgctcacctccattcatatttcagcttaaatttcacttcatggaaccctgccttgactggtttgtttgtttgtttgtttgtttgtttctgagacactgtctctctctgccactcaggcatgatcttggctcactgcatcttccgcctcccttgttcaagtgatttatctgcctcagcctcctgagtagctgggattacaggcatctgccaccagacctggctaacttttgtatttttattttcattatttattttatttatttatttattttagatgtaatcttgctctgttgctcagcctggagtgcagtggcttgatctcagctcactgcagccttaacctcctgggttcaagctattctcctgcctcagcctcctgagtatctgggattacagtcacctgccatcatgcccagctaatttttgcatttttagtagagacggggtttcaccatgttggccaggctggtctcgaactccaggctggtcttgaactcctgacctcaagtgagccaccgcgccccgcctgactgatagactattagatcatttcagtataagcatttctaaccctctgcgtctacctgttaaaacactcataacatttgtctaatgtttgtcttttgtactatacttttcatctgtagactatcttggcttttctgcttatactcttcttaattctttcagtgtgttttcctttttcttttttcctgagcaattgtttacctgaaggcttactttttggccttcagaactattttttttctgtctttctgtttttccttcattgtgtctgtaaccctgactttggccatttactctctaaaagtgacacttcaaactgttgtcagctgttagctttctcttgagttgtattactgacattttttacatagataccctgtcatcatctccttaaaggagattttcctcaaatcaagttttctagctttctatttacttaattttacttgattttaaaccatttttctctgtcttagaatcttcaagtattatgtatctcatccttcatccagcacccctggtcagtactaggtcctgtcagtattacttcatgaggggactgtcctctccccaacccatgatttctgttgagttcccacagctttgtctgtttgtccagcttccttgtaccaggttctccccctttcagttccttctttagtgcattaccaggctgatcttccccaaatatgtatttagatatgtttttcacttacacaaaactggctcaagtccagcttcttttcattcagtgtcttgcttatatccgcattcctttatttcttctgtgtcactgtcacctggaattttccatctctgaattaatccaaatttatatcattttaactgtacatttgctgttgagtgctacacaagaaaaatacacaattggccaggcgcagtgactcacgcctataatcccaacactttgggaggccaaggcgggcagatcacttgtggtcaggagttcaagaccagcctggccaacatggtgaaaccccaactctattaaaaaaaaatacaaaaattagtcaagtgtggtggctcatgcctgtagtcccagctgctggggaggctgaggcaggaaaatcgcctgaacccgggaggtggaggttgcagtgagctgagattgcgccattgctctccagcctgggcaacgagtgtaaaattctgtcttaaaaaataaatgaaaagtatgtagttgtttagcttgactccacaataaaatcatagtatccctgtattaggctgttctttctttgctataaagaaatccttgagactgggtaatttataacaaaaagacattcaatgggcccatggttctgtaggctgtacaggaagcatggaactggcatttactctgcttctgtagaggcctcaaggaccttatactcatggtggaagatgaagcggaatcacgaaggcgtaggggtgtgggaggtgccacactttacaacaacccgatctcgtgataattcactcactatctcaggacagcaccaatccatgaggaaactgtccccatgatccccatttctctcacctccaacacagggattacatttcaacatgagatttgggcagggacaaatatccaaactagatcaatccccaaccttaactcagttctcatgattgccagatttttctttctccttccctggttagtgatttcacctgttgtccacagtggaaggaaaatcaaggctagggaaattctcacttaccggcatgtaaatgtgctttgaaactttgcaaatagctgcaaggtagagttgttttttcctatttatgtgtcttataatttcagccagaattttagactccataagcttaaagattttatcctcattctactcattgcctttatgttgttggtatttaacacagtgcctcatacataaaaattgttctgtaaataaatgttgtttaattttcaaagtcagctgttgacactatttagtttttatttattttattttattttatttttgagatggagtctcgctctgctgccaggctggagtgcagtgctgtgcgatctcagctcactggaacctctgcctccctggttcaagcgatgctcctgcctcagcctcccaagtacctgggactacaggcacacaccaccacacccagctaatttttgtattttttgtagagacggggtttcaccatgttggccaggatggtctcgatcttttgacctcgtgatctgcccgccatggcctccgaaagtgctgggattacaggcgtgaggcatcagacccggccgacacaattttaaaagcctttggtgtgattatttaaggtcatttctctctcaccagaaaattatgaaccaaatctttgcatgtgttagacaaccagccactcccaattaacatgcctatatccttacgtaaactgcaatatagagcaaagcaaagtttatttaatctctatagatcttctttttaactcaattttgtaaaaagttctaatgataggctgggtgcagttctttgttcttctatgatctttttaacttaattttttaaaattctatgatcttctttttaacttaattttttaaaaagttctaatgataggctgggtgcagttctataggctgggtgaatctgggtacagattcacacctgtaatcccagcactttgggagtccaaggcaggtggattgcttgagattaggagttcgagaccagcctggccaagaaggcaaaaccccgtctctaccaaaaacacaaaaaaattaactgggcatggtggtgcatgcctgtaatagcagttgctcgggaggctgaggcatgagaattgcttgcgtctgggaggtggagtttgcagtgagccgagattgtgcctctgcactctagcctgggtgacacagtgagaccttgttctcaaaaaaaaaaaaaaaaaaaaaaattctaatgatacaattatttctaaggtttattctgagcattaagtgggaaaattagtgtgaacatttgcagacattttacatatggcctactacctgataaatatttttttcattcgctaaagtatcagtggatttattttaatttacggatttgtctttctctcaaaaacgtttagccagagtcagcatgtatgacaaatcaagggattacggtgtttaatttgaaagagtgtataggctgggcacagtggctcacacctgcaatcccagctctttgggaggccaaggcaggtggatcgcttggaccaggagtttgagaccagcttgggcaaaatggcgaaaccccatctgtgtaaaaaattagctaggcatggtgcttcattcctgtagtcccaactacttgggaggctgaggtgggaggattgcttaagcccaggaggttgaggctgcatgagctgtgattgtgccgctgctctccagcctggatgacaaagcagagctatcttaaaacaaaataagagaatatatgtatgtaggccgggtgcattggctcacgcctgtaatcccagcactttgggaggccgaggcaggtggatgacagtcaagagatcaagaccagcctggccaacatagtgaaaccccatctctactaaaaatacaaaaaattagctggttgtggtggcgcccacctgtactcccagctactcagaaggctgaggcagaagaatcacttgaacccgggaggcggaggttgcaatgagctgagatcgcgccagtgcactccagcctgggcaacagagcgagactccgtctcaaaaaaaaaagagtatatgtatctaataatgtcctttaaattgtcagtaatgctgtttctgtgacagcttggcagcatgggtaggatctactggtgggttactgaggtcttttcagcaacatcggttactttgaggttaaggattcttgtcagttttgcttacctactatatcaagtgcctgtaacagtagcttgcataaggaggggctcagtaaatatttgtaggcttaatgctttgggctttgttgaaattcagttcctgcctcaaatgatgttgtgctagagggtttgcagttctaacattagtccttttctcctgcatagcgtcacactgctcagctccgcgaagagttgctgaaacttccctgccctgaaggcttggatcctgacactgacgatgccccagaggtgtgcagagccacaacaggtgctgaggagactctaatgcatgatcaggttaaacccagcagcagcaaagaactccccagtgacttccagttatgagctgcattgatgtggacttcatagacacaaaggcttcgaagcacaagccaaatatgtcaatatttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggtatgttcaacaaatttgtgtatacaaagaaatggataaatcactgctatataagggaaactaccttaggaaagaatgtttactgaatgtttattttattttattttttttttactatagagtgaggggttgttaacaaagaatatatattggtcattcttacaactactatttaaagtcagcaacttttcactgaatttgatagattttatgtttggccatatcttcatgctcacatttgatttctgaagacctcctacatacacttcaataaaagttaaatggacatactccctcttttttgatttactggtacatttttaaaataataaatctgccataaaatgcattatatctggagacttgcacttgtatggatgaatttattacattcaacatatttaattttatgccttctaattctaagatgcagaaaaaaataaatgaacatgattttattctatgccaacatttgggcctctgaatgtatctgttatttgaatttaagtatttgaaaaggaatggtcaatttgaaagtcattctaaactgattttttttttctaaagggctccttttttcctggactatgtggttttatgactaaagtcacatgtatgtattaaacattgaggctctgtagaggagagaggatgtacctctctggtgctgttacagtacattctgtacctgccatacaggctcattttcatgcaaattcttcctagagccaaataaataaagacttaggtgaattagtatgtcttgtttctaaacccctttgccatggtgtgaaatgctatttctataaagaattgaacactttcaagacttaagcatgggaaaacaaagcatgtttttccaagaccagttgccgcaggggaaaggctaaggtgattctttgacagtatttttataaaataaaagtggcggctgtgcgcggtggctcacgcctgtaatcccagcactttgggaggccaaggcaggcgggtctcctgatgtcaggagttcgagacaagcctggccaatgcgatgaaatcatgtctctataaaaatacaaaaattagccaggcatggtggtaggtgcctgtaatcccagctactcaggaggctgaggcaggaactggagctgacgcctgaatctggagctgaccaggagaagccgtattctgaaaggcgagttgctctctgatgaaaaaggggatcttggggaaatgatactctcttatgtacaaagtataaagctccttcagcatggaaaaaggagaaacgaatagtatttggacaggaaatcaaagattctaaaacacatagtgttaggtctggtgggtagtgagctacaccgaaaatgacaaaatagtggtagtttacaagaagaaaaaaattatgtcacccacagacatgccagctaaaatctaagtataaaattatcagcaataataaaggacagtcattaatcctttaggctattttttgttgtttttgtttgtttttggactgtgagtgctggatgataaaagctgtatcaaatgtattgtttgtcttccatgtaaaatgaaagtaacaataccagtactataaggtccagttcatattttttaaaaaccaaagtctaaacacctaaattggaaccaattacattaaaacattccatttgagatccagactttatgtcaacaaacatttgagcactcattttttactagttccaagttcctgcacttgaggagtgaatgacagacatgaaaacatgtcagtgccatctggtaaggtctctggta

SEQ ID NO: 13748 - DNA, 21136 bp, Human
  misc_feature (1)...(21136): n = A,T,C or G
tcctctggataatcactcaatgatagctgaacatgtgtctggttaaatttctaacatttccttcaggaattaagatttcgttttagtgcatattcttcaggaaaaatcctgaaaagtaccacaattcgttatacatctatgcattatgtgctctatctaagaaaatcatttttaaaaagaaaaaataaagaccatttggcttaattctctcatttgtggatgagaaaattaaggcccagagacggaaatttacttgcacatgacaaatcataacttaattgtagcccactaagatcttgtgtcatctccttttattataaattatttaaaaagtgaaaatgaaccaggggattcaaatgtattatttgtttatggtgttcctctcctcatctggtttaattgagttttcttgactaaccttcaagcagcattacatcttttctaagttggtcctctttaatcatgcccatctgtagctgttttctgtgtaggacattttaattactattatagttttaatgacttttttttaaaaaaagttttttatatgtgcacaaggtgaattcatcatagcagtgcaactttaaatacaaatcaataaaattaattcatttaattttaaggtgctagaattaaaaaatgagtatttgaattgatatttaaaatgccctctacctgactgtatgggcaataattattctttcttatgcagccttattaattttgatggtttgaaagacagaaatcccccaaatagacactaaaaccctaaatgttcaacatctgcattgtctcgccagattctccttcaggttcctttcctcaatctagcagtactgtgtgtaacacaatatgaaaacttgccccacaaggctggttttacttaatgatacttagcagaagggctttgcactttcatgataatttccaccagaaaaatctctctggaacttactaacaataatcaggcctaatattagcctcagtctggagatttatttaacctatttggcagagtagataaagtcgaatgcctaggtattcaagcatctaggctgtgcttcggccttggaaaaagactctcaggctagcaccctaaaagcattcctcaaaacttgatttatactagaagtgacatttcttactctctagaggctgtgagattgcaaatcttgcaattacttccattgcttttgggggctgtgagaatttccgcctctcatcctccacagtgaggagggtagtcgggaaaggctttctcccttaagttttcgtcaactttgaaaataaggactgtgctccctacatcaccagcaattgacaaggatccaggaaatgcctgctaggcactttcaaactcggaaaaatgggagtatgagggaggctaagtaggcagtatttagctagcaactattatttcctttatgtttctaccttgttaactaagcttccactacggttcataaatctccaatatcgtgaattaaagaaacaacaacaaaaatcctcttctgtgtgcttgtgcgtgaggggatagaagtccactgccctaagatgcaggacttatcttcccaaacaggaagagacccatttctgagaaagatggtaagtttcctaagggtctcctctcagatagaggggatggcagtccccgaggggcgagcgggcgcgggtcctcagggtccccgtgcgctgagaaggcaggtgaggccccgccctgcgtctcgactccggatcccgggtcgcgaagggcagcccaagcgggtccccggccccaggcgcccgggtcacttcaccccacctgattcgggcccttcccttctcctctgtcggccagctctgccgcctcgctctctctcccgccccccgagtctcgtttcagtcatccctttgtccttccccggattggcaggttttattattccgcctgaacaatccggccgcccagtggctgagggtcgctgacgtcggaggcagagccggggagtagttgggattttgctctgtcagtaacacatgtgttaagagccgcggaaggtagcgagcgagccggctagaggccagcgccgccgccgccgccgcctccgagccgggcagcaacagccccggcagcggcggctagctccagcgcgcctgacccggacggacgcagcccccgacgcctgtgtgcgcctgcctgccggactccgtaccgtccgacgccgcttcccggggctgttgtgtctgcaactgctcccggccggatgtgcatggagctcattcgagccgacgctgccatcctggtacgagctagccatctagcgcacggtaggcagcaggtcgcatcctagcagatgagcatgtcagaagcccaacggggccttttccgtctgcagcgaatttactaatgaagctcattgccaaacttcataaactatgcacctatgttgccttttcccnnnnnnnnnnnnnnnnnnnngctgttgtgtctgcagctgcttccgtctgtaggtccagggagctcagccgatcctctgctgccatcccgtagcgagcaatcgatcgagcgcgcgagagggaggaagtcggcgtcgtaggagaggaggagcgggaggagcgcgggcgggggcgggggccgccgggcgggggaatatacaaagtgaagccacattgccaaacttgcagcagcgattgcagcagttgctgccgctgcgccgcgcctgaagccgcgccgcgcgggccgagggctcctgcagctgctcgcgcgcagtcggaggcggagaaggacgaagactgagactgacacttctgctcccggccgcccggcacttacgcgggggccccccaacccgccccagagcaacgcgatttaaaaaaaaaaaaaaagccgcccttagccccctcctcccctttcctgcttctgcgagaactccctccctccctccagctccgccagcccaggcgccccttccctggaagccgagcggcttcgctcgcatttcaccgccgccgcctctcgcaatattgcaatataggggaaaagcaggtaagggggcgggtggagagccgcgggccgggaggtgggagagggagggagggggtcgattcgggccagggctgttttctttggcttccttcccctgaccgtcccaaattgcaagtaaacaatacgtcggcttagataaagcgcgagtctgaaactaccgaggccggcctgcgagctagcgcggagggcagccccgggccgccagctttgtagcggttcctgcttacaaaagggctcttcttggaaacggggctggtggggaccgtagagggggtggggatatttctagttcataagggaaaggcaaggggtgcttagatgaggattttaagtatgagaagtagtgtgtttgggggggtgggggtggggatagtcacgataccccccctcccttctagtaaacactatttttgaaacagtggcaggaaggatctaagtgagcaggattcggtattgctggttcttttaaaaaaattcttcttggcttataagtcttttgttccaatccaggagaaatacggtgaatcacctaattaaaatcaagacatgaattaagcatccatttttgtactacaaattgccagcgttacgtttgtccctcccttggtctccattaaaaaacaccagagacgttgttaaaggggggcagattttgcctctagctgccagttctgctttctatttcactgactatcccaggacctaaattgcttggctatgtaattactagagtataagcctatttaacttaaaagctttcttttttttttttttttttccaactctaaatgaaacttgatgagggcccgtccttagttatcaggggagtcagtttctggtcagtcttcttgattcatctcttttagatttaatcagcattaaggtattgcttgtccttaagagctttagctaatggggttactggatgcttttctcagtgtaatgtttccttttcaaaaaaaaaatacatatatatttacctctcactaaagatgggggcggggaagagcttggaatctcctccctcactctccttttaaaaaggaattcggagcgattaaaacgttgggggaaacagtttaaagatctagggcaggaaatgcagattcatttgggttagggctgaaattgtaacaaaaagcaattcctcgagtaaatgcatcagataaatcaatttacataaaggtatgatgcattcggataaatgcaatgctaatgggttttagagtggtcctgtttccaaagtctcagggttttgttacagcttaattggtgcagttcttattctggtttattgtgcggtcactggacacacgttccgggactctttcggaggaaatgtgtttaaaatcggcctatttaaggaacccgagtccttgtttcgttccttcctcgttttttttgcagcagccaagttgggccgggtacaggcaaagttcgccttcttctgaggtatcagctgaatgtcttgagcagatagccgggagcctcagggggagcccacactctcagcttacagaggacaaagacaatacaggctgcttaattggcagtaaataacttgatctttttacagaataagtgactagaggaacactaggactttattggactcgggattgaaggcaacaaattaatcggtttaggctaagctttataaattgattcctatattatatcccagttgcatctcttgtggcattcattagagtggggaattcttttttaaagcagtttttggtgacagcaggacgggctcgaatttaacttgtgcatcccttaatggtgccttctcgcacattatctgtaacggccgcccgccccccccccccccccgccctttggaggaacaaagctttagcatttaaattgctgatcaagggcagattagtgagaccaaagtggagagtgtttgtataggaagttaacaggcatcctaaagttcaatgatctattattcttgcctgtgtcctgaaaacccagagaaaacactcattgatcttcaaaatgaaatgagatttggaacaataatgggagatggcggtcaccacaatggcatgtgaaaggtgctgcttaaaatacgaaaaaccagtttcgcaactttacacactgcacccacccctcccgtcaccttgccttccctcccatcaccacgctctccgtctcccgtctgccggtccctccctcgttccctttcggaaaaccgaactatttccaacttgtgaactgcagctgcacttcccggggcagaacccgggagggaacgaggctccggcggggccgccgcctccccactcctctcggctctgtcccggggcccggcgggggctggggaggggccgggcgcggcggtgggtgggtttgaccctcatttgctggaggcgggcggcggaggaggggaggagggggcagtgggcggaggcgggggctgggaggaggtgccgcgaggggtggagcgcgcagcggagcctgctctcggagttttgacagtaccggagctgaaattgtcagcggcggcaagcgcaggaaagttgagaggagctcgtggccccagaacaaagcttgagaaaagtaaacaggcggctgctgccggcgagcctcccttcttccctctccccctcagcctccttcccgcccttgccctgctgtttccttccagcagctccgcggggaggaggggaatgggcttgctctctctccggcgattactaacttttgcatcgcccctgttttgtctttctctccctgtccccttcccgccctctgcagaccatggtgaatccgggcagcagctcgcagccgcccccggtgacggccggctccctctcctggaagcggtgcgcaggctgcgggggcaagattgcggaccgctttctgctctatgccatggacagctattggcacagccggtgcctcaagtgctcctgctgccaggcgcagctgggcgacatcggcacgtcctgttacaccaaaagtggcatgatcctttgcagaaatgactacattaggtaagactttgctgtctttcctggagatggggggaagagcaatggcaaggccaaaggttaacagggttgtgaggaaaggagtaggcgtctacggggagtatgcagccttcacctcaaaaatcttctagttggcggaatttaaggggttcaggaagcatgtgttagtcttccaatatctgatggcaaattcatggcaaatgccatactaagtaaagaccatctggtgggactgggtcattagatgtgcaaaggttgagcaccctctggtcctagagtttaagtaagtggtcagcctctactggacttcaggctaaaagcaaacatcccaagcgggagttaagctgcgttcttaaaacaaggtaggaactcacagaggaacccagaaacaaaggttgacttaaaaatacaagtgtagttagtgagaaatgatttgtctatggcgatggcttattaacgatatttacataagcatcttgaaacttttttgagcggaaggctgtgattcgttctttgtgctccttgagaaaaatgctaattatccatcagtttaaagacttgtaattcttcttatagagaaaaaaaaagtcccaagaaataaaacctggtggtaatgtttctcttcatactgttactcggaggcttgcaataattcagttagtgtgtggtttgcgatgtagaatttgcagtttttttcaattgaagcatgttcaggttttgggttttttgttgtcgtttgtatcactgcccttgatccccaaaagagatttagaaaaaggctatagaattatactaatcttgcattttaaagcaatgtataggaacattcatatgtccatgtaagcagtcttttccaacaagttgcagtgcaattaatggaaagaattcaggaggtcaggtgcctataggatcttttcaggtgaactcaagctacttaaactcattaatttgaaaggaggcatttgaaggattacacatttaatttgagtaaatggtttgatagactgatgcacatgaatgcttctaggaggtgttctgtttcaacatccagtaattaaaaaaaaaacccacacgcacacagttgatactagaaaaccgcacacttttaagaatttcatcctatgtaaatttgtcctaaacctttttctttaaagtgattagtagaaaatttttttctttcttcagtgtgggtaaatcagtggatgaactattttgttcaaagtttagctccattgtgattcgccttatcctgcgactaacattgtaaaagatcccagtgcagttccgagctgagtgtggatatgtttaccccagtgatatcattagtgtaagatgatggagtaaaatgacatttagttattttgataatgcaacctgtgtcgattctgctggcatcctcaatcagtccaagtaaaagaaatacaggaagggagagggcttttatttttaaattaagatggcagcattaatttcactaagtgttcttttagaagtaaatgttggaaaatcagcaggaacatgggtgtaatgctttctggtcctccttccaagtaatgccatgagctttgacggtgctgtaattaaatagaaagcaaaactgtggtaagaaaggagtgtggtttgaagtggaaaaattgacagtgctgttaagattccgtgaatggtacagattcatctcttctccgagtgccttcaaaaaaaaaaaaacaaaaaacaaaaaaaaccctcgcttctgattacaactaattaaaaagaagatgggtccgcttgtattcccccaggacaagtttaggcaagtggcttcctgggaattgtgtccattcttttctctattcttggggccaaatgtaaatggccttttggtgttttcctgtgccctaatggagcaatggaggatgtgtgcccagccctgagccttaattaatggcatctacgttcttacttccttttttccctctgaatctggaaactggagccaggctcgctcttgaactacatgctaccccgaggaccttagatctttctaggagagatgagttctagctcagtacgaaattgatggcctcacacttagctcagggctcaccagcagctgagcgccccttcccctccaatttaagagattactgaagtcttccttcagtgttcctctctcagcccatcaggatgtccaaagggtgggaaggtgcagacgttgctgttcctctcagctaccccctctccaatgtccctcaagtccacttgttggaggagctttcaatgccgcagggaccgctgcagaagagtggagtaatctgctcgcccgccgccaggtgaaggggaccccttggtccgactgagaccacatagcgatttactgaggggcttttaaactgtcttgactttgagttgtggttttttgaaaacaaccaaggtcttgctaaaaagctgcgggagagctgggaaaggccggcctgagcgcgggggagggggctgcaagatgagggggcgctttcaccagtcccctccccctccgcggccaagtgtcgatgggcagagctgggcttctgcctcctctccctccaagatttcagataaagcggctgccttgctgcagcgaatccgcacaattaaaagctttaattagtggctcctccattttcttagttctgatgggctttatctaatgagatctggtctctggcttagatctgctccgaatgacgtgtccgcaatgaatgagagctgcgtcgcaaacaaaacatttaattaacaaaattggcctctaagagagggagggaaagaatgaaggggggggggttgtagagcggagggggagggtggatacttaaagggaccaacgcctgcctggccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggcgagcgcaaggccgggaaccagggcgagcgggtcgcgctttcttttcccccgggctcccactcgggcggttcacgtggcgcccgcagccgcagtgagcccggcccgcccgggggtgggggcctggggcaagggtggggagaattggtagttggtggtggagggtgtgtttgggtagggggtggcgttaggaatggaggcgccgccagacagcgagttcatttccctggtaatcaacagcaagctgctatattcagagaatgctgtccctttaattgaacaggctaggtaattaaatggcacttttccaataggacgtgctaggtaaatctaatagttggttatttaatatcactttgaagtctgcccactcaagcacaatgacagcacaggagcatgtgaactattagctagaaaaaaaaaaaaaacaggatctcaaaaattaattaaatcgcatgcaatttagggggaacgtttatcttgatttgtcataacagaattaattcaaggcctccaattcacttgggggcagatctgttactctgaattaaccaagcgtaatttggctgattttttttttcctattatgcacagcccccctcttaagtatcaatagcttctggtgcttttaaggtgcctggtctctagtttttccgaagtacctttaatggacttggctccaggcataatttctgggttgcatttctttgttacatttaatatagctggtgcagaatttagattaaatataggaacctgctggaaaaccaattgcttctggatcagtagctgtggatgtgcttttttctcctcagataggttgctgatatttacttgcaggtacaaatgtatatacctttcagccacactctcagaaacgtacctctccttgcccaaaagcagtttagaaaacacagccaggtagcgtttcatattgcatgtattttgcttgaagtaataatgcagttgaaaataagcccacctattggtcattgacgttactgaaagatgctaagcattgatagtaaactaaaaatacgatttgccctccatctcttaatgccagcaaggagagctggagctcagcgggcaaacaggaataaaactacatggtgttgttcaaacaggagcaaagcacctttaaagtgcagtggtttggtgggatttcttcccatcttttccgttttccctgtataaggaacctcttgatgtttgtgattgattgcattgcccaaatgctgaaatattaacgaccttcttggactgaggacccaaagaaaggaaactgaaaccgattctgtcatcacaattaaagactcccctggctttaattagcctgacctggggtatatctccccgttgcttgagttaaagagaaaagagcccattatagtccagtctgagaccgatagctacttaattgagcacctaaagcctcgagccttttaaatcaaacactgtccggacagtccccctggttagataattaactctccagcgcacagaaacgttgtgaaaaaacacacacacacacgcacacacaacttttcagaaaaagggtggaattctaatggtagccttcctctctggtaaaaggggattagaatgtgtatagacacgtaagttattctgctctgaggcagccttaaagctgtaggcatggaaagatcttaaactccattgatacgttgttcaatagcacatcagtcctgggtagatcttggtcatttcaaactttgtaactgtaatttttggcacttcaggaatcccaccattttgtggctgattgttctctgaaaggttatgatagcagccctggaaaaaaataagatctatgaaaggcttttggattacatatgaactgccctgattattaaaatacacttcgatgttgaagacttacaactgactttactcagggtgaattgttaaataaatgaacacttaggctgagtaatcagatgggtactgtgaaaagggtatttttgagatggagtgtcactgtgtacctgttggtagtggcaaccataattatagattcttatccattaaaatactttagggttgctgtaagaggatatttgttctttagccttgttaggattctgtcacccccttctacccccattacctgtcttctcttatcctcagcatgtatttggccacatggactggtttttaactttatttttacccaaattgtttgaatttggtatcccttttgggggttggaatagcactactgccgtccataaatgctttcctcagggccatgcccattctctggctaccttccccttctgagaactcccctgcggcagtggtactgcaggtgagacaccgggaggtcctcatcagtgttcctgaagtgtccagcattaggagacagcagcccagaggccccccaagctcccacatggtgtggtcctgcagctagaggtcctgacagtgtattatttcagctttctttctgtaactgttctgattctgcaagaacgtgtcaatgtgtcgtggatctcagactaattagttttgaaatggagttttgattgaactcttcaaatcgatgctgctgcaaaatttgtttctcgggcttcctattaaaagccatcttaaggggcagttttactactctccctgtcgttcagtcaatacatttaataacaacttacaggctattttcaataaagtggcgacagcaaattagtagtttgaacatgacaagcctcttctgcaagaccagattctgaaaactcaaagcaattatttttatatagaggcatgctgcaatcattcagattatggggtgttctataggaatatgtctcctggtttgacacagactgcattttatgactttatttggacaaggaggaaatgcaaatgttaatatttattatgacaccaatatgttaatttgtaagtcctcttactttgtttttcgtttttgaaaactacctctctgattctgcttacttgttccgacaccacctttcaatgtgaaatcattttggtctgtttaataaatatttgtggatattaaagagggaagcccaaaagcaaataaagcttcccaggttgagtctacagattgcataaaagcccaagttcggtggttattaaaatattttgttgtgcttgcagaaggatgtaaggaattatgtatatgtttttcttcagtacaccacaattccttgagctttcccctcctctgcagccttttccttctccccctcctccccccatggcagatgttgtggtctcatttgattgcataggaaaactgcagtgatacagcaaacacccagagagatatgatgacaaatgggtccagatcccggtaaattactttctgctcaaatcgaaatttcattcagtttgttgctagcagagatgaagtaatctaaattgtggactcaggagcagatagagggaagttggagcaagcatttcattatcaagagagagagaaggttaggatgaaagagatgagcagaggcaaatcttaagtgttgacaccatgattgaaaaggttaacccatacacattatatatcaacctggatagcagagagtttctaatggaaagtctgcactgatggaggtttacgggagtttcaatacactgagcatgatgtcttcttagatatacaatcaaatcctcttaacccttttgatgactcatatctgaagatatgattaaagtacaaaagagttcttcatataatttcaaggacacaatgcatttaaactccagtcatgaattgtatcttttttttttttatgatgaacctagtaatctgataaaatgtgtgtagaacagaattgtatttgctagaggtgtaagtcaatattttgattaaatctggggcatcctctgcggtaggcagaagtttgttgtcccacaaaaaggatttttcccagattatgtaaatcactcagaaaatctgaggcttgagcctaagaattcagcctgtcaaatgcattccaaagggatgcccagagtctgggggtgtttttctttctttttctttggtttaggattattcactggtgtcaaccgttattctttgtttcaggttatttggaaatagcggtgcttgcagcgcttgcggacagtcgattcctgcgagtgaactcgtcatgagggcgcaaggcaatgtgtatcatcttaaggtagtatttgcatctctcttttttttttaaaaaaaaaatcatacctttcctacctacatgggggcaaagcatttctccttggtatgaactgttttctcaagctgcagacacttgaaggaatgattgaaattgtagcatggcagtgatggttacacatccacatgcacagaccacgcttcccctatgccacagacagaagtacacatgtatttggatttgtccccatttagcctggtccagttgatagcaatttggcttactgttttctggagatctgtcaaaggaagaaaaaacgctaaaccctaagtgtctctgtacttgacagatacctgcttaataacaggttataaacttgtgaccaaaaaaagacttaatttttaccttgttttcagtgggtttgtttttccctttcagtgttttacatgctctacctgccggaatcgcctggtcccgggagatcggtttcactacatcaatggcagtttattttgtgaacatgatagacctacagctctcatcaatggccatttgaattcacttcagagcaatccactactgccagaccagaaggtgaatacccagcaattactaataagctttattagagcaagttggaaggttcaacctcttaacctagcaagagagttttcttgggtggttgtatttttgcatgcccttttaaagaaatgtagattactagttgtacatagagtgttcagaagtaggatagctgattaaattgtgaatcctttctagttaaaaaaaaaatcctgactttgttatatctgtagcttcactcacgttgaacataagattatcacatgcaaaagcaaacaaaatgtaaagcttccatataactggttatttattccatttgacaattttgaaattcagaaacatgatgtgataggttattgtggaagaaaaattagaacatttatggtaggaaaagagaataaagatctttgttatgaaagaatgatttctgcgttaggaatagcaatctggacacctgccttccaaacccaatttacaattcatttactttttagaagagtaattttacaaaacattctgtaacttcataagagggcatttttgttcattggcggtaccataacatttgaataagttatggcttttaaaaccaagttcttgttcttgctaacccgcttagtgccattaatagtgccattagaaattatgtatcttgattcttgatccacaacttgaaaatccttgtaccagaattaaaaattaggaaattatacaagtatacaaatcatgtagtattagaagatattccagagggaaaattggtgatcaacagttgtccagcacccccagtactggatagttttagatctattttaatctccttaataagtcctatagctatgcaagtgagtgcattttgataactgctgtgcctaatttgtaacaattactgtcaaccttcagttaagagactgttcattccacaccggcccagaaaagagtgaaatgtatgactcgtgtgcataattttattcacatcatatttcatactgattatgtattgatgacattgattcatttactctttacagcgccacttgcatggatattaaatcttattgaccacagatgaattttaatttcagattggtgatagatttttccatcagctctgatagtatgtttgactttttcatcattaacccaggcaatcacacagcactgagttattgcattgaaacaaaaagtgcacacttcacttggtaattctttatggatttacaataggaacttcattaatgtctgttgtaaggatcacaaaaaaaacaacatttatctgcaaataggaatttagcaagcttcaaaaatctcggggaaaaaaatagacttttttgtcttctgtaatgcattttcttagtgcggtggtggaggtgggggtttgacaaatatttgaaaacttttaaccattaaaattatgctgccatattttgatgcttatatttgcccttttcccttgctcaagtttatgaggtaattttaaatgtatgttctgtttcttagtgttaattacatgacattatgtgcactttaatttactaatatggggagctacatagaataaccattttaagaataaaagttgaactttttaattgcaaactaaccagtcactgctgatgaggtatttcaagcttcttcaaggagtgccaagacatataaatgcttaaagatttttgtgatttggattctaatgaagtgaatctgcagggcagagttgagaacaatgaatgagcaacataaatatttggagatacctattcagaatagaggtaaagctgtttgtagttacacttggtagcaaaaaagaaaaaatatgctagaaataaaatggtagaccttctctccactccttctgatgtaaaagcttaatttttccccgagttagagcttcactttgttgctggttttataccatttctttctctgacttagcaaagtactatacaaaaaaatgattgttgcagttcaccagcatgcatggtgagaatgaaaggatgtagagatgagatggaaaatgttgctagattgtgaagcactgaatacaggcaatagcagtgttaggtagggaccaagtataaagcacacctaagaaatatgagcaggatttcataccatcttttatagtataagatggcataaatttagaggtgttagggaggagaactgcagaaaaaccaggtttacctgttgatgagattacatgtcttatgcctttcattgaaatctgttttccacaccttttccaggatggcagtggtagggtattcattttggaacactatattttaggcaatgaataagaacctattagtgtatgttttcttaatgttggaggccaaaaaagagacaggtggccttcaaaaattaatagctcttaaaaggcataaggaaatacaacttatggaaatgttcttgtcagacattggtgagaagctgtgttttgggggtgctgttaattaagaacatttccctgttggcgtaagtgtctcacatttttgcccttggtgcccagctcaccatgagcacggtcaattcacaaggtagtttttataaataaaggttttgggcaagctgaacgtggtccagagagatattaatgagagggcaagggggaagagttaatgaaaacatacttcctggtggaacataaactgctttttggaactggagaggctttaaaattattttcccaaaaccctgtggcgtttcttttctggaggcaatgagatggggagaaatgacaaatggcttcgttttattattttctcctctctcgttctccatatttttggtagggaaaattggacatttattttggccattttccttctattcgcagaatcaattacatttttggtgtattatgcgtggtaaatatactcaaggatcctctggcttaaaagcaatgagttgattattcgaacatcccttctttaaaggcagttaattgcatggaaaacataggcccccattgtctggtccctttaaacttttattctgagatttgttcccagggtctgggctgtgtagtgtagttgttgttctgcatcattggctgttgtatattccaagaaaaataattttaagcttttaaatcatacagtgattgaaatcttgcatttcagatggactgaaatctcaggccactagtgttcaaggatctacaacattttataacctatatcacttaaaggaggcttggctagctttgggagaatgctgccttctagagggttatgtaaatcaggaattgtggctaattttttcttttgtagattgctgcctgttctggaatttttttcttccactcaaaagtgtgatggtgccatctagaattacctgtgcttttcagttttcagtggaacaggagttagatcacatctctttagttggaggaaaatttagtgagtgttctagtctacatgtcacttcgcagttcccccatagttacataattggtgttgtgtgtgtccatcgtagaagacatttgatgctcatttattaaatatgcttgctggctgctgctgcatctttgttctggacagacaaattacctttctcacactgagcttccactctggggaattaagccttcaccactttaattagcttggaagtagggggttgcagttcctaatagactacaggctttttgtaagttagggaaagggtgaaacgagaacttcctgggaggctcaaaatgtcatttaaaaaccataacaacctaatatgtattatttcattttggtaattgcaaacagattgtatttgacaagtgtgtggatttccatttctgacttagacattgaagccacccttgcattgaactatgttcttttatctatcacaggtcattaacacattgcatgtattgaatcacatatttgtgtagctattaagtgacatagcagataagaaatagtgaaaaatatgtgaatatttgtacatagaaattttcatatagacacacacctataggtagtaccaatatgggtgaatatttttcacatggggatatcggaataataatgataactgccagtatttgttgaacttttattaagggccaagcactgttgaaagtgctcccatatgtattatgtaattatcataacagtgtcattatcccttctttaaagatgaggaaactgagacacaagcagtttaagcaacattccaaaaggttacacggttaagcatatgaacccaaaacttcctaggtaggaacttgtcttggaatgtccccgctatttaaaaaattcaagatcccactgctgggcaagatgttacattccttttggaaagacacttgctcttaacagagttaagcaattaattgtagtactttacaccagaaactttctgagcgtccatttactgtctcattttctttgctagtaaaactgcagaaaatgttatgctttagttcttcactgccagagtaagtagcatagaaagcctctatcaagtcacagttggaaagtaatctaataaaagaagattagtgaatgtggggaagacaaaagcagtcatgtttgagtttaatatctctcaaatttagcattttagctaagatgcccgtttttatttcttgcaggtctgctaaaaggtcagagtaatgcagaatgcgtgccttcatctcagatttgttcatcacaggtggatcccatgtgtcttcagtagacaagtcacctttgtagctagcaccagtgccagctccatgccattgcaccttctttagtcttgattgcccttcccgcatttattggtgtattaaaatgactgaatatgaacattaaggactccatgaacctgggctaatgggagactgtagagaaaatgaaaaaagatccaccagaggacatcttggggagggggagggagctgggggggagggaaatgactaatgaagctaattaaaagaagcattcaaatctgctttctaccctcattaacaattagcagggcactggccagagtttgtaccctgtgttttaccttaacaacattctatttgctctttgtatatttaagtgttgtaaggaaacgtgtttcaatcaaaactgaccatgagataaaggaaagagatgtggcttttgtgatattctatcacaaacacttattgtatctctgtaaaatacaatgtatgtatgcatgtaagtgtttttgtcctaatgttgctactcccatggcaaagaaaaaaaaaagaatgaaaaaaagaaaaaaatttggaaaaaaaaatcaggctcatagcagctactgtgtagaaaattccccctacttctaatttgctgaatgaagaaaaaaaaaaatcttttatttgtgatattttcagagacatttgctctagtatggtgtatttaaataataaaaacttaaaagaaaaaatatttaatggtgtttgggtttaaacactgctttttctcttctgtattttgaagaaatttagtttttattgttgttgaataacaagctcactttaaatttgaaggagttgagggaggtggagtgtatatttatttagctctgggccagtaaggtattcttcaaattacttaaccacgccattattggcaggggtacaaagtagtttctaacagggtcctttctataagtcaagaatattctgttaacagcatttcgttacacttctatatcacagtaagtcttttgtgtttataaatacttgagtgtccactattttgtttattctttttctcaatagcaaacaaagccttgggtattgatgaaaagtatgtataaaaaaaaatacggcacaaccatcctgttctcttattgagtttatagcttttgaaggaagtcacaatttctaagtcatacctgtacatattttgaagctcacttagttgtagggacccagagctctttttttatggtgatctttgattggtgaagtagccatttcctggtgacccttaggctcgtgtggttggctgtaaggtgtttattttgttttgctcctacacttctttactgactgcgtttccgtatgtattttgggggaagattctgacttcatttagtcttagtcttgagatactgagttgctggttgcaggcagcagagtgtccaccacagtgcctgcactgcccgcagagctgccctccggaaagcatgcagtataacagctagtgctggaaggaggaaaaccaaataggcctggaggctgaggttgtactgccagcttccttagatgtgagcaaatttcaactacaacttccatcacaggctaataaaaccaggtgtgtgaacgctactattttaaattttcttttttaagatggcattttattttgttccagaaaagcgcctgatgtagaccctccctctgagaatagccgtggagccatgtagagaggtgtagctcagcacatctcaactaccagtcagcttccctttgagaacttctgtgctcacttcctgttttcagagattccagggcaggggaaaaaaaaaatcagttgaacttcaaacctcctagaggagattgtaaaggcatagagttgaggtgaatagttttgttagaaccttataaaaataaaatgcaagaaaataatatgaagaaatcacatatatatgtttgaattagatgtctgtttgaattagatccttggggaatttcttcaaactagttctggttcttatatttgttttttttcctttaaggaactttctgaaggaagttagactgcgatggtaaagggggaaatgggttaatgagattgcaggcattttctatattctttttggcataagcacttatgtccctgatatgtacaaattcaaaggaggtggttaataactttagtaaataatatattgtcgcatttaatgatgtggagggctaaggtcattacggactttaaataaactattatatggctggttcctcaagcactgctgcgtatttaataatgagcttctaaaagcatttcttaagttgcagacctataagattacaaatgtcactcatgttagtataatccacatgcaagtgatgaagccttctctttgatgtgctaaattggagaaggactaatggagctatgaatatacaatagaacatatttaagtagtagtcttgctttaggtaaaacactttcttgaaaccagaggcatttcaaacaataaaacccggctctaatggggatgctctgtgtggatagaaagctactaaaaacactcaggtttattctgatgtgagcagcgattgtgtgcagttcctcccccaatctcaacattgcttaggaaaaaaaaaaatctatgagtttattccacctttcatccattgcatttgtgatgttattagttagcaagatggacactgttctttagaaaggacttatttaatattaaccacgtcatagagcaagatg

SEQ ID NO: 13749 - DNA, 156324 bp, Human
  misc_feature (1)...(156324): n = A,T,C or G
accactgcactccagcctggtgacacagcgagactctgtctcaaaaataaataaataaataaatctgtgtgcattcaatgcccctgaattgtacacttatggttataataaatttgattatgcattttaccataataaaacattatacacacacacacacaaatgcatgcagtgctcccctaacactgtatctattacttaaaatggcattattgttgttcggacataagttggcttccccaaagaattctccagtcaccccaaggataagtacctttttttttttttttttgaggcagtgtctcactcttactgcaacctctacctcctgggttcaagcaattcccctgcctcagcctcccgagtagctgggattacaggcgcacaccaccacgcccagctagtttttgtattcttagtagagacagtttcaccaagttggccaggctggtctcgaactcccgacctcagatgatcggccagccttggccttccaaagtgctgggattaaaggcgtgaaccactgcgcctggccggataagaactcctaatcctttctgtaactccaaagcctaggaaaccatctggcttttagttaccagtaaaggtaatcatatcccggcctttccaagtgttctttcatgtatttaattatcatcttcaaccaaggcaatatactagacacataaatagttgtaagacttgtgaagtacacaccagaaaaattctttatcacacatatgataagttagagttcagaaactgtggccacagaactccagatcttcaatacatgtttgctgaattgatgtatgagacttgagaaggcaaaaggatagacgttaagtcctggcatcaggccaacagagttacatggagcgtgtgagaagtacataatgttacacttcctaagaaatatgtcaacgaatgccctttctaagtagcaacgtacctaaataacccttaccactctctccaggtagttttaacaaaggtattgtaccgcagcttcaaaaaatcaaaagttacgcgtttacctatccattcactgctcagacaaaacaaaaacaaaagctacctgtaggagacttcgaaattccttaataccatagtgtcattaaaaacaaacacctagatttactttacttagctatattttactaagtagtcaggttagctttaatgcttaccacgccaaggaaaggtggcttttttcctttcccgagggtaatcccgtcccacctccccctcccttaaataaagttaaaacaacccaaaaaaacccagctaattctcagctctgtacagttctccagtacaagcaacagtagttcaacctcaagaaaaagacatcttaaaggccgtacattaaaagttgccagggatccagccgcttacatttcatgaaaagtacagaccatacccgtttagctagctgtgcaccttaactggtcgagaaggcgcgctgggggctgggtttgagggtgagcaaaaggcaagattattagtttgggttgacgtgggggtcaaggggagagcagaggaataatctgtaagatctgagtcccgaagctctttgggttatggaggttagaaaagggcctgttaaagttaggcccaagtttcggcaaggtggaactgggaaaaaaaaaaaagaaagaaaaaaaaaacgaaacccgaaaaaacaacagcgagcaggctcccgagttctagcgttcacagtgaagccgttaaacgcagcaggaaagtaggcgtgtgttttcttcctcttcccgcctccccagagactcgagcccagtcctttcccctcattttcaccccagccgagtccaatggctgccctcgccgcggagtcgggtcggaagacgccccgccccctcgccgcgttcgccctagggaacccctccgccccaccttccctgcccgatgaggggcagtggctgccgccgtcacgtgtgctggcagccgccaagtgaggccgcttttgcgacgcggtgacagccaaatggtgcgacaggaggagctgcagccgcggccgcagcgcccgcacggagaggcttgaggcggctcctggcgtcgcccagagggagcgactagacgaacagtccggtgagggcggcgagaggaagcccgctacgagtgccctagctccccgccgctctcgatgaaccggacggaataagccgcgcctccagcaggggctgcgcctccatgaatccctagttgtttttttttttttctttctctcccctctcctcacccccaccccgagccccgtcccgccttctcccttcgccagaggcggccgcgtccaggtgcggagtccataccggagcgcaatggcgtccaaccccgaacggggggagattctgctcacggaactgcaggtaagggccgcggccctggtgagaggcgctggcggaggagacagggagagagccccgcgcggcgtcggggaccgaggaaagccctgcggccgccgcgcccctagcccgctaagtgcggaaactccgggatgtcactcgggaaatgcttccctcggggaaccgcttccctggggagccggaccctctcccccgccaaagccctggcctgccaccgctttggtttgattctgcctaccagaggggaccccatctctgcagccctgctgcagcgggagcctgctctcgcctggtccccggagaggccggcccgtcgccccctccctcggtgtcagagctacccgcgaacgcccctgttgccccctcccttcgcgcggccgggccccgccccgcctttcctccgtacaccgctccttaaactcctttgaatgactcccaagctgttttcttgtccctccccctcccctcagactccgcacaaagagcgcccccataacttccagcccctagacaagtttttttaaaaaacgagtctcaccaaatgtttgcttcacttcagcagccctcttcaggtgacagagtttctttcctctattttgagggttatctttttcttttcttttcctttctttttttttttttaaccgagtgataaatacagggtgcctttctctgctacccctgcccagatccgggagctcagatgctgatgcttttcagactttcattttccctctcatttgagcaccagagaaagagctaataagttgtttactaatgagaaagcagtcgactaagggaaaacattgggcaccacatgtctgcaaaagatgagagcaaagtagatcgcttagttaagtcatgtcgagtagcaatgttatttcccatttccagataaatatttgataatgtaggcacgattttctttagatctctatggtgtacatggggacttaagctaccctgtcgggtttttcattacttgggagtgttccagagatgtttgttttttgacttaaaagttattttgctttattttaatatagttatcttttagctactcaaagattgtagatgggaattaggagaaaaaaatagcatgcctgcatttctttttgtgtgttggacagttaattttttttaaaaaaaagactaaatcaagaaattctgaagagttgatgtcaaaattaagtattgcaactgcatctaaatttcttgtttaaatatactttttaagaaatctctttataagtttggtttcttgtgcagtcagacgtaagcttgaaaactttggtataatggttgatatttcctccacaaaaatagagactttaacaatgtatatcaatgcagtgttgcacatttagaatcctttggtaatgcaaagctgaatttcatataattgaaaatgttgctatgtaatattttaattacagttagccttttataagcagatcttacagcataccacatttgctaaatgaatggaatttactattttattaatagtaaataatttacatgagcttttaaaatgaagatgatgtgaggcaagtcagaaatactttacattgcctggtcttgaaccatgaaaaacatactttggttttgattgagaaagatgatagggtcacttttcttttgaattgagcagtgttagagttacaatatatttggcattggtacttgtatgttatagaaagttggcataaaagacacctactttggcactggaactgaaaatatattttcatgtgtattaataacatttaggatcttttaattaataagatcaattttgataataacaaggaagcaagcaaagaaggaagaaattttaaatatgatgacctagaaatacgaccaaaatagaggaatacctaaagttaagcttctagataaactgaaatataaccccttccagaaaaagaatagtttttattaagtgttaccttataggttgtcatatatccaagtcattttcttggtttatttgactcccagttttgataaaagttattgcatttaaactttatcgtgtttattaaaatgtttgcgactattacttatatcaacacttaaagataaatagtcataaagtttgcttctccaaatatttccatctattcagactttttatttcattgggtcctgaaacttagtgtacagcaaccaagtatttattaaacttttgtttcaagattcacttttttaaaaagcttctaaattgtttgaatttagactgaaatactgtttaatatgaagttcttaattcttctctgccatacagattttaagtatttaagaagttttgtagccagttttaagatgtatttaatggttaaaactgttactttgctatgtatcctgtctcaggaatacttgtttactctgaaagttacatattacaacctggctttaataaaattgatatttatttagaaatatatccagcttttcattattttttcaaattgtagaatttgaaatactccactgcttgagctggaattggcttttggtcatggaaaggcaaagtaagaaaatctgaaactacagtattctgtcttgttaattactgtaatagcatggagtaatgtttttaagtattgttagtaattcaggaggcttattcaacaaggaagcattaataaactatgtaaactttggtggctagaggtttcaaggtataaggaagaatatttactgtagtaaaaataaaaatcggctgtttaaaatggccaatttctaatttttatctcataactaatttgttgtgttgtattctctttttttatttgaagtatagcagaaaacagacatttttgcaatgccaaagaaactaaagtctatttccaagaaacctggattaatgaaaactgtaaagaatctcagaatgaaagtgttggctacaatggtaattttgtagaatgcagaccaaatattgagcagtgtactaacaaagctaccttgttgattattggagattcattttcttcatcaaaatgcccaataaagtgttggtctgggaatcttaaattccattctcagcagattttatttagatagaggtaacttgctcaagtggaaagttgagatagttacccttaaattacaggggttaatttcaccaaacagttatgtagtatctaccaaagctatattggaggatataaagatgacaagataggtttttgctttccagaagagagtatagataattgtactagaagataattataagagactacaaataacattttaaaaattatttgctatatatcagacattgtacttagtgtcctatacaccttatttgatcttcacaacaatccaataaggtaggtgttatttccatgttgtggatcaggaaacaagttcaagaatgttaaggaaattgctcatggttacattgtgtgtctgagtttgaacccaggtctgtatgtttcccactacactattctttttttttttctggagacggagtctcgcactgtcacccaggctagagtgcagtggtgtgatctctgctcactgcaatctccacctcccaggttcaagcgattctcctgcctcagcctcccaagtagctgggattacaggcacctgccaccacacccggctaattttttgtatttttagtagagacggggtttcattatgttggccaggctggtcttgaactcctgacctcgtgattcgcttgcctcggcctcccaaagtgctgggattacaggtgtgagccaccatgcccggcgccactacaccattatttaaattgccacagttctggggaactataaatgttttgcatctaatgttatagttgtatgaactttctacaaattggccaaaaacgtaattaaccaacattaactttacactacttgttagctccgtctgtaacaaggaaaaatgatttctacattccacttggtagtctataatttagcagtgttttattattgtagatacagtctaatatttcacaaagaataatagtacaaataatctttttacagggtttcttcattaagaattactgtttctaatgaaaggtgtcacatgcttgcccaaaacttcccaaaagatttaacattactctgtagactgtgctttgctttaaaattttatactcacatgtaacctagctctgtgtttgacacttagtaggtgcgcaatacattgatgagaatgctccatttgtcacgtaggaggagggatgtctaggttattttaagagaagttcattataatctttgacatatgaaattacgtagttttctttaatttacatttctaatcccttctcccaaaaatattctctttaaaagtacaaaagggatttctatagtagttacatcattcttccatatagcacactggtagtttactcatttaatggaaaatgagaagacggcatctaattttgcagtgacactggaaagtggaaggtctgagttgggaggattaaaattttagggtggtttgggggttggtggtatgagaaggtaaacagggtagttaagacagactttacattgttttcaaattagaaatgtaatgcacatgtattacagaaaatccagaaaatgtggaaaagcacaaaagaaaataaaagttgctcatagttctgtcacttagagactgacagactttttccacctaaaagtcccatggctgtagagtccattttttcttttttttctttatctcattttacttactagaattttgaagaaaaatgaagctcagagaattttaagatagaaatcacagtaggttaaaaacttttttcttgccactggttctagatgagtggatctaattagcttttattgccttttttaatctcaaaatatttcaattatgagtcacggctttattaagaagaaaagtgcaggctgggcatagtggctcacacctgtaattccagtgctttgggaggctgagacaggcggatcacctgaggtcaggagttcgagactagcctggccaacttggtgaaaccctgtctctactaaaaatacaaaaattagccaggtgtggtgatgtgtgcctgtaatcccaactacttgggaggctgaggcacaagaattgcttgaactcaggaggcggaggttgcagtgagctgagatcacgcaactgcactccagccttggtgacagagtgagaacctgtctcaaagaaaagtgcagtagtatggatttagtaatagacagtaatgaagtatagcaacaatttctttgaataatatagcaatacagtgtgtttttccggcttaggtttgattgttgctgctcttatagactaccacaatgtttgtaatttgcagcgcatactttgctgaattaaacatactaaataactttccaaatatttcttgactaccaagataaaagtctgtgttaaaactagtgttactaaatgatggctctaaaatggatttttttgtcatctctcattagtgtaatagagattaggtctagtatcatgcaattcctaccattcacatagtgttgaaatagggacaagtaggggcaccttttagacatcatctctttatcccagagcttagcatctgattccttgggctctcttatttctgctttttgaatttggcaatggtaaattttcatgccattcatcagaagcatgtttacttttaaacaaataaagtagtagtttgtaaacatcacctaaaataatgttactttcataccataaatggtatttgaataaaacagttaattctacattattccctcataaaatatactgtgctgataattgtcaaatgtctatattatttcaaaagccaattttactctacagtatatgacatttaatatgatcaacttttgatatacagcagagttcaaacttgacagcaaagttgaaaactagttaaaagctttaaaaagatttaaaatttagagtgggaaaaatatactaatgaaaaagtaattccttaatgaaacagaaatagagaatctttatcttgatgcatgtctagcttgtcttaattttatctgatgaaatcttgtttgaaactagctctattatcatacttggtttttttttgcaatcacaaaaatgaaatttgtgtaacattatatacataaatattgcctgtaaaaaatgaagatcaagaaagcatgggacagtgtacttgatgacagtaaacaccttaaatgtgaaggtagtgttgaagtgcctcataaagatgagtggatatacaagacttacataatattgttaggatttatctcttttagaaatttgtcagtgacttatcaaattggtgaaagttttactgccctggctcataagtaccttaatttaatggaatgtagttatgacaaaatttggaatttatttttgattatagaagacataccacacaatacatgtgctgagagttttttatttattttatttttatttttatttttgagacaggatctcgttctgtcacccagcttgaagtgcagtgacgtgatctcggctcactgcagcctctgcctcctgggctcaagtgattcgcccatctcagcctcccaagtagctggtactataggtgtgagccatcatgcatggttgatttttatatttttttggagagacggggttttgccatgttgcccgggttggttttgaactgctggactcaagcagtccacctgccttggcctcccaaagtgctaggattacagatgtgagcgtctgtgcctggcctgagtatcatatattttacacattaatcatactgttttcccttccctgtagttgctaccttagggattctttaaggaggtgtttgttctccatttcagaattttcattgaacaaattttatgcaacttttggatttttaaaaaatttgttaaacatcaggcacactgcattggattaatcacctatctgtctgtcaatcattttaataagtactcatggaccaccactccccctctctcaaaacaagctaggaactttaacctacgtatagttttcctctattctatccgtctatttccaccttcttgtcatctaggtcatcatttttgagtcctgtgttcattctcttccttatatagtagtccctccttatccacggtttcagttacccatggtcaactgtggtccaaaaataggtgagtacagtatagtactataagatatttataagtactaagatactttgagagaaaccacactcataactgtaattacagtatagttataattgttctattttattattagttattgttaattgcttactgtgcctaatttataaattaaactttagcataagtatgtatgttaaaggaaaagtgtaaatagagtttagtactgttcgtggttttaggcatttactgaaggtctctcggtggataaaaggagactactgtgtatagtttagttggacatataaatctaaacatcttttagttgtttgtatagaattgtgaatataatctttttgaacttgatttttcacctgttataaataagatttatccacatttttgcatgttgctatagtcattatttaaattgctatataatatttcattgagtaaaatattcattaactctactttggtggatatttggatatttatccactctcccttgttgggcagttattttccattttttgttttgttttgtttgtaattataagcaaagatcctatggacagtctgcatgtttcctactgtgcatgtgccacagttcctattatatacctagaggtagcattgctgcctcacagggtaggtgaatgttcaacttaagagatgatgcagaactttcaatatggttgcaccaatttatattcatattagcaatatatgaaataaaagatcctttggttatccatcctctccaacacttgatattctctttttaagttttacaaatcataagggtgtaaaatgttgccttattgtggtcttgatgcgcattttcctggttatcactgatgtagaacacttctttttatgtttgtcggcctttttacgtggcttcttcagtgaaattcctatttatgtctcttgcctatttttgtttttcttactagtttataagagttctttatattgcttatgttaatcctctgtgtacattgtgaatgtcttctttcagttcctaactttttcgctttcttttatggagttgtgtgggagggacagttttaaatgcctctaccttctttggcaaatatttggaataatttacatcgttatcatcaacaggcttgtatttaatatctattgtacatttggtatagaaagggtaaagttatattaatagtttatggcctggggatttgtaaactatccaaatgaacagccataggaagttgtataaaatattgtattgcttcacacatgctaggcacccaaatgctaggttgatttagttaatgagtaaattcagaagcaaagaaatagcaaaaattatacatacacttcatcagttgcttattttccaattccatacctctctgttgcaaactacttattattagtcattaataatattttattcttttgtttaaagggcagtatattccgtaagattatgtgagtcagttatttaggtattttcatagcttgccattaaaatgctggagttgatcagatttaatactggatataaagcaaaatattaatcttctgaacagtttactagttcagaagtttacaaactcggaatcctaaatacagtttttgtcattgctgtgcatcttttgataaaaaaaattcttaagtcaaatttgtccattgtttatcatacagtaagtcctcacttaatgtcattgacgggttcttggaaactgactttaagcaaaataacttataatgaaaccagtttcttttttctcatcagtgttctaaggaaatgatattataaacaatgaaacattagccagaagtggtgatgcacacctgtagtcccagctactttggaggtggaggtgagagaatgacttgagcccaagagttaaggctgcagtgagctggaatcgtgtcattgcactctaacctgggcagcatagtgagaccctgtctcaaaaaaagaaagaaaagaaatgatattgagcgaaacagcattattaaaggacctgaagcacattgtttttcttaaagtctcagttccaagaacctatcagcagtgttaagtgaggacttactgtaattgcttttcatgcccttttaaataaattattccctatcctgggtttaaaagatagctacccaagtttgctcctaagaatcttgcagttttattttttagatttaagtcagtttatctggatttgttgttttttaatagacttcatattttaaagcagttttaggtccacagcaaaatcgagaggaaggtctagagatttctcaaataactgcgtccctacatatgtacatatgcattatcgacatcctccacaagagtacatttgttgcagttgatgaacctatattgacacatcatcatcatccagagcccagagtgcacacatcttggtgttgtgcattctatgggtttgtacaaatgtataatgacatgtatccagcattatagtatacagaatagtgtccctgcactaagcttattctctgtgttctacctattcatccttccctctcctccatcccctggcaaccactgatctttttacagtttccatagttgtgcgtttgggaaaatctcatgcggttggaatcatacagtgtgtagccattttacatgggtttctttcacttagaaataagcatttaattttcctccatgtcttttcatagcttgatagcttatttctttttagtactgaataatatcccattgtctgtatgtaccttagtttattcattcacctactgaaggacatcttggttgcttctgttttggcagttatgaataaaatgctatagacatcctatgcaagtttttgtgtggatgcaacttttcaactcctttggttaaataccagggtgtccaattgtatggtaagaatatatttagatttgtaagaaactcccaaactgccctccagagtgcccgaactattttgtattcctaccaacaataagagtttttgttgttccacaccatctccagtatttggtgttgtcagttttctggattttggtcattctaataagtgtatcatggtatctcatttctgtttatttaatagcattgatttttgaatatggagataggtctgagttattttaatgtttaaaaacattttgaaggccaaggcgggcagatcatgaggtcaggagatcgagagatcacagtgaaaccccgtctgtactaaaaatacaaaaaattagccgggcgtggtggcgggcgcctgtagtcccagctattctggaggctgaggcaggagaatggcgtgaacccgggaggcagagcttgcagtgagccgagatcgcgccactgcactccagcctgggcgacagagcgagactccatctcaaaaaaaaaaaaattttgaaatgtctgtcagacgtctttataatgcaaatttaaaatagagcacttttcagcttttaggatagaaacatctacacatagctttattagcctaactctaacttgcaaaaattaatcaaatatgattaattaaaattaattaaaattaatcatttgattaatcaaatttgataaattcttgccagttagagttacatcatgctaggttatgtattgaactatacctgaacttatccttacctagctcagtaatacctcactttttccttattatatcaatttgtggttcttttgtttttttatctcctgaagctttgggttagtaaaggtcatccttgtcttaactcttattgacacccatcccattccccagttgtggctcaaactttttatgttgttttctgtcatccaacctactcctgctcttttgttctcagcatatcactcatctctatgtagtgatacgtgctgttcaaccacgtgagtttcctcaagttttcttgtctttactttcagatttcttggaatgttagccatcctttttatttctactgaattttaaggaaaaattgcttcttcttggtaaggttatactttcctgggcttttgcttcctctggaatatcatgttttactcttttgcagggtggggctttgcattatccactggctcttggcttaaaaataagttaacgtctctcatgtttttattatactctttaatactgttgtaccctcaaatttctttcttttttaaagaaatttcttagatgccttgtctaccgtttatttagcttactcatatatgacttctgtctcagttattctgttgaagtggttttcttaaaggtatcatgacattctgttgcttctagtctttagacgcaattgatactgctccagcttcctgaaactattgttaattaagctttgaggaccctgcactatattggttacttttctttcatcatacctgcctctgtttgttactactgcttttgtttggtaactccttttctaccttaaatgttccacctatttgtagcctattttcccattaatttatccttcagattaaccaccggaatctgattaaccgccaaaaccttgtttagtaacagttgcagaaaatagaaacccacttaaattagcttaagcagaaattggattttttgaaaagctatggggttgtatcacttaagggtaagatgtatagccagatcccatgagtactaaacaggaaactggatgttttctttctagggctacatgttctcttttctttaagtatgtgtactgctttatgtctctgtatactggttctctttgctctccttgcctgtggtctccaagttgcactcctaacttctaaatttacattaactacaagttcattgcacatagaccacagctgactgactgagttgctatatgtcacaattctaaattcttagatgagaaaatctgagtggccttagtcagtggaacatgtgtccctgatccagctaactatggcagtggagggatgagattctctagtatcaatatggcttcaagaaacctcttgtgaggttgggacagactattttctgaaaagggattctaggttgagaattctagggattctcctgcttaaatgtttcagttactttccatcgattatagaataaaatatatttatacttttcatcatctgacccccattttttctgatttttctccctatttatcttacactctggaatattaaaactatttacatttctttgaaccacactccctatctttgcatatgctgattctggttttaagaatactaatattgcttgtctgtctgaacagcatttgacaaattggacaatccttaaaattctgataagaaaatcatattcattgactatatgaatatatttatatctaataaaagttttacttaagatatatttttgattaataaatttagggaattggtcatgaagcattttgatacatttgcaaattagtctctgattttacagctcctgttattgaataatatatcacttaatatggtaattgttacatgtctctactactttcaagacaggaactaggtcttactcctctttatgtcgctagcaactgacatataggttatgcttaataaatgcttgaataaataaatgaacagattttaaaaaacattatatgaccaatctgccagacctgacttctctaaatttccaaaagctattcttcccctggctgctagaaatctgctagttacttttatttgactgttgcttcagtctcttcagttgtttcttctacttctgtatcttgagttcattcattactttgccattgtttaagtgtgggccttcattatcatttggatgattataatatcttgatattttacctccacctcttttgccttgttctgctgttatttaaactatgtacaattgctagattcagaatttgtccttagcattcagtgactccttaatgcctgtgggatatagtcctaattccttagctaggcaatccaagctgtcattgttgtagccccaaaatgcttttcattcttaagtcttactcatgtaagcagcttattttttcaggcatactatgattagtgatttttcctcacctgtatttttactacattctgtcagctggaatacttcaaggccaaattcaaattttgcatatttatttttttccttattttcccctactcatgttcagtctctcctcaaaacttaagaatattttctatctcatgacatttattatatattgcattgtactgtagttgtttgtatcctacttcattttctcttctaggcttaatgcttaaaatctttgaaggaaaggactatatttttaatcttcatcatttacccctttagccctttagtcctgaagaaagtagcttgcacatagcagtgttgagactcagaaaacaatactctacaatgaaggtcttagaagtagtctcagaaacaaaaggactgttttattttttaacctttttttgtcctcttgtctctcagttttatttttcctccaaggctagccatataaactagaatccatctttttaaaagtgggtcataggaaccagaaccaccaccccccttttctttcttccccagcagaagcaagctttatttagcactgaccttgacagagattcactcaaggacccccctgtacaatgaacgatgactcatgcataaacaatgtcctcaacaagttttacagtaaacaagaaaatattctttatggttgtttttcaaagcaatctttgataaaagctagcacattaatgttagcacttggtgaagtcaattctggaaggacctagacttcgccaagtgctttgttatataatcttttagaggcatcaaagacagtattaataggcgcttacattgcttaacttttaaaaaatttttgaaaataatccatgtgtacatatgcacggataaatcaaaagatactgaaatgtataaaattagaagtaaagaccacttccttagtactttctcttcaattagtcctactccccagaagtagtcacattgccctttattatttctggaattgacattataattttaaatttttgatttatcaactttagaccatatgcattaacctagtgatttataggtgacttacaaaagacatttaaccaacttctgttttcccttcttcatttcctaaatgtgttagttacattattatttttagtttttttctggtagtttcctttacgactatgttttgatttgtagagccatagcatctattaactctgcacaaaaatgagagtttcagtacacttccacttctcacttcccttgcacggactttatttattgcattgtattgtttttacattgacaaggtttatatttctattatattctttccttccttccttctttcctgtttctctctttctttttctccctgacccctcttctgcatagttcctacaacatctttcttaaacgctttatgaacatagttggatcacctggactgttttctatgtctttaaacttaccttcgtatttcctatttctttaaattttctctgttttgggagattgcctttatttttctttcggctcactaacttcagatgtatatatttcattgtgcagcccattcactgcctttttgcaaatgtatttttaattatataagtatcttgttttttttgcgtataggctagaattatttaatgtaattttaattttttccccttttttaaaaatttccaactttcaagttctggggtgcgtgtgcaagatgtgcaggtttgttacataggtaaacatgtgccatggtggtttgctgcgcagatcatcccatcacctgggtattaagcccagcatccattagctattcttcctgatgctctccctgctgtcatcccccaccctccagtaggccccattgtgtggtgtttccctcgatgagtccatgtgttctcatcattcagctcccacttagaagtgagaacacaatggtatttggttttttgttcttgctttagtttgctgagaataatggcttacagctccatccatgtccctgcaaaggacatgatattgttccttttattttttttttaatttttttattttttatttttgagatggagtctcgctctgtagtcgaggctagaatgcagtggcgcaatctttgctcactgcaacctctgcctcctgggttcaagtgattctcctgcctcagcttcccgagtagctaggattacaggtatgcgccaccacacccagctaatttttgtatttttagtagagacagggtttcactgttttggccaggctggtcttgaactcccaacctcaggtgatccacccaccttggcctcccaaagtgctggaattacaggcatgagccaccgtgcctggctaatctcattccttttcatggctgcatagtattccatagtgtatatgtactacattatctagtctgccattgatgggcatttaggtggattccatgtctttgctattgtgaatagtgctgcagtgaacatacacatacatgtatctttgtaatagaaccatttatattccttagggtatatacccagtaatgggatttctggttgaatgatatttctgcctctaggtctttgaggaattgccacactgtcttccacaatgcagaacccgttttaaaaagtcagtcataaagcctaagaatattattctaacttttccttcttccttttttttgtgtaacaccagtcataaaaaaattacctgacctacttcgtttgaccatagttcataagatccctattttagaatccttctccatacccaaaagtaaggagtacatactcagagaggcacacaaacacagaagaatgagacaggtcttgcatggtttccccactcagtctattaacattagatcattccctttttgtccaatcacgttacggctgtccatactttgttgaacctaagcgtaaaaaaggacagtttcccctgtatttttggttcttcattctgaaggctttcatgtcacgtaaaactatgatcaaataaatttgtatgccttttcttctatttatctgcctcttttcagtagttctcaacaaaccttcagagggcaaaggaagtattcacttctgtctgacagtggctgctgattaatgtttgttgagtaaataacagtctaatgtctgaaaatcttccaattttaatttgttacttaaattttttctgcttttattttggtatttatgagggagcagaactgcagtatatcatttttcccttggtaggtacataattttatcaccttaagtcatataataattgaattcccacatctcagactgagattttttttaccggcagaaggagctgtcaccagtcacaacagaagtagataataatagtaatgtttattattaaaaacaaatgataatgaatacatattgatgttacttaatcgttaaaacaactcagttgaggccgggtgcagtggctcatgcctgtaatcccagtactttgggaggctgaggcgggtggatcacctgaggtcaggagtttgagaccagcctgcccaacatggtgaaaccctgtctctactaaaaatacaaaaattagcctggcatggaggcaggtgcctataatcccagctactcgggattgtattttctttacagcttgagagctatacttttattaagcccttctactagagttagccttatcttttaaggaagttaaaataattgtatacagttcctttttttgagttttgtttttctggttgctcaatatgagacttgctcaaggccagctctattgtcagtgcctataaaacgaaacaaaacaaaaaacagcaaagcattaagtattctgactttattttgtctagccttgtgacttcttaaaagagctccagtttactcttcacagttagatcccataaagtaaaatgcccagctattgggtatggtgtggtaatgtataataatataatttgatttattttgggattactgtaactggtttttgttttattgttttcaataaatccgagtttccatctttgagaagcatctatttcatttattgatgactttagatttctagttagctactatatcagaagtacttatttgactgaattatgaaaagtcaaagtttaaattacatttggatagcaatagaagagatggctcaaagtcacacacaatttctaagtgacttgtgcaacagtcattgtaggactttagaggagggagtggtcatttgttttgttttgttttttgtttttttgagacagagtctcactctgtagcccaagctggaatgcagtggcgcaatccgggctcactgcaacctccgcctcctgggctcaagtgattctcctgcctcagcctcccgagtagctgggaatacaggcatgtgccaccaagcccagctaattttttgtatttcagtagagatagggtttcaccatgttgtccaaggtggtctcgaactcttgagcccaggttatctgctgtccttggcctcccaaagtgctgggattacaggcatgagcaaccgtgcccaggttgggcacagtttttattttaagataagcttaaaatgggatagttggaattttctaagaggaaaagatgttcaaggagggtaggataataggaaccaaatgcatgcaagcagaaaaattaaagaaaattttctatttttcattcagaagactgctccaaattatgtcctttttattttttcatactttgacaggcaaattatgtaataactaaagttggccttgatatatttgctggttctaaactttggtcagcagcttgagaaggaaggcattgtgttatttttattctttgagatcaacagtaaaaaaagatgtaaagaatgtaaacaaagaattgttttattttatcccatattcttttttacttggaataatgcagatttcactacttgaaaaagttttttagtcaattatgtgttttctttctagtatgatgaaagataatttaagtcaaggagctatagagaaaagtaaatgaaaactttcaactgcacaggtttcatgagatattctagtttcagttgaaaactatttttctgtgtgatagtttcacctttgggagaattagatttaatttgcaacattgtgtttgaagtatttcatattctgttccttgcttaaagaggtaaatttctttattgttgtggtcagggaagtctttagctaatgatgcagtgatattttgtgtaaacttttaatgaattaaaatatactaaagtccctgttaaagtgtctgcttatgagagagcatttccctgatgatcttattatataaaagtagcagtacttgtgatcctaccttcccgcactccttgtcccttttctccttccttggtttattctgtaggttcaataaaatgcagtagttatttatgtaaatgatacttaatgtgcgctaaataaatatccttgcctaaccttcattcatgctgagcaaccaaagtttttttttaatgtatagtgagagatccttttaaactggtggtgatggttttgttttatgttaattctctggtaaattttcatatgttacaataaagtctaaaacgtgcagatagttttatgatgtaaagcacgatcttattaatagattttaattactattaaacaacttccgtatatcagacatgtgctggttttattttataatcttaagagatattggcttatttttgttatttatatatttttaaagtgaggcttagagaggtaaagttacttgcctatgttacaaagcaagttagcccaactggcatttgaaactaggtctgtctaaatccaggctaatgatcttttctgtgagtattttgtattttaatatttcaaataattataggggtttattgatatattttgtaataagcattttcctctcatcacagaatatgacttggtttatagaatgacattttactatagagttctaggaacaacataatgtggtaaaaagcaaaggctacttagtctatagttccatgaagtattgagatgggaatatatcagtttagcttaatctcattttacaggttagaaaaatgagacccagagaggtttaagtgatttactatcattaagtagaggaattgattctagaaccaagatatcctaactctagtagaagataatttttgatgaatatccttgatattagtaaagggaggctaatcctgtatatagaaaaagaataagagacttaaaaaggctttttttttcagcatccttatttaaagagatataattgacatacagtaaatttcacacatttaaaatatgcaatttgataagcttgacatgctgataacaactgtgaaactgtcagtgcaaacaatataatgaacatatttaccactccaaaagtttctttgtgtctctttctaatctcctcctgtcattattccctttctcccagtccctactttctgtcactatagatgaatttgccttttgtggagtttttatacaaaaagaattatacagtatgtactttggaggtggggggcatggcatctttcactcaaatcatgattttgatatttcaccatgctgcagtatgtatcggtagttcaatcatttttgttgttgagtagtatttcattatatggatatataataccataatttatctttacctgttgatggatatttgggttatcaccaggtttgagatattacaaataaagatgttttgaacatttgtgtagaagttttagtggacttacactttcattattcttgtgtaaattgcctaagagaaaaatggctaaaacatatagcaggtgcatgttttgagtttttaaaaagctaccaaatgattttccaaagtagctgtatcattttacttttccactagtagtgtttaagagttctggttgttaaccaggtgcggtgttttgcacatgtggttccagccacttgggaagctgaggcaggatgatgaattgagcctgggaggtcaaggttgtagtgagaggtgattgcccctgcacactccagcccaggcaacagcaagaccctgtctcaaaaaaaaaaaaaaaaaaaaaagagttccagttgctctacattcttaccaatacttggtacagttaatagttttaattttagctattctagtagatttatagcgacatcatactggttttaatttgcatatttgcatttattgaatgatgttgaaccatcttttcatgatcgtatctgctatctgtatatcctctttggtgaagtatctattcaaatcttttgtctatttttaaaaattgagttattttcttattgaatgttgagagtctttatatattctgaatttaatacctttatcagatgtgtgagttgcaaatattttcaattctgtagcttatcttttcttttcttttctttttttttttaaacagtatctttccaggagcagaagttcttaattctgatggatccagtttatcaacatttttcttttgcacactgtgtttttggtttggtatccaagataaagctattctcctgttttcttctagaattttagttttaggttttacatttagttttatgatccattgtgaggtaatttttgtttatggtgccaggtgttgatcaaagttcatatttttcatatggacatatttgtttcagcaacatttatttaaaaaatatattcttggctgggcacggtggtgcacacctgtaatcccagcactctgggaggccgaggcaggcagatcacgaggtcaggagatcgagaccatcctgctaacacagtgaaaccccgtctctactaaaaatacaaaaaaaaaaattagccggttgtggtggcaggcattgtagtcccagctacttgagaggctgaggcaggagaatggcgtgaacctgggaggcagagcttgcagtgagccgagattgtgcccctgcactccagcctgggtgacagagtgagactcggtctgcaaaaatatatatatatatattctttctccactgaattgcctttatatctttgtcagaaaatcagttgttcatatatgtgtgcgacaatttctgctctctcctgatccattgctatatttattattatttttttttgccagtcccatgctgtatttattaattttttgccagtcccatgctgttttgattattggtgcttttttataagtctcggaatctgggagtattagtcttccaaatttactctcctttttcaaatttgttttgactatctaggttctttatatttccatataatttttaaaaccggcttgccaatttctagaaaaagtctatacggatttttgaatggggttgcactgaatcttagattaagaggagaactgacttccaaacaatattaagttgtctgttctatgataaacaaagtatgtctttccatttctttagatttcctctaatttctttcagcagtattttgtagtattcagtgtatgggtcttttacatcttttgttagatatgtctgtaagtactgcatgtttttatgccattttaaatggtattttaaaaatttctttttctgatcattcctagtatatagaagtacaattgatttttccatatggatcttgtgtcctgcaactttgctgaattcatttagtaattctggtagcttttttgtagtttctatagtgtttttatttaatgataatgctgtctttgcataaaaagttttacttctttgtaatctggagtgccttttatttctttttcttgcttggttgcactggctatgacctccagtacaatgtagaatagaagtggtaagagtagccatccttattttgttcctgatattagggagaaagcatgcagccttacataattcatgtaagattagttgtatgagttttgtatttgccctttaattacattggggatgtttgctgcttttcctgcttaatgtttttatgaggaaagaatgttggatttttatctaattattttttgtttctattgagacaataatggttttccttctttttttagcatcattgcacagtttttgatatgttttcattttcattcagttcagaatatgtgctgatttctttttgacccataggttaatgagcagtacttcagtttccaatttgtggacatttgtccagatatcttccttttattcctttctaattcattccattttggtcaaagaacacctcatttttttctcatctccagtctcattgtctttatgtttggtcagatgttttgggaaccattgttttatatatcttgtctgtttttggttttgttttgtttcagctgggagggtaaatctgcccatggctacttaatgttggtcagaagtagcagtctcctctcatacacttttttttttaattaggaaatatttcaaacatgtaccaaaaggctgagaataacttatgtctcttttccttgagtaaatgttctgcaaaatttacattgtatttttttaaaaataaacgttttatagatgtaagccctactttttttgacattcttcatcttactgcctactacgtttccttgctgtacagaggaaaatgtggcagatgaagtcttacattcattatattcttttacaagtttttttaaatttaattcttttccatatttattcaaggagatgcatgttaatagattggttttagcgacagtgtagtgtctcattgcattgcatatattataaatctgtttttttgtatagatgattatatgaattgcttatgatttttctcatcacaaacaatggtatgacaaaccttttgcattttatatacatgattatagcttatatgcatctagaaatggaattgctggttctgagcaaacgaatatcttcaagttagccatatgttgattgccaagttgttttccatattatagttccttttccttacagattatattttaatctttttccagtcattttggtaagaaaagatacctcattatcttaattgtatcttcctgattgtaacaggattggtatattttcatttgcttattttccattctggatccattttctatgaattacctggtcatatttttctaaccagaatattgagagaaagcaactcaaatgacattttacatttctttatctcagagcactcttagataatggtgaaagtaatccatatgtaacttatattcaaattaatatggttcttgggtctatagttgttctagtatttttctttccatgcatttttatttgttttgtgtatttgaaggaaacccagtctattggacagtattagtagtatatgggaacaagactgctgtttggttttattcagtagcatcactaacactaatgcagattgttaacctagagaaaaaatgttgaaattattcattattaaggctttccttaatacataaatacctggtgatattgtgtagatctgcagtggtggcctacctgttaaactcgaatatggttttgcagttgaacctgttaaacctgtagatcttgtattgtgtgaacagaaataaggaaactagttatgggtattaactggttctctataggtttttgttgtctaacccttgctcataatgaaataagtcattttataaactttattccatttagtagtaaagtataagatatttcaaagtcttgtgactatttgtgtttcttcggggtactgcttatatccatggaaaaaaaatgtttctttgttttggaatatatgacttgatgatacaataagtcatacttcaacattactaatcctaaattgtgattaaaatgtagtttagttttattatattcaacataatgtagtgcctcattgatgagaaatgaagtgtatttcgcaaataaattaatcttaggccttcaaacacataaaacttttttttttttttttttttttaaagtagagatggggtttcaccatattggccaggatgatcttgaactcctgatctcaggtaatctacctgtctcggcctcccacagtgctggcattgcaggcgtgagccaccatgcccggcccctaaaacactgatttttaacattgtttttggagattacatttatgtaatatatgtcacattttgctgcctgatttacagaatataggcagataattttacttgttctttaggcaagtagcagtctttatttctgtatctaatggcctttgtggttagtatgattcttttttttttcttttctcccagttgtattttgacattgagcagctgtctttccattcattcagcaagtattcactgagctcctgctatattcaaagcattattctggggcctgtttatataataataatcaattttttttttttgagacagagttttgttctgccacccaggatggagtacagtggcgtgatcttggctcactgcaacctccgcttcccgggtacaagtgattctcctgcctcagcctcccgagtagctgggattacaggtgcacaccatcatacaccgctaatttttaatttttttagtagagatggggtttcaccatgttggccaggctggtttcaaattcctgacctctagtaatccacctgccttagcctcccaaactgctgggattacagtgagccactgcacccggcccatcaaaatatttaagagtaatcaaatacactttcttctctcatgaaccttaaaatatggcaggggaagatagacattaagtgatgaagcaaagatactgagactctctggggcgagaggatcacacgttgagaactgctgaattgggataatgaagggaaggaagcatacaatcccaaatcaccattaaaccaaaagttgtttacaggattcaaaatggacataatagaaacttagggttaaaattagagccatattaggaacatatagatcattctaaaaatgtcactgagtaaaaatatacaggttaagaaaattagttgtacttggctagatgtaaacatatcacttgaacaaaagaacagcatacatgttattatttattcaaattgtgtattactccctctttttacaagaaccttaaaaaaaattatgctgggtctccagttgaacagtgccacttctcaattacacattctctttctccatacacatagccttgactttgagaatgtatcagagaccttgcaaagggaatggaaagtgggtatgtggtgtttggcatctgattggatgtggagggcaagagaagggacaggtaaaaaaatgatccttaggattggaggtgggtgattgtggattttggcatcatcaaaagaaatagggagactaggaatacagatgaaacatttgttttgagtcatgctgaatttgaaatcaatagactacctcaagtggtgatgtgtaaacagacagttagaaatgtaaaaccggtcctgggattcaaggtggagatgcactttgggaagtcatcggataatatttgaatcatgatattatataaattagaatatattaagtgccatattagtatagaacataggaatgataagtttaaagaagagattaattgaaggaatcttcctggaagtgagttatgattaagatctgttagaaaagagaaaaattttccaggcctattttttctcctattttatacttaatatattgaggagaaattttgcataagaactacttttattatttctttacattctatggtatttttacatgtaaaagctatcataataattatttgaaattaatgtagctgaacttaaccactattttagaaaagacacaattgaaacacacaatttaaggatttgccatgaatcttgtcacaaaccagttttctaaagctcagcatcactgatcattacagaaatgcaaatcaaaaccacagtgagataccatctaagactagccagaatggctattactaaaaagtcaaaaagtcacagatgctgtcgaggtggagaaaaaggaatgcttatacactgttggtggaaatgtaaattagttcaaccattgtggaagacggtgtggcaattcttcaaagacctaaagacagaaataccattcaactagcaatttcattattttgtatatacccgaaggaatataaatcattctattataaagacacattcacgcatatgttcattgcagcactgttcacaatagcaaagacatggaatcaacctaaatgcccaccaataatagactggatacaggaaaggtggtacatacacatcatggaatactatgcagccataagaaagaatgagattatgtcttctgtggggacatggatggaactgaagcccttagcaaactaacacaggaacagaaaacgaaatactacatgttctgtcttataagtgggagctaaatgatgagaacacgtgggcacatagaggggaacaacagacactggagccttttggagggtggggagtgacaggagggagaggattaggaaaaataactaatgagtactaggcttaattacctgggtgatgaaataatctgtacaataaaccgccatgacatgtttacctatgtaacaaacctgcacttgtacccttgaatttaaaattaaaagagagaagtggaaaaaaaaaagaacttaaggttttcttattccacttcccgccattaatataccacctttgcgtaatcagtctggacagttttggttttgaaacatgtttctatgttggaagtgtaagaacctcagatttggtacatgctgtcaattggagtagatatgatttttaattattttttattgagatgtcatttctaccaatagtaatcctggtagtattgattaaatgtgaaataagattgggatgaaaaaattgacttcatattaatgaggtgtttgaattgtagccattaaatcatagttatttaagttctcaatttggatatataatgcattttaataaaatgtatatgtatttggaatgtttgtagaatgcttataaagaaagtttacaattgtaggtagaaatgtgatcatttatattgttcaataagtagagaggtgaaatctctggaagtttcaaagctggagggataaaatgatgcttggggaatggcagtcaaaatttcaggaggaaggaactgtattttatgtaattttcttatattgtcctctacagttctaatataaacatatatgattggatcataaattatacttagtatgtgtatgtgagtgtatgtatacatgtatatatattgaactggcaagagaaatagaaacattatttttaatgtgggaaaattatttttaacttacttttttccctctaagccttcataatctagtgctaaggtgaataaactttagtgatacattattggtttaaaaaattatttttgttttacatatgatattttaggaatatattatgggcttaaaagtcacaactgttttccaatatgatctgaatacatttttaaagcaagttatattaaatatgtttctgtaaactgagagctaagccaccaacttatggaaagagtagcttgctctttatatcaccactgactagaataggatggcgcatataataggtatttaattaatttttgctaaatgagataattttttagaaaaaaaacctgtattctaagtataggatagatgatgtatcaaaatacctatatgccaaaaactgaattgtaatttatatctgatcagactgttttaggccactggtaccccttcccaggtttgcttttatactacctatggtggaatatgacttctgtaggaggagtgtactttcaattatgattttgcatactactaaaatttcttcaagacagtgaagcatactgtattctgaattattaagaatgtaatgatgtatgtgattctttcagacagaaaatactcagggtgtgttataaattattaaaaacattaacaatataccataaaatgtaaagtattttaaattaaggttgtaaatgagaatccatttaagacactaacttgtgaagattccagttgactattacttaaatgatacatttgtgccatcttagtagtttcgtttattttattttatgtttttattatactttaagttctagggtacatgtgcacaacgtgcaggtttgttacatatgtatacatgtgccatgttggtgtgctgcacccattaactcatcatttacattaggtatttctcctaatactatccctcccacctacccccaccccacaacaggcccagtgtgtgatgttccccaccctgtgtccaagtgttctcattgttcagttcccacctatgagtgagaacatgcaatgtttggttttctgtccttgcgatagtttgctcagaatgatggtttccagcttcatccatgtccctacaaaggaagtgaactcatccttttttatggctgtatagtattccatggtgtatatgtgccacgctttcttaatccagtctattgttgatggacatttgggttagttccaagtctttgctattgtgaatagtgctgcaataaacatacatgtgcatatgtctttatagtagcatgatttataatcctttgggtatatacccagttaatgggattgctgggtcaaatggtatttctagttctagatccttgaggaattgccactcttctcttccacaatggttgaactagtttacactcccaccaacagtgtaaaagtgttcctatttctccacatcctctccagcatctgttgtttccctactttttaatgatcaccagtctaactggtgtgagatggtatctcattgtggttttgatttgcatttctctgctggccagtgatgatgagctttttttcatgtgtccgttgcctgcataaatgtcttcttttgagaagtgtccgttcatatcctttgcccactttttgatggggttgtttgatttttttcttgtaaatttgtttaagttctttgtagattctggatattagccctttgtcggatgaatagattgcaaaaattttctcccattctgtaggttgcctgttcactctgatggtagtttcttttgctatgcagaagctcttcagtttaattagatcccatttgtctattttggcttttgttgccattgcttttggtgttttagtcatgaagtccttgcccatgcctatgtcctgaatggtattgcctaggttttcttctagggtttttatggttgtaggtcgtctaacatttaagtctttaatccatcttgaattaatatttgtacaaggtgtaaggaagggatccagtttcagctttctacatatggctagccagttttcccagcaccacttattaaatagggaatccttctccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtttgttattaccgatcttccgaagcctacttctgtcaactcgtcaaagtcattctccatccatctttgttctcttgttggcaaggagctgcgatcctttagaggagaagaggcactctggtttttagaattttcagcttttctgctctggtttctccccatctttgtggttttatctacctttggtctttgatgatggtgacctacagatgaggttttggtatggatgtcctttttgttgatgttgatgctgttcctttctgtttgttagttttccttctaacagtcaggagcctcagctgcaggtctgttggagtttgctggaggtccactccagaccctgtttgcctgggtatcaccatcggaggctgcagaacagcaaatattgcagaacagcaaatgttgctgcctgatccttcctctggaagctttgtctcagaggggcacccacctctatgaggtgtccgttgggccctactaggaggtgtctcccagttaggctactcgggggtcagggacccacttgaggaggcagtctgtccgttctcagatctcaaactccgtcctgggagaaccactgctctccaaagctttcagacagggacatttaagtctgcagaagtttctgctgcctttgttcagctattccctgcccccagaggtggggtctacagaggcaggcaggcctcgttcagtagttttgttttgatgtattaagattagtggagaccaactttacaatgagaaaaatgaatgagataaaagaagcttatgtattaggttgagtataaatttaaatatatcctaatatttctcatatattgaaatataccaagtaacatggcatttgaactgaaaatttcttaacatcttttcaaggaaatgtgctctcagaataaaacaattttaaaagattgagaggtctttgcctttacctgacagaggactatcctatatttaataaccttcagggaattctgcagcctttcacaattacttccccagtaatgaaatccagtatttacttttggatagctttccccctttagtttttgtatcatttcttccctgtttattataagatattatagacatactgaaggtacacagagagtaataaaaacactgttgtattgaccagccatcaaataaataaataaataaacattaccagttttgttgaatgaaaccttctggatacctctctctttcttaccctccccattcctaaacccccacctactatgctaaatgtgatatttatcatttccacatcagaaattatttcttacaaaccctcatggtaatttaagaatattttttcttgtgtcgttagcatatacgaagaccagtatgaggacaatggaaaggttgcacttgttttcctaaatcacatttgtgtcaaattgccagtggaatattttattgctcactaatttttaacttgtttcaacaaagtcatttggatcttttattgtttctatttgcaaatatcttttatttatcttctacttaactagttttatttcctcagggatgtggttttatattgtccatatagtttcatttttcctttctctaccttccagctcggagtaactaacaacttgcttttatttcttcagtctaatgagtaaaacaaaacatttaatgagaagcccaaatctgattccctcccttgttctgtctcttcctatctgtccatccattcatccatctatttatattagttttgttgttgttttgttgtatacttaaaaacaacaaagacatctctgggcttttattttgtaagtttttcctcttactatatatttctttatttaagccaaatacttcatatcattatgcttgaaatagatatgctactgtgttttctattgtgtctgtgcttatttaaaaaataacactctagcacactgggagtttttgtgatagatctattctaaattaatcgtatacataaaacaatttagtttcatcttttcaacattcttatgtttcatcttttcaacattcttattcttactgtccattggccactttttggctatatttagtaataatgatgataatgttatctctcttgataattgcataagtgataagtaacagatactgtgactaagatatatataaatttaatcattttaataattctttgaggtaagaaaaatctgagattattgagtgtgtagtgtgccaaaattcacacaagtagtaagtgatagagctgggattttgaactaggagtcaaaatgttttttgttgttgttgttgttgttgtttttaagacaaggtctcactctgttgctcagggtggagtgcagtggcaccaatcacggcttactgcagcctcaacctctggggttcagctgatcctctcacctcagcctcccgagtagctgggactataggtgcacgctaatttttgcaatttttgtagagacgaggtttcaccatgttgcccaggctggtcttgaactcctgggctcaagcaatcctcctgccttgcctcccaaagccttaggattacaggtgtgagccaccgcgcctgaccaaaacttgttcttaattgttctgatatactcgtaggcttcatgatttcttaagagttgtttagatttctgttgcactgagtctctgcctctattggagtcacttcccaacctgtccgtctccatgtctgtttgtctctattgttgtcttcagaaccagaatttctgcatatttccaaaatgctcctaggaggtaatacagccccattgagaagttctggctaggggtaaggacttttaactcacatttagagatggaagaaaaatataatgtataagtagcccttttcaaaaaatgtttcgtgacccttttttttattatttcaacagattttggggggaacaggtggtgtttggttacatggataagttatttagtggtgatttctgagattttggtgcacccatcaccagagcagtgtacactgtacccagtgtatgtcttctgtccctcaccccactcccacctttccctctggtgttcccaaagtccattgtatcattcttacgcctttgcatctcatagcttagctcccacttatgagtgagaacatatgatgtttgattttccattcctgagttacttcacttagaatagttgtctccgattctatccaggctgcttgcaaatgccattattttgttcctttttatggcttagtatcatatacacacacacaccatattttctttgtccacttgttaattgatgggcatttgggctggttctgtatttttgtaattgcaaattgtgctgctatagacatgtgtgcaagtgtctttttcatataatgactttttttttcgtctgggtagatacccagtagtgggattgctggatcaaatggtagacctacttttagttctttaaggaatctccacactgttttccgtagtggttgtactagtttacattcccaccagcagtgtagaagtgttcccttttcaccatatccataccaacatctatttttttttatttttaaaattatggccattcttgaaggaatggccttgtgtaaggtggtatcgcattgtgtttttgaccctttgttcttaagggtctcagttaaattatattggttagtaataggtatacggaactaattatcattatttcttatattgttagaactgtggacacagtggggggcttgcctgttttatctactgggaattccagggatgggagaaggttcagaatgaaaaaagtgtgagtacaaatagaatctagaccttaagaaaggtttttctgattattgggaggtctgcttaatatgatttttgaagttacttaaatttttaacatggttgattttgtataaaggaggtattatggtaagttaattaattaaggtcttattggatgcccttttgtgaatatagtgtatttttctaaaaagtcttttttgcatagtaggctcacaagaaatagctgatagctagaaggtaactggttgacaagagggtgcatctacataggctttgaatttagggtgcttggataaacctcaggaatctgtgaacctcatgaaacctcctaccactctatgtgagtgtgtgtgtgtgtgttgcacacatggaattttctgaggtcagttgctttcatcaggatcccatacaaatctacatttgtaatctgcatccctattcctcatcccaactccatatacatgcaacagattaaggaacagtactagacgaaagttgatagaattgatcagtggcatggtgatcagatgctctagagtcattggtaggctctagtacttgtctcatgataatgagccctcttgtttaaagtactcataaagtaaaattatttctgtttcaagcacataagattataagaatgtggaatgtgcagataagacagggaaattagtctgttaagtaatcattaagaggacaattattaataaagttcagattttactcactgtataatattcttttatgcttgaatatgtatgcgacctaatggaaaggaacaatgacttgtgactgaaagccctttccatattataaacatgaggtctgtctttatttctgattctacctgtttatgtttcccaatacatatgttttctttttgcctaaaacgttttctataactagacctttggaggcagggaggggtggagattggatttggatatgagggattgctatttctcccataaaatgtaaaaaattgccttaaaaatatcactttgagaggctaaggcaggagaatcgcttgagccaggagttcaagaccagcctgggcaacgtagcacagtgagaccccatctctacaaaaaaatttaaagaaatagccaaccacagtggcacgtgcctatatagttccagttactcaggaagctgaggtgggaggatcacttgatcttgaggggttgagactgcagtgagacatgattgtgccactgcgctctagcttgggtgacagtgcaagaccctgtctcaaaataaaaaaaaaaaaaagaaacgaaaaaaattattgattgactgtgatgtgctggggacatagtagtgagcaagaaagattctgcctctgcacttagaaagcctgtcttatcatcagtcagggaagacaaataaataaaggtgtgatgagggatatgataggaaatgtaagtggaatgtactgtgggtcacctggcaggagcatctaaccaatataggtgagatcaaggatcgctttccacctcgacctgaaggataaggagttagccagaggaaaactgttcagactgttcattcaaacatggttctttgaatatttgaagccaggtatctttttttttttcttttgagacagagtctggctctgtcgcccaggctggagtgcagtggctcaacctcggctcactgcagcctccacctcccgggttcaagcgattctcctgcctcagcctcatgagtagctgggataacaagtgcctgtcaccatgcccagctaattttatattttcagtagagacggggtttcaccaccttggtcaggccggtctcaaactcctgacctcaggtgatccacccacctcggcctcctaaagtgctgggattacaggtgtaagccaccgtgccctgccccccccccttttatttatttgtttattttgagacagtcttgctctgtcacccaggctggagtacagtggcgcggtctcggctcactgcaacctcaccatcccaggttcaagcaattcttgtgcttcagcctcccaagtagctgggattacaggcatgtgccaccacacccagctaattcttgtattttttagtagaggtgaggtttcactatgttggccagactggtcttgaactcctggtgtcaagtaatccagctgccttggcctcccaaagtgtaaatccaggtatcctttttatgttttcatttcaatgtacttttgcctcatttcaggtggcataatatttttagttatcaaaattctattttaagcagtattggtggagttttaaaatctaaaaggcatgtatttgtccattcattttaaaacacaggatactgagcatatacacccccttcttatataatattttgccttctcatctattttttctcttttggttctcataataatattgagacgtaggcattttttcaattttagagataaggagatactcaagtcactttaagttagagatgagattttagagataaggagatagagatttagagatttgagagagaaggagatactcaagtcacttgctttaagttaggtaactatttagttaagttagataactatttagttaaggaaagctcaaatcacttgctttaagttagataactatttacttaaggaaagctcaactcacttgctttaagttaaataactattaagtgttaggacaaggccagaacccaggtgttttgattcctagtctaatgtattacacattgtttcttataattaaatagtttcttgatagtttatattcattagttccacagtatgatttgtctcctaggccttgaatcttgtgtatcaggttaattatccttatattaaatagttgcaggtgtttctgtattttgaattcttggtgcaaatgtctcttgttacatactgctcgttttcaagtatcatcttgttatgctacctatttttttgattcattacttctgatttactttttcctggtaaaactaataatggatctcattaaatttatgtataacattgaagaaagtggcattaaacagtgttccaagggattactcttttttttttttttgagacggagtcttgctctgtcacccaggctgaagtgcagtggcatgatctctgctccctgcaacctctgcctcccaggttcaagcaattctcctgccccagcctcctgagtagctgggattacaggtgcatgccaccatgcccggctaatttttgtattttttaagtagagacagggtttcaccatgttggccaggtgggtcttgaactcctgaccttgtgatctgcctgccttggcctcccaaagtgttgggattacaggtgtgagccactgtgcccgcccccaccccttggttttttttttttttttttttccttctttttctttgagacagtcttgctctgtcacccaggctggagtacggtggcacaatctcggctcactgcagcctccccatcccaggttcaagcaattcttgtgcttcagcctcccaagtagctgggattacaggcatgtgcctgtaagtagttactttttattgcttagtagcatgctgttttgtgaatatgccacaatatgtttatccttttccccatgtacccgttgaagaacattgggttatttccagcttttgggttaatacaaatgaagttactctgggcatttttatacagttttgttttcctttctttagggtaaatatccaagagtgtaattgctaggtcatgttaagtgttactgtttagatatatacagtatttaaatatatatgtttaaatttataagacaatgccaaactgtttttcagagtggctataccaccttacattccatacagcaatgtatgagagatccagttggtgctgtattttcacaagaatctttgtattatcagtatttctttagccatttaaataggtgtttattagacatctattattgtggttttaacttgcagttccctaatagctaatgatgttggcaatctttttatgtgcttgtttgccgttatatatcctctttggtgaagtatctgttcaagcctattttctaaattggttgtttcattactgttgagtatagttatttatatattccacatatgaatctcctgttacatatgtgatttgcaaatattttcttctattatggtatgcacttagcaccttttgaagagcaaaagttttacattttgataagtccaattgatcttttttgtttgtttgcttattttatggatcatgctattggtgtcctacgaactcttcacttaaccccaggttatgattttctcctacatttttttctaaaagataaaggggaaaacacagattttctcatggtttttacacttagatctatgactcatttgagcataccaattctatacatattttgttaggtttttatctatgttttaattttttagacagattgtaactggtattgtgtttttaactttgttgtctacacagtcattgttagtatatagaagaatgattatttttgtatatggctcttgtattctgtgattttgcgaactcacttattgtagatgttttctagtacattccttgggattttctatatacatgaccctgttatctgctaatagggggagttttatttcccagtttatatgctttttattaacttactgtagtggatagaatgtctgatattgcattgaataagagtgctgagagcagacatccttgtcctaatgccgatcttggggaaaagcatttagtttttcaccgttacatatgatgttagctgtaaatttttttgtagatactctttgtcaagttgaagttcttttctagtttgcttggagtttttgccatgtatagctcttgaattttgtcacataatttttctgcataagttggcgtgatcatgtgattttttaaatctttattctcttgatatatggtggattatattgatggatttttgcatattgaaccagtcctatatacttggagtaaaccctactgtgttgtattgtataattctttttcttcggtactatattcaatttgagtatattttgttgaggattattacatctaaattcatgagagaaattagtttttgtgtgtatttcttctgtcagggtaacaccaacctcataagagcaattgggaagtatttcctctgattttctggagaatattgtataatataggactgtgcagattatgtatttcatattgggtgagttttggtggtttttttttgaagaattggttcatttcatctaagttattgattcatactctgtatgcttatgtttcttcacatttctttaggttttatgatgcaggctgtggtctatcatggtgagcattttgtgggtgcttgcaaagaatatgtattctgttcttgttaggtggaacatttctataaatgttgcttaagttccctttttgatggtagtgttctttctattcttcctggttttctattactacttctatctgtctgagaaagggatgttgaagtccccaactataattgtctatttttcaatttctccttatcagtttttgcttcctgtgttttgaagctgtgttgtttccagaattgtattgttaatgtcatcttggtggatagacttttttatcatttttaatgacgctctttttttttttcattttcttttctttgaagtctgctttttcctggtattaatatggttactttttttattaatgtttatatggtatattctttcctatcctttttagcctacctgtgtcatgatacattgaaacagcattcctttaggtaacatatgggtttttgtttttgttttttaagagatggggtctcactgtattgcccagtctggtcttaaactcctgagctcaagcagtccttccaccttggcctcccaaaatgctgggattacaggcaggagccactgcacccggcccaaggccacatttttttaatccactgtaccaacctgtgttttaaatttttgtgtgtagaccatttgtatttaaagtgattattggtatgtgagggcttaagtttgctattttattgttttctgttcattcccatttcccttttcttgacctgtgggctacatgtgtatttttttagaattccattttgatttcttacagtgtttctccgtatatcactctttttttgttttgtagttcctttgggtattataatatgcatgtgtaatttatcagattattagtattgacattctccacataggtgaagtgtacaaatcttccattttaatctacacttttttcttccaatttgataatactaaccggaccacctactcttgccagatgggaagtccagatccccactcagcaccctctaacagcaaggtaggaagcatctgagatgcctggctgcggtagggttggtatttcaaaaagatttctgtcttactgggctgccctgttttgcagttatttggctaaagagagcaggtttttcttggggcttttttttttttttttttattctttggttttgggttacagacttctggcacaatctggagaagtctattaaaggaaaacccagagaattcatatcttgtcttcctcaagacctgaagttcctaactggtctgtttttttccttctaccttctctgctgtattaagtccagggtgtttagttgaatttatgtgggctggagtgaagagatataagcctactcaatcttgttgagaaccagaaatttgacagttaatttttgttttggttcttcaagcaggcacatgtttctttttctccttttggataactcagtcatctctcaggtctcaataaatactacttttctggagaaggaaaataaatactacttttcttgatattttaacctaaattacaagcaggtttttcattctttgctgttatcaaaatttttaattgtggtttgcttatctaatgtctttcttctcactagacatacactcctgagtgtaagggttattttgtttttgtttttttaatggactttattcttgaacaggtttagatttacagaaaaatagataaccatataactactgtactttcgttgataaagttgtttcccatgggggcatgggttaacagttctgatcctgctatacgttttactggaattgaatgattcagtaaatggatggtagatggtaggagccaggtttctcactgttggagttgggatttacagataatcaacgggaggaggctagagtgatctgtgttttgatagattcaagttggagacgtcattatgaactcatatttagcttaatatagatcatgtctttttccccccacaagtctatagccaatgtccagtgatgttattaacatccccatctttttttttttttttttttagatggagtttcgctcttgtgcccaggctggagtgcaatgacacgatctcggctcaccacaatctctgcctcctgggttcaagcgattctcctgcctcagcctcctgagtagctgggattacaggcatgtgccaccatgcccggctaattttgtatttttagtagagatggggtttctccatgttggccaggctggtcttgaactcctgacctcaggtgatctgcccgcctcgtcctcccaaagtgttgggattacaggcatgagccactgcgcccagccaacatttccgtcttttaaattaaattgttacagttgttatccagtaggagtccacagaaagtaatcgataataattgtatttgaaaagactgcttagagctatcatcatttcttgcctagattagtacaatagcctctttattatgtgtctattgcagcatagcaagctcatctcaagattcttcgggtatactaggtgtttcttttcctggtctcaactgggctcacttatgcagctgtattcagctggtggctaagctggactggaatgcctactgtggcttcactcacatgtctggtgcctcagctggaaagcttttgttctcatacacatggcctctttccacatggtttctctcgtcttccatgttgtctctctttcaagcaggatagtttggacttctttatatagcagttggtttctaagagcaaaaacaagctatgagctctcttgaagcctgtacttggaactcctgcacatcagtagaatgtcactttagtcagagtccctcagaagactaccctcagagtccatgtggaagggtgtgaatgcaaagaggcaggattcacttgaggccattttgtaacaatgcaccatagcttcgcaacatgttgccctgcctcccttgaaatctattatttcttaacacaggtcagactatatcatttctttgctgaaaccctgccctgagtttccatttcattcaaagtaaaaaccaaagtcttctttgggaggccaaggcgggcggatcacgagatcaggagagcgagaccatccggtttacacagtgaaaccccgtctctactaaaaatacaaaaaaattagccgggtgtggtggtgggcgcctgtagtcccagctactccggaggctgaggcaggagaatgacgtaaacccgggaggcggagcttgcagtgagcggagattgtgccactgcactccagcctgggcgacagaacgagactccgtctcaaaaaaaaaaaaacaccagtctttatatggcctacagggccctatatgatcttgccttaaccaaatagggatttattttccatctgaaacaagaagtagaaaggtagccagtctagggcttgtgtagcagttcagtaaggccatcagggacccagaaacaagaagtagaaaggtagccagtctagggcttgtatagcagtgcccagtaaggccatcagggacccaggctctctctctttctgctctgccatccttagtgtattgggttttgtcctgtttgttcctcgttacaagatgactgctgtactttcaagccttgggtctgcattcttggcaaatagaaaaggagaagtaaaagctttcatcaaaatcctggatttagttctctttgatgaaacttggtaatgtggttacttctggctgcaggagagcctggtgaaatgagaattttagctgtagacattgtttcatctaacaaaatgggaggttttcttttttattattgttttttaagtgaggataataggaggatgctattatgtaggcacccagcactatctgcttcagtaccaactatgtgccagaaactgtactgttgctatgaaagcatattttttcagtgggcatggccgttatgagacttaaaaataatatggtcaggcagttataataattccatttcacagatgaggaaatcgaagctttagcatgattgcagtatcagaatttatacatggtcattctgatgccaaatgcttcattatttccataacacaacattctaactgagccttctgttcaaaacaaacaaacaaaaaacacaatatggcctacatttgtgtgaagcctttgctgctctttcaaattatatttggttttcatgtctgtcttctttaataaattgaataccagaaagaaagaaggatcaggtcatttttatctttatatttcattacctagaactcaatgcatgttttgaataaagtttttttttaaaccttgtatgatagggaaaccgaaagatagataagcaaacaggtacagataagtaggataatacgcttgaattggatagccagtacactgggcttgtgtttgaactggtttcttgctttctagttgagagcactttccttttgaggcacagaatgttggattaggatgaaattagagaagaagaaatgtgttctgctaatatccctggcttaaggcaggtaatatctattaatgcaaatcaatctggtcaagatgtagttcaaatatagataaacgggtatttcagagggcccctggaagaagatggtatggagtaaataaaaacgcaatttaccaggagtcagaaggactagtaagctgaacccagccaggtctctgacagctggttgcttagctgctttaagcatgctttccccaagactaaaatcaagaaagttagactaaatggtttttgaaattccttctagctaacatagtatatgaatcattgtatccagtgagtttttatgggtactctaacatttcttggcatctatcaggtcagactgttttatatttctgaaatgtagagagagtaacagctttttcactactctgggaactgggccagtgaggagtaaacatcctctcctgtctctccctaaatgaagtacttggtcacgagtgacagtccattttcattttgttctttgaatctggtcttgttcttatttcagtgtttttcttaactttactgtgagtttgttgaagtatattaaattgaaaatgtcagtttatgtttgagtctaaaaataagaatttcattattgtacaaagtaaaagtcattgtatttaccaaatacatattatcacatttgtgtatttgaaatacttgactggcacatgaggtaatttaattacaatgtactgtgtagtctgtagtttggtcccttgtagtagaattgtgttgaatgaaagtggcaaggttaagtagcagatataatgtagtataagatatgattataagcttttacattttccacaattgaaataaagttaatattacttttggttcttttggtttcttttaaataatgtcttttccttattagacaaggttaaaaaaagaagtggagaaaattttattgtcaaaaaaatagagaaaacatggaaaactttgaaaaataaaatggaaatccctcttaatttatctttccctctatttttaaagttcttatttttaacataacttgaaataaaagtgtgtttacacagcagtatatcagctgcatatactgctgttaactaatcaagggcacaaataagggaaacctttctttattcgctagctgacttgaaattcttttgttatgacacttaggtagcatcttgaactttctcttttctaaagttggtttaaagccctgatatttgtaagctttataagggagtctgtctgtgcccaatacagtgcattgaacatattattaattttaaaattattgaattgaccattctatataacaaaaatttctaattattatcttaggttagatttcttgagttttataattctatgtcaaagagaaacactatttttaaatttcttgttttatattcccaactttttaaatgaagtcttgtaagtggataaataaaatatagtatatatacacaatggaatattattcagtcataaataatgaaatcttgtcatttcagacaacgtgaatgtacctagaggacactaagccaggcacagaaagacaaataccacatgatctcattcataggtggaatctaaaaggttgttctcatagaggtagagagtagaatggtagttatgagaggacgagaggggagcagggaaaaacgggtagggaaggatgggttaatgggtacaaaaaagttgggaatatgtaacaagaaacataaaaatagttattctctttgatagacatttaggttgattccatatcttggctattgtgaataatgctgtaataaacataggagtgcagatatctgtaaaacatactgatttcattttctttggatatatatacccagtagtgggatttatcggatcatgtggtagttctgtttaaaattttttgagtagccttcatgctgttttccataatggctatacattcccaccaacagtgtataagggttcccttttatccataccctcatcaacacctgctatcttttgattttttgagagtacctattctaactagagtgatgtgatatctcattatagttttgacttgcattttttgatgattagtgatgttgaacattttttcatacacctgtgggttgtttgtatgttctttttttggagaaatgtctatgtaggccttttgcccattttttgatcaggttatttgtttgttattgagtgtttgagttctttatatttgggtattaaccctttatcagttgtgtagtttgtaaatgtgttctcccagtctatgactggcatccttgctctgttgattgttacctttactatgcagaagatttttagtttgatacaattccatttgtctatacaggttaaatatcctgtatctgaaatgcttacaaccagagtgttttggatttgggattttttcaggttctggaatatttgcattatacttagtggttgagcattccaaatcaaattttgaaaattcaaaacgttccaataagcatttagttcgagtatcatgttggcaatcaaaaggtttcatagtggctcacgcctataatcccaacaatttgggggggtcaaggcaggaggatcacttgatgccatcagttcaagaccagcctgggcaatgtagcaagaccctgtctttacaaaagataaaaattagctaggcatagtggagcccacctgtagtcttagctacttgggaggctaaggtgggaggatcacttgagctcaatgtttcaaggttgctaatgagcaatgattgtaccactgcactccagcctgggtaacagagtgagaccctatctttaaaaaaaaaaaaaaaaaatttggagcgttttagagttttggatttagaatgctcaaactgtttttgcttttgttgcccatgcttttcaggttttgtccaaaatattcttgcctagaccagtgacatggagctttcccctatatttcctccatattttcttcttgtgattttgtagtttggggtcttacatttaagtctttaatccattttgagttgagttttgtctgtggtgagagataagaatctaatttcattctctcatgtggatatccagttttcccaacaccacttgttgcccttttcccattgagtgtacttggcccctttgtcaagaattaataaactgtagatagatgatttatttctggactgtcttctgttccattgatttgtgtgtcttttttataccagtagcatgctattttgattactatagctatgtaatgtgttttgaagtcaagtagtatgatgcctccagctttgttctttttgctttagattactttggctatttatgttctcttgttgtctttctttatggttaggtgattttctctagtaatgtgttttgatggtttccctgttatttttggtgtatttcttataggtttttgctttgcagttaccatgaagcttatgaaaaaaatcttaaaatgagatatttgaaactgatagcaacccaactttgattgtaaagataggaaaagaaagaaaaagcaaactctacttttaactccattttctcccacatttgtaatttttgatgtcccattttacatcttatattacccatctcttggcaaattaaaatagttattatttaatagttttgtcttttagccttcatattaaagatacaagtgctttatgtatcacatttatagtattatagtattccatcttccagtatacttactagtgagttttatacctttaagatgttttcttgttacacattagagtctctttcttcatttaaagaactgtttttagcattttttgtttgcttgtatgttcgagacagggtctcactctgtccttcaggctagagggcggtggtgcgatcatggctcactgcagtcttgatctcatggacttgaatgatcctcccaccccagcctcccaagtatctgggactacagccacacgccaccacacccagctgattttttaattttcatttttagtagagtcaaagtcttggtatgccacccaaggccttgagctcctgagctcaagcagtccttccaccttggccacccaaagggctgagattacagatgtgaaccattgttcctggcctatttttttttaacatttcttgtaagacatatctgatgatgataaattctcttagttttcatttgtctggcaaagtctttatctctgctttatttctaaaggatagctgtgctgggtacagtattcttggttgacagcccaccccccccccccacccccaatctttttttttctttaacaatttgaatatatcatctcactcatcctgacttataaggtttctgctgagaagtctattgctagacagattgggacttccttatatgttatttgctgcttttgttgctttcaaaatatttttgtctttgatctttgagaatttgattatggtatttcttggggtacacttatttgggctgtatctgattggtaacctttgacctttctgtacctggataatttgtatctttctctagttttgggaagttttgtgttattatctctttgaataagctttcttcccatttgtcattctcaattccctcttgaagcccagtaacccaaatatttgctcttttgatactgttgcattgttctgtaaacttcttcattcccttttaccctttttttaattgtttctcctccagctatgtgttttcaaatagcttgtcttcaagctcagatttttgtatctgatagattctgctgttgatattctctactgcattcattttgttcatcgtatttttcagctccaggatttcagtttgtttaatctctcatgtttctctgataaattcctggattcttcccctgtgttttattgaagttcattgagtttccttaaaacagctcttttgaattctctgagacatcacacatctccatcactttagggttgtttcctggtgccttattttgtttgttgcatgaaattatggttcctgaatgctttcttaaaattttttttttttgagacagagtctcactcactctgttgcccaggctggagtgcagtggaatgatctcggctctctgcagcctctgcctctcaggttcaagcagttctccaaccttagcctcctgagtagctgagattacaggcatgtacttccactcctggctaatttttatattttttagtagagacagggttttaccatgttagacagactggtctcaaactcctgaccttaggtaatccacccaccttagcctcccagttgttggcgtgagccactgtgcccgacccctgaatattcttcatgcctttggcctgccctgacatctgaacattgagggattagctgtttattccccattcaaagcctggtggtggtttgttcctgttcttccagaaattctaagcagggcgattattgtgttctttgagcccttggccactatcactgtttcagcactagatggcaccgtaagcccaggtttgcagtgaattcacagttggtttgtgttctggcccagattgactaggggagagactggagtgtctctctgggtgtgtgagtttccactggggccaggacacgttaggcactgtgtcactctgctcagtgcttgggcctcaccatggcatgctccaaagcaacattgtgtacctgttcccctctcattctttcaagcatcagtgtctccacactgtgctgcctggggttgagggaaggggtggagcaggcagtattgtggccaggacggccaccgtaatgctagctcacacctgaaaaccatagctgccaagacaagcacagcacagggatatgcccaagacccatggaactatagcctgcctgctgctgaggtttatttgtggctcaagtccactgcagacagacagtagtgatgtacccctgagtctattccactgaggccatgtctctctgcctgacactgaaatgagttcagaggcacggtctttgggtgccagcctgggatcagtgggccatcagattttgcccagtgtggagtcttaccatggcagacttgtcactgagtcaagatcaaagtactgcttttgtatccctctttttcccccagtagatggaggcactctccaagctgtgctgcctagggttggaagaagaataatggggtcccagtcctgccaccaggactactacatccccggggcaccaatcaggcccataccactgtagccttcctgctgctgaagttcactcatggcttgaggctactgtagatgccagaacacaagtctgtcatactgaggccacaggtttccacatagtatcgggatgggtccttgtctgcctagcttggtctggggttaaggggcatggggttctgcctggtgttgggtttcaccacggcagacccagtgctgagctacaagtcaaaagtcctgcactcacttccctctccttaccccaagtgggctgtgtctctctctgtgctgtgcttatagttgggggagaggtgattcaggcattgtacctctgtctttcctaccctcttcagttgatcttttcttagtaatgctaaaaccagatatggtcatctctgatctggttccttggctcttgcgaagttactttcatgcatagatcatgttcaaatttatgtttctgtggggagtcaatcgctggagagtcttattcagccatcttgactctgcctcttctccaaattctctttatcagatagagggaagcatgagttcctcagcagtggcaggttttccttaattgtaaaggaagaatattaaataacataatggacaagtcattaaaaaacaaacaaacaaaaaaaaaccaaactaatctgccaagcataagccctgccctcaaattgctcatagtctttgaagagtggtcagataaaaaaaaggggtaattgtttcaataaggtacacaatatcagagcacacaggagaggcattcaactaaattctaaagaaaggctttggacaggaaattgtttcccagcaagagttgttcttgatctttgaaacaaagtaaaagttaacagggtcaagaagatacttgaaagagataactgcaggagaaaggagagatggtgcataccaaaggtgaagcatgcttagtggctgagccaagagagatgatttcttgaagtaaagttttataatttgatatgattggagtttaaggaacaaagtggaaagaaatgggagttgaggtaggcagtaaacgaaagtgttaggtatttcttctggcctatgagaaataaggaataatttcctgagatattaagagtaccatgaacaaggaaattttgcagacctctggctttggacataatattaaagaacaaatctgcgaaagcagttcataaagtgttttctgataaatgtgtaaggattgaaacaaaaatatttggaggaatggaactagcttaaactattttttatctaagcattttttgcctcagtccactttacctgaaactagacaatatgaatttgggattttattctttgacaatagacatgtgctagtgttgttgacaacttgccaaggatagacacttaaactttggaaaccaaatggatcgtaggacttatattccattataaatagtgaaaaatctagacagcattttggctcaggtagaagatcattgtttatctgtatagtgacagatcagaaatacaacttctaacaggtgtagattacctgttttaggaattcttaacctaggatccgtggaacctggtaagtatacataacaacatgaaattttctttgtactattttttgttggcgtttcaaaggaattcttagctagaaacaggctgggcacgtgtttcatgcctgtaaacccagcactttgggacgtcaaggtgggaggatcacttaggccaagagtttgagatcagcctggacaacatggcaaaatcccatctctaccagaaaaaaaaaagagatttatagaaatcaactacttcatattttgcataatatacctgcaggcacaaggtaaattgatatgaaaaccaagacgagatcccgtatcacccataagctcacccttttcactattttgcatgatacataatttttagaaattaagaatgaatgtagaaagtacttgcatcaacttatttatatgggtgtgaggaattctcaaaaaattaaagaaaatctttgcattaattaggtctgtgattcaaaggtacaaaaaggctgcacagtgtgtctttttcttttccatgtccttcataaactcaaatctcctccctagaggtaaccattatctttggtttcttgtgtttcagaatttaaacattttaaatccaatggtattatagtaatggactttgaaacagtaaatgatatagaaatagctagaacataactttagttgttgtaaatatagattagctgtgcttaactgattggattttcattttaaggtgactgtactgtgtattgtcttagcttccatcaatagaacacaatttagaggtgttctcaagtaatgatgcttttgtactgagtcaaccaaattaccaattggagtacttagccttgaagtatacagttggccattcatatctgtggattcaacatctgcagattcaaccaattgcagattgaaagtattaggggaaaaaaaaaataaaaaataatacaaataatacagcatagcaactatttacataccacttgtattgtgtattataaataactagagattaaagtatggggtgtgtatttagattatatgcaaataccacaccgttttatataagtgacttggtcatctttagattgtggtatatgtgggatcctggaaccaacctcccacacataccaaagaacaactgtataaatggagttctgaatatagttttcccaagccctagtacatttaattcattaactaaaaagtggtcataaaggtatctattttgccaatattcatttatttttaagaagtttcttacagaagataaaatgattcacctattgaatttttttatttgtataaatttaagggatacaagtgcagtttagttacataaatatattatgtagtgatgaagtctgggcttttagtgtttacctatagaatttaataatactttttatttattaagtgactgcagtgacccagtacttgtatttagaacttcatttacaatatttgtgaattatcacagtatctctaaaaggtggctactattattatttagattttgtagactattaaaactgagtatttgaaaagttaagtaacttgctcaaggttcacagtgtaggggttgggatctaacctgggttcctaagataccaaaatccgctatctttacacagcctttgtgtgtagatgtgttcactttattttaatataaatgtatttgtcaagtaatgctacttagtagccagtgagttcttgaatttatgattttgtatggttataataaaagtcagtaagtagttggtctattgcttattaaggagataattaaatatagttaaatgtaatgtaatcaagaaagactctcttaggctgaaaacactgcatatttactgagcagccaactctcctaaactcccacatttgtatgtttattttttctgtagggggattcccgaagtcttccgttttctgagaatgtgagtgctgttcaaaaattagacttttcagatacaatggtgcagcagaaattggatgatatcaaggatcgaattaagagagaaataaggaaagaactgaaaatcaaagaaggagctgaaaatctgaggaaagtcacaacagataaaaaaagtttggcttatgtagacaacattttgaaaaaatcaaataaaaaattagaagaactacatcacaagctgcaggaattaaatgcacatattgttgtatcagatccagaagatattacaggtatagtagtgctttatttgatgtttatatggtatattaataaaaaaaatgtatctttttagaaaatagtaagtttggggacatgaatagtttttagcttttctgaaagtagagagactttttctcttttggttaaggtcttatttatattctgtttagaagggcaggagttgataggtatggaaattgaaatgtttacttagaatttaataaccctaatgtattctctcttactctctatcagtaggacgttacttagagtgagtctccagtattaatgttttgtattgagtcaatcacatgcttttacgtgattcatcctgtaatcaacagcacaagtttgccagctgacttaaagttaaaactgtgttctttgaacaagagatagttttattatttgcaaatgtaattagtcaaacctatggccttcattctttgtgctctaagcaactgaattaacaagtaaactactaggcatagtgttcaaaaaagaaaaacataatagaaaaaactgttacacattacttttattttctttatagaaaataagaggaaaatataacctatgatttcaatataaaaacataatttttaaacaatagaattaataaatatttatgttggaatttttttaatggtacagaaaataaagattgaaaacccacctctttctttcttagaccgtctccttaaaggtaacattactttttgttgtatatccttccagataaaaaattctatatttgtgccaatattcacccatcagtatgtatagtctttctataacttttcatacaaaaacttacgtttaagtttaagccaaggcctcaagacattatcaatctctgtaactgtcaatttttttatttgcaaagaaaaagagtgtgagagtgtatagagtaatacacctatagcatggtagaaaatttagaagaacgtgtgtgattagctaataaataatagatgtaagtaattttaattttgattaagaaaatacataaatttggctaagaaccttaaatttttaccatctcaaaagttgcagaaaacactactgatatttagtgttcttgttaaaacttgtttttcgacatcactttcaacatctgggatttagggcttttattaggaggctctctgtgtagagatttcaaccttgtaagaataatcgaaactttaaaatgaaagaaataataggaaatccaccttctaattttagattgaaataatcccaaagatgcaaattagttttttcagaatcaccaatctagttaaaaagaacgcttcagctcttcatctagtattcttacacactctataattatgttataaatggaaataatgtattatgaaaatgctgttttttggtaatattatataaacttagaaatagcctgttccatggaactctgccaaactctacatttttttttttgcctgttacatctttaggagcggtctaaaataagaaacagcactggagctgtttatttagagaaattttcctcctcacagaatactgataactaccttgtgattcgctgggatatagaagagttttatcatcacgaggagcccatttggtttccccattcgttttataaaagttaactttattgtggctgggtgcagtggctcgtgcctataatcctagcactttgggaggccaaggcaggcggatcacttgaggccaggagttcaagactaacctggccaacatggtgaaaacctgtctctactaaaaatacgaaaattagtcgacgtggtggcgtgtgcctgtagttccagctactcggaaggctgaggcatgaaaattgcttaaacccaggaagcagaggttgtgttgagccaagatcgtgccactgccctccagcctgggcaacagagagcgattctgtctcaaaaataaaaggtttattgaagtataaattacgtatgacaaaatgcacgtattttaagtacatgatttaatgatttttaacaattgtgtgtgtgcacccagctaaccatctctacaatcgatctagaacattttcatcacttcagtgcttctcgtatattccttcccagctaacccatgatccccaaccctggccataggaacccgctgatccatcttctatcactttagattgaatttgtctttcctactgttttatataaagaaattacctcctttaagtcctatcaaattcctgatcacccttaaaaaacaatttttaggtattaccataaaaccttccatgacattctctgctttatcttctctgtgctactttgtccattcattgttgcattgtaatgtatttctgtacatgttatatcactaaactgtctcctccttgaagggagggacatgtgttcactcatctattttcaaggcttattacagaaactgaaacatagtagatgcttacttgggaatattatatctcaaaatagaaaaacacccagcaaatcgcatcttatattagtctttagaattagtatcaaagcctaattattatgacacttgaaacattaaataacttagaaaacaaagacttaaaagttttatgataaagccagaaactttttatactgaccatttttaatactgacatttcagataattggagggcagatgatatatgaaatataactttatactgtgacttcttaatacttcagtttgtttagaataaacttgataagttcgtcaaatttttattttattaaaaaaattctgtttgcaaatggcatatttacacaacttggtaataagtcattttctcttttttccattttactaacttaacaatctaaaagcaacaaccacaacatagaggattaaaattaatgtcattaattttaggtcagtttgccataaaattttagatgttttaccttgcacactaaggtaatcccatgaatttattttagattaggtctggcaagaagatttcaaggacattgtgctttgctttcagttctgaaaggtatgagtggatttataacagaagtgtttgactaattcctgttgtcttgtgggtacataagcttagtaagcagaacaaatgactgaaggaaagagggacaaaatttaagtctgcattgtgtaaatcattactgtctaagtggttaggggacttctgtttttttctttgtttttgagactgcgtctccctctgtcaccaggctggagtgcagtggtgccatctcagctcactgcaacctccgcctgccgggttcaagtgattctcctgcctcagcctcccgagtagctggcactacaggctccatgccaccacagccagctgatttttgtatttttagtagaggcagggtttcatcacattggccaggatggtcttgatctctttactttgttgatccgcccacctcggcttcccaaagtgctgggattacaggcatgagccatcctgcccggctagggacttgttcttaattcacctctgtaataataatctctgaatcttcagtttcttgtttgtaaaataaggatttttatcagatgaacttttaaactataaaactctgaaatattccttattgtaatgtcaaggtctgattgtttgagaaagttatttgtaaaataaatgtattcatttattcttaagagtagtaggaaatgaattttttattttctcatcatgcccatgatactctgagcttcttgttcatcttctaaatactttaaagatgatcatatgatttttgcccataagagtatccccataggagcagaaaaagcatttaagaaaattcaacattttttcgtgataaaaattctatgaacaaattaggtatagaagaaatgtttctcaacacaagaaggtctatatatgacaggcccacaactaacattgtacttaatggtgaaaagctgaaagcttttcttttaagatcaggaacaagatcaggatgctcactctcaacacttcttttcagcatagtactgttaagccctagctagagcacttaggcaagaaaaagaaataaaagatatacagataggaaaggaagaagtgaaattgtctgtttgtgaacaacacaatcttacatatatgtataaaattctaaagactccaccataaagctgttaggactaataaaggaattcagtcaagttgcaagatacaaaatcagcatacaaaagtcagtatcatttctatatactaactatataatatctgaataaaattaagaaaacaatctcattaatagcataaaacatacgtagtaaatttaaccaagaattgaaagagctctatatagaaaacgatgaaagaaattgaagatggtacaaataaatggaaaaatctcctgtgttcatgaattggaagacttaatattgttaaaatgtccatactacccaatgtgatctacagattcaaggtaattcgtatcaaaatcccaacatcattcttcacagaaatagaaaaagaaatcctaaaatttatatggaatcagaaaagaccctacaccatcttgagcaaaaagaacaaaactagaagcatcacactaccaaattccaaaatattacaaagctatagtaatctaaacagcatcataatgacataaaaatagactcattaaccaatggaatagaaaagagagcccagaaataaacccacgcaattcaaatcaattgatttttgacaaagctgccaagaacacacggtggggactggacagtcttcaataaatggtgttgggaaaactggatatcgacatgcagaagaaggaagatgaacctttatcttacccttatacgtaatacctttataccttatacctttaaaccttatacctttataccttatacctttatcttaccttatacgtttataagacttaaatgtcagtcctgaaactataaaactgctagaagaaaatatagagggaaagctctatgacattggtctaggcagtgatttcttggataaaagcagaggcaaaagcaaaaatagatagatgggtttgcatcaaattggaaacttctgcacagcaaaggaaacaattagcagagtgaagagacaacccaaagaatgggagaaaatatttataaattatatattggataaggggtcagtaaggaactcaaactactgaattcaaggaaaagaaataatcttatttaaaaaatgggcaaaggacctgagtagacatttatcaaaagaaggcatataaatggccgacagataatatgaaaaaaatgatcagtatctctagccatcagagaaatgcaaattaaaaccacgatgagataccacctcatgtgtattagattggctattatcaaaaaaatggaaggtaagtgatggcaaggatatggagaaaagggaagccttgtgcattgttggtggtattgtaacattagtatggccactttggaagacagtgtggaggttcctgagaaaactaaaaataggattattttacaatccagcaattcctcttctgggtatatattcaaagaaatttaaatcagcatgttgaagagatgtctgcactcctatgttcattccagcattatatagccaagatatccaaacaactgaagtgcccatcaacagacaaatggatttttaaaacatggtatataaacacagtgcaatactattcagccttaaagatgtaggaaattctgccatttgcaacatggatgaacctagaggaccttatgctaaatgaaataaaccagacacagaaagacaaatagctaatgatctcacttatgtgtggaatcttaaaaagacaaattcattgacgtagaagagaatgctgattaccagaggcttgaactggggagggggaggatgggtaaatgggaaagaggaagttgttggtcacaggttaaaaagttttagttagacaggaggaataagttctgttgatctattacacagcatggtgactatagttaatagcaatgtattgtatatttcaaaatagctaaaagaaaggttgttaaatcccactgcgaagaaataaatatttgaggtgatagataccttagcctaatttgatcattctacaatgtataaatgtaatgaaacatcacattataccccataaatatataatttgtttgattagaaataaaaatagtttaatggggtactgttgtcattctatgtggaaattacagtgatggttagctgaggctaaatgtaccttatgaaaaaagattactgatctctaaaatggagtagtaatctaagccttagttggaacctgacactcgtttgagaaagatccggtttcctgaatcttggtttctttaagtatgtcatcactgaagaagactataagaacattttttaatattttattaagtatagataataatttgggtagtgtatagtctctgttttcattttatttccttttcttgtaccattcttatattttcaaaccccaccaaacttagattggtttttacttattaatttggtgaatattttcttcaatatttgaaatattcagaagggaattactaatttagtaatataatatacctaataatattgggattttgtggggttaatcttagcaaattcttctaaattcctaaaatatatctgtattgagggaactttgttcatgactaaagaacagtttgtggtcttggatgaatagaaatgaagatttaattttcttttttactattgccctgcccacttaaatagtgtgatcattagtaagttgctcttttgcactcctggatttgtttccttgtctttaaaatcatgagattaaatgtatagattccctaatacttgaattctttttatgatatattttccaaaaaagttaatgtgtagtaaaattgtatatatatttttagtatacctttccatgaattttaagatgaattcatctaactgccaccacattcagaaaaaggaatagttccaatgccctatacatctccctcatgttctttcttcgtagtcacacccttcttcacctctatattccctgacaaccactgacctgttctgtcactatagttctcttttgaagaatgccatgtacatagaattataaagtatataagtttttgagaattttttccctccgcatattgcctttgaaattccttcaagttgttgtgtgtatcagtagttcatttttttattcctgagtaatagttgattgtataaatgtactataatttatccattcacaaagaacgttagggtggttttccaatttttggcaattatcagtaaagctcctataaatattcacgtacagatttttgtgtgaataaagttttcagttcactttggtaaatactgaagagtagggttgctgagtcatgtggtaacatatgtttaacattataagaagatggctgggcacagtggctcatgtctaaaatctcagcactttgggaggtggaggtggggggatcgtttgagctcaggagtttgagaccagcctgagcaacatagtgaaacttcatctccacaaaaaaatttaaaaattagccaagtatggtggtgtgcacctgtaatcccagctacttgggaggctgaggtgggagtattacttgagcctgagagtttgaggctacattgagccatgatcatgccactccagcctgggcagcagagcaagacctggtctttaaaaagaaggaaataaactgccaaatatattctagagtagtgatatttttcattcccactatcagtgaatgagaattctagttgttccacattctctccagcacttggtattgttaatatattttattaaccagtctaacaagtatgtagtagttaatatacattattgtcatagaggaaataaaaatagagcagcaccatcttaaggagaatttacaaaagaacagtgcatgccctaggtacagagttatgtacagaatgaagaagtcttctctactaggagatgataggtgcagttttcaaacattaagatatttcagatagaggcagttctgcaatttttatacctaggttgcttgttttaccttaaaaattattctaactcaatcacgtgaacccaggaggtggaagttgcagtgagccgagatcgagccattgcactccagcccggcgacagtgcgagactccgtctcaaaaaaaaaaaaaaaaaaattattctaactcacagtgttaaccctgcctatttctgtaacatattaagaaagcttaaaccagaggtggtattagttataaaatatttaccaaaattagttcagttggtgatatatgacaagggctatcgcaagtatataaaataaccaattaagcctcctttaattattcagcattcattacaacctgagtaggttccagagggctgtaaaaggtaaagtatctttctttaagaaagttggactttaggagaagtataaagttaacataatggtaacacatggcaagattctggagcagtttatttttaaaatagtaacttagagacttataggaagaagtatgttaagaatatagataaatagtaagctagtgattttgtatattaaccttattaatttagatttggctaagtttatttcagctattagtatagttcctctttaattgtttaatgcagtaaacagtgtttcttaagcagatatcctggctattcaagtaccactttatgaattttggacatagagagccagcttgctataaaataaagaccaaaggttatatcatctgagatgtcattcagctgcactattaaatggttgtgtggtgtataccacctggaacctgtcgagaccttggttttctcatttgtagaatgagagggacagacaatatgtaccctatctagggtgttttgtgaacatggtattttgatagcttgagaaaaagcatgaggtatccaaggccatctaagtttgaacatgaaaccccatttggatgtaaaataaagtctgaggaggctttcctgggtctgagaagtaaagactcaagaattaaaccatattcctaatctccaacacaatcaaggaatcagggtaaggctagaccttaagtagtcagaagtcctctaagaaggatcgggattgctcctgtgttctagaactctgtttcatcttgtaagccaactgctgagttgtggttttagagaaaatactaaaagcaccagaaacagcaatctatttattgctctacacgttttgggggaagctaacaaattcagtatttactccttattctggccttgggaaatcttatccctaaggaaattttaatcatatcctattttctggtgacttccaaagttgtatctccagctaggctgtgttttctgggcttcatctgatagtttatagccacccttttggatattacctggatgtcctgttggctttgcctcttatcatgtctaaaattgaactcttcttttcttggacagctatctctaaatttttctctgtgttttctgccccgttagtgcatgaccccagtaatctataagtaaaacctgactttttaaaaccttttttccccaccttcaaccttcattgtaagtttgtaagtcgccaagccttatagattctacctctgataataggtctcaaatctgtatctcttcttcatctttattgccacagcgtacaagttcagtatttctttaattcaacgtaaacactgctgccagcatttttttaaatctagaattcagattcagtgctgttagtttcttgatttaaacttttcaatggatcttcatttgctacagaatacagtacaaatttgtagcatggtagagatgcctttcaaatggtctggcatctgcctctattatttcaactttttctgctactaatcccagctctaatttttttcccctatccctatgttttctttttttacctctctttttacctctctatacttaggcacgtgtgtgtgtgtagattagcagaatctaggtgatgggtatataggtgctcagtgtaaaattcaactttgcagtatgtttgaaaatgttcatatatacacacatacactctggtatgtgtagacacacatacatacaggtacatacaaggtgtcccttttatatatacatacattatatatttacacatacacacacacacacacacacacacacctgactctaacctctttgagaagaggaattctgccacttgtacacagggttgtcctttgcatgatgcttggctgtatatgatataactagttccctgtattaagttccctctgtccaaaataacttgtatagtttgtttgtcaactagattcttgaatggcaaatcacctttctatattatgtaataaacttagaatacttacatgctattgttggccatgttctatttatatcattttagcttcaattccacaaattagatctaaacattctatacagtcattgttggtttataattacccacatgctgatcattttctttgttcactatttcttcatgcttctcagacctaccttctagagtgatcttttcttgtacttcctaaagtacagtagatactttagaaagacgatttcccctttatatacaattctaagttgacatctattttctttcagcacttagaaactgttatttcgtggttgtctggattctactcttgttgaggaaacagctgccagtctcatggttgaagccatgtagatcatctagtttcttttaagatatcctttgtcttcagtgttctggacttggagtataatggcgtagatttcgtttcatttgatttgcttgggatttgttgggtttcttaaatctgaaatgtatgtatttcatcaattatgggaaattgttagcctctgtccctttgaatgttgtacctcctgttttccttctacgtagttttttgggaactttagatgcatattaatttcttcaaatctatctccatttcttgaatagtttcttcacctgtatcaaacttactctttatcaaatattgtgtttctaattttgttattacatttttttaatgctagagcttctattttgttaatcctggtaattttggatagtctttgtcccagttgataccccttgcatttagctttacatatttaacatacttatttcacaatctgtataggataaatacagtaagtaaaatctttacaaggctagtcctctaatttttttctcattcatggtgaatttttttctgattgagctttgtgatttgtaattgtgctggaactgtcagtattaaaatttcgtggaatgcagatttgctatatttttaaaaaatttgccagttttttctttattttgttccacataattgaacacctacacatttagaattgatgcatatttctggtgaattgaaccttctattaaaatgaaatgacttacctgtaatctttctgtcttgaagtattttttgccttaaagtatcttttgtctgttattaatataggttgtgggttgaggttagtgattgtgtggaatacctttcttccatttccttactttcagcttttctgtatcatgttttaaatatgtttcttaaaatagcatatagttggatttattttattcatttgtttttaccttgtctaataatctcttttacctggatcatttagcctatttaaatgattactattacatttgggtttatatttagtatcttattttgtgcctttaatgtttctttttctttcttgtcatttttagactattttttaagaatcaattattaaaagttcgattgttttggaaattgattcatttagatagtacatcatgcatacttatcaaaggcagtagtctaattgctatttttatctctcagacaattcgaactccttagaatgcttttatttgcctacaccctagcttatattttactgtcttactaggctggtgcaaaagtaattgcagtttttgccgttgtaattatattttttaaaaagcacttcatgacttttttatttgtttatatagtggtcctttaaaatcactgaaatctaagccactttatctgttcttcgttatttcttttttgacctaccaattagaatcacttttcttcttcccagagtacatcctttcgcatttttaaatttttaataagtctgtgaaaaactctttcatctttgtctgataatgtttttattttgtcttcattgttgaaagatattttcgttggatatatacaatctttattagtctattctcgcactgctgtaaagaaatacccgagactgggtaatttataaagaaaagagctttaattggcttatggttccacaggctgtacaggaaacatgatgctggcatctgcttggcttctggggaggcctcagaaaactttcagtcatggtggaaggcgaaagagaagcaaacccgtcttacatggttggagcaggagcgagagagagagtgggaggggctacacacttttaaacaaccagatctcactattgtgagaacagcaccaaggggatggtactaaaccgctcattaaagacccacacccatgatccagtcacctcccgccaggcctcatgttcaacactggggaacttagtttgacatgagattggggcagggacacagatccaaaccatatcgcaatttaaggaggcagttgtgtcttttaacataaagtagctgtcatttcaccttcttccagctttcagtgttgttgctgaaaactgccataaatttaactgtaattcctttgaaggtacccttttctgactgctgtgaagactgtctttgatgttctgaagttttaccatgatgtgtccaagtgtggacttttttcccctatatgtttatgcttggggttgattgggtatcttgaatctatggattggcatttttattagttcttaaaagatgatagtcattatctctttatgtattgtcttcaaatcactattttcttccgaaacaccgtaagatatattggagcttatttttttttctctgtgtctttttatgtcgcatttttcctctctttctctttttaaaaaacttagctatttttcagtattaatctgctatttttctgtgtctggtctgctattaaactcagtctaagaacaaatcttagcactcaagatgcttatagtcgcagaggaaaaacagatgtgaaaacagatcattataatacagtgtagtacacatttcagtggagggacgaaagtatactttgaagacatgttagactagagaatggttagggaaggttttctggagaaagtaatgcctaaactaacaatagtattgaagaaaacaatcgcattttattagaaaggttttgaacacagaatttgacaaggaaaaatagtagtggagaattagcttggagctagatagcacaagacctttaatgcctaaccgtgaagttgggactgtatttggtagatgtggctattaaaaatattttggtggaggaattagtcttgtctgcgttccatcttaaagcacaacaatttatattggctaaatgtatgtaaagatgcaactttatgggcttaactctagtgcattgtctactgtaacccagacatgcctaaaatctctttgatctaaaatgtaaacattaaagcaagtttattgaatttgtataacatacattttgaattgtataataatgtttagaaggttagaagcaagcataatttcttataatacccccgaaaatactttttcagtaatattagcaatatatgcagcaaatggaaatttgttttttgttgtaatcatggggtttagtttctttagccagcaaagtatgtatttaagagtagattcacctctttttgtaatgtaaaggcagttgttagagtagaaaaataattaccattttacagagtttttaaaaaattttttgaatggtgagagtattaatggggagtagggagttctagttttccttgttttgaaatatgtttcactatgagaaagagtttaagaaatatactggcaactgtatgttttataatgctcaaatttaacgtacaaggaagaaaattggagagaagaaaagcagtgtgtaggaaggcaggttaaagaggaaaatagatgaaatgcaaggatgacagcagtgtttctctgatttctaattggggaaaaaaagtgaactttataaagtttactttatataagacatttaaggttaaatttctgcataggtgtacacttttgtgacctttgcaataaattctctaagtttcagatttttttatttgtaaaatgaagttacattgcaaacctttatgacttcttgtgaagattaaatgagcagaaatactggctacttagctgagccctgacttgtaatattattgagcccttattacattttaagcatcgacctgagcactatataggctttatttttacagtaaccgtcaatttgtggctaaggaaactgtagcacagagatgttaagtaagtatataatcaagaccataccaatgagtagcaaccacaggattttaacccaggcattctgacctcagagccctggttcttaaccattttcttatttcttatattcctgtaattgttattaaaactgaggacatacttttccttaagaacagtgttatgtagtatttttacaaattcacaaactatcagatcaattggtatatctttttttttttttttgagatggagtctcgctctgtcaccaggctggagttcagtggcgcaatctccgctcacagcaacctccacctcctgggttcaagcaattctcctgctcagcctccctagtatctgggactacagacgtgtgccaccacacccagctaatttttgtatttttagtagagacggggtttcaccatgttggccaggatggtcttgatctccacctgcctcggcctcccaaagtgctgggattacaggtgtaagccaccatgcccggccggatatttcaatatcttagtacaacctgctgtaatgtttaagaatctattatatagtatctctaacaaattgtaatctttttgtataagtgcttccagagatgagactttattgcattttaagacaagccattttattgttagataacccaaaacataaggaatttatgttgcgacaaaatttttgccctacctacctttttactcattggttctaattctctgtcttgtggggaaatagtaagtggacagctttcatagacaaatatttaaatgtttagacaggaatcatttatccttctcatcctaggctaaatacaccatcaactgttttacagacaacacattttcatactcttctcaactaggggccttctattctgaatgcattccagttctgtaaaaaatgtgcttactataagctatctttatataccaaattctgtgtaatttacacttcttacaagattctgatatcatttatccaaaaagagaaaagaaagaaaattaaaatgttcccagatctgaactgttcagtcattgttataatgcgtagttcaattatggacttaacggagatacactttctacagtgggtactgctggttaatatttattgcatatttactatgtaccacacctgtttctaagctctgtacacataatttatttaatcttcactataatcctgtgaggtacatgatgttttcactatttaacacatgaagaaaataaggcacagagctgtgaagtaccttaccctgtattacatggtttgtactgaatctcagtaccaaaactgagactcaaacctgggcagcctcaaccactatactagatatatactaagttgctcttttgtgatttgatttgaaaacttacctacattttatatcagttttttggagcagcccatttgtaatttggggaattcagttagaatagaaacctttcctgaattgaactcagttaattgtgtggctttgcctgtttcctgatatgtaaagtatggataatatctgtctcaaaaggttattttaaggatttatatgcacacatacatgtgtttgcgcagatatcattaactaaagcactattattttacatcctagcctagtatctctattatttatttatttatctatttattttagaaacagtgtctgacttggttgcccaggctggtctcaaactcctggccttaagtgattctgctgcctcagccttaatatctatatttttagattaattaacaaattataattgcatgtgttgaattagtgaattttttaaagggaatataaaacaatatgaaatacattcattaaaatggttagtcacaccatcttatattgtagaggagtgaagggaacattgaagcacaaaggtaaagtaacttgcagtttaggcagttttccagtcatgaccaagttacttatcacctgaaccagggtagtaccctagtctttagcttttatagaagtaaagggacctggtgtggataaaaatacaaaacactaaacttaaaatatgaagaattttagattcaaggtaagtgttccaacaggctgggcgtggtggctcacacctgtaatcccagcactttgggaggctgaggtaggtggatcatgaggtcagaagttcaagactagcctggccaagatggtgaaaccccgtctctactaaaaatacaaaaaattagccgggcgtggtggcaggcgcctgtaacactagctactcgggaggctgaggcagagaattgcttgaacccaggaggcggaggttgcagtgagccgaaatcacaccactgcactacaacctgggcgacagagtgagactatctcaaaaaaaaaaaaaaaaaaaaaaaagaagtgtttcaataataatggattatccggaataactagatggttctttctgaagttttatttatttatttttgcaaaatgaaaattatttacttggaaaatgataattttcaaaatctgcaggcattgatttataaatgatttatgtattaatagttcccatttttattttactctaggacaaatttatttccatgaaattcatctttaaatggcacatgttttgaatttttagggactttactaacacagattttgaaaatattcccattcctaaaatcatagaaacctataaaacaacatattatgcttttttttttaacttttattttaagtttaagggtacctgtgaagatttgttatataagtaaacttgtgtcttggggttttattatacagattattttgtcacccaggtattaagcctagtactccatagttgtttttcatgttcctctccctcctcccaccctccacactccaataggcccccagtgactgttgttctcctctatgtgtccatgtgttcccatcatttagctcccacttataagaaagaacatgtggtatttggttttgtgttcctgcattagtttgctaaggataatagcctccagctccatccatgttcctgcagaggacatgatctctctttttttaatggctgcataatattccatggtgtgtgtgtgtgtgtatcacattttctttattcagtctgtcattgctgggcatttaggttgattccatgtctttgctattgtgaatagtactacaatgaatatacacatgtatgtgtctttatgacagaacgatttatattgctttgggtatatacccagtaatgggattgctgggtcgaacggtatttctgtcttttggtctttgcggaatctccacactgtcttccacaatggttgaactaatttacactcccaccaacagtgtataagcattgctttttccctgcattctcgctagcctctgttattttttgactttttaataatagccattctgagccaggtgcagtggcttacgcctgtaatcccagcactttgggaggccaaggcgggcagatcacgaggtcaggagttcgagagcagcctgaccaacatggtgaaactccgcctgtactaaaaatacaaaaattagccaggcatggtggcgtatgcctgtaatcccagctattcaggaggctgaggcaggagaatcgcttgaacctgggaggcagaggttgcagtgagccaagatggcgccactgcactccaggctgggtgacagagcaagactctgtctcagaaagaaaagccattctgactggtgtcagatagtatctcattgtgattatgatttgcatttctctaatgaccagtgatgttgagctttttttaatgtgcatgttggccacatgtatgtcttttcaaaagtatctgttcatgtcctttgcccacttttcagtggggttattttttccttgttaagttcatcatggatgctgatattagacctttgtcagatgtgtagtttgtgcacatattttactcccattctgtaggttgtctgtttactctgttgatagtttcttttgctatgtagaacctctttaatttaattagatcccatttgtcaatttttacttttgttgcaattgcttcagagaatattaggaacacctctgtgcatataaactagaaaatctagaagaaatggatgaattcctggacacatacaacctcccaagactgagccaggaagaaatagaacccctgaactgaccaaaaacaagctccaaaattgaatagcctaccaaccaaaaaagcccagaaccagaggggttcatagccaaattctaccagatgtgcaaaaatagtgttggagaaaccacggacaatcatctaactgagtttcagacttaatataatcacttttatattttaagtggaatctaccctgggaagtagtcttgcaactcagatacgtgtttttttttttttgcatgaattggttgaattcatggattatctataagtataaggagatttcatttaggctcatctcaaagtttgaaaaatgctgtttatttgaaaaatattaacttccaattttaagcagcaattcattctaataagtaattttaacaatattttatttacagattgcccaaggactccagatactccaaataatgaccctcgttgttctactagcaacaatagattgaaggccctacaaaaacaattggatatagaacttaaagtaaaacaaggtgcagagaatatgatacagatgtattcaaatggatcttcaaaggtaagtgtagttaataaatgtaactatatagtcagtcattatttgcagattccatagttataaatttacctattcaataaaatttattagtaactccaacatcagtactggtggcatggcactttggcagtcatttgtgtacatgcatggagcaggggaaatttgaattatatgacatgcttgtttccagctgagttcgaacaaggtgattttgccttcttaagctatggtacactaaaaagtatcctttttcagatatatttagtgctgttttttttcacatttttgtgcttttaattggtaatttcactgtttaaacactatattgtgacatctgaaatcattttgacctcagaatttgaaagaatggataaaagaatttggaaacatgtttttctttgttgttgttttttttgtttttttaggtaacattttaaaaattgtttattcctaccaagacccagttaataaaaaattttaccttatgggtaaaggatacacaggagctttccatatctgcaacttttccgtaaatctaaaattatttaaaaagaaattatctaaaagaatttagtctgtaatgaattttccacattatagaccactctcccaagtgtttgggagagggccaatgaaaagatgggacattttggcgtcatcaataattgcttggcctagacctgtgcattcttggagatctggtatgggcatataactcctaactgaaaatcagtgttatggggagcaattcttagtaataagaacatgtccttgttgttaggtataatgcagcaaaaaaaatgttgtgagccgctgaaccagattatcctcaaggttctcttcagcctaaggttctatagttttaataatttccagaaattctgagaaagatataaagttataaaatgtacctttgtactttcaactcatgtattttaaatatttttatctctggaaatcaatttttttattttagtagatattttttaaataatttcttaataaaagttcttacatatttctttttttgtttcagtttagaaagaatttgaaatcagagggaaatattttttttcttaatcatgcatcctaactactcaccccaaatgaaatttgagactaggcctggtggctcacacctgtatacctagaactctgggaggctgaggcaggaggattccttgaggccaggagttcgaaaccagcctggtcaatatagcaagaccctgtctctttaaaaaaaaaaaaaaaaaaaaaagacattagggaagttaccaaaaagagagaaatgtgtactgtctataaatgttttaaggttaattatgaacattagattttatgttatatttcaaaagaattttttgttacttttagagaaatgtatttgttcctatttacttatgatgtgatatttgataggatattatttcactaactttgaacatttgttattggatgatagagttattttttgtgctgttatttttagcactgacatttagttttggggattttatatttttataaaatgttattttgaccttttttttaagtaaatactttgttcctggaactgcgattttagcacattatactgagcatttttaaattaaattaacccagctactgccctgtagagtaaagtttttaaatctggggtggatggattagtttgaggggtttatgaaccctttgaagttataggaaaagcaagtgtgtatgttgatagttgtatggatgaaagggctgtaggttacaccttattctcaaagtggtctttaatccacaaaagattacgaaccactgctctaagttgaacagagttatggacatattaaaagtaaaacaaatagataacctaaaacaaccacagatccaaagtgaacaaggctgtgagcatcctgttaaaacaaatatgtcaattttgcatagctttttatttttaattagatttattaatttgaggaagactcaaatggaggtcgaaagcctatttgcaactactattgcctctgagataggcctgccagttatttctgtctagattccaccttaactgtttttatttttcatctttaaacttctcagagggtcagagtacatcgttttagattagggaaaattataaattgaaattatgtggaatattaatttattcattaaggattttgttaaaagtttgatagccattatgctcggctctggggtgtaagtgtaataaagatggtgccttattacatagcaggtactcaatatataatatcctgcttttaagagacccactatcttaaaaggagatatatcacatgtaaatagttaaagtgtgtaatagtgatttgtttgactgactttggaagcacaatggagaataatcatttaactgccaataaaatcttttaagttttagtacgatatttgaaaaatgatttggcatttaataaaaaattactttttagggatggtgttgtgggtgaatgcagtatatacacagtaaggaactgtggaatagcctggcttgttctgaggaatgaaagtgatttggtgtggctatagtacaagttcttagtgtatttcttacctgacatatctgagggtaggtagaatgtacttctgatagtaagagttgtcaactctagtagtcattttcaattaaaagccatagggaaacaaatctgaatctccagaaagacattcattttgtttgggaaaagttctccaggtgattccagtagggcttctttcccttccccaccagtggagttttaagtgggtgaggcatattgagaggtataacataactgaaagacaagccaggttatatggtatttgcacagaattaagcagttgtgattaccttaaaagatagatggagctgctgaaagcagggagctccttttcgcagggaaaagacacaatgagatttcaagtttagaaagttcacatccatccggccacatgtggtgactcacgcctgtaatcccagcactttggaaggccgaggcaggtggatcagctgaggtcgggagttagagaccagcctgaccaacatggagaaatcctgtctctactaaaaatacaaaattagctgggcatggtggtgcatgcctgtaatcccagctacttgggagactgaggcaagagaatcacttgaacctgggaggcagaggttgtggtgagccaagatcgtgccattgcactccagcctgggcaacaaaagcaaaactccatctcaaaaaaaaaaaaaaaaaaagaaagttcacatccatcctcctcagacttaaagaattaaagaaggtcatttatgcaagcagtaagtttaagtagttttttgcagtagtccaggttaaatagcttcctttctcttgtaacagcagtgaaaacagtgaagataagagtcatacttttggtatcttggatatgaggaaggaggcagagtcaaagattattcttagatcggttatgtggatagactgatgaattatggtgccctttataatgatagagaattcatgagggggagcaaatttagggacagggatgattaattcagtttggcagtaaaaattgccaacagaactctgcttattggattctacatgattaaattattacccttgtgcatgttgtaatcagagctgtcctttttaaatttttcagatattttcaccctcctgcttcaaaaccctccaatggttttccctcatacttaggacaaaatccaaaattcttattctgactctggaaatctatagcttctgatctcatcttctaaaacaccttcctctctcattacactctagctactctagcttcttttctatcccttaaacatagcaagcacactcttacctcagggcttttgcacttgctatatctttgcctaggtatctattctcccaagtacttttgtggctttctcattcattaagtcatctacttggatgctaccacctcagcaagctcttcactactatcctaagataaatagcaacctctgtctcttcttaacccttcattgcattaccaccaccttaaattacaatttatgtgatcaatttatcatcagttttcagcattagaatataaatttcatgcaggcagagacattatcttggttatcaccctatcttcaatacctgaaacaatactccattgaaatagtttgctacaaatactcaataagtatctgttaaaacaatggataccgcttcgctgcccatttgtggccgtttatcttcctctggcccataatttacacattgttctttttcttatttcatacctgtgtgtactataattattttcatattatcccttttatgactaactatttttattgtcagcacaaggatctgaggaatgggatgcagttattttaccccgttacataagtagtatagcttgccatttctttatttggtagtgtggctttaagcagcatcattggttgtgtttgtttttgttttgtcctttggaatgatctctgggggcttgataagacatgttaaagacatgcctcctgttttttgttgttattgttgttttgttttgttttgttttgtttttgagacagagtctcgctctgtcgcctaggctcaagtgcagtggcgcaattggctcactgcaacctctgcctcccaaattcaagcgattcttctgcctcagcctgcctcctgtgtagctggaattaaaggtgcacaccactatgcctggctactttttttgtattgctagtagagatggggtttcgccatgttggccaggctggtcttgagctcctgacctcaagtgatccgcccgcctggccctcccaaagtgctaggattacaggcgtgagctaccgtgcccagccttgtctcctgtttatagaatcacttgaacccaggagtttttgagacttcatctcaaaaaaaaaaaaaaagacatgtctcctgtttatatattcaggcagtaaaccaaggtattaattaaaatttggggttcttactagcatcttgcatcggttttaagtgtttcccaagcctccacatatggatataccagactgtccatccaggtccctccaaccgccaatcctccagtattgcctgtttaagctttgagatctaattgatatagaaaaaagttgcacatatttagttatacatttcaattaatttgtatgtttctatacatatgtatgcatgtgtgataccaccacgacaatcaagttacttccaaaagtacccttgagttctttagtggaagtggttaagttgttgttgtagtggaagtggtgttgttgttgttgttgtcgtcgtcgtcgttataaaagcacttaacatgagaaattctccagtcttgacatattccagacttatttattataatgactcgggaaacctttctggattcccttaactaaaattgattccacttttttgtttgtttgtttttggagacagggtctcactctgtcgcccaggttgtcacccaggctggagtgcagtggtgtaatcttggctcactcactgcagcctccacctcccaggttcaagtgattctcgtgcctcagcctcctgagtagctgggattacaggtgggcaccaccatgcctgggtaattttttgtatttttggtagaggcagggtttcaccgtgttggctgggctggtctcgaactcctgaccttagatgatcccccagccttggcctcccaaagtgctgggattacaggcatgagccaccatccctggcctgattccacatttctttggaattttcttcagctacttttaacttcctagtgcatataataatcatctatatgtcttctagcaaattataagcttcataggataacattctgattgattaatatttgtgttttcactgggtctggcatgtaatttatggcttacttcctatatgttactttaacataaatacatgatgaaaaaaataagaatgactggcctatttattacctagatggtactaataagaacaatgattggcttatttgaaagttttctgtgtgatgtaatgtgttgtaatgtcccactatagcttgcaaaacagtgttatttttttgtaaaataaaaaacataatttgaaagtcgtataattttttagttattcttataattgtaaaatatttattccaaatacaattaccagcattatagagtgccaattactaatagttcattactttagtgtgttaggttgagccatataaaattgctgtttttttagttcaaaatcagacactggcattttcatgtagttctacctaatgtatgtaaaaactttcccaaaatttgtattaacataaaagtcagatttctccaatatgtaaaccagtccgtgtactccagccttatctcttcccttgtacatattatgtgcttaataaaaattccattgaatgcctgaaaacataaaactgatatgtaataactgtatattgcctgtgatagataatatccaaaatccattttaaaagtttcatcatactttgacatcctgcagatcctccagaaatttctgtgggaaaattcacctatttttaaaataaaatacaagtgctgtttcttgcatgttgaattgaaatagtgaagaaaggagtatttccaaagaagtaaaatgatggaactacttcattttgcatgacaataaaataataaaagaagtagcttaattgaagagagtaatattatatggtttacttaatatttatacatttacattagaacttcattggaataagacacttaatcattatttttattgtcctaaaagagaacattttaatgccaattatgtgctaggcaagataattttagtttaatgcttacaaaagttttatatttaagagaatggtatcacaatttacatagtttatgcaagaaacctaaggttttcagaaaataggtaaattgtccaagtttatatataataagatttgggctcaaatctgactgcaaaatacatttgtcccattaaattatgagctttggaatacttttactctagtctgatctcaaagaaattcattcatgccttgcattacaacagggatacattctgaaaaaatcatcagtgggtgatttcatcattgtgcgggtatcatagagtgtacttacacaaacctagatggtactaggctacatggtatagcctattgcacctaggctgtagtaacagcatgtaactatactgaatactgtaggcaattgtaacacaatggtaagtacttgcatatctaaatatatctaaacataggtatatgtagtccgttgttgacctaaatgtcattatgcagcagtctggccagaagctatttgctaaatgactgactttgggaatacaaaagaaataaaagaaaaatttataaatttcataaatatgcaattattttttcctccatggtatattaacctgagtttggtattcagcagggtatatttcagctcacttttattccccttatctccaatctctttcttctttattcagtgtcatatagtgtgtgtttgatttattgaaataatactgccgtcatcaagcgtgtctcttgggttctaagagacatgaatctccaggagaatacaggttgattgtgtgctattttatccaaattagtactgattgccttagtgattaaaaatagagatgcttaaataatatgcaaagcttctcctttcttatgaataagtgctttctaacttgatgcttaatcaatttgtgtgtgtatgtatggatggataccagtctttaacaattaatgcaactctaaaaacaggaaatggcattaacttctgatatttctttttaaaatttcttagttttctacagttgctgtaacaaattatcacaaatttagtggcataaaacaacagaaatttattataattttgtagttattttgtctgaagtgaatcttagcttaaatcaaggtgttggcaggactgcattcccttctggaggatgtagggcagaatgtttccctgttttttccagctgctggaggctactcacacttcttggctcctgactctcttcctttgtcttctaagctagcaatagcaggtccagtttttctcacatcccatcactctgacctcttcttcctctcttttctacacttaaggacccttgtgattacattgggcctatctggaaatcaaggacaatctctgtattttaaggtcaaatgattaacaaccttaattccatttgctaccttaaatctcccttgccatgtaacgtaacttaccaacaagattctgaggcttaagacattgacatcttcgagtaggtcattatttggcatataattccttctgtcactcacattcagtgttactggaactaagcagaggtatgctcttgcattgattcatttgtgttgctgtaaaggaatatctgaggctgagtaatttataaagaaaaaggtttatttttggctcacagtactgcagactgtacaagaaggatggtgctggcatgtgcttctgttgagggcctcaggaagcttacagtcgtgatggaagatgaacggcagccagcttgtcatctggtgagagggagcaagagagagaggaggaagtgccaggctcttttgaacaaacagctcaacaaccagcgtgaactcatagaatgagaacttactcatactgtgagggtggcaccaaacaattcatgagggatctgtccccgtgacctaaataccttccagtaggcctcgcttcagacactgaggaattacatttcaaaatgagatttagagggacaaacatccaaaccatatcaggcattaacattatttcacttaattcagagcttttttttgaaatcttaagatatgacagaagtgttctccagctttattaagaaggtctcattttttgacattaaagtgtttctagggacctttctcattgtcaccagggttgacaaatgctgttttctacctttcttagcataattaattggaacacaattgctatctgtgattaggtttttagtttaggtttaatcatggaggcatttatttcatactatgtttctgagtcttagagttattgatcatagtaaaggaaaattctttatgttttgtgtaaagcaaaaataagaaaattacaaatgtgaatttggattttgattttctaaaagatagtaataagattcaaacctacagtatctgttagcagataaatggattgtgcgatgtatatatatatgtatatacacaatgaaatattgttcagccttaaaaaagggaatactgccatatatgacaacatgggtgagcccagaggacattatgcaaagtgaaataagccagacacaggaagaaaaatactgtatgatctcacttacctgtggaatccaaaaaaagctgaataaatagaaacagagagtagaatacagttaccagcaatagggaggaagaagaaatggggagaagttggtcaaaaggtacatacttagagttaggtaggatgaataagtccagaggtctaatacatagcgtgaactatagttaatattatatactgaaaatatgctaagagagtaaattttaggtacacataaacatacacatgaaaaggggtaactgtagaaggtgatgggtcagtaaatttgtttgcctgtaataatcatttcactatatgtatgcataccaaaacatcatgtacactgcaagtatatacaataaaaaataaattttaaaaatacacagccataataagatttccttttctcccaaattgtcttaactaatggagttgtttttcacaattatcaccctgtaagtttgatggctcttttttagtaaatgtatctataagatatactatagcgccaacagcattcttttaactctgtttttcacttgctgatatatcacttgatctgtttagaagataggaaaatgtttcatttttccctttatttgcttaatttttcaaacttatttttttaataggatcggaaactccatggtacagctcagcaactgctccaggacagcaagacaaaaatagaagtcatacgaatgcagattcttcaggcagtccagactaatgaattggcttttgataatggtgatggaataaattgtcctccttcttatgagcataatggtgctaaataatcttatgcaggaacagggcagtggttcaaagttaagagggaggaagcattactattacttttttttttttttctttttttttttgagacggagtctcgctctgtcgcccaggctggagtgcagtggcgggatctcggctcactgcaagctccgcctcccgggttcacgccattctcctgcctcagcctcccaagtagctgggactacaggcgtccgccactacgcccggctaattttttgtatttttagtagagacggggtttcaccgttttagccgggatggtctcgatctcctgacctcgtgatccgcccgcctcggccccccaaagtgctgggattacaggcgtgagccaccgcgcccggcccttttttttttttttaatcttgagttttagactcttcacttggatagatgcttttagatatttggcccttatgtttcaagaagatattgatctagaatgtatctcttcatttaaatagattatcaaatacttacaatcagtcttcatttaaaaaaaaatctgttacctgtttaagagtatggctttgttttcttttgtttttttgttttgttttatttattttttaattccagaagaaatctttaaagctagttgctaagagtaggagtagaaactttcggtctccccatgttacaatatttggatatctttcagctctaaaatctttttttcagatttgtaatttagatgtgtaatgacaaaaatgaaaggctctgaatttcaatatcatatcaaatatttttatttcagtgtttattgatgtaaggactaagttattgtaatgttataggaattcatttcttttcatgattttaatcactgcaaattggaaagtcagataaatggtgcaattaaaatttttttttcctttctagcaaaacctgtgataagtcctcttgaacttcggatggaagaattaaggcatcattttaggatagagtttgcagtagcagaaggtgcaaagaatgtaatgaaattacttggctcaggaaaagtaacagacagaaaagcactttcagaagtaattttaaataaaaatttttatttggtttaataaatacattattcaaagtatgtgattatttaaatgacaacaattgtcttttccctgtgcaaggctcaagcaagatttaatgaatcaagtcagaagttggaccttttaaagtattcattagagcaaagattaaacgaagtccccaagaatcatcccaaaagcaggattattattgaagaactttcacttgttgctgcatcaccaacactaagtccacgtcaaagtatgatatctacgcaaaatcaatatagtacactatccaaaccagcagcactaacaggtatgtagtgtatagccattgttttttgtgtgtatttttgtctataactggttctgatttaataattgaaagaaaaacctgtgcatagatttttaaaattatgataagatacacatagaataaaatttgttgtattaaccattttaattttattcaatttggaagcatttgctatattcacaatattgtgtgaccatcaccactacctagtttcaaagcattttcatcaccccaaaaggaaacgcatacctgttaagcagtcactccccattcccccttcctcccagctgctagcaactactaattgtctgtctctacagatttgtctattctagatttgtcatatgatagaaattatataatttgtgaccttttttgcctggcttcttttacttagcatattgttgtcaaggttcattcatgttgtagtatgtatgagtacttcactcacttttaatgtctgaatagtattccacttgtgggaatattctaaaattcaaaactttttgtgcacccaacatgatgctcaaaggaaattctcattggagcattttggatttgggatttcagatttccagattagggatgcttaaccagtaagtataatataatataaacattccaaaatctgagatacttctggtcccaaggatttcagataaggaatactcaacctatactatatttgattgacctatttgtcagagcatatgagttctttttaccttttgactgttgtgagtagactgctatgaacatttacgtgcaggtttttgcttgaacatctgttttcaatttgggggtatattcctaggaatataattgctaggtcatatggtagctatatctaagattttgaggaactgtcaaactgttcttctcagcatttacattattttatacttctaacagtaatgtataaagtgggtttcagtatctccagatcctcaccaacagttaatattttttttcattcttctttgatcgtgttctaataggtccattattggaagtatggtaatatatctaactatgtctgtagaactgtctgtatttctcccttcagttatgtaaatttttgtttcctatattgtgggctgttttgctaggttcatgtatgtttacaatttttatatcttctagacggattgactcctttacctttaccttaactcctttataatgtccttctttgtctcctataacaatatttaatttaaaatctgttttgtctgattttataacagctacccctactttgttttggttttgtctttgggttcaaatgagtctcttttagattatatattattgtattctgttttataagatccattctgtcagtcttttttttttttaattcatttttattgagacagagtctcactctcattgcagcctcccactcccaggttcaagcaattcttgtgcctcagcctcccgagtagctgggattacaggcatgtgctactgcacctggctagtttttgtatctttagtagagacagggtttcaccatgatggccatactggtgtcaaactcctggcctcaagtgatctgcatgtgccactgcacctggctaatttctgtatttttagtagagacagggttttaccatgatggccacactggtttcaaactcctggcctcaagtgatctgcctgccttgggctcccagagtgctgtgattactggtgtgtgcctccacatctgaccagtgtttgctgtttatttaatagtttaagacagttatccagatgaggttgcatgcacctgtagtcccagctacttgggaggcagaggcaggagaattgcatgagcccaggagtttgaggctacagtgagtcatgattccaccactgcactccagcctgggtgacacagcaagactccgcctctaagaaagaaagaaagagagagaaacatttaaagtaattacagacaggatgtaataatcctggtggtaactactgagaggtaggttaaatttaataggtttgtagcacagtccccccacaaaactgccatcacttcataagcaagcagcaaatttagagtttccaaggctacatgcactcctgaccaactgtctacagattccaggatttctactagcatctcagctcagtaatttgcaggaacaaatcatagaactcagggaagcactatacttaggattacgtttttattataaaggatacaaattaggaccttcatggctcactgcagcgaaaagaaaataaacataaagggggagatctgagaggatctcaaacacaaaccttatgtgtccttaggatatatcaccctcctaacacatcaatgtctgtcaccaaccaggaagttcacttgagcattgggtgtgcagaattttcattggggctttgttaacataggtgtgattgagtgaatcattggccacatgattgaattcaatctccagccttgtgcccctccctaggtcaggaggtcagactgataatgtggctcaaagcctcaacctcctgaagatatgatcattctttctggcatggccagcccccatcctgaaactgtctagaggcccaccatgagtcaccttaccaggtgtggtctaaggtatccactatgaataacaaaggcacgcctatcactgggggaaattccaaaggtttagacttagaggctgtcttccagaaaccagggacaaaaaccagccaaattatatacaacaaaagggcttatttctgtcattttgcgggtttttttttttatgcaagtgtttatctttttttctctgagttctagtactaccttcttttggttttgattgaatttttctactctgtttttatttacttatttttgagacaggatctctctttgttgcccaggctggagtacagtggtatgatcatagctcactgtaacctcaaacatctgggctcaagcaatcctcctgcctcaacctcctgagtagctaggagtacgggaacgtgccaccacacctagctaatttttagttttttgctagcaatggcgtctcactgtgttgctcaggcttgtctcaaactcccggcctcaagtcatcttcccacctcagacttccaaagtgttgggattataggcgtgagccactatgcccagcctctattcttacttttcttattcccttcttgctcccttttatgagatagatagatatatatattctcccacctcagcctccctagtagctgggagtacaggtgcacaccaccacgctcagcttattttattttttttgtagagatggggtttctctgtgttgcccaggctggtcttcaactcctgggctcgagcaatctgtccaccttggcctcccaaagtgctaggattacaggcatgagctacttatgcctggtctttcactaaatcttgaactcctcgcaaccactcacctcacttcctccgtagttttgccttttccacaatggtcatacagttggaatcttaacagtatgtagccttttcacattggtttctttcacttagtaatatgcatttaagtttcctctatgtctttccatgctttgatagctcatttttggttttgtgctgaataatactctattgtgtggatgtaccataatttatttattcattcatttaccgaaggacttcttggttgcttccaggttttggcagttatgtatcaagctgttataaacatccatgtgcgggtttattattttcttagtgattaccccaatgattataactaatgtcctaaatttattataatcttatctttagtagcctacaaaaaactctttgactgtgcccttgttatattgtcacaaactctctttatgcaccatatacccattaacataggctataaatattgttttatgcattagtcttttaaatcataaaggaaacaaaaagaagagttacttaaaatacagaaatattggcttctggccaggcgcagtggctcacgcctgtaatctcagcactttgggaggccgaggcgggtggatcacgaggtcagaagatcgagaccatcctggctaacatggtgaaacctcatctctactaaaaatacaaaaaaaaattagccgggcgtggtggcaggcccctgtagtcccagctactcaggaggctgaggcaggagaatggcgtgaacctgggaggcggagctggcagcgagccgagatcgtgccactgcactccagcctgggtgacagagcgagactccgtctcaaaaaaaaaaaaaaaatactggcttctatatttacttatgtagttaattttacctgcgtttgtcttccttttttcctttctctctccctccctccccctccccctaccccctcccccttgccctccctgacactgcccccaccccgccccacccgtcacttctcccatccttcatttcaatctaaaaggcttctttagcatttcttatgggcgggtctcctagtgtctacctcccttagcttttgttatctaggaatctctttcttttctttttttgaatgatagtttggtatatatatagaattcttggctggcaattttgtttttttccagcacttaaaaaaatgtccaactaggcacagtggctcacacctataatcccagcacttaaggaggccgagacgggtggatcacttgaggtcaggagtttgagaccagcctggccagcatggtgaaaccccatctatactaagaatacagaaattagccaggcatgatggcgcatgcctgtaatcccagtaactcaggaggctggggcaggagaatcgtttgaacgcgggaggcggaggttgcagtgagccgagatcatgccactgcactccagcctgggtgacagagtaagactctgtcttaagaaaaaaaaaaaaagtcctcctgcttcctccaggcctttatgttttgtgatgagaaatccactgttaatgttactgaggatcccttgtaagtgatgaattatttttgtcttgttgctttcaagcttttctttgttttttcacagtttaattataatgtgtcttagagtggatctttttgaatttattctacttagattctttgagcttgatgtgtaggttcttgtctttcatcagatttgggaagtttccaatcatttcttcaaatgttctttcttctccctctgagactttgatttttgcctacattggtgtgctttatggtatttctcttagactctgattttcttcattattttttctttctgctcttaagactagacaagtgcaattgatctaccttcaaattggctcactttttcttctgcctgctcaaatcttgtattgaacctctctagcaaattttttcatttttgttatacttttcaattccagaatttctgtttggttcttttttataatttttaaatccatattgatgttctctatttgtagacacatcacttttcttgtttcccctagatatttgtccatggtttcttttagatttttgagcatcttaatttagtaagtccaacatgtcttgacttccccagggtcagtttctgttaatttcttttttctgtgaactgaccgtattctgttactgtgcttgcttcataattcaagtacttcatttccttagtatacttactcacaaatcagattttactctttccaaagatttcatttttctgctatatgttgaatgtagttgtttgcctagtaacttttataatctattttgtagagactattctttctcatgtattacccctgaggtgtctatttcattaatatattgtacaccaaaataaaattctaagccacccaactaaatgaatggaccccctcctctcagccaatggcattctaaagtaaacctgaaacactagttcaggtcgtgctgggaatgggtggtttggacatgcctcattatgccttcctccctttggaattcaggtactgcagaccagcattaacatcaaaacagagaccttaagactgactgaacagactctttcagtagataagaaacatttacagtctcttctttctgaagcctgctatctggaggtttcatctacaaaatgagaacctgggtctccacaaccccttatcttaacagcactcttacaatactcccttgtattgattccaggtctttagataaactctttctaccagttgccaatcagaagatctctgaatccacccgtgacctgaaaatccctacttcgagttgtccatcttttctggacccaactaatgtaccttttacatgtattgatagatggcttatgtctccctaaaatgtacaaaaccaagctgtaacccaaccaccttgggcacgtgttgtcaggacctcctgaggctgtgtcacgtatatccttaatcttggcaaaataaacttctaaattgagacctgtctcagatactttttggtttactatatagtcatctggtgtttcaacagacatttcctttaattcctgaagaagaaaagattgcctagtctttgcagctgggccctgtgcttgagcactcacccagacactttacaactctgcatttgctttgtgcagagcttgagagtcaaccataggttagagcttagggtgttctcagatctcttccgaggatgcctcttgcttgcacctagccttctagtttcccaataatatgtagaagcattgcaaagtcttttattctccaaagcatttcctctgctagcttttcctcccagtttctttggcttttctattgtttaccccaactgatcctctttttccttagtttgcagagactggttcatttgccttccattgtttttgacagatgccctccacttagctgtttctctgccttcaaagattttcttttttttttttcgagacagagtctcgctctgttgcccaggctggagtgcagtggcgtgatctccgctcactgcaagctccgcctcctggattcacaccattctcctgcctcagcctccagagtagctgggactacaggcgcccaacaccatgcctagctaattttttgtatttttagtagagacgggggtgggggcggtttcaccatgttagccaggatggtctcgatctcctgaccttgtgatccgcccgccttggtctcccagaatgctgggattacaggcatgagccgccgcgcccagccaaagattttctagttacgtgaaataatggcaagctgttggtgttagtattttagggagccctcagacaggtcaaagcaggtgaccacaattatttgagaaaaagatcttctctgctccctccttacagcaggctgccatcttcaatactgcccccaaggtattgggagtgaagggagggatgaggcaaaggtaagtgaaaactccacagagctctccggagtgtcccttgctttttggattttgattaaacatttgcttatttgtagtaaacctttgaatgttttccagagttctgataaactcagttctgaaagtttctgtcagtttctttttctgtttctgtgaagagactgtctttgtacttttttttttttaggattcattacatatatctttttaaaaaacaatttcacaaggccagatttattaaaggaatatactttattctgcaattatgtccatcctagatactagatactatgtgatctgatctgtaccacatgaggaccttcttactccatcattttctctgacatcacctacaaaggcttcttttttatggaccatgtgaatatgacatatttttgttacacagactttccagaatcctttaattttcttataaatattaatgccaacaaaccttaaaatttttgaggttatgaaagtgttcttcaatattgcatagcatactatcacattccggttgttaaagagtatcattaatcagttttattctgtgttaaacttatacatcaaaacatgaaggacaaatttacagttaaacttcgctgttgccactaattaggatcagtctaaatgtgcagttcacaaattgagtgcttaaatctgaggcaacctgggataccaaagtgaattcacagggccacatcaggattttgtttttgagggatgcacagcattatctgtacttcatgtagtcaccattcagactactagctcaaggtagttacagtttcagggttaggtggagctacattcctttcagtgatgttgtgtatttatgaagctgggttttcctcaattgctgtgattttggtttttttaaagtgctgtgtgaaatcagtgtggaataggaaatcagtgtggtagtttccaaactgattccaaagctttagagttatacagtgcccaaaaagaagtaatcttgcttaagaatgaaatgaaaatactttttcttttagttatatgtattttttttcaaatagctattaatttgttaggaaagcaatcatatcctatgtttggacctaactgtttaatcaacaaaactataaggtatatcttttggcctagggacacagttaaaaaatagtttaataaaacattagggcaccatgaactgagaaagcttgggaacctctgatctaattctttcatattgataactatttatctttccagtcatatctgtgtaactcctatcatgaatattctgtcataaactggtttgtgcccagtgcctcccctaccttgcttaaatgtctttgccttagtattcatcttcttatatgtatttttaaatcaaaactggaatatagacctgtaaagagcaaagaccttgtcatctacctacatataatcctagcctccagcacaggatatttgatacattcaacaagtacttggtaaatagtatctgacaattaggcagggactatactgcaggcaaggactgtacttattgtctgctaagtttcaccaccttttggctcaatgctgaacacattgttgatactcaagcatttctgaatgatccattgattaaaataaggttgtcaaatattttgaataacaatatttctagaaaagtaataaaatcacattttagaaactcagctgataatgactggaaatttttttccttttctattctagtctcctgttccctcctttcagttccttcttcccctgttcctcattccattactgaactttactcaaagttatataagtcaccaacctaaaaagaagtatcttacaattcttaagacatttttaaaaaattctttaagctcctactggaccataaactaaattttaagtaactagggagagaaatactactgacattaatagaagactacacatgacgaaaagatgaacatggatgaatagtaagagcatttgctgttctgaatttttcactgcatgctattatttgtggttcgtctcatactccagtttcttttgtggttgtatgattatactactgaaatttgccagtttgttgctactttgaataaggtataattgtttttttgttgttttttctccatgttttgagaaatttactagttttttataagaggatatttctgcagaattaaaaaaagttgcctaatcataccatgatgaaatactgaattagtgaaataggtataaaatagttttccagacagttgaaagaaaatttttaaagcatttacttgttctaatgcaattcatagttattacttctgaataccaacatttacttcttggatttgcttgttttaaaaatttcatattgtgctttatgaatgtagttttaagctatttctaatgtgtttatatgcaattgtgtcacctcataaagaaacttctagatgtttaataaagaactccctctagatttttttcctaaatgaaagcaggtgttgagcattgtcatgttctgatgtattgaaattgctaaaatatttaataagctaccatagtttgaagtagtagccagatgttttcagtttccccaggatgcattttacagttgagcatttacagtggaagttagctaaatttgccagtttaacaacaacaaaacaaataagaaacacaaattttttaactcaaaatgatataattaatgtgttatcactgtacagtaagataagatttccacagtctagcaaaacattattgacactccacctcccaacgttaatagccttattgaggtatagtttacataccatagaattcactcattttaaacatacacagtatgatttttttagtaaatgtatatgcctatttcaccatcatcagtaatccagtttttagggcagttttattggaggaataattgacatacaaaaactatacatatgttaagtgtatggtcttgctttcattgttttgcatgagagatctcctgccatcttaatctttgttcctctctacgtaacatgtttttttctggctacttttagtgtttcttgttcacgacttgttttgagaaattggattatggtgtgctttagtatggcttgcttctgtttctttgtttagtgttctttgaacttcttggatacttcttgagtttatacttttcatcaaatgtggagaattcatggccttttttttttctaatacattttgtgtctccgattctttctgctctctcttaatgaggaatttcagttacacatatatggccacttgaagttaaactcacagttaatatatgcactgttctttgtttattctcaagtctttctttagtgtcttctatttttgataatttctttgctgtgtcttcaaggacactaatcttttcttttgcaatgtttaatctgcctgcagtcccatccagtgtattttttttttaatctcagatattgccattttttaatcactagaaatttggtttaagtctttttcatttcttccatgtgtctgtgccacattttcagtagattgactgttttgatgtccttgccttctaaccctaacatttatgtcagttaagccactaagcttgtaataatttgtaacgcaaccatagaaagcaaatacacctggtaatctttgagtagatgcagacattgtgaattttaccttgctggatgctgaatatttttgtatttctataaatgttcttgagctttgttctaggacacagttacttggaaacaatatgacccttttgggtactgcttttaagatttgttatgtgaaacaagcatcatttagtttaggggtaattattctctactgctggggcaagactcttctggatattttcttcagtgcctcatgaattgagattttcaagcctggctggtggtaacaaacactattcctacctatatgcactgagtattgttctttctaactttttcagtgggttctttcccctgcctcagatattttcttcataggcaggtgctgattagtactttgatgaatacttgaaaaccctctgaccatctcaggagttctttctatgaacagctttaactgccttgtgaactctagctgctttggtttccttgtactcttatttctgtctcttcaacttggctccgcctgagtttccccctccctgcactgtgtcctagaaacccttaagacagtaagctggagcaatcttagggcttatctcatttgtttcccatctctcagggatcactattcgtctttaacctttttcatatattttgtctgattttctttttttggtagtttgaattgggaagctttgtttgttactacttggatagaaatatataagtacttcagtgttattaaaaacaatttaaaactttaagtaaaattaagtagttatttaaattaatgggacaacttttaccagaaatattcctcctaaaatgttattcattgtacagtatctaaaatgttaatacggaagcattatttaaattctagtatactgtgtctagcccaaataatgacaaagccatatatccagaggacctaactcatagttctttattttcattttgaacacctttagtatttatttgcctaaataaattgaagttattttatgtttaattacaacccatgattttttggctaattaaactaacagaatggaaagataatgtcattttacatcaaatagaacacatttatttagttatacaaaaaccctgtaaagttcttttctgtgttaactacgtaactattaaacatagttggtattcacatagtgagacttccttatttccaatttttatgtgccattttagtggcatattatttagctttatgtttctcctcccatacctctaccaacatagtttatgtaacttgttttcttttatgccctctatacagacaacttttgggagatgctgttccttttttttttttttttttttttggagagagagtcttggtggaatgcagtggtgcaatcttggctcactgcaacctctgcctcttgggttcaagcaattcttgtgccccagcctcccggatagctgggactacaggcgcacaccgcctcgcccagctaattttttgtatttttagtatacagggtcttgccatgttgcccaggctggtctcaaactcctaaattcaggcaatccacccaaagtgctaggattacaggcgagagagctactgtgcccagccaggaggtgctgttcttttctataaaatttcttatagttgtctaaagaatttgtaatgatttctctaattaaaataggaaagatgatagctacctcatagatcctctgggagaagagtttttgttaccagattttttttttctttttttgaataggtaagagatttagattaaggattccatagattaagggttgatgttcttatctgatatttatgtttgccaacaggtactttggaagttcgtcttatgggctgccaagatatcctagagaatgtccctggacggtcaaaagcaacatcagttgcactgcctggttggagtccaagtgaaaccagatcatctttcatgagcagaacgagtaaaagtaaaagcggaagtagtcgaaatcttctaaaaaccgatgacttgtccagttcagtaaccagatttttaaaaatcatgtaacaaactaaagtgcttatacaagggatttatgaagtgttcaagttggacaaaacactttaaaattatggtttttataatttaattaaaaaatattaaaacctgtgatgtcaggaaacaaaaaggcaacaaattctgttttgttgaagatacattagaaaacttaatgacaaatgacattagttcttttggaagaatgaaatattgagcatcactcttatgccaaactgaaggtatacagaagctatgagactggtccttcttgtagaatcgtatcttgattcttttatttttctttattttttgagacagtgttttgctctgttgcccaggctgggtgcagtggtgcaatcaggtctcaacctgctgggtttaagtgatcctcctacctcagcatcctaagtagctgggactataggcatatgccaccatgcctggctaatttttttttctagaggcagggtctcactatgttgcccaggatggtctcgaactcaggggctctagctgtccttccacctcagcctcccaaagtgctgggattataggtgtgagccaccatctccagccttgattcttttaatggtttagtgacactttaatagtaacattgaaattttggtaatctaactgctgatccagacgtgtttactgagatagtagcctggtagtccactgagatgggggatggtaggggttggtttgaggagagtaaaatgcaagaggtttggaaagcactggggagaaattctgaagtataagcataaactatatgtagatgtataactggggggaaaagcatgtgacagttcagcctaccgtagaatacaaaagtgaatttgcctgtgctttcatgtgtatagagagaggctttaagaaaaataagaaaataaggaattgtttaaggaaacaagctctataaatataagatatagaaagaaaaactgattgatattcacacaaacagtgtggcaaacaactactatttatctgttctttcagtcacatgccaatgtaaacaaaagagatagcagtcactatttgtgtttttgtcaaacaatttgggagtgtctagtaggagtatatgtatctgtaaaactagccatttaagattcaaaagttttaatattgattatgaaaaactttattttcaaagggtcttaagacttttattgctaatcaaacagcagtacttctgttttttataaaggtttaaagtttttaagcaagtttgtaaattttaattacagatgatgtctgtgctgttttgaagctcgataatactgtggttggccaaactagctggaaacccatttccaatcagtcatgggaccagaagtttacactggaactggacagggtaagaggactaacattttacttgaattttaattataattcattttaaatgtgagttatattttttagaaggcttcaacaagttgtattcttaacaagaataaaaatagaacttagattttttttttacatttcttattcaatgagttatgcataaatctaccttaatatagagatgaatatcagattgctgtaggatctttcatttgtgtagtaatttgaaaatgtttcattcatagcaaacttaaagatcagtaaggtgtaatattgaagcatattggtgatcttaatgcgctaacagctaaggcgattcttctggctcaccatgtgtaggttatcttactcgagctatatttgaaatgagctattaggcttggtcacccagccttctgtgtgtttgtgtctttcaagaataatttgaatagctagaattcagtctgtggccatagaacccatcagaagttaacctggtccacagtagatttaaatccatagtggtaacttttagattcaagtccattcattgggttgtgagaggaaaatattaaaacgtaatcgtaattttatctaaaaactaagaaagatactaaacttttttattatttggtatttaggttgatggtatatatgttattctaaaaattaattatgttaaagcagatttacaatgcttaactatgtgtgctctcaaaatgttttggtgattactgttctaagcctctacttttaaaactgggaaagcattcaattttaattctttcccagttttaaaagtagaggatagaacagtaatcaccaaaacatttttaaagcattcaatgttttgcagtctctaaagtggaggtaggaatgtaatactcacagaactgttaggatgaaaaaccaagagtagtatatgtaaaataccttgcattgccggtacatttaagccattcagggatattctttcttttaacctggggtttgaagtatggctatgaatttgaatattatgaaaggggatttgagaatggagaactacctggttgaatgtcatttcctttcatttcgagcctatttaaggtaattactgagtaatatcaaaatgaaacttaaagaattgttattagagggaaaatgactagctaggagatttttcttataacaaggttattgttaataaagttttatattgaaaagagaaattacaagtaatttagaatcttgccattattttgtagttgaggaaaccaagatccaggttagttacataccagtaaatttcaggactggtactagaccttcagtgtcttaacttttaaatggatgctctttttctctctggtgatttgaatgagatagaaagataacagtagcacagaggaggaaacagcagaagatgaagagtgcctggaagagataatatggttttaaattacctaaactacaagcttagaacaataaaagactgtgataactgttgtttgttctttccctgccattgtaatcttcacctgaaaatgtttttcgcctcaatggcatcaggcatttttcccactttggaataatgctccttttaaaatttggaagacattgtgcatgttaagcaggtcctctaggttcttgagaggcatctttcttatccctaatttgattataaacttttccttggcagaaaccacattccctattaaaataggtccttctgtttacatagtatattttacattttcatgtgctttctattcttttatcctttgtatttatagactataaaaaatgtttataaaaacatagatggaaacatttcaagcggccttagtaaaaaagagaagaaaaaatttatagaaaatgttgctttaaactgacatgtttgtttccagcattttgcctcatatgtcaactttgtcttctatggcattcgggaactaagtcgtctgtactgtttcatttcaagataaaaaattcatggttctttttagagttgtaggataattctagaaatgatctagatctagaatgatctagaaaaattcaaattatgttctgtggagcttcagtgttctgcagaattgtctcaggacgcaacacagtcttttgtgttgttttgggattttatgtaaaatatcatttggattttgctattagaaaaaacgtttttaaattgttggtataatttagctccattttacaaactaaggaaattatggccctcaggctaagtaactagcgtagggtataatccaggattttttttttttcttctttcttgagatggagtttcgctcttgttgcccaggctggagtgcaatggcacaatctcggctcatcgcaacctctgcctcccaggttcgagtgattctcctgccttagcctcctaagtagctgggattacaggcatgtaccaccacgcctgtctaattttgtatttttagtagagatgggggttctccatgttggtcaggctggtcttgaactcccaacctcaggtaatccacccacctcggcctcccaaagtgctgggattacactcctgaaccaccgtgcctggcctaatccaggattcttaatgaagtctacttactaccagctctgtgttctttctattctgtcgggttactcttttatattttcttgtagctatgcaatttttcatttttcctgaattccctcagccttcctgttataaaaagcttaatgaagctcccatgagagattgaaataaatgacaaaatgttacactaagacctgttaactctttcccttgcacctttcctttagaataacgttactaacatagtagtagaagttctttatcaatattagaaacagagaagagccctgtccttagaaccaaagcttagaacaattttagcagatttcagtgttgttaagagcagaactatagaaaatgtcgaccgatcactgggaaaggagggaaagagagtatagaagcagttaggacaagtaaaaaggtggtaggattcatggattgggactaacagtgggattgtcatatcagtggatgttgaagtattagagagagtgaactagaatattaggagataatgttcagagagaaagatgcagacagttgagattgtggaaggattatagttactggtatgacagtatgatgacaggagtgaaacggcaaggtaaggtaagtcacaagattataagaagttagccgtgtgcagtagcttatgcttgtaatcccagcactttggggaggccgaggcgggcggatctcctgagttcaggagttcaagaccatcctgaccaacatagtgaaaccctatctctattaaaaatacaaaaattagctgggtgcagtggcagacgcctgtaatcccagctacttgggcggctgaggctgagactctgcttaaaccccggaggcagaggttgcagtgagctgagatcacgccactgcactccagcctgggcgacagagcaagactctatctcataataataataataataataataataacaacaacaaaataagattataagaacccaagggacttttcatttattggtttctaattttcagaaatttttgactcacactacatgaaagaagattggaatttaacttttaaaccaccgcactcctattctcattctcccaaataattatgttaaatcagtaatctagtgtttattataactataaagattgtccatagatgaaccaagttctgtatggtgattatatttcctttttaataccttttcctcccttagggccactaaatacctctttgttttgttttgcttagttttctgcatacctattatttatccccaaaagctccagaaggactctgaaacaactctatgtaagcaggtatgcttggttatgtattagtccgcatttcttccccattagaagcatcctttctggggccttacatctttctgctccaatttatatagctgctacacagctttcatcttgagactttgttttactatcatcttgagaactctcttctacattggatcacttgagtcttggatcactccatcttcttgctttacctcctcatgctggtgaatcatatccttcattttcatgctgagaaaagggtgaatgaaataaagttttagagatgatatatgtctgaaaatatgtatattctactatcatacttggagtatagaattcttttaggttggtgcaaaagtaatagcggttttgccattacttttgattgcaaaaactgtgataacttttgtaccaacctaataggttggaaattactttcattaattttgagttgtgtaattattatttagcctcagtattacagtcgagaattctgtgtctcccttgatttttaatatttaatcatgatctgttagatctgctagatctctaaaaacttttaagattttatctttttttccccgggattctgaaatttcacagtagtgtatcttacttgggtatctttcattctttttggtggatattgtgtggcactttcagtttgaaagcttatttgtttcagatccaataaatttccttgagttatttatttgataattttctcatgtccatttttagtgttttctcttggtagttaaacctcttagattgatcctgtgattttcttttgtctatggtttctgtctttttgttctactttctaggaaatttttacaactgaaaaatttacatttgatgtcatatttttaatttttagaagttcatttttgttgtttagtttttgaaaaacaacaccctgtttttctctcatggagataataccatctcttaaaactgagaatatcagttttaaattttcttcttgaattgtctctactacttctgaggtctcttttaagatgtctgcttatcatattgtatatttgggcaaatgtgtggccatccatggctttcttaagaatgagacactaaagtaaccaatttaaagctgtgtgtgggccaggtgtggtggctcatgcctgtaaacccagcacttcggcaggccgaagtgggcagatcacttggtcaggtgtttgagaccagcctgaccaacatgatgaaaccctgtctctactgaaaatccaaaagttagccgggcatggtggtgggtacttgtaatcccagctaacctaggaggctgaggcatgcgaattgcttaaacccagaaggcagaggttgcagtgagctgagattgcaccactgcactgagcaacagagtgaaactctgtctcaaaaaaaaaaaaaaagctgtgtgtgtggagttgcccaggttttgaactagttgagagaaacaaagaaatgactaatggaaaataaaatatccatattactgaaaaaataagctgttttttgagagtatggctgggtatgcagcaagagtggggttatgtccagtctcttggatcactgtaggccccgatctgtgtaaaatttaaagcagggaggaaaagagcaaactacttccattgaacagcctggctttcaacagaaaagaaggaatgggctatgttcctcatgtccagtttgtcttccagagtctcctatcagataacagattctgaggtttgaataagagtattgaggtaaagacctatccagatatttagggaaaatggggaaattatttctcatagcaaccatggcagtgagaaagatgctttctccctagaaaaggataaaaatgcatgcagccaccatacctggtcacagattttttaatggggagtaaagcactataatatagcagaacaagagtaggaatacaaagatacttttaattttttacatgttataaactgtctgacactgggagtattgtttcatctgagatactgttttttaacttgtaacaaagctgtaacacttatcttttttacccctcctttgctgcttccagattccaccgctgttaaaaataacatgtcggccgggtgcgttggctcacgcctgtaatcccagcactttgggaggccgaggcgggcggatcacctgaggtcgggagttcaagaccagcctgaccaatatggagaaaccccgtctctactaaaaatacaaaattagctggacatagtggcgcatgcctgtaacccagctactcgggaggctgaggcaatagaatcgcttgaacctgggaggcagaggttgcagtgagccaagatcgtgccactggactccagcctaggcaacagagtgagactccgtctcaaaaaataaataaataaataaataaataacatgtcatgtattcctctggggctatatgacttctttgagactatgagctgtatagttgacccttgagcaacgcaggggctagggagcacaagcctacatttccaacccatgtactcgaaaatccacataacacttttgactcccccagaacttaaatactaatagtctactgtggaccagaagccttattgataacatagacagtctattttgcaaaaaatacaaggtttttgtgcctgccgtcttagctgcagcagcagcttcagaaatttccttttcttcttttacagtggttcttattctggattcatttatattgaaatggcagaagctacaactgcaaacctcaatatataggatacatatcaagcagttcaacttgttcttgtaatgtcatgatttttctccccttcttgggagcgcttccagcatcactagtggtactttgtaagggttccataatattattcaaggtttatggtattgcattaaataccatgaaaaatatgcaagaactgaggcagatcacttttactgccatatgcaatttactagagagatgaactgctcaggcagaaataattagatttacatagtgttttaaatggatactgttgacacttgagctcaccataagagcattaggaggtggctacaaaattatagtagtacagtactacagttaattttatgcagttatgatttaatattgcatcttgatgtttgtttatatttctcttgactataaatggtgccatgtatggtctgtaagtgtttgtgtgtaagtttgataaattctaaccttttctaatagatttgtgtattttatggtagtgaatgataaaatagactagtatctacatatatgcattcatgacatatctttgttgtaatgtttttgatatttctatgctatgtgattcatctgcagatttttcaaactgttgcacatttccaaaaaagattccagtatatttattgaaaaaaaatccacgtataagtcgacctgtacatttcaaacttgtattgttcataggtcagcagtatagaattgcctacttttttttcttttttgtttctgttatttcttgaacatcaggtactctctgatattcattaaggatgacttttattcttccttccaacatttgccatcattatgagggatttaaaatatctgcatacagttgtcccttggtatccatggggaacgatttcaggactccctctccctgtaccaaaatccatggatgctcaagtcctttatataaaatggtgtatttgcatataacccacacacatcctcctgtatactttaaatcatctctacagtaattataatacccagtgcaatgtaaatgctatataaattattatactgtattgtttagggaatattgacaagaaaaaaaagtctacatattcagtacaaatacaactatccttttattccccaaatattttcagtcgtggttggtttaatccacagataaggaacccacagatacagagggtggactgtatatgtaaacaacccatataatataccactatttaaacttctttgaactcctgaactctggtatacctttactcctttgtcattttaaatgaactgtgctacacaaattgaaatcttaaattcgatatacctgttgggcacggtggctcacgcctgtaatcccagcactttgggaggctgaggcaggcagatcacctgaggttgggagttcaagaccagcctgacgaacatggagaaaccccatgtctactaaaaatacagaattagccaggcatggtggcacatgcctgtagtcccagctacttgggaggcttaggcaggagaatcacttgaacccgagaggcggaggttgcggtgagccgagatcatgccattgcactccagcctgggcaacaagagcgaaattctgtctcaaaaaaaaaaaaaaaaaatcaatatgccagcctttcaccaattctcttgttgtcctgaatgataaactacagaaagcacctagaataattagccaagtttggggcacaagcctgtagtcctagctactggggagactgaggcaagattacttgagcccaggagttgaatacagcagtgagctgagaccatgccactgcattccaggctgggcaacagagtgaaaccctttcattaattagctaactaattaatgcacctaggataataccttgtacataatggtattcagtaaacgatagctcttgttattgtttttcttctagctgttttttttattatcacaaagctagatatttgatcaaatatttccatttccttgattcttcaggatattttcatgctatcagccccttccaaacttaattttcttctctatttaccctaaaaccaatgttactctgaagcatttctttactgatactgccacagcatcctttgaccttatctttatacctacctgctgtggaaactcccaatagcaaataatttctattctgcttctctactctatatcctgaatgttgcttctctgctctatatcctgaatgatcacatttactactgcaaattttagttttcaatcttagctaggcttgtaaaagttatcccacattttacatttttatttcattaccagcaacttttcttttgcctgtctcttcaagttttctaccccacgtcagactcctttgcttttgttttatagattagatttaagaccatcagacctcagctttctcctatcacctgctaatttttttgtatcttcctccttggtttcagagaacgaagtctctctctttcctgtttacagtctatgatcattcaagttgccctctagtttccattctttctagtctcctatagccttgtttcataagttagccctattagcacctatatttttaaccacttctttcttctgatatcttattcttgttggatatactcacattcctcccattaaaaatttttattttgcttcgtcctagctctattgataggtctttctttcacagacaagattcttgaaaaataagttgtgttcagaatctgttcttcctcaccctcccatatgttaaactgaagtttctactgccattataggttctgaacaaaaaaccttatgtatagtgtctaatttaatcctcacaataatcttatgatatacatacaattatttctattttagagagtactgaggttccaggagtttcagttagttttctcaggccacacagctagaaagtggtggagccagtaatcaacacaagcatctctcaccaaagtcaagtctgtctgaagccacggcttttgttcttcattagagttagcaaacttgtctctatttctagtctatccttttggcagtgtagattttcttcattgcatatcacaataataataaaaggcgacatattgagattgacttatgtactggagttgtattaactcctttaattctcacacagcgctgcaaggttgataccattaacacatattttacaggtgagcaatctgagacccagcaaagttaaataacttgctcacggtcacagaactactaagtggtgtgggattaagatttaacctatttgttctacaaacatttattgagtgtgcatgcatacgcaaggcagtttgatcccagtgcttttctttttagcaactatacaggttgaatatcctttatctgaaatacttgggaccagaagtattttagattccaaattttttttcagatcttagaatctttgcatttaaaaatgcaaactgattgagcatctgaaaaatttgaaatcccaaatcctccaatgagcattgcctttcattgtcatatttgtgctcagaaagtttcagattttgtagcttttcaggttagggatactcagcctgtactgcctgatgtgatccaatccctacccctccttacaccgaaaccctttagtaccagcctgtaacttcaagttaaagaccaaattctactccaagtcatgctaagctcctcatgacttatctctgcccatgttttcattcttatttctcacagcatttctacttatattctaggctttaactatatgaaactgtttcctatccctatgatgtactatatacttccttacctttgtatgttttttcccctctgatgactttgtcctctcctttaatctttagatatagctctcaaaacccaatttgagcaattatgatattttttgatcttcctactacctttcccttacaaaaaaattggtcagctctctgttttgtgtcattgtgcatattgtatatgccactgtattgccagtattgatttacatttctgtctcccagaatttccgtcttccaaagcaaaactgtgaactatttgagagcaggaccatatgttacttatctttgtatctctatcacagaagacacttagtatacatattcactaagtattaatgggatgaatgaaaataattaaaactgaaaaggaggtttgctcaacctttttttttttttttgctgcagcatacccaaagaatacaacacactctagtcaatacagtgattcccaaatagatacaggtcagaatctgagaagggagggcaggtataaatttgaaaatgtcagggccaggcacagtggctcacgcctgtaatcccagcactttgagaggctgaggcgggcggatcacctgaggtcaggagttcaagaccagcctggccaacatggtgaaaccccatctctactaaaaatccaaaaatcagccatgtgtggtggcaagcgcctgtaatcctagctactcaggaggctgaggcaggagaatcacttgaacctgggaggcggaggttgcggtgagctgaggttgcaccattgcactccagcctgggcaacaagagcaaaactctatcttaaaaaaaaaaaaaagaaagaaaatgtcttccaggtgcagtggctcatgcctataatcccagcactttgggaggctcaggtgggcggatcacgaggtcaagagatcaagaccatccttgccaacatggtgaaaccctgtctctactaaatatacaaaaattagctggatgtggtggtgcacacctgtagtcccagctactcaggaggctgaggcaggagaatctcttgaatctgggaggcagaagttgcagtgagcggagattgcgccactgcgctccagcctggcgacagagactccgtctcaaaaaaaaaaaaaaaaaagagagaatgtcttccttacctactctcatctggctccacacaactgaatctgatttaattatctgtgcctcacttgttattaggaaatcactgctctacaacatagtgtagacattttagctttttcttacctctctgatctgtaaattaatactcaaggcctccatttagcactgtgagaaatgtaatagagaccaggcacagtggttcatgcctgtaatcccagcactttgggaggctgacatgggagaatggtttgagactagcctgggcaacacagcaagacttcatctctattctataaataaatgcacacaaaaaagaaaacaatttttaaaattagtgaaattttaagaagaatttttaaaaagaaatgccaaagaatgcaaaagcaccagaggtattccttccataaaggaccctaaggcctggtaggttaaaaataaattgtttgagacaaaataaaaaactattaaattgtatttcagaagcttaggggaataataattctaccaacatgagcttgcatacaaaattttaaaatacatgaggatatagccaccatgaccaagcagaagcagataatgggattattaaatatataatataaaatattttaaagtttgtgtttaaatatttaaatgattatagtatttaaagaatagaagagtttgaaaacatgagcaaaggataggtgatgagccaaaaagactaagcagagttttaaaataaataaataaaatgaaattttagatgtctgaaatttgcttcaaataattatgggggaaacgtggagatgaaacattattgaccattattgataaattgttggtgctgatgacaaagagaaccaagtagaactaaaaaataggaaatataacttctgaaatggaaaactaagaggatatgttaaagaaaagaagagagagttagtggcctgaaagtgctaaagaagttgcccagaatacaacacaaaaagattaagagatgaaaaatatgaaagaaagattaagagacatgaaggataaactaagaatgactaacacacggagtggagttccagaaggaaggattagaaggaatggggcagaggccacatctgaaggaataatagccagtaacttccagaatgatgacaaccatgagtcctcagatttgagaacataagttcctacaaggatacataaaaagatagctgcgttcaaaaaaccttggggaaaaaatgtgggctggatttaaaggatgcctttgtagaagagatggatgtttaacttgcccttgatgaggagaatttggactggtatgggggaaagaatagtaggaaaatcttatgtaacaatataggtttgagttggagaataagatataagattagaaatagaagctatatatgtaaagacatggaggcagaaaagtatacaataggtttggaataattaggagtctttggaactttttatatgatgtggattgacataggaagcagttgtgcatagttgatagagcatagcagtttctatcatagttgtttttgtctttcctataaagggagcagaggcagtaacccacatctatagcaggccgacttttcctgccaagatcatggccttaatagtctccattatctctgtctcctactgttgtctctgtatttctcatcctcccatatgatcccaaagtttccctctttttgtcacatttgttccagctggagaatcactctcattggactgctgaactgaaaacatatattattgtttcttgaggtggtggttttctgtttttccccagtggattccattgtccttccttccctgtcctaccctgtttttgggctgatgactacaaagttcacttgaattacttggctctgacttacaatgagagacactgttaagagatccaagagccaggaggaaaggaaagtcgcagtgtgtatttccctttctccttccttgccttgccttgcttttcacaacagcattcatctatggccaccaactcctgtcgggtagttccttttttaagatttagtctaaatcagattctggcaatgatttaagttcctcttgccccttcaggctaagagtgataatggatttctactgttgcttgtcctcagattcttttcattccttgttggtttaactttaatcacatctccataagtagccaatttaaaaaactctctttagttaaactctttcagtgtactatctgcatgctgctaggaccctcactgataaatttccaaagcctatgttgtcctcagaggcacattgaagaccaatatcatcgctcgtgtacacgtttgcagaaatctcatctttcctcagctcttgaattttccaggtattgagtttattctgttttttagtggcaacagaaagcttttttgacctttcttttctttttggcggtggagcctggttctcattttcttcttttgcccttttcatttcagcagtggagcccagctctccacttctatcaaagtttccagactttctcaattcagtgtcctcagtgtccttgtaatgtttctgcagtgtgtccctagacctaaagaaatacccaacagttccatttattaagaagtgcttactagttagtattttaagtcttaaaacaggagtttttgaaaaatacaaatactgagagaaaacgtaatatttttattccattagtacatgattacaattaactaatgggacatgtctgcctgttgtacactatataacttcccacatcttgggatcataaggataactgcactctcatgtcttcttccacagtgattcttcataggaagttgctttttattgttgaaaacccaccttagcaaagatgggtttatgacatcaccagaaggaatatggaatattctaatgttgaaactatgaactacctttcgctagtagttctcacagtgtcccatagatgtcgctgtgttccctatgaaaagtgaaaatactctctggcaccccagggctcctcagtgaacacttcgagaacctcagcattctttgtgctaattcttttatgatagatgtgtactgttcttttttcaattgcaatacatgttttaatttgttgctttctaccacacataaggctgatgcagtgtctcttaccttttttgtttactttcagatcttagacttcagataagacatgcagattctttaagtctaccaagcagttttctctttgattctagattcaattcataataagacaaactgaaacacaagttgggacagtacctatctcaacttgtactgctcagctttttttggtggtagttttactccgtctagaatatcgttgctcctagagtttgaaattatctaacagcatgcccttgccttgtgtaactgacctgcttcatctagaaaattgccggcgtaccagcaatcacacttgcattttaaattctaaacattgggccaggcacagtggctcacgactgtaatctcagcactttgggggagccaagacgggtggatcacctgaggtcaggagttcgagaccagcctagccaacatggcaaaaccccatctctattaaaaatacaaaaattagccatgtgtggtggtgggtgcctgtaatctcagctactcaggaggctgaggcaggagaatcacttgaacctgggaggcagaggttgcagtgagctgagattgcaccattgcactccagcctgggcaataagagtgaaaccccatctcaaaaaacaaaaaataataaaaaataaatggtaaacattagtgacatcttcttatgcagaagcttcagtctatctgtatggtaccttgtttttcagataccatgtgactgttttacttattcaaaccatgctggatgttaggatttaaagtgggattgaacacaagtggtggagtactaacataaaatatctctagatcacagccccaccctcccacttatgttgtgaagaaagtaacgctcactgggaacagtgcaaagtaacaaaaaatgaagagctttatatgtaaaatgttagaaacagataatcggtgccgtgaagaaaagtcagcacggagacaaaggatctctcagcaaggcaatctttactttctgcagaaagcgtgcccctcgcaaatggaacaatcgcgagagcacacctgaacaaaggaaaagcagacatatatatcccttatgcatttgggttgtccttactgctgtgtcctgcatccattggctggagctggacctcacagtcttaaactgattactgatttgctaataacctaaaactttcctaaataggtaaatgcaaaggagaacaaagaggaagaggaagttgcttatgaaaggtttaaggaagcaacaacatttccaaataaggaaggggcataagctgtgagctaagacttgcctgggcctgtccagacatgcttgagtaagccaaagcaactaactgggctaaagcgtaagaactgatagttgataggaggctttagagtaaggagctattattcctagtgtcttttattttatttttaaatcaagatgagctttgaagaggaacttttctactttctacataaaactttaatgtagagtatagaattctaggaaagctagcttaaggtctgtgaggtgacttatcccaaatctcagatctgtaacatactttataaattttaatttttttttttttttgagacagggtctcgctctgttgcccaggctggagtgtagtggcatgatcttggctcactgcaacctccacctcctgggtttaagtgattctcatgccttagcctcccaagtagctgggaccacaggtgcgtgcaccacgcccggctaacttttgtatttttagtagaaatggggtttcaccatgttggccgttgctagtctcgaactcctgacctcaagtgattcacccacgtcaacgtcccaaagtgctgggattacaggcatgagccaccttgcccagcctataatgtactttagtttgaagcatggaatgaagagacagaggaaagagaaattagtcaatatgttagttttaccagactggctggaataaatagcaaatgaggtgattggaccttctcttattcacaataagacaaaatcttaccattttagccagtgtaaaagtgtaataagaacttttaacaagtattaattctgtctctagcgtatgtgcatcttgcatcttcctgatgcataacaagtcttccttgtaacagtggaagaaagcaggagaaagtagacctctcttcctccaatctaaaaaaatggagtctaaattaccaatcctgacatgattcttcctccagtttatttcacaaaataactgcttccaaaatacttaacacttttaacttcaatagaatattatagccttagtaccccatcccttctatatgccatttgctagtcttaattatattctcctcatacttctttcatgacagttctctcccatattaattatgagtcagagagaagaaatgaggtggaaggccctgagatcacattctcactgccatagacgtatttttctaattcttttcctgtttgactgtgaaaccctctggcacattgtattttgattcttttcatgttgcattttttataagtgtttttcgtgttcattaacatcaactagatatataatttaaggtcaatagatttttttttactgtttataccaaaacgttacataatgaaatgcataagtttataaattgaaatttgttatataaaataagtaatttattgctttgtagagccttaaaaggagaaacatttatctctttttgtggatggtgtacagaagcctgaaaaacaaaataatagaaaagtccagtactttatgattaaaatgtatatacgttaaaacatataggtagaggtcagtatatggtttggccacagcttaggaactatgttctacaggtgcatttaaacactggttattaaaaccttaaatatatttcgccacataagcattattttcaatgtctactgtgtattctctcatacggctttggtataattaacttgtccctggtttttgaacattcaaattcttgctaatttgctttttaaattatgttttattgttataataaatgaatatctttctgtataaagcttggtctgaatttcccctttcttcctttcgtacgcagaatgggtcttgctacccagtggtattcttttgaaaattaaatgacctaatattcttaaagtgcttattagcacaatatgtggcacattgtgagtacagaataaatgctatttgcagaactttttctggcttagcaatgagacaaataaatacaaaggtttcaaatgagttatttgaagcaagcattggggtagtaacatagcacatgatggcaaatagaggagggaaatctgaaagattgaagctctaagagaaggagtttcggtggttattcatctgtattggttgttcccagttgtgtattctttaagtatactttaggaataccttagctggaaaatgtcacaatgtaagttttgtttctttgaattaaaatgtgtaagtttgataaagtactatacagttgagaaatgttacaaacctctttaaaacagtgtgacctttgtgtgtgtaatttttgtttattgtatttgtatttcatattttttgtgatattttattcaagtgtgtgtccaatgatgtcttttctgttttctttattattttttttaattatcctagtcacgtgaactggaaatttcagtttattggcgtgattggcggtctctgtgtgctgtaaaatttctgaggttagaagattttttagacaaccaacggcatggcatgtgtctctatttggaaccacagggtactttatttgcagaggtaataaatgtattttattaaatgtgcataactacaattgaaattacatatgtaggcagcataatatagaagtagaaagagtgttaggctgaaagacagatgacttgagttcttggctgagctatgccactgaataggtatgtgactttgagacaaatcaattattcttcctatgtctgttttctcatgtagaaaatgaggggctggactaaactgtaactaagattctcttaagctttaaaattttataaatttagtagatttcatgaaccatgctattttcatgtcaacttgaattttcttcactgcaggttaccttttttaatccagttattgaaagaagaccaaaacttcaaagacaaaagaaaattttttcaaagcaacaaggtaattactaacaatcaaatgcatagcattttgatattttcttaaacaatctaattaccatttaaaaagtaatagccatctgtgtgggtttttttgttgttgtttattcatttatttctaacttcttattaaggaatattttaaatgtatccataagtggagagactagtgaaatgtacagtcacccggcttcaacaataatcaactcatggccaattttattttatccatatgccatcctctcactactttctcaaatttgaagcaaacccagacatcatattgatgtattcataattattataatttatatctaaaagataagatttatttttaaaaccttactactagacttaaagagaaaaaaacaatttcttacctatttatttttaaaactacgtatgctattttgcattagcctttactagcaaatagtaaaaaactagtttttttaagtgacaaattttgtttgttcttcgtagattataaactaatggataagaatttttaaattatgacttttggttatacataaagaaattacttgctgtttttgtttttttcaacatctacaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctaggtatgtgtctgagattttaagcatctcttatacaaagttattgggacattcttacgtactgattatagcaggtgtactgagtcttgcttttttcccaagtagtattttgaaagtagtgttctgtttacttaaaaagtaaattgtttgctttaattttaaagctgtttaaaatacagactttctattactgttttggtgagttactttatcttctataagcgattctacagtaaccaaattggactttgatcttgagcctgaacctcctccagccccaccacgagcttcttctcttggagaaatagatgaatcttctgaattaagagttttggatataccaggacaggcaagccattttaaaccttgcataattcctcttcactgaatgaattagcaataaaagcatcatagtgaataaggcgtgtctttccatttaaaattgccactgaactgtgaatttatggttttttgtttgttttttgtttttgtttttgttttttgagacagagtttcactcttgttacccaggctggagtgcaatggcatgatctcggctcactgcaacctccgcctcccggattcaagcgattctcctgcaagccattctcctatctcagcctcctgaataactggggttacaggcacatgccaccatgcctggctaatttttgtattttcagtagagatgggatttcattatattggtcaggctggtcttaaactcctgacctcgggtgatcagcccgcctcggccttccaaagtgctgggattacaggcatgagccactgcacccagccgaatttatgtttcttatggtctagtctcagctaaattagactgagttggtaggagacaaccaacttcttaatgttggcatgaaattgtcattagcctctggatgctcatggtccagaagagatagaataggctgcttaaactagaggtaacataggagtgtggttgatactacatgacatactgcctgaaatactattcttcttctaacttgattaacatacataataatgtgttagtttttcattgttttggttttgttttgttttgagacggagttttgctcttgttgcccaggctggagtgcaatggcatgatcttggctcactgcaacctccgcctcctgggttcaagtgattccactgcctcagcctccctagtagctgggattacaggcatgcaccaccacgcccactagttttgtatttttagtagagatagggtttctccatgttggtcaggctgctcttgaactcctgatctcaggtgagccgcccgcctcggcctaccaaagtgctgggattacaggcatgagccaccgtgctcagcccagtttttcatattttttagataagtttaatataaaagcgatggctccagctactcgggaggctgaggtaggaggattgcttgtggctgggaattcaagacctctctaggcaacatagtgagacccacctctaaaaaaagaaaaaaaaatttttttaaagaatgagtatctgaattttacttttcactccaacatttatattgacttttgaaatgtttttccttaattttatcattatcaaataagttgttttctgggtatttctatggattcacgtgtatttaatattttacaggattcagagactgtttttgatattcagaatgacagaaatagtatacttccaaaatctcaatctgaatacaagcctgatactcctcagtcaggcctagaatatagtggtattcaagaacttgaggacagaaggtaaagaatatataccaaattttgcgactacatgtttggtaccatactttattgtcttattattaattgaaatttctcttttcagatctcagcaaaggtttcagtttaatctacaagatttcaggtgttgtgctgtcttgggaagaggacattttggaaaggtaatctttttggaattttttggaatatctacaacattaataactcaagtggaaaataattattttaattttatttcaggtgcttttagctgaatataaaaacacaaatgagatgtttgctataaaagccttaaagaaaggagatattgtggctcgagatgaagtagacaggttagtttttaaaaatgaaattgtttatttttctgaatttgtaagttaagagaaatgatatatgtattacaacagcaaaactttatgattttacagtaatatgtgaagaaattaaatataatgtatctatatttgacataaggtagacattagtttttcttttttgcccctttttacccttcttgtgacaattaactggttaatggataccaaaaaaagatagtgaaatgtttgaactaattttgttaagttttttatatatggaaatattaaagtgtttatatggaatagaaactgttattcatctgtggttttgtggggctatatttcattctgtcttaatggaaatgacaaagtcatttacaaataatctacagttaatggaatggtttaaagtattttacaaagcagaatatgttatcttatttttttccttttattttttttaaaaacatgttttttgaccctaacgtctgggtctaataaagtaagttgtggtatcttatacaattgtttttttattttttgtttatttatttatttattttttgagacagagtctcactgtcttccaggctggagtgcagtggtgccatctcggctcactgcaacctccacctcctgggttcaagcaattctcctgcctcagtctcctgagtagctgggactacagacgcatgccaccacgtccagcttttttttgtatttttagtagaaatggggtttcaccatgttagccaggatggtctcgatctcctgacctcatgatccgccagccttggcctcccaaagtgctgggattacaggtgtgagccaccgtgcccggccccacaattattaaaatgcaaggatttggtgggggttaagattgtaattcacttagagaatatactttaaaaaatgactatcttaatacagaataattaaatatggacattattgtataaaaatggcatatttatcacagaaagaggctttcaatggacatttttcttacaccactgtaggaggcatatgttaatattaatggtagacagctctgtacaatgaagagagccctggactatgactgagaaggctgacttttctcgtcctcattgctcctccttagtaaggattgaccctagggcatttcactgaacatctttaagccccagttaactcatatatttaaaaatatatttgttttggtaatacttgccttaatgagttgtcttgctatgtagatatgccaaattgcaacttttaatgtttttttccaccatatgggtagttcttagaataaggacaggcctcaaaaggttgagatttatttttttatgttatataaacttttccttttggattttcctatttatttttcacctctgtttctttttcactgtttctcatacacctcaatcacatcaaaataaatgctttcttgatatctaatactaaagagcttgctggatatttataaaatattctgagtaccatattacatgtttagaattatttttatgttatacaagcagataattaaagcaagtctttgatcccaccaaagcaagtctttgattctaagtctgtttataattggaataatagaagggtcaaatgttttcctttcctgaaggaatatttgcttttctccagattcttaaatggtaaattcatttattttctaaaataataggaaactgtttactacttctattaatcttgatttacgtgggcttctgctaccttgttacgtctttgtgctgaatctttgtaggaaaatgctttctaatgaaatctatagaaagtttggatcacaggatgatgctgtagccagaatctaggccattacctctactgaaaattaatccagtcttgtgtagagacagggtctcactgtgtcacccacactggagtgcagtagcatgatcctagttcactgcagccttgaattcctgggctcaagccatcctcctgcctcagcttcccattgggaccacaggtgcatacaactgatccatctacatttctttcccccatagtgtcagggtcttggtatgttgtccaggctggtctcaaactcctggcttcaagcgatcctccttggcctcccgaagtgttgtgattataggtgtaagccaccacacccagtcttaacttaaatctccacttttcagtaacatgaaaatttaaaaatctcaagtagaactggtataaaaagagagaaaagaaaaatccaagagtgagaaataaaacacacttttagagaaatttgaggaatgaaggtaagaaaaaggagtacttttaaatttctagcatacctgaaagaaggcaagaaaaaaatttataagtttttttttaagactagctttttttttttgagacggagttttgctcttgttgaccaaactggagtgcaatggcatgaatttggctcactgcaacctctccctttcaggttcaagtgattcttttgcctcagcctccctagtagctgggattacaggcttgcaccaccatgccctgctaattttttgtatttttagtagaaatggggtttcaccatgttagccaggctggtctcaaactcctgagctcaggtgatctgcccgcctcagcctcccaaggtgctggggttacaggcatgagccaccacacccggccaagactagcatatttttaaaagtaatgtatttcattacttgcaagtataaatagtaaataactcaagctaaacttattataactgagcagaattttaaatatttactttccacttcctagctcatctttttaagccatagagtttggtgttattgtttattttttaatagctgttcctagtatactttatctatatattttttgagacagagtctcactctattgtccaggctggagtgcagtggagtgatctcggctcactacaacctccgcctcccgggttcaagcgattctccttccttagcctcccaagtagccaggattacaggtgtgcaccaccatgcccagttcatttttgtatttttagtacagacagggtttcaccatgttgaccaggctggtctcaaactcctgacctcaggtgatccacccgcctcagcctcccaaagtgctgggattacaggcatgagccactgtgcctggcctactttatgattcttaatgacagttctcatagtctaaattttctttctatagtctgtattatattattttactttgaaattaccttttttaataaatcatagaaaatttcaaatcaacctctttttaagtgaacacaaattatggattctaaaataaagtgttagataatttatgaacaaagatcatattctgtgtacctaccattagtaaaacactctaagtcccatttgcccttcagttgctgagtaaggatattatgtttatgttactgcaatgcctcctcactcagcttccttttcttaccaatttatatttcaacacaacagaatagggttggaagtatatttttgtgtttgtagaagaaagcacagctaaccagcttatgtaggattcaattctaagaccttggttttattaatgatgttttcccctgactaaaataactatttatataagttttcaggtttctaacttatctgaaaatgtaatgaactttgaaggaagtacacgaaacatgttaggatagaactagtaacttagagaaacgagacattaatacattatgtaataaaggtggctagatagagttgaggttaaaataagcaatacaaacaatagcagttcttaggaggaaatcagtgtactggtgtactactacaccatagtacatatagtgtactactccccaggtgtgcaactcttctagtcttccctattttattaaacagcaataccagttgttcaagccagaacacagtcattcttggtgctcttttccccttacctacaacactcaaactattagcaagtctggtcaacttcacctctaggatatatcccaaaccatacaaagcataaaaccaatagtaaatctctattgtatttactcttaaattttcattccacatctataatctgatgaaatatcaactgacatttgtgttgcactttcactttgacccctttatttgattcctgtcatcatgatcagaagtatttagagcaagatttaggtagagtcttataaaagaggttggatttttgctgggttttggtagacagaagttatttgggaataaggagagaagagtgatgacaatttagagggaaatgttctggacaggatgaataaggcttaaagttttaaataaagttggattgttgcatggacttttagggacaatacacagtttagataatgtgggacaagttgaagattcgtatgtaatagcttttttgtgtgctataaaatgcataaaattaaaattattttgacaatttggatctataaaagagccttgctcctttatctcgctgtcctaagacatctgtgcagatacctcatcattattgtaattcagataattcctgtgaatggcattgaaatcatttcaaggggtagtccagtcaatgggtctcaaatgttttataccacttatatgttccacccagttctaacctaacacctgttcagttgagaacagttgtttcattcataaattcacccataatgaattagtgagtcacccataaataaaaactatggacaggggctggtatggtggttcatacctgtaatctcagtactttgggaggccaaggcaggaggattgcttgagaccagaagttcaagacaagcctgggcaacatagtgagaccctgttcctatcaaaaaaataaaagccaggcatggtagtatgttcctgtagtaccagctactcaggaagctgaggcaggaggttcacttgagcctaggagttcaaggttacagggagccatgatgatatcactgcactccagctcctgaaagacagagcaagatcctgtctcaaaaaaacacacaactatagacaatgaagagaacatatttgtcatctacttaagcccaaaacatctttgttttgtcttatttcatctgattattttatctacatttagccaaaattcagattggcttaataaagcagatgttttagaatacatcttactgatcttgtctaaagcaatttttagtacattattttctagtaaatttaaatgatgacaaaaataaaaactgttaactttttaatcttctatgagtttatttataatagtgccttaatctgtagtaacatttagaaagtttgtcaggtatcctctttattttctagtcttttaaattaaaattttatgcagcatatctgtactgttcaacttcatatcaattttatatgataaaaaattgaatactatagcttgtgaattatagatactgtctttgaaattaccttcaccacaaacttttaaatttttcaaagtacgctttaaattgctaaattctctgaccaattcctgaagaattttcatatttcacccttaattaagccttttaaaaaatcaactgtaaccactaaccatgtatgtgctatagactatcaatgtgaatgctataatcttttaaagtttctattaatatatttcaactgaagttatttattttaggtaggtcagttttcatagcacatatagcaaaactaagacacatgttaggatttttaagttatagttaaaattttgcttatttttaagtttagtaatttataaagaatgttatttccaactagaattatttttaatctgcttattttaaaatattttcttttacagcctgatgtgtgaaaaaagaatttttgaaactgtgaatagtgtaaggcatccctttttggtgaacctttttgcatgtttccaaaccaaagagcatgtttgctttgtaatggaatatgctgccggtggggacctaatgatgcacattcatactgatgtcttttctgaaccaagagctgtgtgagtatgctttagacatttgtctgagtttttccatgactgatttcattctgggaaggaaaagagattctttgaattttagattttttttcctaacagaaaatagatctctgcaagaaatactagaactccttacttacttttttgccatatactttttgtatgtattctgttgtctgtgttgaaaatgtcatggattgcccaaaaccacaattgatactttagataagcaatttagattcattttagtaaaatttctttttttgctattagattttctcactagagaatgccatccagaattacagctttaaagacagattatactcaaaatgcactgttaagtttttgaaaagaaagtacagaagagtctgtatcatatatttatataaaatatttgtatttgcctttctaaagcataatttaaaagaatatcaactatttgcgtccttgtgcgtaaaatatctctgaacaaatgtaaaagaaactggtatgtgtgttgcctccagacaaagagataaaaagcagacttttcattgtaaactctttttgtagtttttgaattcaaggtttggcttattcaaataaataagaataatagtaaacacttgaaattatatatgcatgtgtgtatattttccctgttagtatcttaattttgtagctgttaaatggtggagctaggatttgaacctaggaaagtgatattaatacctacaccctgcatgctggtgtttaccaaatttgtgtttccagccccgtcctcttacctaaacttccaactctaataatattcagtggtcagctagttttccatttgtgtggctaaatatcttatttaacaacttaaactgaactgattttttccatttttctacctacctcatctactactccccaggcctgctactcttagtcttccctattttattaaacagcaataccaggttcaagccagaacacaaaaagtcattcttgatgctctttttcctttaacttcaacactcaaactattagcaagtccagtcaactccacctgtagaatatatcccaagtcataggaagcataaacccagtagtaaatctctattgtatttactctttagttttcattccacatctataatctgatgaaatagcaactgacatttgtgttgtactttctctttgattcctccatttgattcttgtcataaccattagaggtatttagagcagagaattgtaatactgtcataaccatcaagtttcagatgagggacataggggttaattctaatgggtactgaagcattttaaaaggagggaaaagccagaaagtagtagaaggctacgaataattcattccctcaatatttaaggcagagcattacaattatgcctaaccttatgctgccatgggaatttgtttggttttattttttatgcttgtttttgtttttaaaataatacataaatgtagtttgccttaagaaactgttatttttgctgagaatataaattatatacaaataaaaccataaagtccagtgaaaatacaagaatacaatgctgcattacagaactccaaatctgaaagtacctccctttatcattcagttctcagatcaaaggtcatttctttaaaggtaattttctgagttccctagctaaaatatcacatcactaaccaattcagttcactctattttctgtattatctttttcatatcattttatttctacatgaaatcatctgatttatttttaaaatttttattgtctatcttatttcacttaaaagagaggagcaagaaccatatctgtcctgtttattagtgaaacacctaaaagaatacctggaacatattaggcaatcagtgaatttttattgattgaaaccatagaatcaaaatagcttgatttctagctttgttgtttcatagtctaactttagacaaattatgttttctgagcttcattatctgctctgtaaaatatcttaaggcttgattgaagattaaataagctaataaatgaaaataactgacacaataccggacaaacaggagcattcaataaaatatgtattttagatggtatacgcaattaatcaaggcagtctgtttacaaggaaagaaatcagcggggagcggtggctccatgcctataatcccagcactttgggaggcagaggcaggcagatcacttaagctcaggagttctagaccagcctggccaacatggtgaaaccctgtctatactaaaaatacaaaaattagctgggcatggtggcaggcgcctgtaatcccagctatttgggaagctgaggcaggagaaccacttgaaccccagaggcagaggttgcagtgagccaagatcacgtcactgcactccaccctgggcgacagagtgagacccccccaaattaaaaaaaagagagaaatcaaggtatttttataattgttacagtattgttttgccacaaaaataagtttgctaagaaaattatgtttaactatcttaagcaattttgtttgtttgtttgttttgagacagagtcttgctccgtctcccaggctggagtgcagtggcaccgtcttggctcactacaacctctgccacacaggttcaagagattatcctgcctcagcctcccaaatagctgggactacaggcgcgtgccaccatgcctggctaatttttgtatttttagtagagacggggtttcactctattggccaggctggtctcaaactcctgacctcaggtgatctgcctgcctcagcttcccagagtgctgggattacaggcatgagccaccacacctggccatcttaagcaattttaagctcacgtttattttaataaacttcagtagatccttaaaacttctggtaagttgtttaatttttaatgtataattaagtaagtatttctaagtagttgcattttatttttgttttttatttctgtgttgggaagtctaagccctgatgaaactgcctggtggaccctgaccaccacccctgcagcacaagccccgcgtttaaaaattatagacccgtgctcacttcagcagcacatacactaaaattggaaccttatagagaagattagcatgacccctgtgcgaggatgacacacaaattcgtgaagcattccatatttttctgaaattgaggcagtaattaatagcctaccaaccaaaaaaagcccaggaccagatggattcacagccaaattctaccacaggtacaaagaggagctggtaccattccttctgaaactattccaaacaatagaaaaagaggggctcctctctaactcactttatgaggccagcatcatcctgataccaaaacctggcagagacaccacaaaaaaagaaaatttcaggccaatatccctgatgaacatcgatgcaaaaatcttcagtaaaacactggcaaaccaaatccagcagcacatcaaaaagcttatccaccacgatcaagtcggcttcatccctgggatgcaaggctggttcaacacacacaaatcaataaacgtaatccatcacataaacagaaccaatgacaaaaactacatgattatctcaatagatgcaaaaaaggccttcgacaggcggaggtggcagtgagcggagatcacgccactgcactccagcctggcgacagagcaagactctgtctcaaaaaaaaaaaaaaaaaggccgggtgaggtggctcatgcctgtaatcccagcactttaggaggccgaggtggttggagcaccaggtcaggatatcgagaccagcctggccaacatggtgaaaccccatctctactaaaaacacaaaaaaattagctgggtgtggcggtgtaggcctgtagtctcggctgctcaggaggcaggaggcaggagaatcgcttgaaccctggaggcagaggttgcagtaagccgagatcgcgccacagcactccagtctgggcgacaaagcgagactccgtctcaaaaaaaaaaaaagaaaagaaaaggccttcgataaaattcaacactgcttcatgctaaaaactcaataaactaggtgttgatgggacgtatctcaaaataataagagctatttatgacaaacccacagccaatattcaacatagtattggaagttctggccagggcaatcaggcaagagaaagaaagaaagtttattaaaataggaagaaaggaagtcaaattgtctctgtttggagatgacatgattatatatttagaaaaccccatcatctcagcgcaaaatctccttaagctgataagcaacttcagcaaagtctcaggatacaaatcaatgtgcaaaaatcacaagcataatacactgataatagagaactgaatcatgaattaactcccattcacagttgctacaaagagaataaaatacctaggaatacagcttacaagggatgtgaaggacctcttcaaggagaactacaaatcactgcccaaggaaataagagaggacacaaacaaatggaaaaacattccatgctcatggataggaagaatcaatatcttgaaaatggccatactgcccaaagtaatttatagattcaatgctatccccattaagctaccattgactttcttcacagaattagaaaaaactgctttaggctgggtgtggtggctcacgcctgtaatcccagcactttgggaggttgaggcgggtggatcatttgaggtcaggagtttgagactagcctggccaacatggtgaaaccccgtctctactaaaaatacaaaaattagataggcatggtggtacacgcctgtaatcccagctactcgggagactgagtcaggagaattgcttgaacctgggaggtggaggttgcagtaagcaaagactgtgccactgcactccagcctgggcaacagagtgagactccttctcaaaaaaaaaaaaaaaagaaaaagaagaaactactttaaatttcacatggaaccaaaagagcccgtatagccaagacaacgctaagcaaaaagagcaaatttggaggcatcacgctacctgatttcaaactatactacaagactgcagcaaccaaaacaccatggtactggtaccaaaacatgtatatagaccaatggaacagaacagaggcctcagaaataatgccacacatctacaaccatctcatcttttgagaaacctgacaaaaacaagtaatggggaaagaattccctatttaataaatggtgttgggaaaactggctagccatatgcggggaactgaaactgaaccccttccttacaccttatataaaagttaactcaagatggattaaagacttgaacataagactcaaaaccataaaaaccctagaagaaaacctaggcagtaccattcaggacacaggcatgggcaaagacttcatgactaaaacaccaaaagcagtggcaaccaaagccaaaattaacaaatgggatctgattaaagagcttctgcacagcaaaagaaactgtcgtcagagtgaacaggcaacctacagaatgggagaagatttttgcaatctgtccatctgacaaagggctaatatccagaatctacaaggaactgaaacaaatttacaagaaaaaaaacagccccatcaaaaagtaggtgaaggatatgaacagacacttctcaagacatttatccaaaaaacatatgaaaaaaagctcatcatcactggtcattagagaaatgcaaatcaaaactacaatgagataccatctcacgccagttagaatggcgatcattaaaaagtcaggaaacaacagatgctggagaggatatggagaaataggaatgtttttacactgttggtgggagtgtaaattagttcagccattgtggaagacagtgtggtgattcctcaaggatctagaactagaaatattatttgacccagccatcccattactgggtatatacccaaaggattataaattctgtaaagacacatgcacacgtatgtttattggagcactgttcacaatagcaaagacttggaaccaacccaaaggcccatcaatgatagactgcataaagaaaatgtggcacatatacaccatgaaatactatacagccataaaaaatgatgagttcatgtcctttgcaggacatggatgaagctggaaaccatcattcttagcaaacaaacacagaaacagaaaaccaaacactgaatgttctcataagtgggagttgaacaatgagaacacctggacacagggaggggaacatcacacaccgggggtcgggggctaggggagggatagcattaggagaaatacctaatgtagatgacgggttgatgggtgcagcaaatcaccatgacacgtgaatacctatgtaacaaacctgtacattctgcacatgtatcccagaacttaaaagtataatttaaaagtaaataaatcaaacaaatcttttcagaaacctatatatatatatatatatatatatatatatatatatatataaatagaaaaaaataaaaatgcgaggcaccatggctcatgcctgtaatcccagcactttgggaggccgaggcgggcagatcacctgaggtcggaagttcgagaccagcctgaccacatggagaaaccccgtctccactaaaaatacaaaattagctgggcgtggtggcacatgcctataatcccagctactcaggaggctgaggcaagaaaatcacttgaactggggaggtgggggttgcggtgagctgagattgtgcaattgcactccagcttgggcaacaagagcaaaactccatctcaaaaaaaaaataaataaaataaataaataaaaattattgacccatttttaataaaaataggtaaatataaaacatagctatattatctacatgtgaatgtaaatatattctgaaagtttggaataacattaaagtgacaagaattgttatctgtatgaacggcagtggaatgaggtgagatggagatagatggattaaatagtgtactttggagaagcatattacgttttatagagaaaatattcatgttattacttttataattaaaaactaattatcctaagggtctgttcataggctattctacactgaagacatttgcatttttaaatctattcatttatttcctccttgttcaataagcctatcatgtatattaggcattatgctaatgcatttaggataaaaattgaaaaagtcaaacatggtcctgcgcctcaagaattattctctctcaacccaggttttttgagatccaaacctgcatacccagcttttacatatcatcacctgccccacagacaaagtcaacctgtcaaatgccaaacttagttttgtcacacaaccttggctacctctatgtttctttatctgttcattctaagatggaaaccttgaaagttacctttagttcttcccacttccttatcctgtaatgggataccaccttctgtcatgctaatttttaagtttttgtgaatctgtctctctgttgccactacagtggatgttctcatgatcttttcatctataatatgataaaagccttatctgttcttttttcctctggatctctacctacttctccatccttcgcattgctaccagaaaactttaacataaatgccatcattctcctctgattaaaatggtttgattctctgtcactaagagaaaaaatttcagtatccataatatgacattcaaggtccttcgcccaggatatcttttcagcctaatctcctacttcgtccccagatacacccatcctttacttcagccacaccaaacttacttgttatcaaacatgttacgccttttgcacctctatttcttttttctctcaggtaagtactttattattcccctacaaaacttctgcctgtcacactgtcctttgtccttatgttatattgtaattcctcctgcagaaccagatcaaatgtcccctctgaggttctcagtgactccactaggcaaagttaatggcttccattgtcaagactgtacttttctcatttttaaattttacccctaatatctagcacaatgtgatacatagtagggactaaataaatatttgtgaaataaattaatgataggtctgctttgaagtataaacatataagctgggattcaagagcaataaaatttattaaactcctgttgatttaattcttcaaacagattttatgctgcttgtgtagttcttgggttgcagtatttacatgaacacaaaattgtttataggtaagttaatttttaattttttctaatggcttgctttggtatgatttagaattaaagatagtattttgtttttcttaaacattttatgtttaaccagtttcttagttttctccttcacctgtaagtcaaaccccaatgttgaaagacgtggttagcactatgattatatgatgaactttttgtttcctaatccatagcacattttctaattaaaatagtcaaattatgagttggtctatgatagtgcatttctcaacaatattcatcctagtgaatattttgcattcaaacgactcattgcagaaaacctctatagaccaatactactaaaaacgtgtccatgatgagacaagtagcttgtgttagagtgtaaaacatcacactgcttccctcattaagaagccttattgtcaactgaactaaatagtgtattggtgatgtagctgatctctgtaattcgtggcccagcagctagtttgtgaaccacaccttgactaacactcactgcccaggaccaagcagattatgagaaggctagtcagaattagaagactataaacattggattatttaagctttttttttttttttttgagacggagtttcgctcttgtcacccaagctggagtgcaatgcacaatctcggctcatggcaacctctgcctcctgggttcaagcgattctcctgcctcagcctcctgagtacatggaattacaggtgcccgccaccatgcccagctaatttttgtatttttagtatagatggagtttcaccatgttggccaggctggtcttaaaactcctgacctcaggtgactacccgcctcggcctcccaaagtgctgggattacagttgtgagccaccgtgcccagccggtaaggttctaatgatgttttcatgataagattgttttacctaatggataaaatgtttcctgggcacagtggctcatgcctgtaaccccagcatttggggaggccaaggtgggaggattgcttcagtctaggagtttgagacccgcctgggcaacatagtgatattctgtctctacaaaaaaataacaaaaatcagccaggagtgatgacatctgcctgtatcccagctactcaggaggctgaggtgggggaattccttgagcctgggaggtcaaggctgcagtgagccgtgattatgccactgcactccacttagacaacagagtgagtaccttgtctcacaaaaataaaaaataaattgaaaaaaatggataaaatattgtcagtttgcctaatttgtaaacaattagtatggatggatagctttctcttattctttcagaagatgaaacctgccctctgatgccttattaatactgttaactttacaattctttcttatggatggtatataagcaaactttaaaactggattaagttggccaggtgcagtggctcatacctgtaatcccagcacttttggaggccgaggcaggtggatcacctgaggtcaggagttcaagaccagcctggccaacatggtgaaaacccatctctactgcaaataaaaaaaaattagccaggcttggtggtgggcacctgtagtcccagctacttgggaggctgaggcacgagaattgcttgaacctggaaagtggatgttgcagtgagccaagatcacaccagtgctctccagcctgggtgacagagtgagactctgtcttaaaaaaaaaaaaaaaaaaaaaaaaaggctgggtgtggtggcttacgcctgtaattccagcactttggaaggctgaggccagcggatcacgaggtcagaagttcaagaccagcctggccaaaatagtgaaaccgcctctctaataaaaatacaaaagttagccgggtgtagtggcacgcgactgtagtcccagctactcgggaggctgaggcaggagaatcgcttgtacccgggaggcagaggttgcagtgagctgagaccacgccattgcactccagcctgggtgacaaagtgagactctgtctcaaaaaaaaaaaaaaaaaaaggattaaattagattatcacaaataacaaattaaatacatttttccttttttatgtaacaggagaagaatttctcatgagctaccttatatagagtaataaacttaccaaaaggaagaaaactgaatgtttgtgttatagtatttaaatctcaaatcataacttggaaatcccatttttaataaagagaaaacacagttccaattgcaattatttttttaactgtataacctactgatttctttgatttttttttttcatgctgtatctttttatcctgaacagagatttgaaattggataacttattgctagatacagagggctttgtgaaaattgctgattttggtctttgcaaagaaggtaatcgaatgtttttaagtttcttttctgattcagaattactgtttctttgtgcatcagtagttttcaagtttgtctatggaaaacaaactgtacttttaactttattcttcattaagacattgtagatacaatgaaaacattgcttatataacctaattatcacattaagaatttgttctctgaatacaaataaggttagatgtatagaaatcatagtaagcttctctgtgtgattaataattttgtcactactttaaggaagtattgattaagcaccaaaatcgtttattctggtgagactgtacacagtgaatttcataggcctgataatttccttccagcttcttaaagttgaaacatttaaaaatagaaaataaatagagataggtatctcatgtatgttttttgtatattcaaaagtaaataagtaaattggggaaatttgaatcagaggtaacataagaaaggataaagatcatgggcttaggcactaaacagttctaggtttgaatcgtggctttgccactatttgctgtttgtctttggaaaacttagttttaacctctttgagtcttatttccccaattataaaaaaatggacatagttctttctgtttactagttactaacattctctatctccctctgcactggtggcttctgtttgctatttagctttgtttccatagtgcataacacagtgcatggtacatcttaagtattcagtaagtgtttgattaataagtagttggatgaataaatgaatgaactctgtagatatatgcccatcacatacccactgacctaattgctgaatcaagtaagttttttcttgactgggcttctttttattggacactgttcctctaaatgcttttgtttctcagcatctctccttagccggctgctcttcactgcaattttttgactagcagctatatcctaatgactcccaaatctattatttcctttcctatggattccaaagatatatattcaactgtctactagacagctctgcctgaatagtgaagagacacctcaaacactacccaaacaaaaatcatttattttccgccggtagtctgggtgttggtatcacaatcccctcagccttcaatctgaaagtaaggaattatcttgcgttctatcctgttctctactttccgtatgtagttattcacaaaattctactgccacttaacctcctgaatatttctgaaatctatcatttccagtcagctcctttcacccattatcttgttttgacaagacaggtataataatctcctaattgttcctatttctagtctttttctatcccaaatcaacctgccatgtaattgctgaattgcttaaggagtccatataaatacagatcggaccatggcacatacctgctgaaaactcttcagtggctaggataaggtgacatacagtgccgttactgatctgcctgccttcctctctggccacatctcttgctgctctctgtttagtactttttgctgcagcaacaatgaactgcttatagtctgtgtccctctagcactgtcacccatcccaactctatttgctgactaacatctgctcatccttgtcattcaactcaagtgtaacctctacaggcaagttaccagagattcccttttactaccccaactcccaagtctgctttaggagcccttcttcactattctaccttatcttgctcttcccttgttgttataaaattatcaataaatatccatttccctccagtctcctgtaagccccttaaagactgtgtcttactctcgtttttatgttcccgctacttgacacaggtgcctagaacataaaaggtgcagaaaatatgtgtgttgaataaccagacttattaatgcattatcataaaaacatgtttagtagattatatagctaacaacttttgagtgcttaccgtgtgccaagaattttgcttcatatgcatatctcctgtaatttataacaatcgtatgaaggtagatagtttttttggaggaaatattttattttttattttatttttatttatataaatttatagggtagaagtgcaattttgttacatgcataaattgcatagtggtgaaatcaaggcttttaggatattcgtcacccaaataacatacattgtacctattaagtaatttctcatcatccaccccccttccacctcctcacccttctgagtcttccttgtcttatcattccacactggtagatggtattattaactctcatatacagatgaagaaacctagaatttgatgttagacaactttcccaacctcccacagttaacaaatgacagaactggaacttaaaccaggtatttattaatctagagcctgatattaaccacttccatggagttttaccagtctacaagaaacataagttatatttcttcattaattaactttttcctagttttctccaagttactaaaaggctggtgcagaacttacatagatattaatactatatcactgtttttttaaataatattttattgaagaaaataaaaatcattatgatagtgttaaagaaattttgccaaaaaaaaatttctccactccagtgtgctaatgtatctaattgtgcccttcaggtcttggttcatagacacacattcatttctattttatagtcactatatatgcatacctaattattcttaatttaggattgagagcttttctttaaaattcttaaaaagatgacacttatgacaagtttttaacactttggaatacatagagataatatcttcaatatgtagactatatatttgattaacatattaataaattatgaggaacatatatttaaaaactagttagccaaaatgttaatacaggctgagtatcccttatccaaaatgcttagaatgagaaatgttttgaatttcagatttatttggattttggaatatttgcatatataaataatgacatatcttgaggccaagacccaagtctaaacacaaaatttatatatgtttcatatataccttatacatagcctgaaggtaaatttatataatatttttaataattttgtgcatgaaactaatcttaagtacttgcggaattctctatggcatcatgttggtgcccaaaaagtttcagattttgaagcattttagattttggatttttggattagggatgttcaacctgtactctcccttccctccccttcccttcccttcccttcccttccctcccctcttctcccctcccctcccgtcccctcctctctctctctatatatataatatatattgagatatatatatgttttttgtttgtttgttttttgagacagagttttgctcttgtcacccaggctggagtgcaatgacacaatctcagctcactgcagcctccgtctcccaagttcaagcagttctcctgcctcaacctcccgagtagctgagattacaggcgggagccaccatgcccggctaatttttgtttttgttttttttgtagagacgggtttcatcatgttggccaggctggtcttgaactcctgacctcaggtgatccacccgcctcggcctcccaaagtgccgtgattacaagcatgagccactgcacacggccctatctctctgtattatatgacacatttggtcagcttctgattatccaagggtttgctttttggtatttttgaaacttattttttttagaatgttgattttataatgaagtaaataaacttatttaagattgaattggaaagataatggaacttcacaatcagttcattttgttataatttcttagctcccttgtaatgacaagaagaaaaagtaactgaaaagaaacatggatatcttatttctatttacccattaattagacagtatagttgctattgcagtttttgctataccagtccttactgttttcttgaaatgtcttagatatgtctgaatttgttcaccatgcacaaatgtgcaactttaattttgcctcccaaagatagctttgattttttttttatgctagatttgttttctttgctaacaaatgtttacattttatcttttccaggaatgggatatggagatagaacaagcacattttgtggcactcctgaatttcttgccccagaagtattaacagaaacttcttatacaagggctgtagattggtggggccttggcgtgcttatatatgaaatgcttgttggtgaggtaagcagtgtgaaataggtaagagaacagaggaaggatgattgaaataataaagcatgtcatttataaaaccacctaatactgtcttcagtatgagtggaatttaagttttataaatatttatagtatactagtagtcagctatctttctgtaataccttcaataaagatttttatgtggtttgtggaatgcactatcagtgctttgaaaatagttccttgtatttcagtattgtacttttattatgttttctgattttaagacatagtcattttatagggaatggaataacagaaagactaataaaaggaatgtactctgtacctgtaaagaaaagcccactatagattggtcagaaataaatgttaccttcgacttcctccagacttccgtctgagcaacacactctgcatccttgcttcaccgggaaactactgaagttcctggggaagcaaagtagaatttcgtaagaacaaaatggatggagagaggagaaaacctatggtagctgtgaaggccctgatgccatgtatgtcaaattgatatcatccgatggccatgaatttattgtaaaaacagaacgtacattaacatcagcacgataaaagccatgttgagtggcccaggtcaatttgctgagaatgaaaccaatgaggtcaatttgagagagataccttcacatgtgctatcaaaagtattcgctacaccaacagctccaccgagattcctgaattcccagttgcacctgaagttgctatagaactgctgatggctgtgaacttcctagattgttaaataaaatataattttaaaaaaatgaaagaagtgttaccttaaaaaatggtagagttgaaaaaattcgcattttttcctactgttttctgtagattaacttaaatttctgaggataattgagttgtacatagaaattattactattaggaaacagtgagttatgttaaggcaataataggagactaataatttattatgttataaattgttagaaatgttgaattggggtgaaattgggaaagagtaaatcttttaataagtaattgaagattacttgaagggacttgaactggagatgcaagaaaaattattttaagggattggttcattattctgcagtttccccatgccagcaacctcccttgtacacttgtaagtttgaagaagttagtgctgaatgaacaaattatcaaattgaatatcagaaatttctaaagttttgttctatgcttgtcatttattggcacttaccccaaacaaatggttttagtttcgccggatggataaccccttttggtatgtcaatttgaagtggattccttggaaaaggaggagaagtatggctaattaaaatttatcatgtgctaagcactgtactgtatgccttaaatattagttcatttaattttgcaacagcctttaataagctcagtactgatcttatgcccattttcggaggtgtaaatagagacacaaagagattaatgacttgcttaaagtcacacagctctcatatggtggagctggaattttaaccttgtcactctggctccagagcatatctaaagcattatgctttgctgctccaggacaggatcttcaattcatccagccttgtttctgttcttaagactagtggtccagatctgaatttttcacctctatttagaaaagctgttgtgcagtgtttaggttggaaagatttattttagctccagtccacagtggcttttactttctgagagtgccagaagttctcataaaatagttaatctgctgtaagctctggcatacttgaactcctccccacccccttcctttattttaacagtaacattttggagggtttttttggttttgtttcatgtagtattcaagtaagtatgagatttatgagattcaattatgtgcttgcttaaaatttactctccatattagagatgacatgtgcaaaatatgagtttattacaaaatactgtagaattaatccagttgaatctactccctcctattataaagccactggagggtttggcagaaaacaaggaagctcctgtttcatgttttttaaaagagctaattgattgagctcttaattacctagaagataaaagacagtggatctggctatttcttcacagttgtttcttgcaatttctctttagtatctccacaagagggtagctgggaaaagaactaaacttaaaactcatcagtctacttcataattttatagcattagtgaaatgctagtgataactcctttttaactatgatgaaagtaaggtgtggctaaagtttatgtcagatttctctattattacaaataattgtaaactcaccggatatattatacatgttcagatttgtatacttctactagttttgattactggaaagactccaggaataaacaaacatcgcaagtcccctttttcctgtctcagatgggagtgaagataccagagagattgaacagaatgctggacatggttttagatactgtcagtgttgacatctgaacagactattggtttcctttaaatgtgctgaaaacacatttgttagctttcagttgttagccctgtttgcttacaatctatttgcagaaaaaagatactacatattttaacaaatgtatagatatttctttgctgttcagacttgtagaatgagttttcaagtaaaaattgttcaagcagaagaccaaagtgctgtctttgtattatccattgaaattcccattgagaatcctagtaaaataaaattttcttctgacttactgtttcagtccccagaagaaattagattgtccatgtagtacatttgatttatgtattttgagtgtactacattgtcccacgtagtatattttatttatgtattttgagtgagtgaatgaacaaactaaggttttggtaactgtaagctttgaaattttcttagctgtgagcaagattagaagctcagccttaagaagttggattctgaatttattttcacagattcttaaagattgctcactttccctggatattgctttctgcttattattctttaaaacttaattggaagcaagcagccaaatcaaatctaacgaggctaagtaagcctatatttcttcaatagccagtgagaaaataaggttcaagatactaattcatttcagtgattttaaggaattaaatgatatttagacatttgtttcctgatttaaaaaatgactgagtgatttttaagccatctgaaattctgaggcaggcagtcacatttgatagacacgtttttagcatagttgaaagtttctctctttgtgaatcaaattgtcatactgaatataatgtaactacttttttatgtctcagggtcattatgaaaaatgattttaatactgagcttatggaaatgccctaaaactttttgtgtttagaacattaaaaatgcctggcaatgtgtgctttttgggttcctttcagtctaattttgttggcagctgcttcttaatacagtcattatgcttgctaatccatgattgtgttttaccaccattaatttactgttgactttaaaatccaaagcacatttatatctgatgtatttccgcagattgccttcctttattataacatttattaccatattaaccttatccattttcttctgtttttccacaagattgaggttcttcaggatttatctattatctaaatattccctactgtctgttagacactaaaaattgactgtctggccaaataggtgattgagtgaatgaaataaaatggaatggagtggaatgaaattaaatgaaaagtcatatcatatatgagatagacaagttttttataagggtctataaaatttaaagatttcagaaagagtatatggtgtattccctctgtaatagatacatatctgttgtcacttcttatagttcttttgttgttgttttggtaggcatgggtttattgttgttgttgttgttgttgttgttttgtctgttttttctttttcactgcctggatcttggttgtactttgaatgggtgataagattttactgccttaaaacttgctttaacttactcaaaggtatttcttctagtctccctttcctggtgatgatgaagaggaagtttttgacagtattgtaaatgatgaagtaaggtatccaaggttcttatctacagaagccatttctataatgagaagggtaagaattaaaataaggataagaattttttaaagactactttaattttttatactaaagaaaatttcccagtagaactttaaaagctgtttttcagttcataaatgttgcatggcttagacaaaaaaagacaaaatatatctaagttttttaaagtaataatccttatcagtgaattttattctattggttttattttaacttttttattttacattatgctagctgttaagaagaaatcctgaacggcgccttggggctagcgagaaagatgcagaggatgtaaaaaagcacccatttttccgggtaagtgtgactatttaaaattttttatgaaactagagcgattagatttaacaaactaaactagtcattttttattttatgatccagctaattgattggagcgctctgatggacaaaaaagtaaagccaccatttatacctaccataagaggacgagaagatgttagtaattttgatgatgaatttacctcagaagcacctattctgactccacctcgagaaccaaggatactttcggaagaggagcaggaaatgttcagagattttgactacattgctgattggtgttaagttgctagacactgcgaaaccaagctgactcacaagaagacctcttaaaaatagcaacccttcatttgctctctgtgccaccaatagcttctgagttttttgttgttgttgtttttattgaaacacgtgaagatttgtttaaaagtaccattctaatacttcttcaaaagtggctcctcattgtacttcagcgtaaatatgagcactggaaacagtttcatggagtttaagttgagtgaacatcggccatgaaaatccatcacgaatacttttggatcaatagtctatttttaaaaagaaagaaaaaaaccacttttttatagtccctagctttgccatatgcccgccttaagtggaaggaaagttaatcacttaactatgttttataaaaagaaaaaagggcttggaatgctattactgttcacacaaagtatgattctgtttgaataaggcaaatgctcctttttttaaaaaaaaagacattactgtaatatcaaaaaccgtggcagtttgtatacaactcggggcttgattttttttaaaaaaacagaatgaattgatgtcttattttataaatgttctatatttattaggagaaaactttatattgccttttttatcaatcatgtaacaggcttatagctttccaacagagctgcttgccaaacaattttttttgtttattaaacagtgctgaaacaaacaggatcagcatttacttaagatgttaagaatgaggacttttaatcagccgaaccaagatattgttacctgtatgcattcccaaagtctagatgctcagtatgttcagtcatatctttcagaatcagtgaaccgattaccctttttttggtattcactctacatctgccaacctagttcaccttggttttgtgtctgctgtagaagggaaccataacttggttaaaccgtagggattatcattgtatacatgctgtgaacatgtatatgtgcaagttttaatgtattctatgttgtaggcttattatttaattttaccacttcatcacttttgtacagtggccaagcagacacctcaaactccagcatttacattaagtgcatttgtacattttaggccactggatccagattttatattggcagttattgagggcaaaagcaatatattgtaacagaatgtataaatatttttgataaaacagtctatattttattaaaaaatgaattataacactaaagctgtacctcaaaagtctcaaaaataatttgatgaaatattttatacaactcttcaaaggatccgtctgtggctttttatactcttttagggttgtctttttacaaaccatgactttccacttgcctgtagttttttgtttgttttggtttggtttgattttatatttttttctcctaatctatgactttattgttttttcttagtttagtaatagcatctttgatcctgtgcttagcatgttagggtcattatacctcaggaatagcaagctgttaagtaaccatactgaattaactatttaattacagtgagctcatctcttaaaaattgttcaggtgtaaatcttatgagaaacatgaaaaagcacactgatttatggagagttgagctaaaaacatttataaatatttgctgggatgttttagcatcttttcattgtactctgagaacaattaaaattgtccagagatcatttatattaccttccaaattgtttattacccaagatcctttgggagaaaatcttatagaatgggggaacaatatgtggtttaaagttattttaaaatgccagttaatttcctcggcaaaggacaatagaggaacttagcttaattgtctggctttaatttaaactgtgttaatacaacattaaaataaaacactaaatacttttgaggtacagtctgctcacttttttggttctcaaatagcaaagaaagtaatgtctaaaataggctcttagcattaaaaactgacagcattttgtaactacacagtgtacagaatttttttttaattgaagtcaatcactaaaaaaattagaaggcagggtctatttacacaattaagctgaagaaagcactaattttttgtagtttaaaatatatatatattttagtcagatttaaaattttaagctttatagagtgtaaatatattttgctattactgtatgtgtatgtgactgctcaagcactttgtaaagaaattaggatattttagaatggtacactatgcattcaaatgaaatgtgcctttcactatgtcattctaagaaaacaagtgttttttgcagtcataaattatcacaaatgcacaaattaaagtctatatagattgaaatttgtaactttggttttaagtattctttccttttagaaacttcctaatgattaaaatatactttaacttttctgtgttcaaaatctcaaagactaattaactttaataaacattcttgcaagtactttttgtcctagtgaaggcttaaaaccatgaacattcagagcaaactgtccacttcattgggaataatgggaaaagtttgtattctgctcctgtaaggtcagtagcatcttttatttgaagcatatttatggactgcttactgtgtatagatactgagaataggaagtttttttttttaaagcaacaaaatgttgatgaatgaagaacagcctgttttaattaagatgcaagcaccagtattgtatgtacttttctcttgtttgaggttagcttattttaatttaggacctggcttctcaaaaaggcaaatgaataaaacagaatactagtattttatagtaatcttacttaaaaattacaaatggaatattttagaaatataaaatgatccatgctctccctgtaacacaaattgaggacataatggaaattgcaatcatatattgacttggtaaatctgctgtacagattcaagtctaacaagatttttgcaagtactgccagtattcccaaagccactgaaggagtaagtatgaaaaatccaaagaagcaaatactaatccacagatcataaccttaatttaaatttagaattcttatttaccttccagccatcttttgaggtctagggtttttctgagatactggctttatacattagtatgatgggtagaggctttaaagttattaaaaataatatgtatacatatacatataaaattagtggaagaccgtcaataagatacgtaatttgaggtattgatgatctcaataaaggtaagagtggtctctggcaacccttcaccccaaaacaagcaaacaaacttgagcagagtctggacaagttagggcttcagcacctaagagttagagtgggagtgctcaagcacaaaagtaggaatattgagagaactggaagctgagtctacagagtatggcagagtagcaggaagttggaaaagataggagtcacaatggcaaggagcaggttttgaaaatgcaggcacccaagagaagtggggttaccaaggatagatttctctagcaacacaattttgaggatagcaaaccttgcaatagcatcaggacttatcttctgtgcttaaatcctgtagacgagttcatattttagtttgcatgtcactctttccctgacagtggaaggaaatattctctggatggaagcttctccaggttgggactatcagattccacagattaagatcaagtaattcactgtcagaaatccctaaccacatgcgagagacagcaagttaccttgaataagaaccaacagaaatattaaatttagatatccctgtcagagatttcgtacattagaattatcagccaggcacaatgactcatgcctgtaattccaacactttgggaggccaaggcaggaggattgcttgaggttaggagtttgagactagcctgggtaacacagcgggactgcctctctacaaaaaaaaaaaaaaaaaaaaaaaaaaacatataaaaattagtcaggtatggtggtgtgcacctgtagtcccagctactttggaggctgaagtcagaggattgcttgagcccaggaggtcaaggctacagtgagctgttatgccactgcattgtatttagcctgggtgacagagcaagtccccaacttaaaaaaaaaagaattaccagatacaagttatagaatagctatatataaagtatatatacatatatatacctaaagctatcagtataaacatgtaaaatgaacattttaacaaacatttttaaaatccaaaaatgaaaaatgtaattgttctaatatgaaattcagtggaaagattaaacagcagattagacagttgaagaaaactgaagattggaaactgaaaagtcaatcccaaatgaagatgggaaatataaaagggagattaagagatacggaagatggaatggagactcgaggaaagaatgagaggcaatatttaaagacataatggctgcaagtttctcggagatgaaaaatatccaagcagtacaatatttcccaaacaggataaatataaatgtatgcgtagaaccattgtgaaatggcaaatcaccaaagacagcattttgaaactatccagagaaaagggactaaatgtctataaaggaaagacaccagctcacctctcaattgcaacaatgcacgtagtggaatattaccttcagagtgttggggaaaaaaaggttaacctagaattacataaaaataaaataattttcgtaagaattagggcatataatatgttttaaaaggggaatgcttgctgctttaatggacgttctgaataatgtgcttgaa

SEQ ID NO: 13750 - DNA, 132456 bp, Human
  misc_feature (1)...(132456): n = A,T,C or G
cagcactaacatccatccttggccacaagccagaaacctttgagttttccttgatgactccctctccttcattgccccacataacccatcacttggagaatgtgcaagttctgcccgttggacctcctaaataattcacagatctttccatgtccatcaactatttccatgaccatcaccctagatcaagcttccacctcttaccgtctaggctactcctacatccacctgggctctttccaataaggaatcttttcaagaagctattctgaccatgccacaccctttgctgaatatgtcaggggcttcccattgcacttaggataaaaagattttcaacatggccaatatggatgtcctacgtttggtccctttaccaatcttcctgacttcatctcatagctccttcttccttgctcctccagcagagctggcctttcctgaatttctccatcttatcctgcttaatctcatcagaggacctttgcgtgcaaagctacctctaaaatattctctgtctagtcaaacctattcccagctcaagtgacagttcctcagggaaatcttttctggccttattaactagtgtattaattggtttcatagtattatgtatccttaacaatttgtattataaaacagtgataattttgcgtttactattattactttcatagtacagtgattaaatctgtaaactctactgtattgcctggcactgaatgggcatgcaataaataattattgcaggaacaaaggatggcaggaaggaaattaagaaggttgagagggagggagagaggaaatgggaagagaatgaatgaataatcatctgtatgttccctttcagaatcaccagaaacaggccagccccacatgtaataggaaagtagtttacctgaaatcattcatttattcaacaaatatttatatattcattattaaagtaacttacttgtttctgattgtgaacataactattcctctcggaaaacatgagaaaatacccaaagtataaacgagaaccaagtcaccctttattccatagtccaatgatgaaccattgttaacataatttggtgtatttctttccaggttttttctatgtgtatatatagtatctaagtgggaccattctatatatgacttgtttcttgcttctttctcttaatgatacattgtgaacatgttcctatgttgttaagaattccttgaacacatggcatttaaattgctaaaatgtattctaccgaatggtgtaggtagttcaaacgcctttccacccgttgttggatatttaaaggacttgtcaatttatcgcttctgtaacatttacacgctttgtggggcctcagaagtaaaccaggtaatgcaaggaatctgggaagaggtggatttgcaaggaatctcggaggaggtggattttggaaaaactggaggcagcttttcccgggcagctgaagagaacacttatctctctgtaggtttctgggacccggacaggtgtcctcagaatggaacatattgtcggtcaaggtaaccagctcttcatcactcaggtgtgtgtaccggaagggggtgcctgttcgctgcgcaggttaggcctaagcgcacctgcccttcaaccctgtgccgacgaggcccgaaggcttaagctctgacctggctaccgccgccaaccagatgcggtcccctggggccacgcgccgccacgtgccgccacagggcccgcccctcccgctccaggccacgcccctcacccacagccctcggaggctctctccgcggctccgcctccaagcgacctccgcaagtcctctcgtaacccctggagtagcgccgtccccgggcggcggccccgcccccgcaatccgggccccggggctgccccgccccgccggccgctcgggaggcgcgggggcggggccctgcgcgatgacgtgcgcgggcgtgcgcggtgacggcccgcgtctctgttactcagccgagcggccgaggccggacgacgcggcttggattgcggagccgcgagcagcgatgggtaacggccgcgagcgaccaccccggacggcccctgtccccgctggcgggattccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcagcgctgaaaagggccagagtggcctgcagctctgggctgcagggcagagagcccaggcccgtggctcgggtgggaggtgtccatccagcttggcccgagcttcggtggtcagcgcgcatttctcttgagggtcatcggtggtgaccttttgactttttcaccccaccctcccatctctttgtctcgcatttgtgttcccgattcagagatggtagaaccaagtccattttaaagtaccctgatgaacactttccgtttttatttctgaaagttccctgcttggtctttactgcgaatttaataacatgttgactacatggcattgtccagtgattactatttttacctctgaaattcagcgatctttccagtagaattctggtccgtcagtccattgtgttttgagataagcatccagcaagtacctccttggcaattagaacatctgttttttcattcattcattcattcagcagctgtttagtaccgtactcagatgaagaggtttggtgtgaaggtaaagtatcctttcatggaagaggatgctttgactgaagtataatagatggacctttaaatgagacagttacataagtgatgtctgttaaggaaggtatggttatattctgggtcattttttaagcagtatatctggaagttcaagtgtaataggaagtagaattagatttggtctaaatatacaacagcttttatttatttctaaattttattttttccagtcttgcagccttacagtcatttgtaatggttacctcagattcccctgctgtggttaacgttaaacctaggaggtcagatgctctaagtgaacatgtttagtgctgtgcctgacaaaagcaagcaatcaaaatgggacttccttgagggcaggcctgtcttgcatctgtttctccaccacctagcctggaatatagtaagtgttcaataaaagtcggattgatgaaaagctctttgtaattgataatatttaaaatcaagccttaaaaaaaaccgtaatgttctccataaagttttggaagcttcatgcaactgtcgcatcagatggctaaatggtcagttcatgtacattatctgttatgatgacatgggcttttgaatcacgtgtaggtcattcactgtcctaaaataaaatcttgtctaaatatttttttaatatgataaataaagtaggttgtggagtgtgtgtttctgtgtatgtgctagtttatgtgtgtccgtgtgtgtgcatgtacgtaatccacacacaggcactcataaactggtatttcagtaggggtctaaaatgattgcatttataattttgtgaatattatttgaaagttttttggtgactcttattgtggaaaattgaggacaaaaccacataaatgttttattagaaatatttctaatattttagaaatgtttacttgaaatgtttggttttaagttctaacttgtattaacacaattggtacaaaatatgagcctaaaactcaaaataattgatttatcgaagttaaagctcttttccacttactaaatacagtttagcgtttgttttgtatttgaaagaatatgaaatgagttaactaatgagtttcttattatttgctgtaaagtggaaatgaagaaataagaaaataatacttttttaagatgatggttgaaaatctttgagataccaaagttttattgctttacctagttagggtatgtcagattctagtaggggttactgacaatcctttggcagtagctcacaggctgtgtaaagaaccagagttgtgttactttgttttccaaattgttggtttttaaaaatagctttattgcaatttaattgacataaaattcaccagttagagtgtatatatttcggtttttagtattttcacagtgttgtgccttgatcaccatcactaattccagaacattgtcatcaccccaagaagaaacaccatatccattagcagtcactctgaatttcacttcaaattatcctttaaagtaagagatatagcatcgattctgttagtaaatatattcctttagtaagtatgaaaagggctccttttaaatgtcctgtcctggcagaataggaaactatatccttcatactcctttagatcctgggggaaatgccatttggaaaggaagtcagtgcaagaataaattgtatacaaattaatgtggttataatcttaactatttgctccatgcctgatattatcaaagtgaccttgtgaggatgagatgttcagtgaaacaacttgaaggaatttgttgttaaatgactagtccccaactatcctagtgctaagaggttgttgaataggagcctgcttcttgttggtctgctttgccagcgggttgaattttgacatatttcagtcatctacatggttgagatgctttgttgcacgagtggaaatacaaaataatgtctgacattaggattccagtgctctagaggtctctggtcaagtcaatggtatgggtagtagcttttctgattcatgtggtccaaggaagtcattataaccacatagctttatatatgaatcatttgcctatgtcagtgaactgtgatgctgattgtcttaatcatgagctctttacctgaacatttagaagccttgcattcttactcttaatgcaggttaagttgaactttgatttcagaagtgagttgactgaaaggtaacaggagtattgaaatgagttatcctgtcattcaggtcaataggtggagctagagcaatccaggaatcagacctaggttcatttctcagttctgccatctggactttgtcatcaaattctggagctttaggcaagtgccttaatgtttttggctttaaaagtataaactgaggctgtcagaacttttttttatagaaggcttgttcctcagataggtggttcttgagaaaacatactaggacaaaaagagcccttcttgggtgataatcagaagcctaagttaagaacagtagtcaaagttaggattttgtaattttgtaattttcagaagccaaaaaaattgttgagttgaattttttctttaatatccagacttagaaaacaaatggaaggcttcaccataagctagagattcttggaaaggtaggcttttatttattccacagcatcatgccttctaatgagaccgtatgctcccagagactttgtggaagacataaaatgagttcattatcctcaggaagcttataatcaaggattagactgaaggcatcgctaaacagttaatttatgctcttttaaaaggtatatgaaagggttcccgccaaacaaaagcccacttcacatctctgtgcaggccaaatttcactgaaatccagtttttaaaattgtgtgtgtgtgtgtgtgtgtgtgtatgtgtgtatacgtatgtgtatggagagagacagagaggagacccctttttggaaaacttagtagcttccattctttttcttggaggtgggttatatcacaaatacaagagatacctgtgtttcctgttaccctttattatatttcagatttagttaaaatctgccattctttagaaagtcaaggaactcaaaccttacaatgattgctagcgtgggttttaaggtcagccctgagttctaatcgtgctccaatctaactaactgtggtataggctagttcaggttatataacatatttgggcctgttttattatctgtcaaatgagaataataatagcacgtaacctcatagggctgtgaggtttaaattaggtactgcatgtaaagtgcctggcactgttgtggtggctggaatgctagatacaagtattcaggtagtttttgctattgttatcacttacatttaactttgaacaaacataaaatgccaagtaaacgtcaaaccagtttaatgcacagtgtccattctaattctccagaatatgccatttgtttcactctgcatctctggggggtttatttaaaattcgatcatctcatgtaatctgaattgactgagatgatttatattaacatttggaccagtaatcctctctatcttaaaatttggaaatgttccagaagcaaatattgaagggaacatatttgccactttcacgattttttgccttttcccacaggagaaaattgcctaagctttcctaggtttgttatagacatctaaaggaatgagaatttaggagctacgaatagctttatcatgtgacacatttgaagaaaatggaatgctgtcacatcttttaaatttagtgttattgggatcttcgattctgtgaagattgcagatttgtcagagacctggtaaccacaacaattcattgaggcctggaggcctcttaaaaaatgagggagattatttattagtaccacttagaaatattatcttttctgtattttctgtggttttctaagtcttctgtttagcgtttctatgattataatggtggattaaatttcttgttccttctcaagagcatctactatgagatgacactggtttttacttcggcagtatttactgagcattgcactatactaatccaggtattcggtgatgtaggaaccaaaggaaatagaagtcagtttctgccctcagtgagctgagtataatttgatagaagataaggattaacgtaagcacatttatgtcctaacacaaggaagcaaatattgttagtcatttcattaggaatttcttttgtcattggggcatttggggccttccaaaccttacatctcttgccatgcctttgtactcactcgataaacctgagaaagcaagatatcttcttttctgattcctggtttaagttgagagtgtggtgcacattagtcaaaatccaaatcataagaaaaggcaaaccttatgaattcattttggaatacaacagggtatcaaaataagtatatgagaaatatgaaaagctgacagtagaaaagatgctactcaggtactaaccagagttctcaatctcctctgtattgaagctcttatgatgtaaggctggatctgtactagaaacactttttaaagtctctctccagtattgagaagtatagtcctccagtactgcctcttggtgctgagagactcaagcctgccacccaccatatttctggggaaactagaaacgaaaaatagccacacacaagcacttgctttgcttggcaggaaacatcaaaaccataagatgttatttcctaaaagtcattaattgggtagaaaaatcaccattttctgacttgttccaggaaggatggctttctgattttcagatgccattgggtcaaccaaaggtaagataaagaaaagctactgctgtgtggatttttctgtgacttgagaaagcgtcacttttcagttaaacaaaaaccaaagcatctagctttggctgttactattgagaatttaaaagtcttaatgttttaatttgtttacattttatattttgactaagtagtaatgaattcactttgactcaaaattccaaagatttaaaaagataaagaatctccttttctactctgtgtagccacctagttcttctgcctggaaactgttaaaattcctgtgaatacttccaaagatagtttatatatgtttaagtatataatcctttgttcaaaatccttggtccagatgtattttagaatgaaggctttttttgcagttgtggaaagataatgtagcacatctaccgtgttatccaaaatccctagtaagaggttgtagcctcatgattaaacacattaacatttctgtaaaaaatacagacataggccaggcgcggtggctcacgcctgtaatctgagcactttgggaggccgaggcgggcggatcacctgaggtcaggagtttgagaccagcttggccaacatagtgataccccgtctatactaaaaatacaaaaattagctgggcgtggtagcgtacgcctgtaatccacctacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgtactaaacttattttaaaaacgtattatgtcacagctttatggattttggctttgccaatgaaggataggtgtcatacatatatacagtactgtatagcctctgctctgctccctccctttttatttaatgtaagttgttgcatgcaatatgtatcaccttttgcttttttgttttttgcttgttggtttgttttttgagacggagtctcactcttgttgcccaggctggagtgcagtggcacagtctcagctcactgccacctctgcctccgaggttcaggtgattctcctgcctcagcctcctgagtagctgggattacaggtgatccacctgccttggcctccaaagtgctgggattacgggtgtgagccaccgcacgtggcctgctttttgttttaatatagctgagagattattttatatcagtcatatcagtatgtaaatggcatgcttttttaacatctttgtggtattccatttgtcttactctgtttgggctgctatatcaaaataccataacttgagtggtttaaacaacagaaatttatttctcacagttctggaggtcgggaagttcaagattaggctacttagtcaatttggttccctggtgagggtccttttcctggctttataggtggccggcttctggatgtatcctcacatggcccctaagagctctagtctgttcctcatcctatcatgggggctccaccctcatgacctaatatagtcatgagaggcttagttaactcctaaaggtctctcctccagatactatcaagttagagggtaggccttcaacatatgaatttggagggacacagacagtccataacatcattatactggtataccatttaactcctttctgatgcatatttaggtagttttcagacttttgctatcaaaagccatggtgcagtggattaccttgtgcatacgtcgtgttgcacttaaatgcataggataaatttccagaggtagagttcctaggccagcgtatgtgcatttgtaattttatgtattgctgaagtgtagcctgtagaggttgtccaacttccattccaccagcactgtgtaaggatgcctgcttcttattacccttagacgtctttcatcttttaagggctgtttgtgttttctttcttttgaactgtccttgtctttgcatgtttttctattgctttgttgctcattttcctagatttgtaggattaattttacaaattggctccatgctattttttggaaatgtttttccccaatttgctgttttccattctatggtaggctattatgtatggttccaactttattttcttcaccagatatccatccatttgtccctacaccatttattaaataatccatctttgtcttaactgatttaaaatgccacctttaccatttacaaaatttccacgtgtatttggtaccattgtttccattgacccatctgcctgtttgggacctgagccatcctgtttttattattgtagtttatgctgtgttttctgctaggtctaattcccttttatttctcttccttttcagaagtttttttctggcttctatcttgtttattttatatgaacttctaaaaacaacccatctagtctagtctgtacccctcctctgccagtctttctgttggaatcactttttttattttattgtggtaaaattatgcacagctagatgcacaagcattacagtccaataagtttgcctttgtatacacttgtgcaatcccagatcaaaatacagaacacttccatcacccagaaccttttcttacatccttttcaagttaccttgctccccagtgattggcttctattacatggattcagtgtactgttaggatttctttgtatttatagaataagtgacagctttatgatgtacctttatatccaagaataggaaaaacaaccttttcatttgttgaagtctcattttgagttcctgatagcatttttaaacattaaaatttttttttgctgttttatatatttaagttttttttttttttgctggaaatggcatctttttttccacttttatcttctatctggttatatataagaaagctttttattttgtatattagttaatattttatatattaaataataagccccctgtagaatatttattatttctaatagttttgtagttgaattttttatttttcttatgtcatgccagcttttttgtttcctttgatttttacctcctccctcccccaactttttatactcttatattttttcttattgcatttatagtggtgattttagaagattatagttttcctccattatatgtaaaatgagccaaaatatctgtttatctgttgagtatttaaatgttatgaataataatgaaattagggagggattatgggaatacttaaagtagtgtgaagttttctctctaaagttaatgtaacttgaaatgaattgtggttttcaaaatgttaaatggacaagttggggatcacttgatagtgaatgtaggattagcagttaactgccttgtgtcttatttgatgatacagtcatgcaccacatggtgaggtttcggtccattacagaccacatatgtgacagtggtcccataaaattataccatatttttactctattttttctatgtttagatacacaaatacttcccattgtgttacagttgcctgcagtattcagtacagtaacctgctgtacaggttcgtagcctagggtcagtaggctacaccatattatagcttaggtatgttgtactatctaggttggtgtaagtagattccatgatgtttgcacagtgacgaaattgcctaatgatgcatttctcagaaggtatccccgtccttaagcaaggtgtgactatgtgtataggctgctttctatgtgcttagcacccagaggcagctcccggaaatataatttagtctggtgtcagagagcatgcagtcaaagtagaggtcaagatatgagaagtatgaagtgaatgaatgtagacaggagggtcttaagcttggaaaaatgcaaaaatcaagtcaggaaagcacaggagtgagagggtgcaaaaagtgagtttgatttggcaactggattggggcaggttgctcatccttataaaattatatggtagttaggtacttagctgaacttcagtagagatctcattgcttaatggggattaaatagtttattttctgtctcttcttcccttcccctgctcccaccaaaaagctaaggcagttttctactgaaggacgcatacatcgttaagtaagctagaaacaaaaagttagaacctcgggaaaacaagtatccagactatcctaatggtataggagctaatgcatatttggtgcctatcatataccaggcactgttcttgtgctttatgtatgttaaattgtttaaacatcccacagcaaccctacaaggtgggcactgttactcccattttatacatgaggaaacaggcatagagagattatatgggaagttgttggtgatcttgttgggtggttttattaaagtgggaagaaagaagccaagttgaagatggttaaaaaacaatgaatgatttttctttttaaagacagggtctccctctgttgcccaggctggagtgcagtggtgtgatcgtagatcactgcagccttaaactcctgggttcaagtgaatcttcctgtctcagcctccagcctcccgagtagctgggactcggctggcgaatttttaagttttttgtaaagatggggtctcactgtgttgcctaggctggtctgaaactcctggcctcatgtgatcttaccacctccgcctcccaaagtgctgggattataggcgtgagccaccacacccagcccctgaatgaaacactttgaaaaagagtgagaaatgagcaagtgctgacacagtgggtgcagaccactcttttaagattagctctgaagtgaacaaagaaatgggttggtggataaaggaaattgtgaggctcagaaaatgagtgaaaatggcattgctgtatgtaggaaaggggatgcagagtacgggtagagagtttggccctcagtagaggagagatcttttccatctaacaggaggaaatgcagaaaagttgtgtgcccttgcgaggaagtttggaagttggaaggtgaaggcctattctcctggctttcatcttctctgtggtttctgtttgctcaatgaagcatgagattcatacgggcagaaagggatgggagtttggggagtttgaagcagtttgccaagaagtattgattgttcatttaaggtttaaaatcttgaatttaaagtgatatcagtcagcctggttttgtgaccccccacccccccagcattatttagctgattagttacaggcacagattaaggcaggtagttgaatttacccagggtgagattttgccaggtgtattagagttctccagagaaacagcaaatcggagttataggtaggtagactgagattttaaggcatttgtttttgtgagggctggcaagtctgaaatctgtagggcaggcaggaaattcttggtcaggagttaatactgcagccttgaggcagaattttgtttttctcagggaaacttgtttttgctattaaagccttaccaagtgattggatgaggcctacccacggtatcaaggataagctcctgtacttaaacttgactgtttgtagatattaatcacatctacaaaataccttcacagcaactacattagtgtttgaataactgggtactacagactagccaaattgacacttaaaactaaccatcacaccagatcagttcaaaagaaggaaagggggacaagggaaataaggaccttttaactagaatgcttattgtgtggtggtggttgagtgtgtaactggccacagggtttgagtaagttaacttgaaagattgaatgccatggtcagagtggaatacctgaaagagagatttcacaagtatgacaattattgacattaataatgctcaggttaactttgggtgtgggcttccgaggtggaattcagagacaaatcctgaacgtgaggaggccaatgagttaaagagtctgaggtattaaaaaagggtcagtctgcatgcatggtgaaatcagcaactagtgaggggagtaagggtacgtactgtaaaccagttgtaatgtcctcaatgaataaggaagaattggagggaggctagacgaacaagaaaggttaaaggtagtgtaacaggctaagtttgcttgtcacaaattgggaatttcagaaggccaagtaaaggaattaggaggatgaagaattgagtcaaatggaggacgtacacagcagtgtggcagtgagaattcagagaataatagataaccagggagagctggattttttctggtgaccataagcagggatgtgaggtatgagaggattagtcctgatacaggagatggtggttatcacttttagtgttgtaggactctgtggcagtgctttcagactgttactcatgacccattagtaggttatagaattttgggagatcacaatttctgttacgttgttaaaagaaatgaaatagaaaataccatagtgtgtcatgtgtaataagggactaagaattttttaacggttttattgagatataattcacataccattatagttatctatttgaaatatacagctcaaagcttttttagtatattcctggaataatggagccatcatcacagcctaactttagaacatgtttgtcaccccagaaagtaacctcatactcactagcagtcactccccatttcttcacacacaccccctcctctccctggccctaaacagccacttacccactttcttctctatagttttgttcattctggctatctcttttttatttttttgagatgacgtcttgctctgttgcccaggctggagtgcagtggcgtgatcccggctctctacagcctccacctcccgggttcaagcaattctcctgcctcagcctcccgagtagctgcgattacaggtgcctgccactaggcctggctaatttttttgtatttttagtagaaacagggtttcaccatgttggccaggctgatcttgaactccttaccccaagtgatctacccacttcagcctccaaaagtgctgggattacaggtgtgagccactgcacccagcgcattctggatctttcatgtaagtggaatcatacactgtgcgatcttttgtgattggcttatttcacttagcatgatgtttttaaggttcatgtatcatgtatcagtacttcgtttctgtttttttttcttttctttttttttgagacagagtttcacccttgttgcccaggctggagtgcaatggcgtgatcttggctcactgcaacctctgccttcctggttcaagtgattctcctacctcagcctccccagtagttgggattacaggcgcatgccaccactgccagcttattttgtatttttggtagagatagggtttctccatgttggtcaggctggtgttgaactcctgacctcaggtgatcccccaccttggcctcccaagtgctgggatttcaggtgtgagccactgctcggccttttttttttttttttttttttttttttttttaaattagatcaggtcttgctctgtcaccctgttacccaggctggagtgcagtaccatgatcgtggctcactacaggctgaaactcctgggctgaagcaatcctcctgcctcagcctcttgagtagctgggaccacaggcacatgccaccacacctggctaattttaaattttttgtagaggcaggctctccctatgtttcccaggctggtcttgaactcctggcctcaagttatcctcccaccttgagctcccaaagtgctgctgagattagaggcatgaaccacagtgcctgaccttcatttctttttatggtgaaatattatttggttgtacgatatgccacattttatttacctacacttcatttgatgggcatttggattgtttacactttttggctatagtaagtaatatagtacacaagttatgaatatgaacatttgtacacaagtttttttgtgttgtatgttttcatttctcttgggtatgtatccaagagtggaattgctgggtcatatgggtaactctatgcttattattttgaagaactgccaaactgtttttcaaagtggctgcaccattttacatttccaccagcaaggtgtgaagattccaaattctccacatcctattcaagcttgttattgtctgtcttgaaaatagccacctgatgagagtgaagtgatagcccattgtgattttaaattgcacttccctgatagctaatgatattgaacatagtttcatgtgcttcttggccacttttatatcttctggagaagtatttcagattctttgcctattttaaaaattgagttatttatctttttattacgttgtaagagtttttttttttttttttttttttaagagatggggttcttgctctgtcacccatcctggagtgcagtgatgcaacctgggctcactgcagcctcaaactcttgtacacaaatgatcctccctccccagcctcacaagtagctaggaccacaggtgtgccctgctaatttttaaaattttttgtagagatggggtctcactgtgccgcctaggtgctgtaactcctgggctcaagtgatcctcccaccttggcctccaaaagtgctgggattacaaacatgagcttcctcgcctggccaaagagttctttatatattatagatacaagttgcataacagatgtatggtttataaatattttctcctgtttcagaggtagtctttttactttcttgatggcatcatttgtagcacaaaaagttttaatttcaataaagaaatccaatgtatttgtttttcccttgtgcttttggaatcttttataagaagccaatgcttaactcaaggtcatgaagacaacttctgcattttcttctgagttttatagttttagctcttacatttaggtctgtgatccattttgagttaattttatggtgtatggtataaggaaggcatgtgaggtaattcttttgcatatagacatgcagttgtcctagctccatttgttgaaaatactgttctttcttaccaaattgtcttgggcattcttgaaaaaaaggcagatttatttctggactctgaattctattccattgatctatgtgtctattcttaggttcccacggtgtgttgattactgtagttcagaattttttgaaagttgtgtttcacatagatgtgtgagtatatttatatatagatacacacagaggtgtgtgtgtaatgggttatgttggaaaatgttggaaaacctatggtgtctccccattagttcactcgcttgtggcaacttagtggagtatgttccctctcaggtaatatacagagaagacaggttagagggtctgtctgtgagtgtatgaattccttttagattggatgactgatttttcttactttagtaaagttttcaagtgcatgtggactgaagggcagtaaggagggcatagaacagctatgggaattcctaaagaattcatcagagatgaatgtaacgattatggagtgaagtatttgaaattttgaagttagcagggttttgtactgtgccagtctttcatgatttaaaaaaaaaaaaacttttttgaatatattaagcatgtctgtgtcggataacttaagacattatataaggaaaattatatagataatttaaggtttgggaatgatgctatctccttctagagaggatttttgttgactttggcaggaggcaagctagtggcactagcaatcccgaatcatcttaatccagtcagagactatgatgtttcaaaactgggttccggagtctacgaaggctggtctattttatgttttatttacttctaggtatgaccccttggagttctagcataaagccagggatgttatcagccccacatgcccccaccctcacactttcttgggcccttaactccaatatttaatcctctctagtcatgtaaatctattgcaagttcaagctcagcttctcagccacgtctttggaattggcagatcccttcagggggagaaatggccccggatgccagactcccttatgagcttttccttactctcccagatcttggtcttcatgctttttcactaccttggcactctgatgccctcaaacaggttttttggttttgatttttaaaacattttttctggggacttgggcaggtgtccagtttttctagttgctctcagtacgataattggtttgaattatctagttcaccattttaaggaaagcgatttgttaggttgatcaaggtttatgtcataagattctctgtttgaaattgtagtatatgtggtttcagtttttcctgagggtaagattttgggtaccagtttctacagattatagaaattattagaaaagggggaaatagccttaggaatagaaatgggagggaaaatggcagagaaaactagatatttttgcaaagtttgggaaagataaaggtatagggtaacattttcatgtctattaggagtgtaaaagggcattcatgtatcaaaggcgctgacatatttgttgtaatgatattgtcataattaaaaggctgtagaatctaggtattgtgggggtggctttgagaagtatctacttagtcgtgttgaataaaatttttaaatttcgcagagaaaccctaggatactgagtcattaattgaaggagtcaactttggggctggacttatggttgtgtcttatagcagtataaatctgcgcagccagtagtatgtaagggattgcagaaagaatttaatttcatagaacccattattaatatgagagatacaaaatgatactgattttgatttagcatgccatcttcatttatgtatgaaaataaatgtaaggtcttaaagagtttttgtttttgattctctaagctattcccatacttcttaaatttcaaaattacaaagttttccatacatcttaatcattataattgaggaaaaatggtatatctttaatagccccttcttctcttgagaaaatgatagatactgggtgtatttcagaaggttttatcagcagagttttggttgatattttaaactttttgaggataggaattgtttagtaaaatgatgccctctcttttttggctccatcttccagtatatgtgtcataggaacctggtttaagttcagtgtgtttctttgttacacctgtcagtagaatcggctattactgttttttggttccttacaactgaacattttggtcaccgtcctcacccactttttaaagtgacttcattctcccacatcactcccaactgaagaatgttcagacatacacattgaaagaatattacggtaaacacctgtatacttcatttggatattgtggttgttagcttttttgtcatattcgtttatgtctctcctaaaagtaaacacattctcttacatatgtcatacttaagcccttaatatctagttcatattcaagttttgctaattattcccccaaaaggtcagtttgtgctgcaaccaggtactgtgatttctcacctagtttccatagctcttgtgaaggtgttttcgtgcatggatagtgttcaaattgatgtttctgttaggggacaatcactggagagtcctattcttccatcttattctgcccctctcctccaaaaaggtcaacttgtaactgcttttttcaaaccaatattcaatcagtttatgaaccacatttgatcgttgttgctttagtcacttatacaacagttgtcctgttttctagttttttttttttttttttacactcatgatattggcttcttgaagagaccaggccatttgtcatatagaatgtttcgcatattttggatttgtctgattttcttgtagcaattaacttttatctcaattcccactgtatttcctaaagtagaagattgagcctaaagactggattatatttagttttttttggcttagttactcctgtgtacgttatattgactcataacacaggcatcaggtggtttgcctaaagtgtgatcatttggtgttaaggtggtattcaccagatctatccattataacaatgggtttccccttgacaatcagcagatcagtgagatgacgttttggttccctttgaatatcctgttttccagcagccttttacctgtgtgttgagtctcttggtgagctttgaatcagttatttcatttgggcttgcaaatggtgtttttttgtttttgttttttgtttttctaaccctatcatccttttttttttgagatggagtcttgctctgtcacccaggctggagtgcagtggcacaatctctggtcactgcaacctccacctcctgggttcaagcgattctctcacctctgcctcccgagtagctgggactacaggcacgtgccaccatgcctggctaattttcatatttttagtagagatggggtttcaccatattggccaggctggtctcgaactcctgacctcaagtgatctgcccaccttggcctcccgcctgtcatccttcttgatcaattaatattaaccagctttcctctgttaagaagacctttccctcttgtcaactgggattgaactacagttcttcctaacaagatgagataaatgtttatttctcttcaatataccaactctttttaacataccaattttgaaaatttaaccaatttggagtagtcatcttcaaaaagtggcacataactttcagtctctctgtatcacagggatttttgtttttttcagaagttttatgatcatttcagtcattctttttaaaatagtcttcatttgtagaagttttagttttacagaaaaattgagtatatactacagtttccatataccccagacccaatttctcctataattaacatcgtatgtttgcatggcacatttattacaattagtgaaaagtattggtacattattaactaaaatccatagcttattcagcttttcttagtttttagctagtgtttttgttttgttttttcaagatcccatctggaataccacattacattttgttgtcatatctccttaggatttcttagctgtgagtttctcagatattcctttttgtgattaccttgactgctcaaatattttgtaggataccgttttattggaatttgatgtttttctcatttttagactggccttatgggtttctagaaggaaaatcacagaggtaaagcatcatttcatcacatcctgtcaagggtatgtactgttaacataatttatgacttgattttgactttgatcacctggctgaggtaatgtttgtctgatttttccattgtaaagttactcttttttcctccttttcatactgtaatactggggaaaggtgaccatgcacagcccacactttagggagttatgtcctgcttcttgatggcagagtatctacataaattattaatatttggaatccttctgtgcaggagatttttattttctcccatttagtaatttgttcagtcatttatatcagtatggactcatggttgcttattttatactttgggttatagtccaatactattaatacttaattttgctacacacattgtttcagatttggccattgggaacccctttagttagctcctgtgcctgtgacatacttccatcggtgtgggtgttttgtgagcacttactttctggcactgcaggatactcccagctcatcttgtatgttttctaccctagtcctgggatcagccgtttctctaaggagcactgtttcctttaattagaaaatggtattagaaacaaagatctaggtgcccttgttgctactgggatgttgtgttttaggtactctcagcagatagagcaaataaatatattcatatattagaaatatctgtatatctatgtgtctagagagagatataagtatttaatattatatatcagtatttatatgtgcataaatatttgtaaccatctgtatctatataagctaaacatgaattcttaatgtcttcaactctaatctattaccatacggatcattcctggtcctcccgttactgaccagtaaatttcctccaatagcgggaaacctgcctcccagcacacaccatttatttacttagttgttcaattccaacataggtcttatagcagtatcagaattgttaactcacacccaatggaaacagctgtatcaactaggagtgttttttgtttgtttgtttgttttttgttgttcaattcttcagaaatttctaagtggacaatcatgtcatctgcaaacagaaacagttttatttcttttcccccctccgtctgcatgccttttcttcccttttattgtcttattgcagtatttaggactttaggtatgatgttgaataggagtaatgggaggagacatttttgccttattcttgttcttggggggaaagtagtttttcaccattaagtactatgttcactgtagagggttttttgaggggagtagagtagatttttttaaaaaatcaaattgaggaaattcttctccattcttggttttctgaccgttttcatcatgagtggtgttagattttgtcagacgctttgtctgcatccattgatatgaccatttgatttatcttcattagcctgttgatgtggtggattagggttacattagtagattttagaaccagccttgcatacctgggataaatctctcctggttatggtgaataattccttttctacattattggattcaatttactaatattttgttgaggatttttgttacctgtgttcatgaaagatactggtctgtagctttcttttcttaccatctctttgttttattattattagagtaaggctgctcttttagaataagtcaggaaatgttccttctgtttttattttctgcaagagattgtagagaattggtatcacttttttccttaaatgtttggaataattcaccagtaaaactgttcaggcctggtgttttctgttttaaaaggttaataactgttgattcaattttctaatagatacagatctattcagattattgatatagtttctttaatagttaacaggtttgttcaggttatctgtttttctttgtgagaactttggtagattgtgtctttcacagaatattggcttatttcatcttactaaatttttggtgtacagagttgttcatagtattcctttgttgtacttttaatgtacttgggataagtaatgatgacccctcttccatttgttacattagtaatttgtgccttctctctttttcttcttttgttttttttgagacaaagagtctcactgtcacccaggctggaatgcagtggtgcgatcttggctcactgcaacctcagcctcctgggttcaagcgattttcctgcctcagccttccaagtagctgggattacaggtacatgccgccatgcccagctaatttttgtattttttagtagaaatggggatttcaccatgttggccagggtggtctcgaacttcttgattagtctggctagaggtttaacagttttatttatattttcaatgagccagcttttttttttttctttgtattttcctgtttttaatttcactgattttgactgtaattcttttttttcttctgctcactttaggtgttactctttttgatgatcagttgtctcacatttggccagtgagagtctcttgaggtggctgctgtgtccattttgatctgacctggttgatcgttgaatgcttccttgctttctggcaggataaaatgtatttcaacctgtacttatcttgccttaacctgggacactccttttctttaggaagttggcttcagtcttaattttatgtgattgctcacttctttcatctaaactttaaacagatttgacacattgagatcagcacttttgcctttttttggtagtcaacaagagcaactgaggtgtcctgttgatgctagtatttaatgtcttaaaacttgtcttaaaaacagaacattttcctgttcaatttatataagcaaaaagacactttaactgtatccagccaaactcttctatggcatctctgaaagtaatttatactttgccagtttgtacttttgctaagagatagttgaaaaccacacctttttaagaagttcagaaattgaggatgcggtattctgaattatctaatttgatttttctgcatctctacagttgtttcattacttagtaaagcgtttccaactttagcttcagggtttttcttttacttttaacaaatattatgtgccaacacttacaaatagtaactcatttaattattttaaccttgctggtagatatggttattctcctctctccctcatagatggggaaactcaggcaagatgaagttaagtaacttgcgcagggtcatacacgagtggcagggccagagtctgaatccagacagttggctccagacgccagactcctagccactgctttgtgctgcccctctttcctctgctagttaagtcgaaaaagttgtttgtgattctgcatcttgctttcctcttctcttattaattatagtataatgggtgtcactcttattaccataagccttagtatggcattgcgagcaccagttaattaagcaataacgttttgagatccctaattggaagaattcagagcggtgtattgctttgagttagttggccctttgctgcaactctggccatgagacaacgttatcttgaatagtgataatgtgtaaaaagatgaggcctccttttttttttaaaaaaaaaattaaattcatttagagtatgaattttaaagtagtgtagtcagtgatgatataagatcaaagaataagtgaaaacacttcataaggcacagagagctaaatgtgtgtaactgttttattggtgtacatagttactgctggaactacagaggaagaatcattattttatgggaagaacatatgttactggaaatcctagattcttagatcacaattctaaattccagttctttgatgtgttaacatagggtccattgcatcctatttactggtttatttttatccttgctctgcttcttcataattgtaattaagtaaaactttctggttccccaaggtcagggcatactctttttgaaaataatattaactactgctgatgagaggaagagagcaacaggaagcatttaaaaaaattttttttaaactaacggcaaatataaaatatttaggaaaaaggtaaagattaaaagtacctatagctagtaatattttggtgtacttctttttatgtattttgtgcacatgtgagagagatttatatacatgggtacacacatgtataatttgtaaggatacaaaaatcatattagcttacgttaattgaggactagagtactgataactgcttttatttaagtctaggaaatagattttgtttaaaagaaatgtattcttaatagagaaataatttttataaaataagagatttgcagcattgctttttttgtataagtatgctaagactgccatctctttatttaacaggaaggagttttaaactttaacttaataggaagatgtttcaggggttctctgaagtcaagaatgttttcatataatactagaagtgttatttgcctttttcatgtctgttctcaagagtttttctgaggccatgtgacttgccctgtgatgtggcaacagactgtatagaagcaaatgagagaacccagctgtctgaaattaagccagaccataaagggatttgcagaaatgtagaacaatgtgtgagaaacacattcacccgtccaaacccgatgaatggactcagagacatgaagaacagcggaagtgagactttcaatggcagtcttgcaagatcaggtgtctggtaggcaggcacacccggggcaggtacagcaggtaatttatctcctagcacgcaggtctcttccccagttcctcactggtcgagtactatggggttacagtcttcccggacgttgcctaagtttcattatcccccttaaaaggttatactccagtccccttccccccgtaactttcaatttcccaatagcaaaactttcttcccttttatgggctgacccctcctctacattctgatcacttatcatgactttataggtgcatgagccatgcaatttgtcacatccgcaggctgactgccagtacttagatttgtttctcggtctagaatggatggattgtcattggtgatgagtataggattgcattctaaattgtggcagttatttggcagggagcccttggacagatgtagtttattcttcaagggtctccagcttagagttacccaccccgtttactgtccaaccctgaaaatgggtagtctaccatacatcatcccagctgggtggggcaggatgatgctctactgtaacctgtatctggttcagggcaaagatacttatctgcctgcgagagctatccctgattttccaaattcccacaaggtaagacctggcaggcatcaaatcttacagtctgggatgctactgtcttggttacactaattaccaacctcattggatagggaggagtcccctgccagtttccattttgaccttctgctttttgtatagtagcccatcccagccatattaacttcgagaaatggggccaacccatgttttctttttagatttttctcagagttaactttaagggttcctcagtgcactttccactggtcttttcccctcccttccagggtctcttttaccaatcccttgactcaaggatagtgagtccacccctgttcagctgtttgcacagctatcttagtggggaccttcccagcttgggtggagcttgtcttctttccaaatcttaatcagcaccaagttgccaggctggaagtggtgaaccgtgaactcaagaggtggcatttgagtcagaagtcctcttaacctaagggatgacagggtggaggatatggccagtatataatttcttaagcattgatccatggtttccatagtagggaggatctgtagctctgcccaaatatgggtgcccctataataactcatagggggataatcccaagtattttcttggggctgtcataatcctaaggagtactattgggagacatttggtccagggtattttagtttctagattagtttggtgattatgctttttgagagtttgattcattctttctacctttccagaggaagggggatgccaaggggtatgataatctcatctaatttgtaaaccttccataattccccttaacacccttgagataaagtggctcccattgtttgaatcaatattttctaccaggtcaaatctaggtacagtctgttctaatattattttgaccacattactggcagtggctgttggaaggggaaaggcttccacccagctggaaaggtgacctacgatcaccagtaaatatatcagtcttcctcctttgggcatttctgtgaaatctacttgaatgctttgaaatggtcttagtctgggaggtcttcctcctgtggcctgttttctgatcacctttttgtttatcctttgacaagttacgcaacttccacatacttgtttagcaggggtataaatccctgtacacccataccctgttgcatcatgcagagtcggggatccccaatgactccttttgtgtaatatagacgttagctctctcatcaggggtttacttatttttcttccatcgggaagtatccatctcatcttcagtttgagtgacccctatcctgtctaattcttctttctcctctctgataaactggggccttaatactaccttagggatgtctgggatcaggctaaatagtctaatttcttcctccagggaggcttgcttagcagcttcagctgcaaacctgtttgctacagcttctgtggtgttccctttctgaaaaccatttacatgaactatggctacctctgctggaagcaagaggctttctaaaacctgtttggccagttccaaatgtaccaattattttctcctgctatttattaggccccactctgtccagatttttccaaaagtgtgtaccactttggattttaagtaggcatacttaaattcagtgtatatagtgcctttttggccttcagggagctttagggcctggttaagagcataataattcacaggtttgggctaaccagcaattaggtaatcttcctttctcacataaggagtgtttatttccatcaatgacaccatcactgttatgtcccttgccatctgtcactggagacagcccatccacaaacagccttatctcatcatgtagtagagcttccctaaggtctggtctaactttggtttggtattctatgatacctaagcagttatgatctgatgtctctttgttctcctctcctttccctagaaaactgtctggattcaggcaagtatttgttgttacgaccaagtcatctttttctagtaatacagcctcatattttagaatccgagaatcagttaaccatcttccagctctttgatttaatatattcctgactaggtgtggggtgcttactattagggccccaccaaaggttagctttctagtctcctctaccagcaagtctgtggcagctattgtttgcacacatttgggctacccttgagagacaggattgagaagcttggagacaaaagcagcaggttgccttttcccaccccatatttgagtgagcactccaagggccatgccctagtctactgttagaaacaggtggaatgggttctctaaagatgggagggccagggctgtaatgagggcctggtttagctctttcactgcctgaatttcttctgaggaccactgcaagtgatcaggttcctcttctaataacttgaccggccggatgcaacagggaaagaagaaggggtggggacacggggcagagccagtcctcctgtttggggcctgggcctaggaaagctaactaggggcaggaaaggggagccccaggctgtggatgcctctgcgggggaacgttgggtcagcaacggccagaggaaatcctaaggccaaacagtatctgtggcctccctacctttgggcatcttctggtcgccaatttgctgcaagtcacagctcccaaatctggttgtgcaggctccaaagcagtggagcctggcttttctgccatctccacctcctggatctcagagctgctggatggctccacccaccacccgctgagctggccccacttggggctggcattggtggacagcatgttccgggcgcctctgctcctctttgctggggcctgcacctttcctggctgctgactcatagatgtcagagctgcaggacggctccacagaagccctgtgtttaggacacctcattagtgaaggagagtggagagtaaacccaagggactatccagaggaatgtcagatggagtctctttggctccctctttcctttgtcccctaagcctagaatttctgtttctcattttcagtcagtctctgtgtctgagcttttccctgtgtactcaactccccaactggaggtttcttgcacacctcgagaatcgctttgtctgtctctggccgtttccctcgcagaacggaactgcagattgggactctgcacttgccttatatctgggatacgtctcagtcacacacactcgacctccaaaaatgcccaaccaccaaggcagtacttagagtccaattttcctaccttggcttgtgcatgaggtttcctggttgctgcagtgcctgcttttctccgtatgtcacctccactgcctcctgaataacagtctcaggtttgtctatggcctttgcaaggagctgggacactcagacagagcgggccacctaaatcgggtgagattcatctcccttttcggccggagtctgactctacgccggcataaagatcccagacgggcccccaagtttgtaagggaaacattcacccgtccaaacccaaataatggactcggagacatgaagaacagcggaagtaagacttttagtggcagtcttgcaagatctaggtgtctggtaggcacacacacccacggcagttacagcaggtaatttatctcctagcacgcaagtctctcccccatttcctcactggtcgagtactatggggttacaatcttcccagacgttgcctaagtttcattatcccccttataaggttataccccagtccccttcctcacttaagtttcgattttccgatagcaaaacttttccctttcatgggctgacccctcctctacattctgatcacttatagtgactttctaggtgcatgagctgtgtggtttgtcacatctgcaggttgactgccagtacttagatttagcatgccttgaaaatggatcatttaaaatgttttctcacacaatggcactcttttcaccaggttttccttttttttaaattgtcgttttccatcaaaattctagttaatcatgcagtggaagtttattatgtttaaataaattttaaaaagtttaagtgctcacttctgtttaatatattaaatattgatatatcaacataaataaaagcttctgttaacaaagttctttgtttaaaaagtataaaggaatagtgataaccaaaaagtttgacagctgccatattatataatatcaaaaaattatttattacttactactcatctcaccagcaaaatcattggatcctgcacagggatagatacaaattttgcaaaattttaattttcacttgatagttttaattttttcattggcaataaatactgtcatttatttttcttgaagtgataggcacactttgttcattttcaagaaaatgtcttccacataccctagcccaaataacatagtttgtgtgtcattctttcaagtaaaaattgtattatttaaaaacatgtctcacaagtgcttttcctgcaatggcccctgtacttcagtatatagcaacagtgcttatgtatacttcccatttcatcataacagataatgtggatattcctcttttatatgtgctacaccagaatttaacaaggtaactgcagggagaatctgaaactatattaataaatttttcatattctattatattaaaatccatttgtctatcttgcgttttaaatgagtgttttgcccatttataagtttgaaacatcatgtattagtcatttggaaaatactgatttagtgaggcctgcagatctttcaaatgtgtttctttataccaccattgtcatagtgtggtttgaggactgacagggctagcagaaaactccatctgtatcaggtatttgacggtcaagatttatgtaattaagaatttttggaaatagtaagattgttaaatttctaccctgactgatgagtattaaaaaaaagaaccacagattatcagtatgtggagtgaaagatggacatcacaacatatatggcagatattaaaagaataaaggaatattataaacactcaaaagctaagaaacaatgtagatgaaatggaacactcttttaaaaaatattcattgcccagatttacacaagaaaacagctacgtatttattaaggaaattaaatttgcagtaaaaaagttcctcacaggccctgtgatatcatgagggaataatttgatgtggctcctacttctaaaagcagcaattctcaaactttttaagagttttggaatgtctgtgttgttaaaaattattgaatatctcaaggtgctttatataggctatagctattgaaatttactctattagaaattaaaactaagaactctaaaaaatatttattcatcagttcattgacaaagtaataacccagttaaagttaacataaaattttatgaaaaataactttttcaaaagaaaaaataatataacctattgtgataaccctgtgggttgcttagcccctggaaaactgctgtacacatgtaagagaatgccagtgaaaaaggcaaaaggtaggcatttctggaatggaacttttatttctcagcactttataggttttttaaagagaaggtgttgctattgttgtatcagataacacagatattaaaccaacaacagtaacaaaagacaagggcattatataatgacaaaggatttaattcaacaagatttgtatctcctaggtatatatgccatacccagtgttgtagcacccacatttataaaacaaatactactagacttaggaaaacgagacaaccacacaataatagtggaggactgcaacagcccactgacagcactggacagatcaccgcagaaaactaacaaattctcgacttaaattgaagttttgaccaaatggacgtaatacacacgtacagaataccctacccaacaaccacagaatacacattttactcatctttgcatgctctaaaaatgaccacatgctcagtcataaagcaagtctcaataaattcaaaaaagcagaaatcataccaagcatctgtttggaccacagttgaataaaattagaaatcaataccaagaataactctgaaagccacgtaagtacatggaaatgaaacagtttgctcctgaatgacgtttggctaaacaaaattaaggcagaaatacaatttttttttggaacaaatgaaaatagaaacaatatatgaaaacctctaggatatagcaaaatagagttaagaggaaaattttagtgctaaattcctacatcaaaagaaagatctcaaattaacaacctaacattgcccctaaaggaactagcaaaataagaacaaaccaacctgaaagctagcagaacaaaagaaataacaaagatttgtgcagaactaaacagaattgagaccaaaaaattacacacagaatcaacaaaacggaaagttctgtttgtccttctaaagggtaaacaaaattgatagactgccagctagatgaaccaagaaaagagagaagattcaaataagcacaaaaatggcaaagatgtcattacagtggataccatagaaatacaaagatccttagagactactgtggacatttttatgtgcacaaactagaaaatttagaggaaatagataaacatctggaagcacacagccttccaagagtgaaccaggaagaaatcaaaatcctgaacagaccaataacgagttataacgttgaatacataataaaatctaccaaccacaaaaagccctgaaccaaaaggattcatagccagattttactagatgttggtagaagagctgataccaatcttactgaaactattccaaaaaaatcaaggtggagagatatcctccctaactcattctttgaaaccagtatcatcccaatatcaaaatctagcaaggacacaacaacaaaaagaaaaacagaaatgcaggccagcatccctgatgaagatagaggcaaaaatcctcaacaaaatactagcagactgaatctagcagcacataaaaaagataattcaccatgatcaggtaggttttttcctagatacaaggatggttcagaatacacaaatcaataaatgtaattcaccacataaacagaattaaaaaacaaaaaccatattcttatgcagtaaaatccagcatctctccatgataaaacctcaacaacctaggcatcagaggaacatacctcaaaatagtaagagtcatttatgacatacccacagccaacatcatcctgaatgagcaaaagttgaaagcatttcccctaagaaccagaacaagacaaggatgtccactctcaccattccttttcaacatagtactagaagttctagccaaagcaatcagacaaaagaaataaaagatgtccaaataggcaaagaggaagtcaaattatatgcttgttgatgacatgatcctgtacctaaaaaaaccctgaaagattccccgaaagactcctggacctgagaaacaactccagtaaagtttgaggatacaaaataaatgtacaaaaatcactggcatttctatacaccaataacattcaagctgagagccaaattaagaactaatttacaatagacacacacaaacacacacaccacacacacacaatatctagaattacatttaaccaaggaagggaaagatctctacaaagaactgtaaaacactgatgaaagaattcatagatgacacaaacaaatggaagaaacgtcccatgcttgtagattgaaagaatcaacattgttaaatgaccatactgcccaaagcaatctacaacttcaatataattcctatcaaattaccaatgtgattttttttcacagaattagaaaagacaattctaatattcatgtggaaatacaaaagagcctaaataggtagagcgatctaagcaaaaggaacaaagccagaggcatcatattacccaacttcagactatactgcaaggctattgtaaccaaaatagcacggaattggtacaaagatagacacatacatcaatggaacaaaatagagaacccagaaataaagccacacacctgctatgaactgatcttcaactgagtcaacaaaaataagcaatagagaaaggataccctattcaataaatggtgctgggaaaactggctagccatatgtagaagaatgaaaatagactcctacctctcactatatacaaaaattaactcaagatggattaaagacttatttaagacctccagctataaaaattctagaagaaaacctaggaaaatatcttttgaacatttaaagaatttatgactaagatcccaaaagcaaatgcaacaaaaacaaaactagacaagtggggtttcattacagagcttctgcacagcaaaagaaacaaacagggtaaacagcgtacagaatggaagaaagtatttgcaaactatatatccagtaaaggactgatatccataataaataaggaatttgaatcaataagaaaaaataactcgattaaaaagtggcaaaggacatgaacagaccttctcaaaagaagacatacgagtggcgaaaaaaggtgaaataatgtgcaacatcactaatcatcagagaaatgaaattgaaaccacagcaagataccatctcatagcagttagatggctgttattaaaaagtaataaaataagacatgttggtgaggatgcagagaaaagggaacgcttacacgctgttggtgggaatgtaaattagtacaacccctatggaaaacattctggagatttctcaaagaactaaaaatagaactaccattcaaaccagcagtctcattactgggtatctacccaaaggaagagaaatggttttatcataaagacagctgtgcttgcatgtttgttgcatgcagcactattcacaatagcagaggcacagaatcaagtgttcatcaacagtggattagataaaagaaaatgtggtacatatgcaccatggatactacagagccataatcaggaatgaaataatgtcctttacagcaacgtggatgcagctggaggccattatcaagtgaattaatgcagaaacagaaaaataccgtatgttcttacttataagtgggagctaaacagtgggtacacatggacgcaaagatggaaacagtagacactagtgactccaaaaggaggctgagggggtagggttgaaaacctccctcctgggtactatgttcactatttgtgtgatgagttcaacagaagctcagaccccagaattatgcaatgtacccatgtaacaaacctgcgtatgtgccccctgaatctatacttaaaataaatatactcataattctctattaaatataattttcactataaaacaaagttttagttttcttatctctgacttgtgtagtttcagatgagaagtctgttgtaattcttagtgtttctgaataagttctaggaattgttcatcttatagtttcctggcatttgccctttgcctaagacttgtgaggttttgctttatgcatgtgcaaattagtattcaaacaaaaacataagaggatccctatgccaatttctggtgctctctattctctgaatctctctcttctctctatactgccctacaaattctactcaccttcacctccttgatctgtctcctcaacttggcaaagtttccatactgtgtttggtgtgaccctttctgcacagtgttctggaaagagcctcctgccagaatggcaggacagttataggacttacctaatttgttttccttctgtctgttgctagtgtctgacaacagtttcttatattctgtccaatttctagttgttactgtaagagggtaaatctgatcccaattactctaccatgttagaagcagaagttatattaatttttatttttagagttgcctcaagaactgctgttctaaaataaactgaaccctatttaatatataatggataatactggacagtgaaatattttttccttaggaaaatctaaacagctgtgggtctgggttaaaccatattaacagccttgctaatgaaatgtaaaaagtaaaagaagaaacgttaggtgcttccaggacactcatacttgaagtacaggttgaacatcccaaatccagacatctgaaatctgaaatgctccaaaatatgaaactttttgaatgccagcatgacgctcaaaggaaatgcttattcaagcatttgggatttgggatgctcaactggcacatatataatgcagatattccaaaatctgaaaaaattagaaatgaaacactttttggttacaagcattttggataaaagatactcaagctatagtagatttcatttttcaattggtaaatactgtttggtgcttattatgcgccaggcagtatgcttagacttcaagatgagtaaatacaacaagcattacctatcttcttggagtttatagtctagtgaagaagaggattaattgtaaaaataaacaattagaactctgatgagtacaatgaaagagaagaacatggtgccatgaaagtatataaagatacctgatttaggatggacagacagggaaagcttccctgagaagctggtagctgagctgaaatttgatacttgaaggatgagcaggagctcaatagtaaggagaaggaagtaagttgagtagaacatttgcacagcaatctaggctgagggaaagcacatgcagaagcgatcaggagagagcctggcatatgccaaggaactgagggaaggctaatgcagttggactgcagagagcaatgttttggagggagtggtggaagatgtggcaggagaagtatgcagggcctatatcacacaagactgagtacaagttattcagaatttattcattcattcatttatttattgagacggggtctctgttgcttaggctgcagtgcagtggcgctgtcacggctgatcacagcctcaacttcccaggctcaagcgattctcccacctcagcctcccaagtatctgggactacaggcacacaccacctcgcccatccatttttaaaatattttgtagagacaaggtctcaccatgttgcccaggctggtcttgaacttcctggtctcaagcagtcctcccacctcagcctccaaaaatgttggaattacagccatgagccaccacacctggccataattttattttttataaaaaaaaattttacaataaaattcagatttgttcttattgggagaacagtagaagtcattgaatgaggaatcagtgagcagattttaaataagaaaacataattttgttattgtgaagaatggatagaatatggcaaacctattagggaactattgcagttatccaggaagacatgatggtagcttgaaatgtagtcgtgtgaatggattcaagagagatttagagggtaacagtataatcaacctgttgttgataggaggagtaactcctcagagtagttgtgggtaatggaatacatgtttctaccgtttgctgagacaacaccggaagaggaccagattggtttttggatatgttgaatttgaggtgccttttgaatgtccagatggaaatgtcatgtaggcatttgagtttgaaatcagaggagagatcagaattggaactcacacttgggttttattatattgaggtagtaattgctgtgggtgtgaatgagattagccagagcaaaggaatatagaaagagaagagcagtcctgtattttgaggaattccccctattgaatatccaggtagaatagtgaatcattaaagaagcctgcaaagaactgatttcagcaaacctaggacagtgaattattaaagaagttaccgtgtgttgctttcctatggctgctttaacaaattaccagttctactggcttgaaacaacagaagtttattctcacagttctagaggccagaagtctgaactcagtattagtaggctggattcaaggtgtctgtcaccagggccatgctctctccagagtctccaggggagaatctgttcctttcctcttccagcttctgttggctgctggcattccttggcttatctccacatcactccagttactgcctacacggtcagattgcctcctccttttctgtgtgtctaatctccctctgcttctcagacagctgtaatgacatttagggcccacaagataatccaggacaatctcatctcagaatctttaatgacatctgccaaaatttcccataaaagataacattcgcagcttccaaaggttaggacccagtatcttcagggtagcatttttgaacctgccactcaagggaagaaaatgcttcaaggattcaattgatcagcaatgtcaggtgtttctgaaagattaaatgtgaattaaaaaagtccaatcagtagcctcagagagtggaagccagattgagaggtgttaggagttaataaggtgttttgtagctagacgttgcaagatttcttgattgctttttctctgtgagatggaattattggagattgaaattttgaaaagaatggagaaaattttgtgttggagagaatggaaagtaattttaacaaagagggcattattgtatactcattgtatactgttgataccatgcatgaaatgatagctgaatcgtctgtcctcttgtgttactttgtccatttgcacttggatatagctatggagaaagcagcttgctgggttcatctggggttggtattttgcaagacaggaatctaaggagtttgatatgttggtttgcagtagtttgaatcctctactgcttaccccgtgaacatttttggtgtacctccactctgtcccatttagccaggatttacttaaggaatgcaaatgaaatagttggtaaaatagaacaatatcagagtaaacaaagatcacatattttcactcttaattatgggtcccctctgtgaccacaagaagcaacgatagttggtcacttctgaaaattgttataatacagtccagatgtgacttagaaagtctagggtaacagatttgctttttctatatgcatttttaaacctgcacagattttgtcagctacttttgtttttagtgctatttataactccctgttgcctttattcctaaagagctactgctgtttaagatggttgccagattggccatctgctgtttcccactagtcatcgatttttcatcaggtacataaccaaagcatttcttcttttcagtccttttggggagtttcacatcagtccactgtatagaagctgatagaatattttggtggtggcattctcagcatacatttctgaactggcagactgttttcttaccaggatctcattgttgatatactgcctagcttcctaatgctgcaagattaatcttcttgagtaatttaaattcaaaatgtatttttaaaatatcttctataagcaaggctacaggctgaatacttttagaaatttaaaaaaattaattaaaaattttctaccttccaaatgcatatagttcttggggagacagtgtgtttgtcaatatgcccaaaccatataattagaattacaaagagacaaggaaaggtaaaatgctgtataagaattcaggaattctagataagattgtgatgtgattgtgcatatctcgcattctgtcttcctctttgtccaccgaaatccaggtagagtcagtaaacaaaatctaagtagatgctttctaaaagaaaatcatctaaaacaaagtgatacagaagggttaaaagttttttaaaaaaatccgtgaatgcttgaaaaagattgtgcaatttcaaaagaaaccaagaattgtaataatataagatgcggcagaattcaaggcagaaaacattaaacagaaaggatcattttttaatagatcatagtgggagattttaaccattgtctctgagagtaaagtattcggagaataagcaagaccataggagatactaagagatctagataaacttggcaggaacttccggtttcattgcttgacccaatacttctgtgaattacccactttatttctttattgttaaccctctctctcaactattgggtaccttctcaatttggttaatgagtcacttggcatacagttctcgggttctttgacattttctggtagaaagtgaatcctaagtattttgcgaaataaatttcagggttcttgtagagtcataaagaggcaaatgaatgaaatgaattaggcacatttcttttgagtccaagatctaattctgttcacacacacacacctttgcctatcaagcctaaccatgaagaaaatgatacgtaaacttctaagtgatatggtacacatttctgcttccaaaatgggatagatatacttttccatagttttacctattattcttgctaagtagagctaaaatccctggacattacatttaaaaacaaacataagaaaacagaaaaatggagagaactgggtggatctgctcaggacccagataatatcacagtaaaagtcctgagttttcttattaccttatgtatttcagaatggtgcagaaaagctggcaatccagaaatgttgggcacagacaaaagccccaggaaaaaaatgatgctctttagctggggaccaggaaaagggtagcctagcaagacagaaaataaccacttcagccaaagaacatagaagagtcaccctgattagcaaagaccaagtgaggacctagactttcacagtgtttaggctgtaacaagacaactcctcactccatagtggcagcagagccaatatgggaagcagtaaccataggcagggagcctgaactcccacgtatgcttaatatgagtcccttcttcccttcacccccaagttctttggtatacaaaagcctgtgggcggcaagccacccaggcaccgaggcaagagacaggggacacgagctgttccagtataataaaatataaaacaagaatagttataccagatatagatcttagatatgattatatatgaatatcattaatcattagtttgtagcaattactttttattccaatattatgataatcctcactctataatcatagtctaggaaaaaccaggccatacagagataggagctgaggggacatagtgaggtgtgaccagaagacaagagtgcaagccttctgttatgcccggacagggccaccagagggctccttggtctggcagtgacgccagcgtctgggaagacgcccgttaccaggcggatcgtggtccagcagtagcaaaaggtgtcaaggaacaacacccgctccttagcagactgggaagcaggggggagggtctccttttccccgggggagtttagagaagactttgctcctccacctcttgtggagggcctgacatcagtcaggctctcccgcagttatccggaggcctaaccgtctccctgtgatgctgtgcttcagtggtcccactcctagtctgccttcatgttccatcctgtacacctggctctgccttccagatagcagtagtaaattagtgaaaatactgatagtccctgatatgcagaaataatggcgtaagctgtctttctctgtctcctctccctctctgtctcctctccctctctgcctcagctgccaggcagggaagggccccctgtccagtggacatgtgacccacgtgaccttacctatcattggaggtgactcacattctttaccctgccccttctgccttgtatccaacaaataacagtgcagccagacattcggggccactaccggtctccgcgcattggtggtagtggtcccccgggcccagctgctttttctcttgtctctttgtcttgtgtctttatttctacactctctcgttgccgcacacagggagggacccaccgaccctgtggggctggtccctacaaaagcctagtgagaaacctgcacttccaccccccactaggcattttttccaccagagcaatgtcaaaggaagcttactataatggaatattaaaagtagatccagtcacctaatgtaataacccaaatatccaggtttcaatgaaaaaaacctctcataccaagaagcaggaaagtgtcagctcaaattagaaaagacagttaatacatgctgacactgaaataacacagatactagaattatttgacaagaatttttttattgtactttaagttttgggatacatgtgcagaatgtgcaggtttgttacataggtatacacgtggcatggtggtttgctgcacccatcatcccgtcatctacattaggtatttctcctaatgctatctctgccctagctccccaccccgcaacaggccccggtgtgtgatgttcccctccctgtgtccatgtgttctcattgttcacctcccacataagagtgagaacatgtggtggttggttttctattcctatgttagtttgctgagaatgatggtttccagattcatccatgtccctgcaaaggacatgaactcatcctttttgatggctgcatagtattctatggtatatatgtgccactttttatttatccagtctgtcattgatgggcatttgggttggttcccagtctttgctgttgtgaacagtgctgcagtaaacatacatgtgcatgtggctttatagtagaatgatttataagcctttgggtatatacccagtaatgggattgctgggtcaaatggtgtttctggttctacatccttgaggaatcgccaactgtcttccacaatagttgaactaatttacactcccactaacagtgtaaaagtgttcctatttctccacatcctctccagcatctgttgtttcctgactttaatgttcgccattctaactggcgtgaaatggtatcttgtggttttgatttgcatttctctaatgaccagtgatgatgagcttttcttcatgtgtttgttggctgcataaatgtcttcttttgagaagtgtctgttcatatgtttcacccactttttgatggggttgttttttcttgtaaatttgtttaagttctttgtagattctggatattagccctttgtcagatggatagattgcaaaaattttctcccgttctgtaggttgtctattcactctgatgatagtttcttttgctttgcagaagctctttagtttaattagatcccatttgtcaattttggtttttgttgccattgcttttggtgttttagtcatgaaatctttgcccatgcctatgtcctcaatggtattgcctaggttttcttctaggatttttatgtgttatgtcttacatttaagtctttaatccatcctgagttaatttttgtataaggtgtaaggaaggggtccagtttcagttttctgcatatgactagccagttttcccaacaccatttgttaagtagggaatcctttccccattgcttgcttttgtcaggtttgtcaaagatcagatcgttgtagatgtgtggtgttatttctgaggcctctgttctgttccattggtctatatatctgttttggtaccagtaccatgctgttttggttactgtagctttgtagtatagtttgaagtcaggtagtgtggtgcctcgagctttgttctttctgcttaggattgtcttggctatacgggctcttttttgggcatgtgcaaagacactcataggctcaaaataaagggatggaggaatatttaccaagcaaatggaaagcaaaaaaaaaaaaagcaggggttgcgattctagtctctgataaaacagactttaaaccaacaaagataaaaagacaaagaagggcattatataatggtaaagggatcaatgcaacaagaagagctaactctcctaaatatatatgcacccaatacagaagcacccagattcataaagcaagttcttagagacctacaaagagacttagacccccgtacaataatagtgggcgacttaatacccaactgtcaatatcagacagatcgagacagaaaattaacaaggatatccaggagttgaactcagctctggaccaagcggacctaatagacatcgatagaactctccaccccaaatcaacagaatatacactcttctcagcaccacatcacacttattctaaaattgaccacataattggaagtaaaacactcctcagcaaatgcaaaagagcagaaatcataacagtctctcagaccacagtgcaaacaaattagaactcaggattaagaaactcgctcaaaaccacacaactacatggaaaccgaacaacttgctcctgaatgactactgggtaaataatgaaattaaggcagaagtaaataagttctttgaaaccaatgagaacaaagacacaatgtatcagaatctctgggacacagctaaagcagtgtttagaaggaaatttatagcactaaatgcccacaggagaaagcaggaaagatctaaaatcgacaccctaacatcacaattaaaagaactagagaagcaagacgaaacaagttcaaaagctagcagaagacaagaaataactaagatcagagcagaactgaaggagatacagacacggaaaacccctcaaaaaatcagtgaatccaggagctggttgtttgaaaagattaacaaaatagactgctagtcagactaataaagaagaaaagataaaagaatcaaatagacaaaataaaaaatgataaaggtgatatcaccactgatcccacagaaatacaaactaccgtcagagaatactataaacacctctatgcaaataaactagaaaatctagaagaaatggggaaattcctggacacatatagcctcccaagactaaaccaggaaaaagttgaatccctgaatagaccaataacaagttctgaaattgaggcagtacttaatagcctgctaaccaaaaaaaagcccaggaccagacggattcacagccgaattctaccagaggtacaaagaggagctggtaccattccttctgaaactactccaaacaatagaaaaagagagacttctccgtaactcattttatgaggccagcattatcctgataccaaaacctggcagagacacaacaaaaaaagaaaatttcaggccaatatccctgatgaacattgatgcgaaaatcctcagtaaaatcctggcaaaccaaatccagcagcacatcaaaaagcttatccaccatgatcaagtctgcttcatccctgggatgcaaggctgtttcaacagatgcaaatcaataaacataatccatcacataaatagaaccaatgacaaaaaccacatgattatctcaatagatgcagaaaaggcctttgacaaaattcaatagcccctcatgctaaaaactcaacaaactaagtattgatggaacttatctcaaaatagtaaaagctgtttatgacaaacccacagccaatatcatactgaatgggcaaaagctagaagcattccctttgaaaaccagcacaaggcaaggatgtcctctctcactactcctattcaatatagtattggaagttctggccagggcaatcaggcaagagaaataaataagggttattcaaataggaagataggaagtcaaattgtctctgtttgcagatgacatggttgtatatttagaaaaccccatcgtctcagcccaaaatctccttaagctgataagcaacatcagcaaagtcttagcatacaaaatcaatgtgcaaaaatcacaagcattcccatacaccagtaatagacaaacagagaaccaaatcatgagtgaactcccattcacaattggtacaaagagaataaaatacctaggaatacatcttacaagggatgtgaaggacctcttcaaggagaactgccagccactgctcaaggaagtaagaggggacacagacaaatggaaaaacattccatgcttatggatagaagaatcaatatcatgaaaatgaccatactgctctaagtaatttatagattcaatgctatccccatcaagccaccattgactttcttcacagaattagaaaaaataactttgaatttttttttttttttttttttgagacagagtctcactctgtcacccaggctggagtgcagtggcatgtgatcatagctcacagcaatctcaaactcctgggcttgaatgattgtcccgcctcagcctcctgaggtctcgctatggtgcccaggctggtctcaaactgctgggctaagcgatcctcctgccttagcctcccaaagtgttgggattgtacccatgagtcatggcacctcgccctgacacaaattttaaaggagtcatcaagacagtgcttcaacaagcagttatgaacatgcttgaaataaattaaaaaaaaaggaagttttcagcatagcaaataaataggtaaagaaaaaccaattggaaactttataactgaaaaatacagtaaccaaaataaaatcttaatgggtaaaactgtagcaaaactgacacaaaaaaaagaagacacaaatcatcaggagtaaaataagagatacaggttgagtatccttcatctgagatgcttgggtccaaaaatgtttcggatttcagattttttcagattttagaatatttgcattggttgagcatcccgaattcaaaaacccaaaatctaaaaatgctccagtgagcatttgctttgagtgtcttgttggtactcttaaagtttcagattttggagcatttcggatttcagattatcagatttgggatgctccaccactctggagcctgtggacatgaaaaggatactatttttaaaaatctacagaaataaatttgacaactttgatgaaataaactaagttttcagaaagtacaacatactgcaagtcactcagtatggcatagataatttgaatagtgctacaacttaatagaactttataattttaaaatgaaaataggcccgaatgatttcattggagaattctagcaaaggcttaaagaagaatttacactatttctgtgtagtctctgccagaaaataagggaatacttcctaattcatttatgaaatcagtattattttgctaccaaaagcaaagacaataccaaaaaaaaaaacctaccaataaagaccaactcctttttaagtatagatgtagataatccttaacaaaatgttaatcagtataatccaacggtatataaatagaattaaacacaatgaccaagtggactttattttgggaatgcaagattgattcaacatttgaaaatctgtcaatgtaatctatcaatgtaaccatattaacaggatcatgaagaaaatatatcaaatgctatagaagcatttgacaaaattcaataccatttatgattaaaactcttagaaaactaggaatagaagcaaacttcctcaactggataaagaatatttatagaaaataaacagcatcatacctgatgaaagactgaatgctttccccttatgattggaaacaaggtgacaaggatgcacacactcacaactcttattcaacaaaatattgggagttccacccagcacagtaaaacaagcggggggaaagccctgacaattggaaaaggagaaatgaaacaccttccttttcgcctgtgacgtgatcatctgtttagaaaatcctaagtaatctacaaaaaatctgtggaactaataatgtagcaggatcacaagatacatttaaaaagcaattgaatttctctacactagcaatgaacgtgtgaaaaccataattaaaagtgaaatactatttggaattgctaaaaaaaaagtgaaatacctagatatcagtctaacaagacatgcataggacttgttggatgaaaactattaaatgttgatgaaagaaatcaaagacccaaatgaatggaaagacatactgtgctcatagattggaagactcagcatgttataaatgactattttcctaaaatagatgtaatacaagtttaacaaaatttcagcaggttctttttgtaaatatagacaaaatttttctacgatttatatgaaaagacagaagaaccagagtagctagtttttcatacagttttgaaaaagataaggtgggaggaaacactctatactcaatttcgacttataaagatagcataatcaagacagtgtagtattggcagacagatagacacataggtcagtggaacagactagaaacccagaaatagctccacacaagtaaagccaattgattttgacagacgtacaaaagagactcagtggaggaaagtggcctgttcaaatggtactggcacagttggatagccataggcaacaaaataaaccttgacctaaaccttgtgcaaaaattaactgcaagtggatcatagattctaaatgtaaaccctacaaccataaaacttaaaacatggaaaaaaaaatctctgggacatttgtgattcatttgtatcatggaatcctactcagcaataagaagggaatgtgatgtatatgcaactaatcagaactcttaaagacattatgctgagtgaagaaaagtcagctcgaaaagtcacatatgtatgactgcatttatagaacattcttgaaatgacaaaattatagacatggaggacaaataacagattagttgttgccagggattagggatggggttatgggaacagagagggaagtgaatgtgactataaagcaggtagtctttgtggcgatggaacagttttgtatcttgattgtgattggtggtagtgacacaaatctgcacctgtgataaagcgatacatagctatacacacacactgtactaatgtcagtttcctagttttgattttatattatagtaagatgtaaccatgggagaaactgggtgcagggtacaggggacctcttttgctatctttggaacttcctttgaatctaaaattatttcaaaattaaaaaaaaatttttttaaattatcctagctaaagcatcaagtgaaagttcttaagagaaaaaaagaaaacaagggaagggaaggtacaggatgtctgggaaattgtctgtgacatttaaactggtttttgcccagggggcatttgccaaatctggtttcctttcctcagcatcagagagcattgaggaacctgaggaaataataaggtctttctttctgggatgatgaatctgatacgttcttcctcttcaccttaaagctgagactcagctaaactggaaaccaccaccaatcccaccatccttcaagattgcagggaaagttgattttctgcatgcttcttagtttttaatgtgcatcagaatcacatggaggtcttgttaaaacaaagattgctgggcaacatccccagagtgtaagattcagtaggtctggggtgagacttttaaaatttgtacctctaataagtttccagatgatagtgattttgctggtcgggaaccacactgcaaaaattatttgtatagctaaaaccttgtcggagtgaatatgggggcaagatcactgctgagaattttaagcaaccagctgacccttgtataatttgcagtgcgaatttaacgctgtgtaggtgatctaaaaaaaaaaaagaaaaagaattccctaagataatttatccccataatggcagtatacatagactggcagtgagtatccccagactcttgtagaagctaacagaaattctctttggagaaactcatctccatcccagagttgaaagttttcctagaaataaaattctaagtaagtagaacaactgtgatagtcaaaaagaaaaacataaagaaactaagcactgtgagcaggactcaacagcagacctgctggaaaataggaataggcagctacagaatatgaagtaagtgtttcatatgtttcaacaaaagttgaaaatatgttccaagattcagaaactataaagactattcaaagagattttttaaaaatagctagaatttatacaattgaaaattatagtagttgaaactttattaaaagtcctcaatagggctgggcgtggtggctcatgcctgtaatcccagcactttgggaggccgaggtgggcggatcacgaggtcaggagatcaagaccatcctggctaacacggcgaaaccccatctctactaaaaatacaaaaaattagccgggtgtagtggcgggtgcctgtagtcccagcagctcgggaggctgaggcaggagaatggcgtgaacccaggaggcggagcttgcagtgagccgagattgcgccactgcactccagcctgggtgacagagccagattccgtctcaaaaaaaaaaaaaaaaaaatcctcaatagatgaatttaactgcagattatataaactcaaaaaaggaaataatgaactgaataattactcaacaagcattcaagagaaacagttgaaaagtacgaaagagaagttatacatatttaaaaataaatatttatctgaatggttttctgtaagagagaatggtaaacaacagttaaaagaataatggctaagaattttctgcatcttgtgaacaacactaaactatacattgaagaagcacaggaacctaaggtggttaaataaataaatcctcacttagccttgttacaataaaacagcagaacatcaaagacaaagaaaagatctttgatatatctggggaggaagacagatttaccgtgaataaggtcacacccagaagacaggggaacattttcttaaattaaaataaaaatctagaattttatactaagagaataaatccagggaaattcatacgtttcttgcagacaaaaactgagcatttgcaattaggaagtcttcacttgaaatttagaagtgtgtactctaggcatgaagaaagttgactctcagacaggaggccagagatacaagaaagatcaaaaagcataagagtaataaatatcttagtaaatctaaacaaacatttttataaaacagtaatcattttcataggctttaaagcatattaatatatatgtcaatgatagcacgtaagtcagaaggatgaatggagtttctgtaaggtacttgtgaggacagtaaagacacataacttttcagagtctaaagttaatcagtatgtgtgtcataatagcagatagaagaaatagaggtaataacttgtgaaataacatagaggatgaaataagggaaaatatgaaatccaaaaggagaaaaacccagaaacacatagttcacagattaagtagaaaacaacgtgatggatataaatccaaatatatcattaactacattaaatgtaagatgaattaagccccaattagtttgagtggcctactgaatttttaaaatccaactatgtggcctggcatgatggctcacacctatagtcccagaacttcaggaggccgaggcaggtggatcacttgaggtcaagagttcaagaccagcctggccaacatggtgaaaccccgtcttcactaaaaatacaaaaattagctggttctaatggcatgtgcctgtaatcccagctgcttgggaagctgaggcaggagaatcgtttcaacctgggaggtggaggttgcagtgagctgaatttgcaccactacactccagcctgggtgacagagtgagactccgtctcaaaaaaaaaaaaaaaaaaaaaatccaactacgtagtttaccaaaaaaaaaaaaaaaaaaagtttaaaatggttgaaagtaaaaggatggaaaaaagatatatcgtgcaaatactaatataggttttaaaggcaaaaatcggattgttttttgcactgataaaaggtaacacttcgatgggaaaatacgattgtaaattccacatatttaatgctgtgactacaaagtatataatgcaaacaaaataccaggaggaaaaagacattcataatcacagttggagggtttttaggcttgtctcattaactgatagaacaagcagagaatacactgacataaaccttgttttacaagtattctttaatctgtttcacatctgtaacatctgtagtcacatcctgtttttcaccactcataattggttttctgtgccttctttgtttttgtttagtcttgcaaacaccaaatagtaaatgccgctatctttatggtttgctaagaataatcagtgataagtgaacataccagagagttcatcatttttgtttgtgttttgagacagggtctcgctcttttacctatgctggagtgcggtggcatgatccaggctcatgcagccttgacctctcgggctcaggtgatcctcccacctcagcctctgaagtgggagctgggactatagatacatgccaccacacctggctaaattttgtattttttaatagagatggagtttcaccatgttgcccaggctggtctcgaacccctgggctcaagcaatgcatccacctcggccttccaaagtggtggggttataggttacactgcacctggccatcaatcttattttttaaaatcttttaattataaaatacacgtaacataaatttattatttgtttagtacatttagaatgttgtgcatccgtcaccactgtatagttccaggacattttcatcaccccaagaggaaaccctgtatccgttacgtagtcactcctcattcccctgtcccatttccttcctggtaagcactaatctgctttttgtctctgggtttgtcttttttggatatttcatgttaatggaatcatagaatatgtacctggtttacttcacttagcataatgtcctcaaggttcatccatattgtagcaggtatcagtactttgtttctatctaccacattttgtttatccagtcattagttgatgaacctttggatgttgctaccttttggctgttgtgaatagtgctgctatgaacatgtgtatccacgtttttgtttgagtatctgttttcagttcttttggatatatacccctgactggaattgctgggtcatatggtaatctatgttttactttttgaggtacccagcaaactgtttttcatagcagttgtaccattttatatttctacccatgtgatatacaaggattctaattatccacatcgtggtcagagcttgttactttctttttgattatattagtagtcatcatagtggatatgaagtggtgccttatggttttgatttgtatttgcctcatggggtaatgatgttgaacatcttgtaacatacttattggctgttttgggtttgtcttttttgttgttgaattgtaagagttctttcctgttttggatacaagacctttgtcagatacatgagttgcaaatattttctcctcttctgtgggttgtctttccactttcttaataatgtcctctgatgtacaaaagtttttaatattggcaaagtctaattcatctggttttcttttgttgcttgtgcctttgatgtcatatctacaaaaccgttgccaaatccagggtctaaaagatttaccctcctatcttttcttctaagtgttttatagttttagttttatattaggtctttgatccattttgagttaatttttgaacatggtataggtaacaggctaatgtattctttgtgcatgttggcaatctagttgtctggcaccatttgttgaagatactgttctttccctcttgtcttgacacccttgtcagaaatcgatgaccattgatatatgggtttacttcgggactttctgttctattccattgatctgcatgtctgtccttatgccagtaccatactgtttttattactgttactgtgtagtacgttttgaagtcagaaagtatgagtcctccggctttatcttataaaaaacccgacttttggttttgctgattcttcttctgttttgcttcattaatttgtgctctcatctcatcttcattattttcttccttttactatattctttgggttgatattactgctcttttcctaattcaaattattatttattagcttattaacttttatctcttaaaaatacgcattttaagtgtgtacattttcttcagtatactgcaccagcggatccacaggttttcattttttaaattaatttatctcagttttcatttttagtagttttctgtttataatttgctgttgtaattcggatacatttagttttgccattttttaaaagcttgttacacatagttttgtaagctgtgatcattttagtgtttaagttctttgcaggtctttttctcttgtctgtgtcaagagtttcttgacagtttggggggctagccctatcagatatcgatatattataaaatgaaaataattaaacattgtgatattggtacaaaggtagaaaatagacagtggaaagaatagagtacccagaaccacccattccctgcctatttgaatactttctatgtgacagaacaccattgcagatcactaaggaaagggcttcaatgacttgtgctaggttaatcggatagacacatgaaaaaaaataaattggataccttcctcacatcgtataaaaatcagttccaggttgaataaatacctctatgtaaaagccaacaactgtataaagcttttaataacataaagagcatattatccatgattttaaggctggaaagattcttaatcaagacacagaaagcatgaaaaggattgatcggttcagctacattgttttggaactcatctttgccagaaatctttataaggggagtgagacagcaagcctccaactagagaagatatttgcaacacataattgagaaaggactgttacaaattaaccgggtttggcagtatgcacctgtaatcccactttcttgggaggctgaggcaccagaatcacttgaacctgggagatgtaggttgcagtgagccgagatcgtgtcactgcactccagcctgggctacaaagtgagactctgtctaaaagaaaaaaaaagaagaaggtgtaaagaactcgaacagttgaactagaaagagacttcaaaaataggaaaactgaaaggaaagtatacagaaaagatgcccagtctccttagtatttaagagaagtgcagactaaaaccaagtgagatattagttacatttaaaagtctgtcaattccatgttggtgttacccctttggaaaattggtttttttatcacctaaaatagttgagcaggtgcttatcctatggcccagcagattaactcgtagataccctagaagttagggtaaataaccctagaaaagcataagcaaatgtgtgggggaggcatctacaagaatgttcatagcaacgttttttatcatagcctaaaattggaaacagcctaaatatccctcagtagtagattagataaactgtggtatattcatgtagtggaatatcattccataggcccaatttgtgaactacagccacacacactctcacacgcatgtatcacagttataaaatcaggtgaaagaagcaaacgcaaaaggatatgtatgccatgatttcttttatatgaagtttggtaagagccaaaaccgaaaaatatgactgggataaatacttagattgtgaagttacaaagaaaagcaaggcaatgatttccacaaactttaggataaatggtacctcttgggtgtgagaggaggagatgattatggggggaattttaagggattggtaatgggtgatggatacactggtgttcattctttttttaagtgtgtgtatatacagaatacactttgttatgtaatagtttttgtaagatgcattttttgtacatttctatgccagttatctgtaatcatgatgaagtggttgattttttttaaaggaaaataaaaataaccaaaatcgataaaaagaaaaagacctgattgattaatattatggaaacagcatcagaccagctacttttatacatgaattctatcgaggaacgtgacccactttttagagttccacttttgtatttccgtacgtctgttgcatattacccctgatcacattaatagggtctccaaattaacatgtccaaaatcagtgtttttatctttttgcttttccagtgtgtcacttgatagtctgtttgttcttggttgactgcccttagttgacttatgactgcctctgtaattaccttataatgatttcattttccttatgttctcagctgttttccacttcccttctcccccaatctcttactgctccacaggacctcatgtccttttctagggtgaaaacagccactgaacatgaattatttcagtttacctttcctaggcttgaatgcttccctgttgctttcagaataatacttatacttttaaaaaaggaaatgtattatagctatcatcactttcacactttaaagcaaataaagtttttaccacttcatactactaacattgctctctcttgtactattatacttctctaagttttcctttctaccctgatgaccgttgtgcatttcttcttccatccttgcctttcttctttctttcccctggggcgtagcggggagcttacatataggtcttccctaaggtgctgtccttagtctgcatctttcttcttactaatttgtatgtaaaatgagaatttatatgacacagtaagtatgttttctacttgggttaataatatcactacccttcctggcatgcagactgaaatttcttgagttctagcttcttcctcattgcctgtatagccagttgactagcaaatttcattgattctttccaaaacttcagaaaattttcctcattttcattgacatgaccagctttatttgccttgcttaatgtcctcagatgtggtttgccagtggtctgtgatgcaaaagtaaattcatcgtacctttttccagctttatttcctgcagtggatcctttatgaaacctgtatgcccagcaaaatggaatatttttctttgacagttgctgtttttgcctctgttctttcctctcactattcattcccttcaccatatcccccatcccttctacctcttttctccttacacaatgagtcttagaaagaaagatacggaagtgaaaattaccttttttcaggccagattcttagcctcaaagatatctgtagcatttcatttgtatcttttctgacccttgtttctgccttgctttaagatgaactttgagtgttttatttctactaactagtttctctatttcttgggatcagggagtcatctttgtgtcccagactcagaagaggaaatcatatactgttcatgtgaattaatggggaacaaatacaaagaaaaaaaccacattttctttttattagcctctattttgggggtggggggtgggaagtgggtaggggtttctaaaatcattaaattttagttaagagcgatcttaccactaatttattccaagaccatagttttatgaacaagaaaaatgtgcctccaaaatttaagtggattccactgtatcacactgctcacgtaatttgtgatttccaaaattttattagtttttttttttttttttttgagatggagtttcactcttgttgcccaggctggagtgcaatggcgtgatcttggctcactgcaacctccacctcccgggttcaaacaattctcctgcctcagcctcctgagtagctgggattacaggcgcctgccaccacgcccagctgatttttgtatttttagtatggacagggtttcaccatgttggccaggctggtctcgaactcctgacttcatgatccgcccacttcggcctcccaaagggttgggattacaggcgtgaaccgccacacctagcgtggtatttattttttagaaatggggcctcgctgtgttgcccagactggagtgcagtagctattcactggcctgaacataatgcactgcagccttgaactcttggcgtctagccatcctcacgcctcagcctcctgagtactgaaaattttaaggtcattttgccttcagtcccacatgggagcaggagtcctaggtgagctggggttgccataaccataattgaatgtgagtcccctggcagaaaggtaacctccttttctttatatgcgctcatagaaattcatttatctattcctatttctcttttctccccacctttggctttggtagctggagctggtaagaaatctttcttattttctgtaatgtgttttataaattatgtgtggtctaatgattatatggttgtaagaaaaataccataaaggaagagtgtttgtccttagttttcatctttagttatccataaaatctgaactctaccctgaaaaatttgtcgtcattgtatttttcatctttcctcgatatctacttgttagttcaatactatcttttatcaattttaatgtactgttccaaagaacatatttgttactgttttcatagggaattgagcagtaggacgtttttcttacagaattaaacttacatttttctccatccactagatggctcaagtgcaccactttggcagctcagattgatccttgcttgctttgcttgtagtttctactttgagtactgtttgctttttaaaaactggatgagcccttacctgaacctagctttacatatatgtgatggcagatttcctcgcattttctgattatttacagacttctgaaaagctggtgaagtgttcttcatatcagtagtaaaaagtgcattacagtgcttagaagattttgttttttgcttttaagttattttagactttaattcaattgccaataatctatttagatttcttcaaactaggcatgcagttaataattcatccatttcttcctgattcatagtcatttggagtcattttccagcacatggtggtacctcaggagtttttgaggcacacggggctatttgcttcagttctgtagtaatatttatttagtgtttttgtgcttggaattgtatggggcagtggagggaaataccaggatgactaaagaggatattttcatcagcagggagctcactgcgttaattcgtttccttaagtttccttttttattattttttatttttattttccctgaaagcacacattggtatcttgagtttttgaagccaaataatgagtataatgaaatggctcattagagcttatgtttgtaaccaaccctgaggagaattttgtttttgacattgaccctgttgatattgcctgaaaaaatttaaaaaaaaaaactgaattctttagaaatattttatgcttatggctttctgttttgagttaagtaaaaaggaaaaggaattaagatttgttgaatgcttatcatgtgccagtttcttacttaatttgatgctctcaataatttggaagacaagtacaaatatctctatttacagatgaagaaactaaggaatcagaagttgcctaggatcaaagaaacagtaagttagagaggcaaactctttgtgatatcaagggttgttttttatttttttgcccaagagaaaataattattttctgaaatggcagaaacatttgtaatatcaactagttggatactttcatatcctaaagacagaaaactccaaacaaaggattgattgcctctcacagttgatctttgagattataaacaaatattcttgccaagctagagcaatcagtcatactggtatctcttttacagatacctttagaatgacagcaaacactataaaattgatttttccagagaaagtgtttgcacctaataatcttatttttcaggaataataactgaattatttcatcagtttgaaaatatagtgtacgatttaaaggagaatggcaagttattgatgtaaatacacattatttacaatattataactagattacattacaaatattgtaacaacaatttgtctttataaaatccccttgatttctctttattgtttaagagtccttgcagctaagccgtgtaaaacaggaaatatggctgtttgccagtgttcttaaggaagcaggagtgaagtaaagcaaacaatacaaaaggggtttgtttaaaggatgtacttaatttctgtgtggctgtggtatcatttttctggctctgttgtctttgtcctttttcactgcaaagttgaaattgtactttcacaactattaaaacaaaaataaccagtaatgcgaactgaacccaaagatatctaagataaatatcctcccatgactgtaaatttgtatcctccatatcaccttagaaattttcgtatgcattgactagatttattgctatttttgttctttttttatgtattatcagatattgccgtcagtactattaccgcatttacacaatgttgccttgtgtggaaattctaaacctttgctaactcttggtaaccaaaataacgataaactaaagagattattatcccatcttttgagagaaatgtaaaattattcatttgtctataaagaatctttgacaaaagtattttttaaagcatattgaatcctagccattttattattattagctgtgtacctaaatgatattttagatatgagtataaggaagacaaactttaggttgtcaaagaatgagcatgtctcatgtgttacagtcatggcatgacagttggattacaattatctcttgatgaatcaacttcatctaaaccttaattgcatattaaattatttagtcatttcctgattcagtaatgagaagtcagaatatatagtaatttactgggtagcatgttacatgccatagtttgcggaatgtacttgatcagtaaagtccacagtaaatcaaagacaaatgagaaaattcttttagaattcagttttttttttcttaatttgaagtcactttaaatgctcttatgtaataagaaaagaaccctaggtatatttaaatacttaacctgctataactttttgttggaaaggaggtagattttttttatgagtatttttttcctatgggaaaaaaaataactttggtgatgcagtatgcctttatctgtgtattgttaaaaactaaactaaacaaaaaaaacccctaagaacctttaaacttaacaaagtttatttgagcaggaaaaaggttctagaagcagacagcactctaagatggttcagaatactaccacttacaactggtgagctgttctaataacagggaaaaataggaaatgtcatacagaaattacctgattggtgcaggttggtgtttgccttatttgggcataatctagcagcttttaacctgggattggctgagactcagatgtgtggttataagggtatactcctaagttaggttataacttgtttacacatcaagctagagtacagttaatagtgtatggaggcagctttgggccaaatctgattgaacagtataaaaataagttttgcaaatatttatccttaccacatgagttacatcctaatattctttattctcttctatttcactaaaaaaaattcaaatccaccaaattcatttcatgacccatcggtgtgttggagctcattagtttggaaaacactgccatatagggttgaaaaattttttttctttttttaccctgttaacaactgactagtctgaaggagctcaaatatttggaaagctttattagtgcagtttagtagctggcttttaaaaaaaaaaaattgctttctagaatcctccctgctacataatcaccaaatgttatttcaatattgttttcctaacttgaaaatttaactgaatgactagaaggtgttggaccaagaaatatctgaagtaccaagcccacaaaggaaaatttaatattgattgaggtatcatggttatttgtgcacccttaaaattaagccaattttagttaatagaagtttcagctgggtgtagtagcgcagcactttgggaggccaaggcaggaggatcacttgaggccaagagtttgagaccagcctgggcaacagaatgagaccccatctatacaattttaaaattaagcaagcttggtggtacacgcctgtagtcctagctattcaggaggctgagatgggaggattgcttaagcccaggagtttggggctgcaagtgagccatgcttgtgccgttgcattccagcctgggtggcagagtgagatcttgtttaaaaattaaaaataaataaataaataaataaataaatacatatatatgtttacatatatatataaatttcaagttaattgtttaaaggatgtcattaaccaaaactaagcatcagtctttggtaatgaaagcattctaaaagtctttcttttagatagattgaaaagtctatcttgcagacaaagataattttattaatcataagtaacattattatgaaaagtatttgtgaatattaataactcagtttcttcacttatgttgagttgctttacatgttttatctttgcataatctgtaaacttgatgtttcgtagttgacagaataagtttacagttagatatataggtaacttttagttcaatgttttaaaaattgtgtcatgagaagtataaataaaattcaacgaaagataccatttcttggccttatataatggcatatatttgaacacttggagatagtggaaaagggcatttcacataaggggacagaggcatcaaggcagaaaagcttaatatggtccaggaataaaacattcaactggatgggctttgttctaaaggcagtttttgagagaagacagaattaaattaacttatattacaatacctacttgctacaggagataatgggtggatttgaagggagtgaaattaggcagagagagtagttaagaaatcattgaaatattttagagaagaaatgagattgaagtaggacagtgtctaaggaaataaaaagtaatttatcaagacagtaaaatcaacacaatttggcagctgattagattaattcaaaaatatttgagtgtgtgctatgcaattctgggaatccaactgtgaacaaaatgcatgctctttacccttacatgtgttttagtccaatgggaagcacagacatttcaattcagggtaatacatgtgctgccatggagaaagactcagtgttgtcttgggagtgagtatactgactgaacttgaagcctcagggatgagtaggtcttgaccaggtaaagttggggttagagtgtgttacagattcctccctgtcctctccccgcatgttggcttggaggtgaaaagattgtggtacttttaaagcagttaattgtggctggatcctgggattggagagggaggaggatctggtaagagagggccagggccaaatcatccagagtcctgaagttcctggaatcccctagttcttggtccacaaccctaatgaagccttggattttatcttaggaacagaaattaactgtggtatgattttaagcaagggagattcagggtcaaaattgcatgttagaagaattattttagctaagaatgtcttagttataagtcagaaacttaagcaaaagacaaagaaagtgacccagaggattcagcatatgcagaggtaggaagtgcggctggacttcacaaagatttggaaccagacatggttcagtatcagatgcttcctcttctgttgtatcgcatagtgtcttgtctctcatgtctgcttcattgctctgtgtatactgtcttctcttaactatacagctctaacttaacagcctctgaatttctctcccactttcaagtcctctggagagagtctgactggttccttgtcagttgtctacccttggtttaatcagctgtgctaagagggcagggtcatgtagcataaacatggtgcttcaaagccaacccctctcacagttaaggggtatggtgagttgtgggctaggcagaattcttagaaagaaccaacttcagaagatcattttggctgcagaatgaagaattcaggggaagggaactaaaggaaggggacctctttaagagaatacagtaatccaggcagtaggtaatactgccctgaatcaggggtaagtaagaagagaactgatctgtggtagattaaaggttgaatctccagaagtgtatgtagattggatattggagtataaagagtcaaggatagtgtttgtgtttctggcttgaatacctgaatggatgatgatagcaatccctgagctgaagtagcatcgcagcaaatttagtggggattgaagacgaagaatttatttttgtgcacgtgcagagtttgagatagcctcaagacatctaagtggtaatgattagtagacccttgaatatatgcatctatagcagagggaaaagctcaatagtagatacatatttgaaattctttagtgttaagtgataactagagccatgagggtagatgaaattgccatgggagagtgtaacaagacaagagggccaagacagccatgaagagaatctgagggctagcagaggggggaaaatgagcctacagggcagactgggaaggaacagaaaggtgtgagaaaaatccagagtatgcagtgtttttagaaacccaagaaaagtgcttcaggcaggagaatgtggtgaaagtgtcaggtgctgatgagcagcataggaaaaagtcaagttctgtttaggagcaagaagtttgttgatgaccttggtgaatgagcttaatgggattggtgaatatgggaaacaggattgaggactctggcaagtgaagaaatcaaaataaatataaacagtgcttgagctataaggagaaagagtgggtagagatgattatgacagcgaagtaaggtttttatgtattttttaaaatatcagggtcttgatcatatttcagtgctaggagaaagagtgataatcagttgagcaagatcaggagattcttcagggcactattacattgtaatggtgaagagtgaagcaaaagtatgtggaaactagtttagtgaatggaagaagaggtattccctgactttcattttctctaggaagaggttgggattatttacaaataaggtaaagtcgaagacttagggaacaggaggacagtttgtaatagatactgtagaaattagactagtgcaacttgggattttttttttcactagcttaattagaggtcttaaattgaaagcagcaccagtatacatcattgtattggttttgttcagcagtctgattacatgcttatgttgtgctacttcaggttggtaccttgagagtaagatattgacatgatggtggtctgactaatggaacatggaatataagctgtggaaggaaagaagtaaaagtgaggactaatagaaaagtgagttgttaaaggcctagaggtcttatgtgcaaagaataagtgagagtaactcagcttgagaggcaggtcctaaaatgagggtaacactaaaggggaatggaccaatagcgtcttaggagattttcctgcatttgcctgcattgctggaagaatggtattgctgataaaagaagtaaacatggaaggaagagcaagttagttttagagggaagaaaagttagatttttactgtttcccctttgagtacctatggatcattcatactgagatgaccaagaggcagttgaaaatataagggagaagccagggctggaaacaaaattgggagattataattgaacccataaatttacaaagaatataaagtggtaaggtctacttagacgctatgtacatttaaggagtaagaaatagagaaaagatgcttacaagctttgagaatttgtgaagaaactcaaaagaggttgaaagggttgaccaagcagatcaccggatttgtgagtggctttccagagggtttagtggagcatgaaaggagattggaaaggtttgaagagtaactgactttctgagagtatgtatattgccaatgaatgatgtattattatatgtgatttttaaaatctccccaatatactgatatttttaaaataactttaatttgcttttttattaaaaaaattattagctatagtctggctttctgaaatagagtatactggtcatttaatttgttaatgcctcaggagtatcatagttatcgattattactcagagctataatatggttgggccctttcaagtgctgttaagaccatttgtttttgtactgaatgccttcagtgtgttgtgtttttcaaggccttctttcccttgtcatttgttgcattaagtcatttgacagtattattcaaggatttttttccccctcgaagcactttactgtgttatagtttataattattggaagcctctgtagatatatctgaggatatgggggttggtggggagtagtatctcctactataatcatacaagacagaatacttctgtggcctctggtcaccaaaatgtatgaagatttctctccaacagacaccaactgggtgtcttctgattcaattctattctgacattgtcttccggaaaacagcatcagatcccacaggttgaggtctcagtcccacaacactgcccccctacttcagatgccagtcacaggcataagttgtagccttgtgtctgactgaatagctataaattggggttcccatgatccgctccttgggttcgattaattttctagagtggctcacagaactcacagaaatacttacatttatccacttattataaaggatattacagagaatacagatgaacagctagatgaacagacaagatgcataacacaaggcgtggagaaggggcatggagttttcatgccttctccagctatgccacgctctgggaacctgcatgtgttaatgttatccagaagcccacaaaacagtcctttagaatttttatggaaacttgtttacttaggaatgattgattaaatcattggccattggtttatcgactcaaccttcagctcctctccccttcctagaggttggagtaggaccgaaagtttcaaccctctaattatgattacaaacagaaaggaatagtaccaacatcaaagaccaaaggtagataagtccatgaagatggggagaaaccagcgcaaaaagtctgaaaattccaaaaaccagaacacctcttctcctccaaaggatcacaactcctcaccagcaaggcaacaaaactggatggagaatgagtttgacggattgacagaagtaggcttcagaaggtgggtactaacaaactcctccaagctaaaggagcatattctaacccaatgtaaggaagctaagaacctggaaaaaaggttagacaaattgctaactagaataacccgcttagagaagaatttaaatgacctgatggaactgaaaaacacagcacgagaactttgtgaagcatacacaagtatcaatagctgaatcgatcaagtggaagaaaggatatcagagattgaagattaactcaatgaaataaagtaagaagaccagattagagagaaaaaaaaaaagagtgaaaagaaacaaataaagcctccaagaaatatggaactatgtgaaaagaccaaatctacgtttgattggtgtacctgaaagtgaccgggagaatggaaccaagttggaaaacactcttcaggatattatccaggagaagttccccaacctagcaaggcaggccagcaacattcaaattcaggaaaatacggagaacaccacaaagatattcctcgagaagagcagccccaagacacataattgccaattcatcaaggttgaaatgaaggaaaaaatcttaagggcagccagagagaaaggtcgggttacccacaaagggaagcccatcagactaacagtgaatctctttggcagaaaccctacaagccagaatagagtgggggctaatattcaacattcttaaagaaaagaattttcaatcgagaatttcatatccagccaaactaagcttaataaactaaggataaataaaatcctttacagacaagcaactgctgagagattttgtcaccaccaggcctgccttataggagctcctgaaggaagcactaaacatggaaaggaacaactggtactagccactgcaaaaacataccaaattgtaaagaccatcaatgctatgaagaaactgcatcaactaatgggcaaaataaccagctagcatcataatgacaggatcaaattcacacataacaatattaaccttaagggtaaacagactaaatgcctccattaaaagacacagactcacagactggcaaattcgttaaagagtcaagacctatcagtgtgctatattcaggagacccatttcacgtgcaaagacacacataagctcaaaataaaggggtggaggaagatttaccaagtaaattgaaagcaaaaaaaaaaaaaaaaaaaaaaaaaaagccagggttgcaatcctagtctctgataaaagagactttagatcaaaagagacaaagaagggcattacataatgggaaagagatgaatgaaacatgaagagctaactatcctaaatatatatgcacctaatacagtagcacccagattcataaagcaagttcttaaagacctagaggcagactcccacacaataatagtgagagactttaacaccccactgtcaatattagatagatcaacgagacagaaaattaacaacgatatccaggagttgaactcagctctggaccaagcagacctaatagacgcctacagaactctccaccccaaatcaacagaatatacgttctcctcagcaccacatcgcacttatactaaaattgaccacataagtggaggtaaaacactcctcagtaaatgcaagagaacagaaatcataacagtctctcagaccacagtgcagtcaaattagagctcaggattaagaaactcactcaaaaacgcacaactacatggaaactgagcaacctgctcctgaatgactactggaaaaataacgaaatgaaagcagaaataaagatgttctttgaaaccagtgagaacaaagacacaatgtaggagaatctctgggacacattttaagcatgcctagaggaaaatttatagcactaaatgcccataagagaaagcaggaaagatccaaaatcgacaccctaacatcacaattaaaagaactagagaagcaagagcaaacaaattcaaaagctagcagaagacaaaaaataactaagatcagagcagaactgaaggagatagagacatgaaaaaccctaaaaaatcaatgaattcaggagctggttttttgaaaagatcaacaaaatagaccgctagccagactaataaagaagaaaagagagaagactcaaatagatacaatagaaaatgataaaggggatatcaccactgatcccacagaaataccaactaccgtcagagaatactataaacacctctatgcaaataaactagaaaatctagaagaaatggagaaattcctgaacatatacaccctcccaagactaaaccaggaaaaagttgaatccctgaatagaccaataacaagttctgaaattgaggcagtacttaatagcctgctaaccaaaaaaagcccaggaccagatggattcacagttgaattctaccagaggtacaaagaggagctggtaccattccttctgaaactactccaaacaatagaaaaagagggactcctctgtaactcattttatgaggccagaatcatcctgataccaaaacctggcagagacacaataaaaaaacaaaatttcaggccaatatccctgatgaacattgatgtgaaaatcctcaataaaataccggcaaaccaaatccagcagcacatcaaaaagcttatccaccatgatcaagtctgcttcatccctgggatgcgaggctggttcaacatatgcaaatcaataaacataatccatcattataaacagaaccaatgacaaaaaccacatgattatctgaatagatgcagaaaaggcctttgacaaaattcagcagcacctcatgctaaatactctcaataaactaggtattgatggaacatatctcaaaataataagagctatttatgacaaacccacagccaatattgtactgattgggcaaaaacgggaagcattccgtttgaaaaccggcacaagacaaggatgcactctctcaccactcctattcaacatagtattggaagttctggccagggcaatcaggcaagagaaagaaataaagggtattcagttaggaaaagtggaattcaaattgtctctgtttgcagatgacatgattgtatatttaaaaaaaccccattgtctcagcccaaaatcttaagctgataagcaacatcaacaaagtctcaggatacaaaatcaatgtgcaaaaatcacaaacattcctatacatcaataacagacagacagccaaatcatgagtgaactcccattcacagttgctacaaagagagtaaaataaaatacctaggtatgcaccttacaagggatgtgaaggaactcttcaaggagaactacaaaacattgctcaaggaaataagaggggacacaaacaaatggaaaaacattccatgcccatggataggaagaatcagtatcatgaaaatggccatactgcccaaaataatttgtagattcattgatatccccatcaaagtaccattgactttcttcacagaattagaagaaactactttaaatttcatatggaaccaaaatagagcccacatagccaagacaatcctaagcaaaaagaacaaaattggaggcatcatgctacctgacttcaaactatactacaaggctacagtaactaaaacagtatggtactgataccaaaacagatatatagaccaatggaacagaacagcagcctcagaaataacaccacacgtctacaaccatatgatctttgacaaacctacaaaaacaagcagtggggaaaggattccctgtttaatagatggtgttgggaaaactggctagccatatgcagaaagctgaaactggattccttccttacaccttatacaaaaattaactcaagatggattaaagacttaaatgtaagacctaaaaccataaaaatcctagaggaaaacctaggcagtaccattcaggacataggcatgggcaaagatttcatgactaaatcaccaaaagcaattgcaacaaaagccaaaattgataaatggtatctaattaaagagtttctgcacagcaaaagaaactatcatcagagtgaacaagcagcctacagaatgggagaaaatttttgcaatctatccatctgacaaagcgctaatatccagaatctacaaagaacttaaacaaatttacaagaaaaaagcaaccccatcaaaaagcaggcgaagcatatgaagagacacttctcaaaagaagacatttatgcagccaacaaacatatgaaaaaatgctcatcatcactggtcattagagaaatgcaaatcagaaaccacaatgagataccatctcactccagttagaatggcaatcattaaaaaatcaggaaacagatgctggagaaataggaacacttttgcactgttggtgggagtgtaaattagttcaaccattgtggaagacagtgtggcaattcctcaaggatctagagctagaaatactatttgacccagcaatcccattactggttacatacccaaaggattataaatcattctactataaagacacatgcacatgtatgtttattgtgtcactgtccacaatagcaatgactgggaaccaacccaaatgcccaacagtgatagactggataaagagaatgtggcacatatacatcatggaatactccacagccgtaaaaaggatgagttcatgtcctttgcagggacatgggtgaagctggaaaccatgattctcagcaaactaacaaaagaacagaaaaccaaacaccgcatgttgccacttctaagtgggagttgaacaatgggaacacatggacacagggaggggaacatcacacaccagggcctgtcaggggtttgggggagggatagcattaggagaaatacctaatgtagatgacgtgttgatgggtgcagcaaaccaccatggcacatgtatacctatgtaacagacctgcacattctgcacatgtaccccagaacttaaagtataatttaaaaaaaaaaatacatttcttggacccatggtagaaagactgatcactatatccagatatccactccctcactgctcttggtcaattgaacccttcaacttttagttgggtacatggctactttgcggtaagatgtgactgtggtgtgtgagccaagctaatttgcgcagaaggaattgtgtagcttgcaagtcatatcctcagaagagaagatgctcacccttgtcttctttccacccctcccctggattggagaagagatacgttattgcccaccacatgggcagtaactccctaggaggtgacagagcaacaggataaaaggaacctgggtccttggataacttcatgaaatagagttgccttttctctgtggctctcccacttaactctggactattatatgagaaataaataaactaaattgtttgaaaaataaataaaagatgaatagggagggagtgactacaaaagttgcttatcaggaattctaattggtttacagaaataacattggttaatgattttctatacattgttaaattgtaaggtgtgtggcattttatgtcttcttgaggtcagttagtctagagcttgaatagcaagtggcttcaaggggtaattatttacctcaagggagaatgaggcatgactgctgttagattttaaatacctttttgggactgataacttaggcccatattccttagataaaaagcttttcttcccccctccctccgcaacctttactccttgtggtcaaaaatctttcttctcgaaagcattgttaatcaaaatctaagtgtcatgatgtcccttgtcaccaggaagtctcactcccaggtagtgctgtcccatgttgatgagggaggaggaaatgtctcagtgaggaattttaagagttcccaaaagctgacttaggatggcatcacagagtggcagaaatgagacctcagttaagtcattgatttatgtaagtcattgcttgttgaatcatccctagtctttggaatcccatgattttagtttcctccaaagtaaaacaatgagagatacataacattaagaatttgtattgcagaaatataatgcacacattgactacaatcaaaaagtgaatttacatgtcagaatgaaaaaagaacctattcattagggagccaacaacaaaatcttgaaaaaaattaaaacctggttcttctttacagactggttgtagccaggaaataattcaggatttagtccaagtggtagacaaataagaaaactcaaaaacaatggtcaggctagaatctaataacaggtgtgttatagttttcttatgaaacgtgatttttctgtctctagtctcccttttatttttttaaaatacataattatatatatataaaatgtatacatttatacttagaaattttttctttagtaacaatctcactctgtcactcaggctgttgtgcagtggcatgattatagctcattgcagccttgaattcctgggctcaagtgatcctccacctcagccgtgagtagctgggcttacaggcacaagccactacacccatccagtgcctcttttctaccgaagagaaatagaccaatttatttgcaaaaaaagttttagagttattatacttggcctgatttatttgcataaagtgcagcaagagtagtgattggtcatatagactagttggctttgcctgaaactttttcgttagaaattttggattagacttttggaaacttctcaagtctaagaagtcaagccagggattaaccatcagcctgtgcctgtaatactttcacagtttggtgaattcttctcttcttgaagtcccaaaatattttgatattcctgaaactctcagaaagtgacattctttacataccgcaagtcaggattcttgtaagggaacagtatagacaacttattaggtcaagtctttccaaggggctttttattggctctataaagtcaaccttaattcctcaaagtagtttgatcatatgctgttccagttaaaccttggtacaataaccagtgtctccaatgcgtcctcttacaaaacaaagaaaatattgcacttatacaaacaactatattgtcataaatgtcataaaataagaatattcacaaatagttcccaaattctggagaaaatcaggtaaagaggaaggtaaatgtttcacttttccccacaaaagtatactttacctaattgctatgagctataaatggctcaaaaaaaatgtggactctggcaaaacaaatatgagaagaatcaacaatgtttcaaacaaaaagtgattaaaaaatcatttcagtcctctatcagttcagtcccatgtaattaattcctgttctgtttcatgttggcttagcaatcttcattaacacatcagttttttattcgaattttggaaatttttacctagtccaatggtatcatctccatagttatctgaaacctgtattcaagaatacttgaatatggtacaaactcgtattcaaagtcctttccacgaatttctttgaagacacacattttaggatttggagggaaacaaagctcttaaaaaaaaaaaaaaaaaaaaaacagactagatgcagtggctcacgcctgtaatcccagcactttgggaggctgaggtgagcggatcatgaggtcagtagttcgagaccagcctgaccaacatgatgaaacaccgtctttaataaaaatacaaaaattagccgggcatggtggtgcgcacctgtaatcccagctacccgggaggctgaggcaggagaatcacttgaacctgggaggcggatgttgcagtgagctgagatcatgccattgtactccaccctgggcaacagagcgagactccgtctcaaaaaaaagacatgagaataaaacagtttactgcatataccaaggcatatcagatgtttaggaattgcatacaattttggaacacatatcaatacaactgtaactcaaagaaagctgaacactatttcttgtctgacagtgctttccatgtttgaaatttgatttgggggaactgtatcagatatcaaaggtttaaaacactagatatggccgggcgtggtggctgacacctgtaatcccagcactttgggaggctgaggcaggcagatcacctgaggtcaggggttcgagaccagcctagctaacatggtgaaaccccatatctactaaaagtacaaaaaaattagccgggcgtggtggcatgcacctgaatgtgagctacttgggaggctgaggcaagagaatcacttgaacccaggaggaggaggttgcagtgagccaagatcacgccagtgcgctccagcatgggcgacagagcagggctcccatctaaaaaaaataaataaataaatgtaaattaaacagatatcaagataagaaaggtttgaaatgctcagtgttaaaataggatcacaggtcattgtaaaacagtcatttaaacaaagtgataagtcagtgatttttaaaaagtcaaaacctgtgctctttgattagcaggagactccatcaaagagtaagtttgaggagactgtatcaaagagtaagactccatcaaagactcacttttccaaataagacctaataaaggcagcatgagctcaagaaaatctctctctccctccttttcttttgtagtttactcaaaagtaaacaaaaccttttactatctcctgttaacactacctgaaaatcttgttcaaaagagaaaacgaaatcctacctttgtatcagtatattattaatattaaacctaattttaataaaatcttacaataaacagatccatctgatcccagtcagctttgaccagataagattttcatgaatcttttataaactcttacaattttattttttctttctccaactttttagttttagctatatcatgtaaattttgaaacaatctttaacctctaaactaggcaaaattacttttcctttagcaaaactcacaccctcctctcttttttataactttcttcaccaaaaacacatcctactttcattgtatactttgcatacaagagtgtttcccatgtatctagtacttttaattacatatattaactacgattttaactcttagtagttctaatttcaagtgaaaaacctagaaagtaagtagtagttaactggtttatgtctgtatttgtagacaaatcatttcatggtttcgtagaaagatatttctataaaatataattgatgcctacttttttgtttattaacagatctaaagattattaacagatctaaatatatttagcttttttataccatgtaaaaacaaaataccaaattatgtaaactaaactaaaacatatctaataattaatgtttttgtatcttaatgtatgtagaaatgactcaaacattttatgattatctattactttattaaacctaacatgacttcaaaactttaaactactgaaaagaattttgaaactgcaacacagatacccttcctaatgtcttcctcagtcatactgagtcgcaactacccacgtggcacccaagtatgattatgaaggggcagggcctatctgagtcctgattttacacacccataatggagcccaggacagaggacagaactgtgaagataatgtctgactcttcccaccatagccaggagacaacagccaggccagagggagtaccacatatgtctgcagtcctcacttgttagagcccagaatctaatgagtctaatacataagctcacagacaagtcaaataagcatcaaacatatcacagaagcaatagttttatgagcttcagacatctagtagagaaagcctaaacctttctgaccagcagacccaggcaaaaatgtctgattgtgtttaaaactgacaagtctgaagacattctaattttattttaccaacaattaaaaagctaattttatttctcaaagattactaaaatcacattaacttgaaaaatatttgggattattaagctatgagcattaatttgtcagtttggtaccatgtaaacaatatacaaacagatctgtacacatatatacataaaaatacaaacataagtgaagatttcatagctttgatataaaaattctagccatgagacaagtaaaactcgctattttaaaaggacattggattcaaagttcataaatagaacaagttcaagtttattgtatatgcctgaagcccttaccaagttttaaataacaagtagcaaatttatatttcaagcacagagaatttaagctttccaaaaggccaattcaattttacgttatctttggcaaaaatcatgttaacagaatccaaaagagtaaaacataaaggcctttcttctacaaaaaaaaaatattttatatattttttatatattatatatctttatatatacttatatataatatatattatatatatgactcaggctagctatatatatacagctgtgtgtatatatacatatatacacattcaggctagctatgtgtatatatatagctatgtgtatatatatatatgtatatatatatagctatgtgtatatatatatgtatatatatatagatagcctgaatgtcagcttttaattaagctaatttctggctatagacctctttcaaagaaaaaaaaatattttcaagtttcttaacagattttagctggaataaacagccaatattcctggcttttgactttttttttctttttaaccaagggtacctttccaagtgactcaccaaaaccaataagccttaagaaaaatttttatgacttgaccaaggatgcacaagccatctccaaagaggtgcaaagcaagccctcacaagatccagaaccaccccaaagacagtttaaataatgaaagtcttggtagccacaaataaggtgcaaatccacatttttgcttgactgtactctctagggtttcagctgatggcagacagaagaagacaggaaatcaaaagctgttcatggaagggaaaaggatcagtaacaaatgggtaccctaaaaggtcaagagtcatattaatattgtaataattgaaaatattcaaattcttgtaaatgtttctctcctaagctaaagatattaaccaaagaaaggaattttttgttgttctaaagaattttaactctgttttagatcttatctcagctggaatgctgcttggctaattccctgcatgttaacatttcaaacacatgataagatttatctctccaaggtactgtgaactccagctgggcattaaaggatatcatcagtgccatttattagtcctggttttgaaaaaaaaaagttgttagatctgtatttttataatctcagtagtttcattctcattttttagttgcactgtttgctccttttgttccaaatttaaatacatttctctcttttagactattaattttccagttacccattttattgccctaagtagttgttaggttcttctaaagggatgacacttaacatgaaatatgtagaaaaaatatataactcaaaagtccagagctgaaatccaaggaagaaggatgtaggtaaaagccagttaagacaagatggcctggcccagtgccgtggctcatgcctgcaatcccagcactttgggaggccaaggcaggtggatcacttgaggtcagtgagactagcctggccaacatgatgagatcccgtctctactaaaaatacaaaaattagccaggtgtggtagcgggcacctgtaatcccagctgcgtgggagggtgaggcagaagaatcgcttgagccggagagtcagaggttgcagtgagccgagatcacgctagtgcactccagcctgggcgacagagcgagacagtctcaaaaaataaaaagacaagatggcctgaaaagcaccttcaccaaagacttatgtaaatgtaagccaatggtaagtttctagtgactcagcactccctctccaggtacagtgaggtaaagacccttacaaatgaagatttcttttgtagatgtaaatttcttttataaatagccaactaaatgacagaaagctgtattttggacactgattttgttgaatgggtggtctttttatgttcacttttgttagcttaaaaattactgagttcagctgggaaagcccattaagaaaaagggcaaaaaaagcataatatatgtgtggactcagcatggatagctctgataaagaagcaagcctgaagggttacccctaggttaaagacctcttctaaaaaagaagggtttgaaagaacagcccaaataaaatgtacaccttcaaccaaagagtggtataggtccagattattagtaggacttttgtccaataatttatcttggaattggaagaacatgagagtttcatagttggccaggtgccaagtccaggaatggctaagggtggcttactgtgaatcctgctcacagtgccagaaatgtcaacctaaagggaagaaaatgaggcatagttaatacagataatgtatttgggccaaggttgaggactgcagcctaggacacacttccaagtggtcttggggagtgctccagagaacagaagagaggctcatatttttagagaaaaaaaggatgaatcaggaaagggattgattgcaaaaaggtattcatcaggaattcttgttggtttacagaaataacattggttatttattgtctatacattgttgaactatagtgtatatggcattttatgactacttggggtcagttagtctagagcttccatagcatgtggcttcaagaggtaattatttagctcaaggggtagtgagacatgactactgtacatttaaaatgcctctctgggcctgataatttaaaggggctcgaattccatagagcaaaagttttttttgttttgtttttcataaccctcatgtttagttaacattgctgacattcatgaatcaaaaaacccaaaccacaaaaaaacaagctatttttattatcacttctgctacctagcatgtcaggcagtcatgttatgtttaaattgccttcaaatggtttcaggaacttttcccatatgtatgttattgaaccactccagaaaatcgtaaatcccttttgtagaggaagagatgattagacgagaaatacttagtgtctggcacagatttatacagaaaaaaatttttgtttttagtttctggtctttgttgttactttgttggtagtaaaaaatgagttttttttttaattagccaggctttaggccttatccagtgaaggacaacttgaagatgagatagagcataaaattcaagctatttctagagattgatacaggttcattagctggacaattaaactttttacttgtcttgcaagtcttcaacttagatttgtcatatttggttatcataatcaaatggaaatagtagtttttgccccatcttgctgagcttttagattttgagatcatttgtaacatactctgaaattcagtgaattttatttttttctgctgggggcaggcacatttaattacagaaagccatttgccatggaatctttttttctaaaaactacctagcgttaaaaaaaaatctgatcataattacgttgctagcaagataaactagcaataagtatatgtggtatcaactaatatgaaaaaaattatctgtaaaatgcatctgggacacttctcatttgctattcttaatttgcagttttaggaattgtctcgtggtggttgaatgtgatcagcattttcttttatgagcctgggagtcttattagtgaaagatttggcaaaagttagaagaaaatgtcaggcattcgggtcttctcaaggaatgagatttttcagtatgtaaccaatttttttggataggcaaagatttaacccaagtagtacactgtacaaaggtgcctttaaaactcagcattctttcttgtgtaaaacctcataaaaattttatggaaatttatgggtatcaatttttcttagatttaaaattaaaatagcttttgagtaccttgggaaatagtatattcttacaaagtagatgacctatttattcagttgaatgtccttgtgaaaattgacgttgctttactgacactaataatctacatgcagttgagcaagcccagaagccaactttggaatattttgaaatgtttaccattttgagtacaaagtaattttagaatcttggataccagctcactgaagtgttatggtaatatcatacccatatcatttccgttacttatatttgttattgtttaaacagtagccaaaaatggccaggcacggtggctcacatctgtaatcccattactttcggaggccaaggcaggaggattgcttgagaccaaggagttcaaggccagtgggccatatagcaagacctcatctccattgaaatatatatattttaaagtagccagaaacatgtacttactttactgccaaggatatggctgtaaagtcttgagatctttaataaataacttgaatgtctgaatgacttggaaacaagttctgaattagcttactgatttcatgtgtctggcgctatttagctaaatccaccctcctcaaaatgtagaaattgttaagggacagtttcttgttgagacagtttctgtcttagcatcattttgtggttagaatgtagtaaacctactcaaataagcccaattaagaattaaatctattttatgaataggtctttaaaaacccaattgcagaactacaaaccaggcctctttctcccctttgtgggtgggggtcagattctcctagaagagagggcaaactaggtatgattagtatacctgctagaaagaacagttaagtggccagggcaaacaaagttgtctcttggctgtaataatttttttctggactcatgggcaactaaagaaacatgctaattatactgatgcttaaaggatttgccctctattacggagggtctgtgggagtagaactgtaacctcttctttataagcgagtagtacagaaaagggagaaggagaaagaagaatcctaaatatggaggggaatcatctggaaagagctcagattaatttttataaaattgtgtaagattttataagattatatatttttataagattataacctcttcctggaagcctcatttttaaactgcttatggtagtgacattttattatacatgaatttaacttttgaatatccagctgtacctgtcttgacagataaaatgacagtttcagtagtacagacaattctgcccatcctaggaagcttatgcccttgcagatgagaatctgctgttctctcttagtttgtacatgtctcccgtcagatgagcatgtcatatgtagtgtaaatactttaaataaaatcatggccctgaatgttattgtactaaatgttacattatgatttaaggagattttcggggtaattttgactatgtcagttttgtggattatttggaagagtggaattttgtgcactctgggctcgagtctaaagttagtgtgtaaagccaaagtcagaatcacccttgaaagttcctcaactcataaaagccaatatgaaatcttttgtgtacatatacactcttgagcattaattcttacacacatttaaattggagagtgactaagctagactgaaaggcaaaaggaaagtatacaggtgttgtatattcattcagctttaaacatggtataggtagggaattctaaaatgttccttcttgcctgccagctttacttcattttgttttaataataaactctagaatcttaattcttactaatcgtgtatttgttgtgggaatttcaggagctcgttagcctcacctttctgtgagatagcttctgaaatcagttggctaaattctaaggttagccattaagtaggtttatgataaaactttgttttattgtagttttcattatttcccttttcttttgctttagtattttagtaacatcacttttaagatgttactcatctcaaaggaggcaaaggaagagatttggtatcaagtccttcattcaactaaagtagaaagagagggaagtagtatgcccctctaggctggtggttgctgtgggaatcaatgtaaaaacccctttaagaggataaaaatgggacagttaactggaaacttaccaatgagacattctctttctagagctttttcttttctagcatgttccccccagttttaagaagataacccacactcttatctgtttcttcagtatataatctcaattgtgagattacaaaataatttctctttaataatatgcccaggtgagaatgggagtaaaattctggttttctttatttggtgctagtgtcagcagtgactgaaacataggctgtctcagtctgggccctgtagtacaatgctcagacctaggctggcttactcttcatatggctctactaccttagtatagaggaggaaccgtaaagtccaagattgggcacttcattcacaccacttagtaggcagtctcctaaggaaagaagaaaagtgtatgtccggagagacataaatggctagtcagccatagttttttggggggaaaggaggaaggggagagtaccctaggatgcaccctatatttcacatattgtttctactacttttggttaaattgtagacaagtctgttgttggaataggccttcttagtgcaggacatagtggtatttctatattaattacttaaaatatagttgaaaaatgaactttgagaatacctagaactgaaatagatgcatttgtatggtggcagctgagatctgatctaaaggccagttgagggctaataaggagtgaggttaaatttaagcttattactcttttaggaaaatgatgtgagttagggttgaggccaagaaattcttactatattctgaaagtagtgagacttcattcgttagagctaacctcatagtgctcactatgagcactcaccttaaaggttattatctgcctcttgaagaagcacttactcagcggatcctgtaacatgtggttctgccactttgtccataactgattagaccagggcaagcctctggctcaaggctaatggcttatgaagtggcctggtatgaaaactgcataaacagcaataacaagattaatcatctttctctttctctttctctcctgtaaactactccttgagaggagaaagacaggcaattcataatgggaatttaaaataacagtttgttcacttgttcattggttcattcaacacttttttgaatgtctgctgttagccaggtactactcaaggcactggtgatttattcatgaacagaacaaaattcatgctttcatggaacttgggtttgagtgggacagataataaccatgtactagaatgttagcaatggtaagtgatatgaagaaaaatgaagtgggttgaggggagagagtgtgcttaaaggggaatttagataggctagtcaagtaaggcatctctgaggagctgtattaagagatttattatacggaattagttcatgtgggtatggaggttcataggtcccaagatctgcagcttgcaagctgaagaccctggatagctgatggtgtagcaccagtttgagtccaaaggcctgagaaccagaacaccgaatgtagtttcagtccaaaggccagtaggctcaagatctaggaagagctgatgtttcagtttgagtctaaaggcaggaaaacaccaatgtccaagctcaaggcaggcaggaagagttcccacttattcatactttttgttttattcagggcttctactgattgaatgaggcccacccacatcacagagtgcagtcagctttactcagtctgtttatttatataaatgttaaaattatccaaaacaccttcacagaaacacccagaataatgtttaaccaaatatatgggcaccctgtgtcctaggcaagttgatgcataaaattaactgtcatagataggtctattggtagccaaagaaccaggttaagtaaaaatagataggctctaagttacctcagtgacttattgccaggattgcctgatgattacagctgtcttaaattctgaaccttgttgtattacctgaattattttccagggtctctaaagtctggctatatggttgcattgaacttattcttttctccttaagtatgttttatgtaactagtttaacctgtgtgtttctacattcaggcttgacagcctagccattttatggacggggcggagcgggggcggtcagcctgatatataaagatatcacagaaataaaccttgagtcataaaaacctaatatagccgcccccctttactaatgaagagaaacactggtaaagacacatgaaacaatttattaagtaatttgttactttaaaaagatttacattttggttaacttttttagcagttgtttgttctaactctgtgaagagcctgttttggaaatctgaaaatgtaggagatgcagctattgtcctcagaaagaccatagtctgataataaaatctgcataagtaaatatacagcaaagtagtttagatgagaatttaggttagagctggtttgaatggaaaaggcttatgaagatcacatttaagctagtcttagacaaaatttggatagatacaaaagagtgttaaaaatatttcatgaaagggaaagggaaatgaacaaatgagatacatcagagtttgggggatggtagtttagctgtgttgacatggttgtagtcttcttgctgtaggagtagtaacaggtgagatttgaaagttaaagccgaacctcagtatttccatacttttggttgcacattaattcttttgagcctcagattattccatctgttaactgggataataatgccaatatttgttcatatgttttaatcagttacatctaaattctataacaagagttcctttgtttttaatctcagaagccttctaagtagggaaatgagtcatcagaaaccatggcatttccttctcacacatactcttgctgttcaagcttcatgatggagagatcagtatatcaaatgcatcctctataaatctcaccagtatccttaatgcccttatcttggtgaatgtggaaaaactcaaagtgctttttttctgttctctcaacacaacaatcacagaagacttatgtgatcaaatgttgcatagggggagttccccacacaccaagcaagcgatcagttttgcagcagatgcctgctaagtgtcttccaattccattctgacactagttacctggagatagcatgagatctcacaagtcgagggcccagtcccctcccaccgccaccagataccagtctcaggtctggaacttctgactggctccaagttgaggttcccatgcccctctctttgggttagattaatttgctagagcagctttacaaaactgagggaaacacctttaccagtttattataaaggatattacaaaggatgcagataatgagatgcatagggtaaggtatgggggaaggaacacagagcttccagaccttcccagggcacgccatcttccagaatcctccacgtgttcagctatccgaaagttccctgaaccctgtcctcttgagcctttcatggagatttattggataggcatgattgacaaccatgtggaaatgggattggacaaaaagggtataatctaatactaacaggccgagtggagaaacccacaagcctgtctgtccaaattcttcttagcctttctgtgcagcattcctttctcaagggtgtgggacaggaccacttctgaaatgagagtcttatgacctgcagtcagaaaggcaggggaagattagactcttgccttgagctggtgaaaggaggatgggaaaatcagagagagagattctgttttctgaggcctggagcaccccaacatcataaccaaagtctgtaacaaggtatatgggagttaagagccgggagctgtggatgaaaacctatatatatgttccctatatatacaatacatagaattatatatatgttattatctaatatgtaatagatatataatatcacacttggaaattgcactttttctcagtcttttgatgatacttttttatggtagtgacacactaatatctccatccgtatggccacacatgtgctctggatcccattcttttcttcctttttggaaataatatgctatctgagaaacctattttctttctcattcccccattctcactcttcctctctttattggatcctttttgttagcatataaacatgttcaggttgtctctatgttatatgtgttatactatgctatatcatatataatatataatctaattatcctcccttgaccatttactcctctttatctatttcatctttggtcttctttgttaaacttctctaaagaagtagctatatccagtttccttataaatttcccagttacatggcagctcattttaatctagcttctgctgcgttcgctctactcaaatggcttatttgacacctctgttaaaatcaatgctattagccattttgttctttaaaacactctcttcctttggcttcttcagtatgttcttgttttctgtctaggtctctggctgcatcttctgtggcttccttgtcagctcatctttctccagttgctcattaaatgtggttgttataaagctgaatcttaggtatctttttacttaacgactactcttgaataacttgtctctcattgctccagttacagtgacaactcctacatttatctttcaccgagactactcatctgggatccagttctatatctagataccaaattgatatttccatttgaatgtcttaaagttatctcagactcaacaggtttaagacttacaacttctcttcctccatattctctttatcttcaagattatttttttggactcattgtagtccaaaatttgaaggactcaaattctctaccccttacattgtaaccatagtcaattaatcattctaagattcagtttcataatctgtaagatggaaaaaatgtagtacctttcctaacataaggaaacatcagacaaaatgtgaatatgggatgtaataccacggactagatttaccctctagctgtaaacaaatagaaaaccctcctagggttgttttcagtattaaaatagtatttacaaagcccttgaaacaggaccccatgtaaagtaagatttttttaaagtgtctgctttattgttgaatatggatatgaagttgtcagatgaagcttgcaatgatgcttaaatgcttatattataaaaagcagttctcaaatcagtacttttaagattgcattttaagaaactaaaagaaagaatagctccaaaacaagcaatgagaagaaaataaagataaaataggaagcattgaaatataaaagtgtaaaacattagagaaaagtaagagaaattaaaatcttgtttttttgaaaagatcactaatagtgataaaattctagccagactgattagaaaaaagaagacacaaatgagattaataggaatgaaagaggagagatgagtatagattctatagacattaaattggacaacttagattattaaatgagcaatttccttgaaaaacacaaactaacaaagcctgtttaagaagaaatagttgccaaacagccctatgtttataagagaatgtagatttataattaaaacattccctcaaaaagaaaacaactcatcatagaagacttcactgagatagtctatgaaacatttaaagatgaatatcatttccatacactctttctgaaaataagagggaacactgttgcaactcattttatgtcagcattactctaatatgaaagaaaactacagtccagtattccttataaaatagatggaaaaatcttcaatgaaattttagctagctgaatcaatacataaaaaggataatattttatgaccaagcgggatttattccatgaatgcaagggtggtttaacatttgaaaatcaatcagtgtaattagccatatgaaccaactaagaaagaaaactatatgattatttcagtatattcagaaaagtcatttaacagaattagtaccattaatgataaaaactctcaaactaggatttaaagggaactttctcaacctgtctgtcaaaggacaactagtaaaatcctataatatatatatcatgcttagtgatgaaagactgaatgctttctctcttaagatcatgaacaggcaccacttctattcggcattgtatggaaattatagttagggcagtggagcaagaaaaagaattcaaaggcattcaaattggaaatgaaaaaataaattgcttttgtatacagaaaatcccaatacacaaaaaaagcctactaagatgaataagtgagtctattacaaaatcattatacagaaattcattgcatttctacatactagtaatgggtaattggaaatttaaatacaaacaaattaaaataaaaatattagcattcaaaatcttaatgcttatggagaagttaaacaaaattatgtaaagcctgtatgttagaaattattatacaggcctatggaaacaagtgtcatgtctgtgaatcaaaaaactcaaaattactataataccatttctccccaaattgatgtataccataaatgcaattctagtcaatatctttgcaggccttttttgtaaaaattgacaagcttagttctgatatttatataaaaatacaaaggacctagaatagctgacaattttaaaaaagaacaaagtttaatgacttaaattgcctgattttcacacttactagaaagctacattactcaagacagtgtggtattggccgaaggataaacatattattaatggtatagaaaatagttcagaaataggcccagacacatatatttatctgattttcagcaaaactgctaaggcaattcagtggaggaaactggtaatctttttaacaaatgatttttggacaattggacatctgaatgcaaaacaatgaatcttaacctttaagtgggcaatgatttcttagacatacagaaccaaactgtgaaagaaaaaataaaccagctgtacatcatccaaattaaaaacttttgatcttcaaaagtcactgttaacacaattcctatcaaaatcttagcattattttttgtagacatggacaaatttattctaaaatgtatatagaattatgaagtaactggaaacaattttgagtaagaagaatagagctgaaaaaaatcacaccactagattctaactaagacgtaacatacagcattatactcaggacactgtggtattgatcaaaagatagatcagtgaaacagaattaaaagtccagaagtagacccgtacaagtagagccaactgaagtttgacaaagatgcaaaagtaattcagtggggagaaatgatgctttttgcaacaaatggtattagtataattagataataaccaaagaaataaactttgacttaaaactcttatacaacagttatcatagatctaaatgtaaagtgtgaactataaaacttttataaggaaacaaaagagaagatctttttgatctagggccaggtgaacatttcttgtaccaaatccataaaggagaaaaaaataatgacttgggcttcatcaaaattaaaaacttttactctgtgaaagacactgttaagagcataaaaaggcaagccacagactggaagaaaatacttggaaatcgcatgtctgataaatgtgtatcccgaatatattttaaaagtctctaaactcaacagtaggaaataagacaatgcaattagaaaatgagtaaaacactgaacagacacttcaccaaagagtatatagatgacaaagaagcacatgaaaagatgctcaacatgattagctactaggaaaatgcaaatttaaagccatgatgagatatgacacacgtactagaatggctaaaattaaaagtactggcaaaacgaagagttggtaagaatgtagaggaactagatctttcacacattgctggtggaagtgcaaaatgatacagcactctggaaaacagtttgccagtttcttataaaattaaacatggagttaccatatcttactcctggatatttaccctaaagaattgaaaacttatattcacacaaaaacatgtacacaaagccttagaacagctttgtcatagccagcaagaggtgaatagatagcaaattgtcatacattcatacaatgaataatattcagtaagaaaaagagcaagctattgatataccaacaccttggagaatcttaagggcattatactgagtgaaatagctattcagttcttttccctattataaaaatacggctgtcttcttatgagttttaagcctatatacattccagatacacatcctttgtcagatgttttacaactatttttttcccagtctgtggcttgcctttccattttcttaacagtgtctttttattttgaaataattttaggctcacatagaagttacaaaatattacagtttctgggtacctttcacccagcaacagcatttgacaaaccatagtacaactatcaaaatgaggaaactaacactggtataaaactattaaccaaactagaaactttcctcagatttcaaaagatttaaaagattacttatggtaattttaatttgtataacctttttttttttttgagacagtctcactctgttgcccaggatagcatgcagtagtgctatcatagctcactgcagcctctgactcctgggctgaagtgatccttctgcctcagcctcccaaatagctaggactatagatgtgcactactactgtggcagattttttttttctttcattttttatagagatggggtctctctatgttgcctaggctggtctcgaactcctgggctcaaggagtccttctgtcttggccttccaaagtgccaggattatagatatgagccactactactaacctataactttttaaatgaaaaaaatgatagtgacaaagaacagattagtagttgccgcaggtagacttgggaggagtatgtgattataaagggatggcatgaagatgtttctttgaggtgatggaatagttcagtattctttttttctttttttgagacagagtctcattctgtcacccaggctggagtgcagtggtacgatcttggctcactgcaaccttcgtctccagggttcaagcgattctcctgcctcagcctcccaagtagctgggactacaggcatatgccaccacgcccagctaatttttgtgtttttagtacagacagggtttcaccgtgttagccaggctggtattgaactcctgacctcaagtgatctgccctcctcagcctcccaaagtgctaggattacaggagtgagccactgtaccaggccggaatagttcagtattctgattgtagtggaggttatactaatataaagtatgtgataaatttgtatagaactatacacacacagggcatgtaaaaactggtaaaatctgaggaaagtttctagtttgattaatagttttataccagtgttagtttcctcattttgatagttgtactatggtttgtcagatgttgttgctgggtgaaaggtacccagaaactgtaatatttttgtaacttctatgtgagtctgaaattatttcaaaataaaaagacattgttaagaaaatggaaaggcaagccacagactgggaaaaaatagttgcaaaacatctgacaaaggatgtgtatctagaatgtatagtcttaaaactcataagaagacagccgtatttttacaatagggaaaagaactgaatagctatttcaccaaaaataattacataaacggcatataagcccatgaaaaggtgctcaccttcattagttattaggaaatgtaaatgtaaaccaccatgaaataccactgtacacccactagtatagataaaattaaatggcaatccgaagaatgtggaacaactggacctctcacatgttgctggtgcaaatgaaaaatgatatggcctctttgcaagacagtttgacaatttcttaaaaatgtagggctcagcaattccactcctagataattaaacgaagatgaatgaagaaaaagtgaaattcataccagcatcatttataataaccctaaaactgtaaacagttgaaatgtccaagtggtacgtccacacaatgaaatttattccctagtaaaaggactccagcatggatgaatctcaaaatcattagaacaaatgaaagacgccaaacaaaaattacatgctgtgtgatttcatttatatgcagatctagaaaaggcacaataaccaattcagtggttgctaggagttggggggcaaggggtagagagtggagattgaccatatagggaatgtattgaagtaatgggaatgttttatatcatgattttcctgatgatggttacgtaattgtatacattaatcgaaactcatcaaattgtacagttggtacaatttttaggtcctttgcattcgatttgtttttttctgcctagaaagctctctcctctccctgtctggttgactcatattcagtgttcagatcttgcttaaacgtcatgttgtcaggagtatctgttcctgagcccagactggcataggcttctttgacatcctgccgctttccttcattgtccttaccacagctgtagtttcagtcaggcaggtagccatcagcttaaggtctctttttctgtcctagctgcaacactgtgaggagccagatgctgattaccatcttgttaacagtacgtagcatggtgcttaaatcaggtttgaatattgcatgactgagtataagtgagtagagagttgtgtgtcttctgttcttgtaagtggcagctgtggcttctgccaagggtactactagctggggctgcctgcttaaccttggagcctgtctgcctgcctctgccctgctcctggggagttgtgactatccatgctcatctgcctgccatagcctttgttcagacttcttgtcaccgtgaatcccactcctgtggccgggccaccctgttctgagaacagaaaggagcttttccttgctgttattcttttagcagaaaaggaaacctgccctactgcatgcatgttcctggatctactcaagctttttctttttttccagcaagtggagaaactctgaaacacagtgttttgttacctgctttggtaacaatatatcacctcctgtgaagcaccagagtacccctttgtctcctgattatcttaatctttttgagagagacatatgactcctccaagtaaggttaggaatcctaatctgcaggtagtctgaatgcttgggtggaaggtttaaccttcccaaaggtgaaaacaccatcaactttgtgctcagcctctgctcatatttgcagattatcagagatcattattactgtctccatgtcccccgctgacccagtttccaggataaatgtgtagaataattaataaagggcttgacagccaacactcctcttccactcttcccacttctcttcttccttatttcactactgtagtaggtaagagggaattcaggttatggtaggaaaatgattaggatgaacaatccctgtatgtgagcattgtgtgaacatagctcagtgtttaaatcattaccaaagctcctttctttattatgggctgtccacttaagaagaatttatgagtcttgtcatttcagacagtcttccctggagcactacatgactagtccagttagtgattttagaaatgtttctctggaccttttaaaatgtatccaagtctaattcctcatttgtttctagtttatttgtcctcggttttacagcttacatagtttggagtttcctgtttagttttgtttatttttaactcctttaggcctaagactcttcattgtttctctttcatctgagtcattataatagtctctcaaaagttcatattccactcttgctccccctttctcctgcagtacaatctacatgtcgcagccaaggatcaggtcaaggcattctcatgctctctccagtggctcaccttcttacctagtttgtgatctggccccaggacatgcagactgcctagtaggcaattaatatctgctgaattaattctttgtattgtaagtcatatcaggatttcttgggggttagcattatcttaaaaccacaaaaaacaataactttagacctaattggtttcatgacttattgaggaggcgaggaataggttaaagctgctttgcatacattttggaatagtctcttttgtctagtaaggatggataagtttgttaataaccagtattcacatgggtagaaaaaaagtgtcttgatttttaatcctacaagtagtaaaggaatggtagtcagaagttgaatcgtacttttaatgcctcaggcaggatagaatagtattgttttgttttgtatcccaatatgcctaactacttctctctctctcctttctgttttgcttctcatcctttcacccattacagtctcagtatgtgtgttacaccaggaggttgccttggcaggtcagaggatctgtcacagtgaaggcactgtggtaccctttgttttttaggcaaggatgacacatgctagtcaacttatttccatttgttgttccctccacttggcactaaatgagacttaaccatttttgaatcaaagtttataaatttcttacaaaaattaaggtttttattctctataataagcacatgagaaagactggttttaaattttaaactgtggagtgacgtaaaaacatgtttaattttaattatttgctttcttttgttcgtcttgtaagttattaatgtattaatactggtaacttctagattggaggaatgatttatcctaatgtttcttttttaaaaaaaactatcagtcattcatatggcatatgctaatcaaggctctgcggtattttttttcttatgttttttaatgaagcagctcttttcatgatctagcagtctgtgttactatcagtaagtaaacagtaaggactcaaattttaagattaaaacaagttcattttgttaacatcatgttttgttgcatcttgcagcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatggtaagtgtttacttccaaaaattaggcaaagaatcattaactgctaccttttctcctctcgtaatttagataccttggcaaatatttaacttgctttgaaaaattaaattaaaactaaaaattaaacgaaaactattccacagtaaattgtttgcttcaggatcaatggtcttttctttattattattattaaaggttgagtatcccttatctgaaatgcttaggaccagaagtgtcagattttggaatatttgcattggttgagcattccaaattcaaatcagaaatacttcagtgaacatttcctttgagcatcatgtcagtgcccccaaaatttagattctcgagcattttagatttcatattttcagatttgggataataacctgtattattcataagatacaactctataaactagcactgccatctttaagtataaactatgattaaatacttgggcatagccattgaagacaaatatctctatcagcaaagaataagtggcatgcttgttaatttcatgtatacatgtattcccatagataattgtttaataagaagcttcacttagtcatcactttcacactataatgaagcgtggaatttcagaaatcttattctatactggggaatgaagtcagctaatatctcactgtgtgtgtttcaaaattcatccatatgtttaaaattgatttattagctaatttctacaaaagcctcaggctatatcagcataattctttataaactgaaatgcagatcactctttgggatagttctgatactgattgcagatcactaaattagcataataataaactagtgttttggggaattataagcctcactcaagaataattatatttttattacctcttcttgaaacaaatttcagaatctattctaaacaaaatgtaaactgttaagtatttataatccagtatttctcctaggttctaaaaaaactgttttacatgtgcacagggagtcatgcataggattggtgtttgcagcaccatttataacagcaaaaattggaaatagcatcaaatctatcaacagaagaataaaaaattgtgatacagtcatgctgtgaaatactatataacattttaaacgaactggagccatatgtgtcaacaaggataacctcagaaatgtagtgctgggcttcaaagcaagatgtagaatatatatatacatcattataccatttacatgtagcttaaaatatgcaaagcagtaccatatatttatggattatatatatgtacaaaagattaaaacatgcataaataccaaacttaggatgttgtttatctctgagaaaatagagaaaagaaaggaggtttgacctataatattatatttctttctaaaaaattcagagcaagccgggcgcggtggatcacgcctataatccccgcactttgggaggccgaggtgggtggatcatgaggtcaggagttcaagaccagcctggccaacatggtgaaaccctgtctgtactcaaaatacaaaaattagctgggcatggtggcacatgcctgtaatcccagctacttgggaggcggaggcaggagaatagcttgaacccgggaggtggaggttgtggtgagctgagatggtgtcactgcactccagcctgggtgatagagtgagactccgtctaaaaaaaaaaaaaaaatcagagcaattatggtaacgtattaagatttaataaatttgcataatagaatggcatttattatctttcctgcattcttgaagtaatttacaatatcaaaaattatagaagttggagtcattttgtaagccgttttgactggcctgttctcattgtaaccaaccacatttaaccaaccataaattaaatttaaagaaaatcatattatatagtcagtattaggattctgaaagccagctctctgttcagattttgttttttgttttttgtttttttgtttttttgtttttttttgagacagagtctcactctgtcgcccaggctagagtgcagtggcgtgatcttggctcactgcaagctccgcctcccgggttcacgccattctcccgcctcagcctccggagtagctggggctacaggtgcctgccaccacgcccggctaatttgtgtgtgtgtgtgtgtgtgtgtgtgtgtgtgtgtgtgtgtatttttagtagagacagggtttcaccatgttagccgggatggtctcgatctcctgatctcgtgatctacccgcctcggcctcccaaagtgctgggattacaggcgtgagccactgcgcctggcccttctgtatttattttattgtgtccaaaaggatagaagtaatgtgtttacatagaattattcagcaaatcttttgagtagaatttatatgctttttttttttttgagggagtctaccaggctggagtgcggtggtgcgatcttggctcactgcaacttccgcctcccaggttcaagtgattcccttgccttagcctctcaagtagctgggactacaggtgtgcaccatcacacccagctaatttttttgtattttagtagaggcggagtttcactgtgttggccaggatggtctcgatctcctgacctcatgatccacccaccttgacctcccaaagtgctgggattacaggcgtgagccactgcacccagcctcgtatgcattctttatcctaccttttcttgatggaagtacaaggttaaggatttatttaggctttaggctatctagtggagctaaataattatggatttgtacattgagtgcccacgatgtactaggtggatctttgaggcaacacaacgaacatgcagggtctctgttggcatagtccactgtctatttggatccattagcattttaggaaataggtgcaaaaaaatatatgttgtaatagatatagaagacacatgttgagcgtcatagacttggaagggatccagttacttgtctttggagaaagtgagaaatgtatatgactgtttcatgaattcagtttacagatttttgcttgaagtttttttgtgtgtttttgaatttcttattacagcgcagcttatgatgccattcttgaaagaaatgttgcaatcaagaagctaagccgaccatttcagaatcagactcatgccaagcgggcctacagagagctagttcttatgaaatgtgttaatcacaaaaatgtaagtgaacatttttggtttcctaagtatagatgaaatcaagatttattcatgaatatgtgaatatcaaagactaaatattaggggctttaaattgttctgtattaaaacattgtttaaaagggatatatatatatatatatatatctacagggtgattttcctcaactttattaaattgtatcagaagaatggcttctaaaatttagattatatgatttcctgtcatttaatttacaaaaggagttttaaaaagataagcgtttgagaagaattttattcagcttgatctcatcttctgctttttgttctccgtcaggctgacatttagaaaactgtagcattagcacagagatgaaattgttcccattatgctttgacactctgactttaatcatattgaatataaaatttatatcacttctccctaccccactcccacctctttaagtgatggcagtattcactgatcactttatgatgaggatagtgggtttagcagaaagtgtttgaaactatctagagggtattaacatgtttctaattctattttctaatgattgcaaagataagtctttataaagatatataagttgcactcattttgagaataaacagttatacttttttaaacttacattaagcttattcatacttttgtgattgttctaatggaatgatttcttcagttgaggaaataaactaggagtgaattgtgtaagggacacttttaggcagtcctaaaccgaaggcatctgactaaagacatttcgtagtgtttgtccaaaagagtttatataatataatgagcacagtaccttctgactacagataatacaatttaccacattttgagatctaaatatgtgcaggcctctgtgtattggagttactgggttcattatcaagggaaaaaaaatcatggaagttcaggattaggccctttatttggggagcttacaatggtgttttgaatacaaaacagacatacagagagttaaatatcaaacatcacaaagcagtggccgtttgtcaaatgatgatggtggcccatatattgaaatctaaaaagagggacgatttctgtgagctttaattaactgggaaggctttggggaggagtagacctaggctgactcttaaagatggggtaaaaattggattgttgaaggaaaggagccttcagagaggaagaatgacgtaaaaaaggtccagagacaaagattaaacttagataataatagggaggaaattgtggtagccattcttgttccaagcgggaacttgatgtgttgctcatcacagttttgctggtggcatcctgtccatggatagagctgctcgtgccccttgtggcctgtgaacgcagttccatggcagtggtggtgttgccttagtttttccttggggaggagttcagttaatcctacctctcaagcctgggtgactgcaaagaaaggtggttccttcaactgcatggagtatgactaagcatgtctcacatgattaggcctctagcaggggtggcagaggtttatccaggcagaactctcagcacctagaagagtgtggacaagagtaggtactcagaatatatttgttcagtgagtgagtataaagctaaatatgggaaaactggaaatggtaactgaattattccactcacccatggatggatgtttttgtagtgttttgccttttaaacaatttcatcctctgtacagattgtctcttcactggtctaagcatctctggtttttctcattcttttcatagatggtcttgagtttcttttttaatcttggccgtttatctctgaacacactttgaaagtgacctagcacacactactgcataagccacctagcacacagtactgcacgtctgatcaaatcctctgagaggagctgaggcatgtcatctcttaactgtagacattaaaaccctgtttagaaatttcgtccccatctgactcccgttgtctttctttgttacaggcctgccttacagttcccatctcacccagtctttatattttttcttttgattatggagaattaagtatagtacttcatgtttctccctattaaatttcaaaggtgaaatgtggttgctcttcctggtctactagtgattgctgtgattgcttttttcttccttgttctgacttttcacttgtgggcttcacttcccagttttgctcaggatatctttgtaatagctggattaattcattagcaacttttgagcatattgcagaaattacgtgtctaactatcacagttatccagctgtttccaattcatcatcttattcacatggatgttattattagaaacattttgtaaaatgccattttgaaatcttcatatactgtgtctggttgcatttttctgatttattgctattgttctttgttgtttttattcatggaaggaaatagtatttctcaatgaacttttacctgctcttggtaattgttacttcttttgaagtagttatataccactactaatcattgacttttgcttggctgtccagtctataactgatataatttcctttatttccctttttgaaaaatgggacaactatctgtttgaatctcttttataacagctttattgaaatataatttctgtgtcatgcaattcacccatttgaagtataccattcagtggtttttagtatattcagtgatatgtgggaccatcactacagtcagttctagaataattttatcacctcaggataaaagaaagaaatcttttatcctttagctgtcattcccctacctcccatccttctcagttctaaacaaccactaatcaatcttctttctgtctctatatgcctttaatatttaatacctctcttctactctagggcttcccagatattaatgagaatagatttagtatttgtccaagtctcctattgtgcattgcatgcggttggtagacttgaacttatttagagcagccagatgctttcttattatcatttccctctcttaaatttgtttggccctttctggtgtattatttttccgaatttattcactgaacaaatatttaaataccttatgtaaagctgaatgcttaaaagaaaaacatcaattctgcccttataaagtttatgcctaaaaaacaaattcccatccccaagtatcatcgtcagcaaacatttttatatgtgtgtcatgtaacttgccatatactaggcagtaaaagtgattaagacacagttgtttctaataaggattctctgtggtagggatgaggctgatgtgaaaatgagactagattacagtgtgctgaataccataacaacattagaagataactggggacaaagtagagagaatagtcaactctgtcaagaactaggagttgtcagaatctacaaaagaggttcacctggaagataattaagttgagtagataaatgacaagcatagggaatagtatgtttaaaagcatcaaaacattttaaaaatgacattcttaaaactagcatagctaaagtatgaagtgtaatataggacttagcaggagatgaagtgagttgatggcatatcatggaggcttttgaatatactgcaagggagtttcagaatatatttgttggctttaaatttttgaggaggtaagtaatatgatcaggtctttcttttaccatattataggcagtaaatggtagctggatttgtagaaaaccatcgttagtgacccttaatcagctcaggccaccataacaaaatactgtacactgggtgtcttaaacaacagagatttatttctcacaattctgtaggctgggaagttcaagatcaagttgctggtcaatttgattcttgatgagggcctgcttcctgacttggaggtggccaacttttcaccttgtcctcatttgcctttcttcagtgtgtgctcaaggagagggagagaaaaattgctcttttcgtcttcccttgttttaggccactaattccattatgagcgccccactctcatgacctaatctaacccttattaccttccaaaggccccatttccaaatactatcacattgggtgctaggagttaaacatatgaattgtgtggggtgtgtgtgtgagggacaatcaatctgtaacactagtgttagaaggaattacagcatgaacagtctagatgttagtcttcaagctgtttatagcacagggaatggaaaaaagagattgaaggtcagattgacagtagaatggacagcattctatgagtatttattatggtgcatatactgaaaaaggagttaaaaatcaccctgagccttcttttgtaaaagagagggcacactggaaaagtaaggggtttgggtaggaatgaaaatgaattcagtgttaccttattttgtgagatgtccatgcaaaaagtgaaaagaaatgggttaaacacaatagtgtgagaagggatatgcttatggatgaaccagtgaaatagactgggaatgaagaaaactgggcaagtgcagtattatgaaaaaccaagggaggaaagggctgagattatatagagatactgaattggaaaagaactggtagaagggatttaagatttgctgataaattatgtagaggtttgtataatgtaagtgcttgataattgactgttcataaatggaattacagataaatgggttacagatactctgtgcctccacctatccatcccctcctccaactcctgcccataaagttgcaatatataaaatgaaagcaattaacttgagcttagaatgtaaagaaagattttaaactgatggtagttttttttaactcatgtatttgtagttcccaaattaaaatattatgaagtaatttctaatttttctgtctctcgacttttattatagataattggccttttgaatgttttcacaccacagaaatccctagaagaatttcaagatgtgtaagtgtaataattaaaattttgttaagttagtacatttttcttagattgctgctggacactttagctgttctcttttttcactcataaagttacatagtcatggagctcatggatgcaaatctttgccaagtgattcagatggagctagatcatgaaagaatgtcctaccttctctatcagatgctgtgtggaatcaagcaccttcattctgctggaattattcatcgggttagtagaagaaactatcgtcatactctttgttttctcattgaggtgaaattcatgtaacaaaattaaccattctaaagtggcatttttagtacattcacagtgctgtacaactaccacccatattaaattctaaaatattttcattacccccaaaaaagtctccatgtttcttaagcagttgtgcatctttgccctggcatgataccagtctgctttctgtgtctatagatttgcctttatgtttccatttatatgaaatacggcgtgatgttttcaagatttctccatgtttaccgtgtatcaatagttcattcctttttatgactgaataatattctatataccatatttcgttcatccattcatccatcgatggacatttgggttatttctacctttcagctattatggatcgtgctatgaaaattcaagcacaaatatttgtttgaatatatattttcagtcctttaggatatacctgtgactggaagtgctgagtcatatggtgattctatagttaactttctgaggaaccatcaaactgcacagtgactgcactattttacattcccactagcagtgtatgcgggttccagtttcttcacatccttgtcagtacttgttatctgactttttaaattctagccatcctaatgggtacgaagtggtgtttcttgtgattttactttgcatctccctaacgactaataatgttgggcatttttcatgtgcttgtggccatttgtgtatcttctttggagaaatgtgtattcaagccctttgctcatttttaaattgggttgtttgtctttttgttgttgttttagcatttctttatgtatttcatacatgaaacctttatcaggtatataatttgtaaatattttctcccattctgtaggttgtctgttcactttgctgatgatttcctttaatgcacaaaaactataattttaatgaaatacaattgtttatttcatcacttgtgcttttggtatcatgtataagaatccattgtcaaacccatggtcatgaagatttagtcttatgggctcttctaagagttttatagtttaagtctcacatgtaggtctttgatctattttgagttaattttttgtctggtatgaggtaaggttccaacttcattcttttgtatgtggcaatttagttgtgccagcaccatttgttagagactactcttaacccattgaatggtcttggcacccctgtcaaaaaacagttggtcatagatacatggtttcatttttggactctcagttctgtttcacatagctcctatgtgcctgaccatgtattatactagtaccacattattttgatcacttttagcttcgtagtaacttgaaatggagaagtatcaattctccagctttattcttttacaatattgttttagcttttcagagccctttgtgatgccatatgaatttgagtatcattctatttctgcagaaagggcaattagaattctaattagtatttcattgcatctgtagattgcttaggtagttttgccatcgtaacaatatttagtcttccaattcacaaacataggatgtcttaccatttccttccttctcttcttttttcttttctttcttttctctccttccctcccttcccccctcccttccccttccttcctttctccaccctctcctctcttcccctcccctcccctcccctcccatttgtcttgtcttgtcttctccattctcagctcactgcaacctctacctcctgggttcaaacaattctcctgccgcagcctcccaagtagctgggattacaggggcctgcccccacgcctggttaatattttgtatttttagtagagacagagtttcaccatgttggtcaggctggtctcgaacccctgacctcaagtgatctgcccgccttggcctcccagagtgctgggattacaggcgtgaaccaccccacctggcctctttcagcactttagatgtatcatccattgctatttgttttgccatggcttccagtgataaatcagctgttaagctcattgaggatcttttataagtgacaaatgcacctctcttgctgctctcaagatgcctttttgtctttcgctttcaacagtttgattatgtgtcttagtgcagatctctttatgtttatccatcttagtattcattcagcagcttggatatgtagattcatgtcttttttgatcaggatggaaggaagctaaaaagaaaaaatagattcatatcttttatcaaatttagcaaattttcagtcattattttcttaaatattttttctgctcatttttctctttcttctccttttggaactcccattatgcaaagttgatatgcttaatggtatgccatgtcttgttttctcctccactttaatgttttgtcccaggcagcattgggctatttacttgccttaaccatgttttcaaggaatgcctctgtctaaccttggaccagggtcccacactgaaaatgtggctgctttcttcaaaatcctttgctagttagggaggcaggtagagccaaagactagttaaaatgctggaaatatttcccaatgttttttccccacctttttattgtagtaaatacatataaaatgtgccattttaaccattaaatctacagttctgtggcattaaatacattcataatgtgcaaccatcaccaccatccatctccagaattcttttcatcttgtgaagatgcaactctccacccaccagacagtaattccctattctcctctccccgcaacccccgacagacatcattctattttatgtctatatgattttggctactataaatacctcatataagcggaatcatgcagtatttgcctccttgcaactggcttatttcacttagcataatgtgctcaaggtttatccatgttgtagcatatgtcagaattttcttccttttcaaggctgaataatattccatttatgtatataccatacttgcttatccattcatcagtcagtggcaattgggttggttccacatttagctcttttgaaaaatgctgctatgaacatggttgtccaaatatctctttgagaccctacttttcagttcatttgggctacagccagaagtggaattgccggatcacatggtcattctttttaacattttgagaaactgccacactgttttccatagcagctgtaccattttacattcccaccagtagtgcagaagggtttcagttattcctcattcttaccaacacttttatttttttcatagtaaccatcctaaagggtgtgaggtggtttcctgtttttaagttgccattttcttggttctgagttcacttgattgccgtaaacctttgaataatttccagaattctgaaaaagtttattctgacactttgatgttttatggtgcttctgtggagctattttggctgacatcactgcctctcatcaaattcttagtatcactgtatttcactgatttatatggagcaatgtaaagtttgtttttgctctgaagtgaagcagtatacaaaataaactgctgttattaccagtcattccaaattgggaattgaatattaccaagttaccaaaattgagtatttgccagaattgttatatatatatatatatatatatatatatatatatatatatatattcagaaatattttatatttttgttctctgggatttttacctgcttttttgctatataatttacatgccatacaatttattcatttaacgtgtaccactcagtgtttattatatttgaagattgtatgctcgttaccacaatcttaactttagaaaattctattgccctaaaagaaactccacatccactcatctttatttcccattcttctgtgttcctttcacctctagccctaagcaaacactaatctactttctgtctttgtatatttgtctattctggacatttcatgtacatagaattatataatatgtgatattttgtgcttggcttattttacctagcataatcttttcaaggttcattcatgtatttattgtgtgtcagttcttcttgtcattttattgacaaatatttcactgtatagatatattgtttatccatttatcacttgattataatttgggttgttaccactgactattacaggtaatgctgacatgaacatttatgtaaaatttttttgtgtgttggtatgttttgtattttagttaaatctagcttattctttgaaaagtattgagaggattttttttttttttttttcctgagagacagaatcttcctctgtcactcaggccaggatgcagtggcgtaatcatagttcacttgcagccttgaactcctgggttcaataggttgaaaagaattttttttttttttttttttttttttgagacagggtctctgtctgtcacccaggcatgagtgcagtagcatgaacatggcttactgcagcctttacctcctgggctcagtgatcatcccacttcagcctcccaagtagctaagactatggacatgtaccaccatgcctggcaaatttttattttttatttttttgtagagacggggtcttgccatattgcccaggctggtcttgtattcctggcttcaagcaatccagctgccttgacctcccaaagtgctgggatcacaggcatgagccatcatgcccagcctggaatttttaaaaattatttaattcagtggaattacatcttccttctgagtcatctgcgtcaaataaccttactcatgtaataaaataaatacagagagagttttcacagtataagacaattatgtcttagggctattggggctttttttttaagtgaacaatcctgctacaggcttatccttaattatcattgtaagtgaattccttgtatattacatatacagctgctctaatcatttgtctaatgcaatctttaaataacataataaaaatctctttaaatgggagagtattttatcttcctgagcccctactcatacagtatgtgaagtagagcagacgagtgaaacttctaggtttgggttgtttgtttcctgagtccttagaccggggcagtaatccaacattgtggaagttcatttgattttagtaaagcacacccctccaaatagaaaggttccagattaatgaggatagcaggtggctggaccagaaaaacagaccaaatggtagaagatagaaaacaatggaaacaacaagaaccacaaaaaacaaacacaaaattacaaaagagcaatatttatggtaatatgttaatcggattagttccttaatttaaaaaggtcagattttggcagcacacaaggctcaacaacaactgcgtatttccataacacaaacattcgtagctaacttcaaaaggctgaaggcagagaggttggcagacatataccaggaaaatgcaaacatcaaaacaagggtaactctatttaatgagataaagttgaatatggtggggtcagagaggaagtgttcctctctgagaataaagagtctcgcgttttcaaggtgaaagatactatccaattaggatacacaattatacatgaagtagggttgctatacaaaaagcttaaactgtagaaaatagaagaatggcacaagcacagttgtattgggatattctaacttactcccttagtatcagtacataaagtggtaaaaatgaagtacatctgtagaaaatttcttaatgtgataaagtggagctaatgagatctactggggtctgttatctattatgaagaatctccctttatcttggcttgggctctttgggaaactctagagtggggatacgcatttaagttttttgcaggtggtcttgaggccacgattggtactcatctctctgctctactacttattctagattcacctccacccttggctagtacttctgctagtctgaggttacttacttggtaaaataacctgacctttcatcccttgggggttcagggcaagtcaggattgctactgtgagaccaaagctgacgaggtcccaccatctagatagttgcgggtcactttgtcggaaagagaaagccaagtgatgtgcatggatggctcttctttgcttggaagtgacacacatgacttctgcttagagtgcattgacaaagctagccatagacttgcttaatttgtaaggaaactcggaaatgtggggagagcagacttcagcatagtggtgagccccagcctctgccacagtctgttcttctggctggcaaacattcctttgctccctttattccacaccttcttaagggaaataacccaaagttctattccatcaagacatttatcaaatccaggcattgttcctcttggtccagaaacataggaactggaatgaccaaattatatggccaaccctataaccactgctcccctgccaaataccatagatggagtggtcagacagggccagtgttatcacagtgaacaatcccatttagaaaactgaaaaatgcagtcattggttagttgtaattaaattcttctgtacagacattgtgagtgtcccttgccgtgggtggggaatattcctaatcagtcctcctgactgatctctgtggttctctatagtacctggctctaccctgtgggagagtcatctttttgctatcctcatgaatatatctaaagtggatattgaagaatgtattttccttgagggctgctcacctttctcagcctgcttcttacctataaaagattggggcccaagggtcattttaaggccatccttctcagccttgccactattgacattttggagcaaacagttctttcttttgatgatggaatgtttagtagcattcctggcctctacccactagatgccagtagcactccccagttgtgacaatcaaaaatgttttctgacattgccaaatattattttggggcaaaattactgtgaattgagaactcctgtttgaagtgtagaaggatcatagacctttggcgttaggtctgacagttaactaactctttcagaaatttaagagatttcttatctttctgattgtagttcctttcatagtatcttttttagctcatgggtcctgtattcttggacttaattgaggctgtcttcagtcttcctgtaagctttcaagcttctgttggcagactgaggcaaatttatcaattgaaaattttacaggactttttccctgaaagggtttcataattattatgtgaaaatgatgcatagaaaccaacccaagatatcagtggcttaaggcaatatttattgtttacttgggtctgcagggttggctgtgtgacactgctccaaactgtgggtcaagttcaggcttgtcccatattcaggtttcagcatctaaactgaagcatacaccagagacatccttttctcatggtgaaaggtagaagagcaagagctatgctgagtcaaacacattcccccatattccattggacaaaataagacaagtgactgaacctatcgatagggtgaggacacagtctggggtgggcaggaatatttgcagaacaatctaccatactttcttccaggggtctagtagcatttagcttttccaaaatggcaagaccctgaaattctaggctctgttcccttttatttctgctttaaaaggtggctacttcttttaaatgcaaccagtagctaccaacacaaactactgaagttttgctttccagtcttttctagagcagggttcaacaaactttttctgtcaaagccatgtagtaaatattttaggctttgtggataatagtctgcgtcacagctacaagactctgccattgtaacacaaaagcagccataggtgatctgtacttgaatgagcatgactgtgtttcagtatcagcactttctttacaaagcaggcaggccttaatttgccagcccctgtgctagagcttcaggttcattgtacaagtggctgtgcaggtgacagcttcatgaaatgttttgttactacgtaacctagatcacctttccagccttcgatgtgagtttccctgctgctcaactgctaagccaggatcttatgtttttataataattaacaccccacctctgacaccagtttcagtgttagaatagactcagctgtactgaataacagataaacccttaattctcagtggcttagcacgactcaggcttatttcctttgctgaatgtgtggtgcagatcatggtgggtttgtggactgtgcgtttacatagatgatcagcaacccaggctgccagagaatcctctggaaagttcctaatcaccaaagcagggcaggagatgacaggaagttgtgcactggcccttctcttctttacttccactcacatcccatgaactagaactacccacgtgcccttgcctaactgaggaagctagaaaaattgggggaagaagacagaatgttgggttagttccactgcctgcataaattctaagttgctattcttatatatagttagcagtgtaattaacagctgtaaggtacatattgatatatatggatgaatttcaattaatagtctttgaggctttttttgacaatttttttgcttaacaaaaatatctgtctttaaaaattgttactttgctcttaattttttcacaatgaagtgcttgaaattggaatgttatttctaaattggaatctgctagtataaagagccagtaaccttcaaccatcacactaaacattgaagtagtatcaaagcttgtaatatttattcttaaacatgcagtgtttctttgctgaggtactgtattttagaagtattagcaacattatatttacagaataccaataatgaaaatttttttcttctgtttcattaagacctttgaattgttggtatatttaatttcataaaaccactagattacatatcttctaaacccatccatgattgcctgtcgaaatatgttaaagacaacatacatgcttttctgtatgttaacattacaaaagtaatacaaaagtaatagttgtctttcaagcaggctattttccttttttgtattaatcggtgatatttaatatgtatactgcatgtcagtacaggtaatacagtgcatttgtgttgtggatttatgctttcttcgttttttggtcctttggcttataatagtattcatcaaagctaacaggcaaagtatgttaaacatgaagccatgagtgtttatgctgctgcctgacttttgatgggcacagcacagaatatgttaaagtaggggccaggtgaaaaattctgaattattcagtagtatctatagcaagtaattttatagattagtggcaccaaggcaatggtgtcctacttctacaaacagacagaaattttatagcaaatttgtgtgacttcaggtgggaaatcagggatggaaaaatggataatgactcttctagtcctttggaactgggtatctgccagtctaaaagatcaaataacatttgttaggattgacaagatggctcgttgttgacttaaaacatctgtataaagcttattgtgactttaaaatgagattttaaaaatattggtaatatgttatgcaaatgaatataaatgctaacttatgactttcttttactatagtagtttttttatgtgagctttgcgatgtcgtttcaaatcccttttactctaaccaaaaatgtctagctaatcataatttctagcaattaaaacattactaacttctctaataactgtatgtattcataaattttaaatcccataaaactgacttctcaggtttgccttttaacgatgaatcagtgcagtaatattacagtgagaaaaacgaacaattaacatgaatgttttgcaagggatagtataactttattgtgaactgtaggattttcctatatatcatggcagtcattttttaatttttattttctgaaggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacggtcagcacacacatttatttgaaatatttttctgatttagcttttttctttattcagtagatttttaatgtaaatacttaagcagaagtacgttgagttaaatgtgtatcattgtttgaaatgtgtatcaaaagtttgcaggtaactataaattttttcatcaatgtttggaaaaacttggggcccttatttgtttaaatacggatacataacatcagtactaccattggatgaagaatttgttgccgtggccctgagacagaatttatgctctttgcttgcctataacttgaaaatgaacatttctaacatggtctcagggatgtatagtgtactgacagtttattattagtgtacatcagtgatatttgcctatatttccaaccccatgaaactaaagctcatagcagtagcactcattgtaaattttaagagatacattaaggcctctgcaaagctgatggataattaaggtgacctcttgaaggaagcagtaaagtttcattaaaacgttgtatccagccttaaggaaatgacttttagtattttgtatgggtatatccagttgtatcaatcaacctaagaatcagtgttgaacaaaattatctggcatgtagatcatgaatttaaacattttgtatgcatatacctacttatatttaatttaggaagaaattttgttgagtcttagaaatttaggagatgaataaatctgctaagaagcatgggattttatggaaataaaccatcgttttaaaaaatgtggtgacttcatccaaaatactaccaagaataaaacctagacattttttctggcaaggaatctggaatagcagttcattttgaatcaggaaattgtaataagtcaacttttaagattctttttttataaaagatacaattaagctgagcttgattttctgagctgattaaaaacaaatactttaaacatttgctattaattttttattcttaagtaaatatgctgttctttttacttacactctacctgaaatttgaagttttttattttttgggaattgataacttcacgtgacccaccagcatgaagattgcttttgcatttgctgtaattgattgtcatagatatggtgttatgtgtcagtgtcctataaatatgatcttaggatagctccctgccagaaattagcactaagaaaaactgtcatatatagaattgaggctgggtatggtcgcttacacctgtaatcccagcactttgggaggccgaggctcgtggatcactcgaggctaggagttctagaccagcctgagcaacatggcaaaaccctgtctctactgaaagtacagaaattagtcaggtgtggtggtgcacacctgtaatcccagctattctggagatgaggcatgagaatcgcttgaacccgggaggtggaggttacagtgagccgagattgcaccactgcattccagcctgggcgacaaagcaagactctgtctcaaaaaataaaatagaataaaaaatgaactgacatatggttcctctttagttaagaattatgtagatcaccttcttgccttcccactcccaccctaggaaacggagtcaaatgtaatgcttaatgattataactacattagccagcaaggttaaacataagtacttcctccttttaatgacacctcacactcattttatttatcttatttatttatttatttatttatttatttatttatttatttttgattttgatggagtctcactctgttgcccaggctggagtacagtcatgccatcttggctcactgcagcctccacctcctggcttcaagccattctcctgcttcagcctacgagtagctgggactataggcatgtgccaccatgcctggctaatttttgtatttttagtagagacagggtctcattatgttggccaggctggtcttgaactcctgaccttaggtgatccacctgcctcagcctcccaaagtgctgggattacaggagtttgagccacaacgcctggcctcccacccattttaacaactttgctttatgtaccttttattgcaggctactcagagcattttggaaagcagtgtaatcaatatatttttaactgcttaatagactaagcagttagtttacagctagagttgtgcatgaatcagacttatgttcctagtcttcactggcccagataatatcttctctcatgcttgcagctttcaaaatacttttgtttaaaaatgagcttttctgaaagttaccaaataagttgtaagctggatatttaaagtttaacattctctataaaatctgtagagaagatttattctaatagatttttgtcaaaaacggaaaccttagaaaaaatttttctctgaggcactaatttataaatattaaattttttttctaaaatcttatccttgaaagctgaaccatgacataaatatgaaaatattcattcattttaatatgacattttagggaaactttagttccacagtatttccaaaagtaatttccagtttagctcttaagactcttcagtgaactggcagccttttaataagaatgtactgtattagaaagtacaggctttaattttctaagtcctttaacatgagtaaagggcacgtgtctttctgacatctatttgtgccgttttccacttgtcattttaaagaattgggaccttcagatgtcacaactaaatgcaagtttctaaggcttttccttctaaattgctcattcttccctcttttcctgttacactgcaagcacttactctctcctttttgtgtgatgttcaaacccaaaggcataaaatgccacgatgtgttgtcagtttcccttagtaagtggagattccaaattgtctgtttctgtgtctagcagattcttgtcaacattgattgggattcccatttacagttggcaagggtcatcagtaagtcttccaggagactcttcatactcaattcgtgggaactgacttactgtatctagccaaaactaacttcttaagccaaaagcagtttggttttatgggtttaaaaaactttaggtaggaaacatgaaatacatttctcttactaagttttccttgattagttgttcattctctgtgcacttgttccttttgggatagtagggtaaatgtagcatgatgttgccaagaaaacaaatggacttttaattcagaacaagcatagcacttctcagttaaatgtatttgggaaatccagtttaaaaattccaaagagctttagattaacttttttatcataattattcatagagattatttctgttagatattttaatatgctgaattattttctcatgcttttttcttagagagtataatgcacagttgaacttctaaatagtatagtataacaattttatttttataattttactacctcatgtacatttttatttacaaagtttgtgtttggttctatttcatattttataaacaagttctcagggacaaacatgcagggtttttctatttatgcaatttctgtgcatagctctcactttgaaattagatatgtagttaaaatgccacactttacattttcttttgtgaaccagactttcaaaaaataatttgtgttttaaattattccgttagctaaagttacaatcactttttttcttttcgtgacgttttgcagtttttatataatgcagtcatattatgcttctttgattttaatgaccttttgctttgcttttccttcttttgtgctgcaaacatatagtggatttatggtctgtggggtgcattatgggagaaatggtttgccacaaaatcctctttccaggaagggactgtatccttgtgctgctgcagcagttaattagttaggcgatgaacttctttatgttctctaatgaaaatgaatatgctacatttacacagatgggtttttaaacaggcataaagtttgtggctattatagttcaaaaattgttgagataagaagctgaaatatttgtaggctgcatctggcagtaggacatacagtctctgctggtagtcagagcacattcactgtcactcatttttattttatactgctttttataattttaaagtatacatggtgtgtgtgattttatttctttctttttttttttattttaaccaaaatctttatgttaatgtcattgcattttgttttcagttgacatttggtcagttgggtgcatcatgggagaaatgatcaaaggtggtgttttgttcccaggtacagatcgtatccttatctttggcctaaaatgtagtttctaaaggtcaaaatgtatgatagcacttcagtttggtcaggtataatgtattttgtctctccctaatatattgttaaattactcttaaaataccacctactatttgacatagacttttccttccgttatttattgtttcatatgttaattctgaaccctgctcaattgtaattatgcacaattacttgctggctttgagttgatttaacctaaatcaaaaatcatggcttgcattaaaaatttataataattatacacttaagtctagaaatacgtacaacttaatatgaattttggagctgtctgttgcttctggccatccttttgttttgtcccctacctcctttttgttaatgttctgtgtggtttgtgtcttttgattgttgtctcattactcacataacatactgaccctttcatctgagaatttcagcagtagtagttttgtatggtaacgatagctttggattcatactttttgttcatcccactacttttaatatttatattaacagtgatttgttatgtgtttaccagctagtaacacttagaattgtttcaggaggaagaatgggaaaaggcatattcacaaggttacaataagtgagttttaggccttggccttcagggtcctggagtgtaaagactagaggaaaggagaccaagaaatcctaaccttacaacttagcaaaaaactgaatcttttttataagggtcagagctttagaaaatttttttaaacctaagctaaacaaagaatggcaaaagaaaatgccacttttatcgaagcctttatttttattacaactgattattttctgttagtgtagaaaactcagtaaaacaggatgtgttctagaaatattgtctaggagatataatcatgttttctgataaattgacagaaaaggaaaaattttgtatattattatagcattgtgtgcagtttgcagttagagccactatggatagtaattgtcattattcttagttgcttatcattttatttagaatttgtgagtttaagcttccattttaaggtaaaatcagttagtttgaacacacaataaataaggttaataaagcttatttattgatcatttctgtccacctacaatcattgccttttgcagggtgcctgtgagatataaaatttataactgccacatcctttcttaggaatttttaaatttctattttcttgtaatatgaatacaagaatacattcttgtaaatgaatgtattgaacattagttatggagtatttttcttagctacttgatattagatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaaggtactttttacaaatatgtacatttaatcccatttggggtgtgtagtgtgtgtgtatgggtttgtgtgtttatatgtattcatattcttatgggacatgaacccaaggttttctctggatggtggggaaaaaaatgaggtttttgttttttttttctttaatcttatatattttaatcatatgtataagataattttacagtaatatttttaaaacatatgctttttaaaaaatctcaaattgctgaaagttattaataatttgagaatctttacaaatatatgtacattaacaccattatgtttgcagccagtcaggcaagggatttgttatccaaaatgctggtaatagatgcatctaaaaggatctctgtagatgaagctctccaacacccgtacatcaatgtctggtatgatccttctgaagcagaagctgtaagttattttcttaatgtttacagaacatattgcattcttagagttagaatgacagttaggtttggaggagaccttttaattttaaataaaaatgtagatacatgatgatgatgtttttctgtttcttcatgaagactacgtcaaataaactaatgaacatattcgagcccctcctacacaaaataaagttacctcccactgttttttgcaatcttgcctggatacctaaccagagaactaggatgttgaatgctctgggggaacatcctaactcaggtataaaacaaattactgtatccaaaggaaaacagaattctgtgatctgtgatataaataaaatgtggcaatttcaagagctagaagaaaagaaaaaagacagttaaacattttatttcctgcaatgaaggagtcttcctaaactattatgtctgtataagtaagttgatgattgatcagtcttgatctaatgatatatttttataagtcatctgtgtggctaatatttcaaataactacagagttaaaatactcccagcatactgacttggttattattgccttgtgtttttcagccaccaccaaagatccctgacaagcagttagatgaaagggaacacacaatagaagagtggaaaggtacattcgtcagattcttagagggaaaactgtgaaggagcttctggtttttatatggtgatttattatcatgttagagaaatttgtgactttaatatgcataaccgaaatgtggtaatattaatatttttacataagtagaaagtaagtctgcttccttccttaacttaatcttaagttcccaagtttcccaccccagacacagacacattagtgctctgtctcatatttttttccatggtttgtgaatacacaaatgtgtttagtgtctcccacctctcctcttccacccttttaaaatcacgtatggttgtgtacggtgtatgctatatgtacttgctttgtttatttattatatatttttttgagttggagtctcgctctgtcacccaggctggagtgcagtggtgtgatctcggctcactgcaagctctgcctcccgggttcacgccattctcctgcctcagcctcctgagtagctgggactacaggcgcctgccatcacacccggctaatttttttgtatttttagtagagacagggtttcaccatgttagccaggatggtctcgatctcctgacctcgtgatccgcccgcctcggcctcccaaagtgctgggattataggcgtgagtgctttgttgatataatcagatatctggaaggttattctcttttagttcacgtatctgcctctcttgctttaataactggttagtgttctgctgtatgaatatgtcacactttatatatccatctccctcttggtgaccatttaaattgtgtccagtctgttgctgttagaaacaactctgcaatattcatgttcacatatgagaacatgcctggaagaaaaatcctggaaggagatgttctgagccaaagatatttttcagttatttccaaattactctccaaagaaatggtagtagtgtacacttccgtccatgttatataggagtctctctttgccctcacccttgcctacagaatgggttaatttttaatatttgtaaatctaatgtagttttattctattttatgaatgtggctgaaattaatcatgctttgatagtcatggaagttttcaaatatttcttcaaaaggtgccctgggacatgtgggtcaggtaatttttaggtcccgtttacttccatttgtgttattgtccttcagtgttttgaccacttttgtaactgcgtgactttgagtaaatcactcccccttcatctcaccctcctacactgccccctgcattttacctcatcttaaaatagaggcagaagacctgttattaagagttgtctctaaatcctgggaagggaaaggggactggggaggtataaacatgaataagtgacccatctataaatgtattttgctaagcatgaatttgattctttcttagaaattgaagagatttagagattggttttctctgaactttgggaaacccatggttagcagagcccgtgataaagttagaagaatgacaaaatgataaaattggatagagtctgctgcatttgaatatgtaatgtgcatttgaatatgtataaagatatagctctgtactgagtatgtatgaaaacattaacctaatatttttacatcctactaatttacagtagacgatgaagtattttgtagaatcttgtggtttttttggttgttttttttgtttgtttgtttttttgagacagggtctcactgtgtcccccaggctagagtgcagtggtatgatcatggctcactgcagcatcaaaactcctgagctcaagtgatcctgctgcctcagcctcccccgtagctgggatcacaggtgtgatccactgcacttggctaattttgttttttttttttgagacagggtctcactgtgttgcccaggctggtttcaaacttctgggcttaagtgatcctcctgcctcagcctcccaaagtgctgggattataagtcttaagccactgcgcccagcctaatttttaaaaaaaaattttgtagagatggggtctcactgtgttgtccaggtcatagactcttaataggccagcagttgtaaggcacaccattatgtgccacaaagaaaaaaacaccttcggttgtacagcaccattggttataagatatagtcaatttcagagattaaactgtgaaaaaagtacatcttaaaatcagtgagatacagtgttttcatttgtataaggatatatttgggggttttgattgctttaaaaacatttacctttattctgtatcctttactcctagccccaggtgcatgtcagtaattacccacagactgcctttttcaagatctacttaagagttttagcgcatagcagaaagaaagattaattgccaaagccattaattacagatggctttgcctagttagtgctcctaattagttttggttcttctgccttaatccctttgtgctttttcccagaggagtgctattttctctcttaaaaaatcctcttactgcaaatgtttatcattcctttttgtttctttgaagaaaaccatctcttattctctcctttatcagtgctttctatttttctccttccaagccttaagttactatagcaaacaaacttatctccagttgttgttcattccaacatattcatttgttttaccttattaccaatataaatgtcatactctgtaatcagggattctttatcagaattttattcttcaggaattaacacagactccttgaaattcgatgcaatattttttgtttgtacatttttctcagaagagggttcactacttttatacaattctcaaaagattccatgacccaaagaagatgataaatagtgttgatgtggcatccaccattaaggttaagtgtggtgtgccctgtgagtctgaatgtctacttaagaaccttaagtagacattaagaaccttaagaaggttttttgtttgtttttgtttttttgttgttgagatggagccttgctccgttgcccaggctggagagcagtggcgcaatctcagctcactgcaacctctgcctcccaggttcaagcaattctcctgtctcagcctcccgagtagctgggactgcaggcgcctgcccccaagcccggctaatttttgtgtttttagtagaaatggggtttcaccttgttggtcaggcttgtctcaaactcctgacctcaggtgatccacccacctcggcctcccaaagtgctgggattacaggcatgagccaccacacatggccgaaggttcttcttaagtagacattcagactcacaaggcacatcgcagttaacatcagaatcacttctgatgataatataagtgaagaatataagacaggaggcgcatatattaataccagcagagcagctcccagtgtgtctcttcagttggaacagttgttgcagtggtctacttgctgtccagaagcctgataagagaaaaagattcccatggagaaatgttcttcgaagtgataaccatgcttactcataaggagttgaaatgtagcttacctgctagttttcctccaataaaaatgtgtttatctttcattctgatttgttgtgaagcttttgcacactctaatttaaatcttggtagcatatatctagttgagtacccacagtgcaccaggctctattccagggcccaggaaatggaagtcagtaagacacgtggttcaagccctccctgagacagatggtagtacagaatggtatgtggtatgatgtgctgtagcacaagttgctggtagagtgaaaaagaaagcttctaccccagcactatcaaaccaacttcagaaacagtgaattacaggaaagattagtacttccttttaatatgatccattgttgagtgtcaaggaattgttattaattaacatccttgaatcttaggccgacatttaactgactgtcattgtaaggacactgtttgaagtacttcacatgtataaaaatttccacttaaaccatacatgcgttgtgagattggctcttagactttgaaaagttcatttttgtttacttcttttacagaattgatatataaggaagttatggacttggaggagagaaccaagaatggagttatacgggggcagccctctcctttaggttggttacaatataagcttggttaagattacagtttacttcttgtgttgtaatcttcagtggcctgaaacctgcagttcttcccatatttacaaaatcattattattccaggcttaataagtataaggaaatacagttttgttttttctactaatacattatactaatatatcagtaactgttcataagatgcacatctttttctatgatactgacattctgaagaacagaaatttaaaaactttttgttggcattgttgctgggtctttaaagaggaaacttctcaaaattcaatatacatacctttctatgatcttgacagtctttactttggataaataaaagcttcactgcaaaatttagtacatgtaataccaaattgctgtctttctctttttgatattattgatttgttgaatgaaggcaataacattaaaaccatcactagaaagtattctttctctaagaagaaaactgggtttgtaggagttaaaacttttttttatcataagctgatcttatatttaatgttagtacaagtaaaagtataaagaatagaggggaaaagttaaatggcaggtaacatgtacactaagtacataccacataacagacactagtggtttatatactttatttcattcagcccctaagatcctaaggtataggattattgcacacatgttatggatgaggaaactaaagttcagaaatttgaagtaacataagattccaaatctattatgtagatgaactaatacagtaacttcagagtgtgtggttttttcagcctcccattttgttatctggctggcaacagagacttctctggctacagaggttaggacagttgtatgaaggaggtgaaatttgagctgagccttaaagagtgagtagtatttcaaaagatcttgattttgaagtaaaactatgccattttaattcctcagaaacttctacttttgaggaaaaaaatagatgttgtatctagcatcttgtatatgggtaaggttttttaaactatagcgacattgtatactataaacataattgtttaagccattttttgtggcttgctttgacatttttggttatatattttagagttgtatattttaaatctttgatcaagaatgcaatcttccagattatagtgtagatcctgttgaatatatgaattggttttgaccgcttttacctattttggaaatggccttttctctacaatttacttataacaaatttaaagctctattataaatgctttgtgtaattaattagctttgtattgctatatagtagtagtagtaacaattgttcatgatggaggctcaggtgggatttgaaaagttcattatgtgggacagttttatactttagcatactatccaagtgagtggcacagctggagtgccagatgtttgagtaaatgtaataatttcatgagttagagcatttgtatttgttcttaatttgtaagtgaataatttgaatcttagtccagcacttgcttatgatcacaaaataagtcagtgaaaaagatagaaattgaggtttctagactttttctggatcctcagttatagcttgcaaagacgagtattagcaaattaagctgttataaaaatattctgctcttgattttgtactaaaacagaaggagtagtgtttggtaaatcaaaataccagataaccacagtaccatttccacttgatttttaaaaggaattttattctttttccctgtcgagtgccttcctatctttgttttggtttggctaatagtaaagtaagtttacctgccttgagtgtatagaggctcacttaagagaggaatgacccacgtgagactaaagattttccatattattaccattcagatatttgagaatttactgtattgctttaaagagaaaacaagtgtgtgttttttccccttaggtacttgatttttagattaaaaagttaacaatgcatttaaaagtcaatttttatcagattaagacatttgggtaacataatagaccctgaactagaggcatatataaaaattgtatatgttggagcccttttatggtttgaatgtttcagtacaagtcttagaaactagtcattgtgtactatgtatggtacacagatataccatactgttcagtcagaaaaggctcattccaagtattgattgaactaaatagaatatactatctgaatttcactctgactgggaagctaatggacctttcttgggtctaggagattatcacctcttttacctctcatctctcaggcctgaaatgctcatcctgcttttctcttccgtttcagctcccatcacatgctttgtctcttgtggttccattcctttctgtatcccagtcccctccctaaagattttcctattcccactacactgcctattttctttttgcatttgaagaaaagctcacagaagacttttcatattgaagtgtttcattgctcatctggacagaatggagggatgatctcaaatacagatgctgggttcaggagcagtggttttcagcccatttggtttcagcatctttgggtgcctgaacctcaccctcagaaattctgctcagtgttccatttgaagaccattgattttatttcataaatgtattcttgagaacttttaagtaacttgcattattccaatttggaatgacccttatttagtgttcatgtggttcagaagtacttagcctagtgcatgagttacctttaactatccttcatcccccagcataagtcattcctgtccccttcctaaaccaatccccttgagaggatttctgtctcgagctcaggtattcctgttaactttttaaaatccaggaaatgcttgttaggtaatactttcggcaaaggaaactgtttgctcttactatatttaataaatccatatttctgcttatcaagtattagagtagaaataagaagacccaagtttacttaactaggccacttgagtgacagtggcatgtcccataacctcgtgtaaagtggggcagttgaattgaggtttcttcctgttaaacttaattttattccttgtcttggcatttgctttaaaacaagatgtgccagaagtacatcttgtttcaaatttgaatcatttgaatttttcctttttagtgagaagctgtaaagacttttttgtagggaagtagcttttaacttttgtagttacacagtcctttaagatcctctgtccaaaaaaaggcattacagacagttttgcatgtattatccgcagtattcacacataccctgaagcccattcatggatcttgctgcaggaccatttctaaatgtggttcagatgtaaaattcttgtcttaaactgaaaaacacattcattgaaaggataggactccacgattctagacattttcagaattctcacctcatagctgtcaatgaagagtgtttttaagttagtgtgttggatatcatttgcgattatttttagtgagccttcgaaacccaagagaaaaaaattaccactggaggcagtcagtgcagtgcaagtagcttgatctgcagctgtctgcaactgatttgctgttttgtttctcatagcacaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacgtgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctcgttatttctgaaatacgttgtctgtaatagacccaggcaccttttaaattatctctggaacaagagggatttcatgtaatgaactaggaaatgcatactcacataagcaacaaggttctaggcagaaagccccttggaatttgtgaccaacaggagcaagaacaggtgcggctcaacatgcaatgtctgaaaatttgcttggcattttattcatatatttagtgcaaaattatttttgagtgagatattttacatcactgttaatgtgcaatatttaagattaaaatacattagcttttttatatactttgaagtagcaagtttgttttcgatggcttagagtcatgatttccagcttcccagcctttttatcagtcccttttctaatacaacaaggtgcattaatttgattaggcaaattagagttctaagacacttcttgaattgtagacagaaaatattggattcacaatttcagcagaaatttgagaatgagtgtgtttatattaatttcacaattagctgtattttctgtagcatagattatgtcactgttgcactttcacagcagacatgctttcagaaggttctcatattttatgtttgattgctgataagccatctctattgatacagattttggttaagtaaggaaaaccaggtgtgtgtctgtatcatttattgtaaatgccagctgccacttgccaaccatc

SEQ ID NO: 13751 - DNA, 77663 bp, Human
  misc_feature (1)...(77663): n = A,T,C or G
cctccctggctgcctctagtttctccaggagattaaccttttcaaaagatagatgcacattggattgcaccatgcccatgcttaaaactggttatccagtaagcatttcgtaatactcaagtcagtaacttggctaaggcttacagggtctggccttggcccatgcctacagattcactcccctgactcctccccatggtctctacccagccacatcagctttcattcattgttcaacaaatattgatttgcttgtcttgtgttagagagtcattgaggatacattagcgaccaaacaaaacacagttattctactcacagaacttagattttacagggtgggggaacaacaacaattgctagttgtaaaaagtataaaaatgaaattgaacctgcaaataaaaaaagagtgctcacttgagatacagtagccaggaaagtcttctttaagaaggtactattttagacgtaacctaaatgatgaagggaagtgccacgtgttgaatggagaagagagaatttaggtacagggaacaacccatgcaaaggttcatacatgctggaaagaagttggtgtttgaggtatccagagcagatcaacttactgtacagttagtggggagtgaggtcggctgacacttgattgtgcaggacctgggaggccatggtaaagatcagaattctattccttttcccccctcctctttttattttataaaatctgttattttagaaagttgcaagactggtacgatgtacaccattatacccttcaactagattcaccaattactaatattttgccacatttgctttctctatttttttgccatatcttttgaaggtaagccgcaaacactgtgacactttgctgctaattactttagcaagcgccttccaaaaacaaaggcattcttccacttaatcacaaattaattctcacatgcaatcaatttaaaactgattcaatatcatctaatatgtagttcatatttaaatttccccagttgtccacaaatgtctttcgaagtttttttttttttttaaaaactatgaaccagccaagattcacaaatttcatttggtttcttttgactctcgactaaagtaattttccacttcgtttttttctttttcctgtcatgacactgacatttttgaagagcctaggcctgttgtcttgtagaatattctacattgtttttttctgattgtttcctcatgattaatgtcaaacatttctagcacaaatactatcgggtgatattagcgatgctaagtatcttcacttggttaaggtatgtctaataaatctcttcagtgtaaaattctattttccctttataataagaaatgatctgtagggtgattctttgagatactaacatcctcttccctacaacctttcagttaattgtttgttttagcatcttgcattcattagttttagcattcataagcttacctatatcaatttttagactggcagttgcacaatggggatgcagcgagggaagtgaccctccggatcccgggatgccgagcctttttctgccccgtagggacaggactgggaagtggctagcccgccattcctcggcccgtccttaggggagtcgcaggactaagtgcagtggcagtggcctcacctcgggccttcgccacatctttattgcctcaaggacagaattggagatcggtgtcccagtcaacagcgtggtacttatgacagccgcgagaaagcgcactactaaagcccggctagcagagctgggaggcaaaccagaccgtcagcaccagggcggcccacgcctgcttccgcccattggctgcccgcgtttcaagacccgcccccatattggagagcttcttccggtagccactggaaagcccgcagcgcgagccggctacgctccctggcggagctctggacgccccacctactcccagcgttcagtgcggtgccctggccgccattgtttgaatttgaaaacggtaacatcgcagtgctgctcgcgggtctggctagtcaggcgaagtttgcaggtgaggaggtgacccgcgggaatgtgtggggaaggaggtgggtgactgcgcatgtatggggcctaaggtggggaaacggctttggcaatgtggacatgttccgacagggctcataccccagtggaggttactgtcaggaactgggttgcggagcgatgcgaacacggggtacgcagcgaggaatgagtcatactaattcggttacggtttaaatctcgcctccactgctaattagctgagtgacgcaagacaattcatttaatctctctctgtaccttagttttcttatcagttaaaaggctgcaatgaagtgtctatttctttcggcttttgtgaagattaaatggtaatgtgtaaagttattagtgctggcacacagtaggtactaaatgtttgcagttattaatattattattgttgttgcttctgttgttgttgaggaacaggcctgttttgccacacctagttttctgaagctctgaggtgagcagtttgctcggctggtaggtaacacggcctttttgcggggggagccctgtggtagcctctgtgcacttatttccagactactcctactggtccttggggcttgcccttctagggttttgcagtgccaggctgaagagtttgtggcacagtgactgctgtcattccccagtttagaaggctttctccatctcgattcgctcgctggttcagtgatgcatgtctggcacagttctcttatatttcttgctaaactactagtttacagaagttcacgccttatgggttaggtagtgtaacagtgtatttatcttacatgtccaagactccagattttaaattgtaaaaataacataaaatactcatcgattagttgtgaagactttttttgaggctttgtgttgtagaccacattcagaaacctcattcagtaacagattctgctatttttcaccaaagtctccaattgtggattcttattggagagagggtaaatatgcagttttccagtcagagcagccttttgaaatgaaaaatgaggtcttggagcctgctgtcacgaaagataatattacagactaggaccgacttttttttttttttttggaatagtattttctttataaccattattttaagtcattaggtagtctttatccctgcataagtcgctgaatttgttataggggatacagagtggtataaggcaaggttcttgccatcaagaagtttccagtttagttgggaaggccacgtataagtagaagtcatctaaaatcgcaagaagttacagtaagtctgaacacttttagaaatgctaggaagtagtttgttcattgaaaaatgagcatatgaacaaatactttattataactgcttttagtacataggaatattctttttaattcagcaatttaaaagatttatcaacacttttctttaaaccaaaaattattatttgaagccacaggtgttttttagttttctgggcatttccatgaactctgtgttatgaaatgtcaagccggtactttaacgttttgcagatgctcccccctctgcacccccttacccatgatctagatcagtgctttccttagtctttttgcaatttaggggaaaaaagtcaactatgttcttgtgatacgtttaggaatttcagcctgatcaaggaaaaagattgacaacaagatggcaggaataaacaaggattttgacaggattgtaggcaaaggaaatccgtctcagtttgggaccttttctagaccagggtgaggggccaccatctagaggggaaagagggcaaggggaatggggagtcggggaggaaagaatcatagaggggcttacatgcctaaatgatgttgcacagtggagagtctccggatcatagaaactctcaagggcagcagtggcttgggggtcttgataatcccgggttttatgtgtctggcaaatgttgggtgcagtttcatggggcattcaaacctggcaggctctaaatggctaaaaatatgcttattttgggccattttgaaagtaaatggatgcttcagaatttgactttggcgccccagcaggcttttcccttttttttttttttttgacgcagtcttgctctgtgttcaggctggagcgcagtggcgcagtctcggctcactgcagcctctgcctcctgggttcaagcgattctcctacctcagcctccttagtagctgggactacaggcgcatgccaccacacccggctaatttttgtatttttagtagagtcggggtttcaccatgttggccaggagggtcttgatctcctgacctcgtgatccacccacctcggcctcccaaagtgctgggattacaggtgtgagccactgcgcccggccgtaggctttttaatttttattttaaacattcatggtccttgatccagtgggcttttgagctaagatccctaccagctgtgaagaagtttacactgtagagctattatgcaagggccatctttggttcattttatataatacctgtgggtgatggtcgttactactttcttgagctaggaaccttagtttgggagtcactgatctgtatattttttaatcttgtcaaaaaacagcacagagtcctcctcctctctctggtattgtacatctagtagattctcagtaaatattagaatgttagtattttttagttaaggttatccttaagtttaccttttagtttagtgatttgatgtttaattcaatggtaatagtttactgatgcattattcctatttaacttaaaacctgtgatgtgtcaggtactgttttgaatgtgtttacatatattattttactttttacttgaatttgaaattgaaaacaatttttcagataactgagttttgttttgttttttttttttgacggaatctcactctgtcacccaggcttgagtgcagtggcgcgatcgcgattcactgcaacctctgcctcccgggttcaagcaattttctgcttcagcctcccgagtagctgggattacaggtgcctggcaccacgcctggctaattttttttgtatttttagtagagacggggtttcaccatcttggccaggctggtcttgaactcctggcctcgtgatcgacccgccttggcctcccaaagtgctgggattacaggcgtgagccaccgcaccagacccagataactgagttttaacttttaaatgctaaaacaaagtctgtaagtaacattctacaggagtcactaagtagatgacacaaggttataatttaccctgtgatctccttactatttgagttttgagaggatttcacggagagagtaaatattttataccatctttacagattacctgtactcacgaaacctctttgaatggatattatatgaaaatagtaggctgtgttcagtattattagaatcagagtctgtaaatataatttgatctttagtctttcctgtagggcattgtgttataaatgaagcaatgtaatgcgtttcttttctaaaatctagttatttggagggaagtagtgggctagacttttgaaagtgtgggtggcttacatgctgacttattaaggttgttaaagaagttgctgttattcttgcagaatggaatctaattttaatcaagagggagtacctcgaccatcttatgtttttagtgctgacccaattgcaaggccttcagaaataaatttcgatggcattaagcttgatctgtctcatgaattttccttagttgctccaaatactgaggtaagtacaagaaaagtattgtgttgattatcatgcctccttctaatgcaagggttggcaaacaatggcctgtttttgtattacctgtttttgtacttagatacaagctaagaattgtttttatatttttaaatagtggaagaaaaatcaaaataggaataatgtcacataacataaaaattatatgaatttcaaacatcactgtccataaagttttattgcatcacaatcgtgcttattggtttatttatttactacatccgttgtggcactataatggcagagttgagtagttgtgaggagactatagggtctctagaacctaaaatattagctgtctagctctttacagagaaaatttattgactcctggattggcatgatgtttttgagatttgtcgtgtgtcatacatcagtagtttttccctttttattgctaaatagttgtctgttgtgcagatatgccacatttccatttgtcgtttgatggacatttaggtagtttacagtttgaggtcattataaataatgctgctttgaacattcatgtgcaagcctttttgtgaacttgtgttttcatttttctttggtaaatacctaggaatacaaactgtataagtttaactttataagtaactactaaactgtttttcaaagtggctatcccagcagtggcaatgtatgtaggttccagtgcttctacctctttgctaacacttgataatggaactttttatttctagtggatgtgtaatggtatcctgttgtggttttagtttgccctttctaatgagcactctttcaagtattcttggccatttttctactttctttgtaaagtgtctcttcagatctttttcccatttaaattaggttgtttcattagtgttttgtgagaaatctttatgtatacaaatcctttatcagattaatagtgtcttgatgatcagacattttaaaatttaaagacattcaatttaacattttcttttcttttttggtgaatttttttgtgtgtgtgttctctttaagaaactttcgccttccccaaagtttttgtcttactttttctagaaattttagttttcatttgagtagttatatctgtggtccattttgaacagtttttgtgtgcagttgatatagggacccaggttaacttttttctttttctttttagcttccatacatttttttttttttaactacataagtagttatttcagcattatctattgaaaagactttcctttccctgttgttttggtgctttacaaacggctgtgtatatgtggatctatttctggattttattctcttcctttgacctatttgtccttattccaacacaatactctctatttctgtagctttataatgattcttgaaattaggtagtgtgaattctccagttttgcttttctaggaaaattttggcttttctaggtcctttgcatattcataaattttagaatcagcttgccagtttctacaagacagcatcttgggattttgactgggattgcattaaatctgtggatcagtttggagagaattgacatcttgacaatattgagtcttaatccatgaacacagtattcttcattttatttaggtctttaatgtcttagcagtattttatacttgtcaatgtagaggcctttcgtgtcttttgtcaaatatatttataaacattttatgttatttgatgctattgtaaatatttttagttgctttatttaggcataatgaaacactgcatatattttagatacgcagtttgataagttttgacatgtgcatacacttatgtaactgtcactacagtcaagatagtgagtataaccattaccctcaaaagtttccttgaggctccttgtaagtgctccctcccatcacacctccaagtaacctctgattagcattttgttagtatacattaattttttgtagatttgttggattttgtatgcgtatgttcatgttgtttctaaataaagaaaattttatttcttccttcccaatttggatgacttttgtcttttcatttcctttttttctttccattttttttttccttttctttcccctcctctcccctccacttctttctttcccttcttcccttcccttttacctttctttttcctttccttttctcttccctttttctttcccttacccctccttttttcttcccccatcccctttcccccttcacacccaattacaccagctagaacctttaatacaatgttactagaagtggggaagcagaaatcctcttcttattactcattttgctgctcatcttagattgagtctttcctgttaagtttgttgttagcgatagattttttgtaagtgccctttatcaggatgaggaagtttgcattcattacactttgctgagaatttttattacagatggacgttggattttgtcaaatgctgttttcccatctgtagagataaaagtttctcttcatttattcttttaatatggttaattgcctggattgatttttgaatgctaaacagactttatattcctagaataaaccattcttggtcagatgtattatcctgttttatatattggctagtattttgtgtgggaaattttgcgtatatcttaatgtggtattttgttttctaattttttcgtgaggatatctttgtcaattgtgttattcagcttatgtcaaactcaaaattagttaaggtattttctcttcctatattttcttaaagagtttatgtacaatttgtattttttttttttttgagacggagttctgctcttgttgcccaggctggagtgcaatggcgccatcttggctcaccgcaatctctgcctcccaggttcaagcgattctcctgccttagcctcccaagtagctgggattacaggcatgcaccaccatgcctggctaattttgtatttttagttgagatggggtttctccatgttggtcaggctggtctcgaactcccgacctcaggtgatccacccgcctcggcctcccaaagtgttgggattacaggcatgagccaccgctcctggcctgatcattttcttaaatgtttgatagaatttactgttaaactactagggcctgaatttttttttttgtggcattattttgtttgaaaatggattcagtttgcttcatagaaattgggttattcagattttctagttatgtctgttttgattaagttgcatttatcaagttgtttcctttttacttttttaaaaaaacattaaaacatttctttaaaattacattttctatgcacatttcttcctcagaaaaagtaacaaggagaatggtacatagtaaaaaaattctgaatacctcatggaattgagcatttgaataatagaatattctagttacttttgatttattctagagttatattttccaatgacttagggcctcattaattatattaggcttttgtggaataaagcctttttataaacttcacgtataaatacaggagatggaggaaattggatcttttttggtgtattttgtttttatttaaatagatttattgagtttttctaacattattaaaagcaggatagtgactgcttagaaattctttatcatctcagattattatgtaaaaagtagccatgttaaggaaaaatggtctctgaaaagccgtatctttcaaaaacacaatgtttttctcctttattttttaaggcaaacagtttcgaatctaaagattatctccaggtttgtcttcgaataagaccatttacacagtcagaaaaagaacttgagtctgaggtttgtgttgaatttaatagaattttaatattttactttcatttaaaatggcaaaatactagtttttatttattgggggtatgttttctagggctgtgtgcatattctggattcacagactgttgtgctgaaagagcctcaatgcatccttggtcggttaagtgaaaaaagctcagggcagatggcacagaaattcagtttttccaaggtaaaactgaagtgtttttgttttttgttttaaagataaagagacttggcttaggctaaattgctatataattgtatataatgaactatacattttatgcttatgcaacttagattttaaggataagactcaaatctcaggtctggaaatatataattggatgtaaagagatcactgtagtgttattaaagttattattactatatttttattaaagttattattaatatatttttaagaaatattcttttcaaaacttaggtgaatacttgattccctggtacagatttctatcttgaaaactttctggtagtaaaactatcaaatgtatttgtgggagtggggatgtggcacctattttaagaatgaatcttttaaatttttaaacagtagtgttgggatggaacacactattaatattaacttgaattttctaaaaagagtttttaaaaaatgtttgcttaggtttttggcccagcaactacacagaaggaattctttcagggttgcattatgcaaccagtaaaagacctcttgaaaggacagagtcgtctgatttttacttacgggctaaccaattcaggaaaaacatatacatttcaaggtaaatattgttttattttggttggaaaggataaggaagcaataataatcactcagtgtttttataatacatacatgtagttatgttgctattacctagtatgcgtttgctctatttttaatagtactagcatattattacgtattgctgtttttttttttttttggcgggggagggacagagtctcactctgttgcccaggctggagtgcagtggtgtgatctcagctcactacaacctctgcctcctgggttcagatgactctcctgcctgagctgctcagcttcccaagtagctgggactacaggcgtgcgccaccatgccaagctagtttttatatttttgtagaaatgggggttcaccattttggccaggctagtctcgaactcctgacctcaggtgatatgcccaccttggccttccaaagtgcttggattacaggcaagagccaccatgcctggccttgctattggcttttaattcaaatttatttaattcatttgtaaaaatactttacccattgatagagatttagatgatgattaaaatccagaaaaagtattgatgtgatacagagaattaagcataaatgaccagaagaaattttatatttcattttacttttatagtttgtgattatgggtggttacaaatcttaatatggttgcattatctgaatgtaaagtttcatgtttacatcagaataatagtcaataaaatgttggtaatactgtgaataacaaagtgatggaaaactgagtaatccttagctatcatttccgtttcagttgttgactcttgcctattggtagtataaaaggagctttaataaacaagtaaagtttcctctttcctagtagactgagagagtataacacaaaaattccttttgcagggacagaagaaaatattggcattctgcctcgaactttgaatgtattatttgatagtcttcaagaaagactgtatacaaagatgaaccttaaaccacatagatccagagaatacttaaggttatcatcagaacaagagaaagaagaaattgctagcaaaagtgcattgcttcggcaaattaaagaggtatggaaatattttagtatgtaaaatatgtataattcctgacttcttataaaccctttagattgtttcaccatatattggaatctggtttgtggtggtagtgttttttgttattatttatgttttcgagaaaaataaagcttaaagtgtgaagacatcttttgtatttatattataccaacagcaagaatgtttaaacaatacaaatgtaaatggttctgaaatcttttttgattgttgtagagccagcattgtgctttttatgtaatgattttttaaaattctgttttttaattgtgaaagtaatatgtacccaaaatttaaaatagggaatgtgagaagtaaaaagtaaaagtttcctttaatttcattcctaaagaaaaaattattaatagattgggaagtattgtttttggaccttttctctctctatataaaatccatatacagagctttctatctgtatatacacaaacatggtcatatatatgatgtgtatatcttcatacctttgtttttatatgtatgatataatttttttttttaaacaaaaaagagatcttactatgcttaccattctatgacttggtatttcatttagcgtatcttaaatctcttcctaccttaaatcatgtgcgttttatctgttatgtctttaacttgtttttttaaattttaaatcagcttttaaaactaagtctccattgatggacatttgtattgtttctgtgttttactattttgaacagtgtttcagtaaagaaacattccattgcaaatatatttggtgctaattttcccaaactcaggccaagattggatatttaataatgtctggtttgataggtgaaaaatggctcacttgagcctactttatatttttttaattgtaaattagttgattagtacatcttagaattttttcctgtgaattgtcacatgttctttgtccatttatctagtattgtatgacttttcttgtttactgatttattaaaatgtatttaaaaaaatgaatacattattaatgtattagtgtatgggttgcaaattttctggcttattgtttgcttctcccctgcccccattgtgtttttcttttttttcttcctttttttagtttttagagacaggatcttgctttgtcatccaggctggagtatagcggtatgatcatagctcactgctgtcttgaactcctgggcacaagtgattctcctgcctcgacctcctctgaatagctggaactacaggggcatgccaccactcctggctgttttgattttttttgtagaaatggggtcttggtatgttgcctaggctggacttgaactcttggcctcaagagatcctcttcccttggccttccaaagtgttgagattacatgtttgagctgccaagcctggcccattgtgtttttcagtattcatctattcagcaaattttattaagtcatctgttttttttccaggcaatattttcagttttgaggacaaatggtactgccctcatggagactgacaataaataaatatgtaatatactgtgaggaggtattgttttatataaggtggtaccatataaacttttaaaaatgaagttatacttgtctgtttattcctcttgtgccttctggattttgtagtatattttcagacattattctattcaaggctgttaaaaactactaattgtttttgtaaatatttttaccctattattattaatgcaaatttttcttttttaaaacatttagaaaccagggttttaaggcagtaaaaagtgtgttaccagtggagttcaaagttgagtctgtgactatggtctctgaaagtagaatagtgttttaacaaaatttatggggattggtggataactccatagccaattcatagaggaaattaaaatcattaataatgaaaaaaatttttcactgggcatggtggttcatgcctgtaatctcagaactttgggagactgaagcaggctgatcacttgaggccaggagttggagactagcctggccaacatggcgaaaccccgtctctattaaaaatacaaaaaattagctgggcatggtgactcacacctgtagtcccagctgcttgggaggctgaggcacaagaattgcttgaacccgggaggtggaggttacagtgagccgagattgcgccactacattccagcctgggtgacagagcaagactctctcaaaaaaaaaaaaaaaaaaattctaacaagttatccagttaaaacatgatactgttttgcctatgaaatgattaaaatgttaaaaaaaaatgagataatgtgctttcatatattgtaaatggttctagaaagcaaattggcaatagtgtgttaagagtgagaacattaaaatattttatatcttttcatccaccaattcacttttaggtgtatactccaaggaaatgggtttatttctatttctaaggaaataataagaatgcagaagaaaatatgtaaagatgtttggcaaaacttggtgaataaattaaatgtttaataataagggaataattaagtcatttcacatgttttatatagccatcaaatgttgtaaacaatttttaattatggggagaaaaagcttacaacataagtgtggggaaaagaatagaagggaaatattttaaaatattaatagtaaccaaccagagtggcaggattatacatgataatattctttttcatagttctctgtatttttccatgaaactatattatttaactaggaaaaattaaagaattcattgaattgagtagatgaaaggttgtgatttggtagtgacttatttggataggtaattaatatcttgattatttaaccttaatgaaaatgtttttttaattttttaaaacaatcttttttttaggttactgtgcataatgatagtgatgatactctttatggtaaggtttcgttgctcacttatctttgatgtatcgattatatgaagtacacttgaaaagcttttaatttttaaatcacttctaatgttttatttttattattaaaaaatttttaggctgggcgcggtggctcacgcctgtaatcccagcactttgggaggctgaggtgggtggatcatgaggtcaagagattgagaccatcctggccaacatgatgaaaccccgtctctactaaaaataaaaaaattacctgggcgtggtggcgcgggcctgtagtcctagctacctgggaggctgaagcaggagaatccttgaactcaggaggtggaggttgcagtgagccgagatcgcgccactgcactccagcctgacaacagagtgaaactgtctcaaaaaaaaaaattttcaccttgtatttatttattttttttctatagacctcttctttggttactaaggatttaatttctataatgacatagtcggtgatacctggaaaatgatacatatttatatgaaatgtcagtcattgtgatgtttcgtttgtattaaatattacagatatcccttttactggttacaattttaatattgaatttgaaagacacttgtttttctttgtcctttacatttaatttctattggttcattaacatattttcaaaaagaaaggaattataagaagttgtctaactttggttaatccacatattatttacatcttcctttgttccaaaaagtttttaacatagatggtcaaaagattaagcatacttggtttttcaagtgtgagaatcgatttgtacttttgtcacgtttttagtcagttgcttactttcgtgattgttttttctttttcttttttttgtaggaagtttaactaactctttgaatatctcagagtttgaagaatccataaaagattatgaacaagccaacttgaatatggctaatagtataaaattttctgtgtgggtttctttctttgaaatttacaatgaatatatttatgacttatttgttcctgtatcatctaaattccaaaagagaaagatgctgcgcctttcccaagacgtaaagggctattcttttataaaaggtatactaatgaatatttttatcttattgctctgaagttctcttcctgggctttgtgatagctgtaagactaaaacaaatagaaaattgaaaattgtaatgctaattattaacattaagagaagaagataattttgtgctttggaagtatgttttggtatatttattaaacttgaatataaaagggtctattttggtattgtatttgcttgagtatcattaattggatttgtggtgatgggaaaagctgtgtatggttatgttcacgttattctcctgctttgtaacagtgtccaaattttggagctatgaaatgttactattcttccggagtggtttttctaaccttttaaaacaattattcacagtaggaaacacatattaataacatcatgattcagtacctacatgcatgtatatatattcatatgtaatatttacaactcaaaagtttcgttaattatacttttactacaaggaatgcactgtaatattttctatattctttgtcatttctacaaaatgctggccagatgcagtggctcacacctgtaatcccagcactttgggaggctgaggcaggtggatcacttgagctcaggaattcgagacgagcttggtcaacatggcaaaacgccatctctacaaaaaatacaaaaattagcctggcatgatcgtatgcatctgtagtcccagctactcaggaggctgaggcaggaggatcacttgagcctaggaggtcaaggctgtagagagccatgatcacgcctttgcactccaggctgggcaacagagtgaaaccttgtctccaaaataaataaataaataaataaataaataaataaataaataaataaaaattaaaatactggtcatgattcaataaatctgattttatgattcactaataaattacaatcttcagtgtttcatagctaggtaattttacaggtttaatctgtactgtactttgccactctttttttccctgagtgtctaattctaaggaattgttactgtattcaattttccgtttggcagactctgttgacaaacatttattttgtgtgtttgtgtaatttacattctagaacattgttacaatcttctctggtgtaacctgaaatagctgagttgactccagctaggatgtgttgttagaagaaagatttcattatatgtcactaggaaaagactttcaaagagattacattgtagaacacattctttgtctcaataaattaatatatatcctctttattttttaaagatctacaatggattcaagtatctgattccaaagaagcctatagacttttaaaactaggaataaagcaccagagtgttgccttcacaaaattgaataatgcttccagtagaaggtaaagaataaactctgtaagagtaaactcgaatcaccgatagtattctgtgttaatttaaacacagctaattttacattaaagtgggcagtaggttctctcgtgttaaattcataaggcataaaaaacatttggtatacagaataacactaaacacgttcatcaatactgtttcctgtcctgacagtagatttattaatttataggaaatctctgaggtatttttactctttctttatgtcagtatctaagctcagtatttttggagttggtaataatggtggccttttctctgggtctttctcacttatcccctgaatactatataaatatactcagtgagggtataatctcaaggggttaaggaaggaagttttgatgggattgggggatgagaggcaaaggaaataagtttaagcagtgagataattaaagcaggctttttcttagagaaggagccctgttcccgtagtcagttgggcatgggacaatacaagatccggatctataggtcaaatgtatgctttgctttaggtatgtattcagagtattggctagctgtacataatatcattttaactaatattatcttttcaaacaaaatgtcgctttattataaatgatactattaatagaagttgaactgtcaggatataatttgagggatttagagctaggcaaaaggtgattttaggcatttgggtatgtaagtgacagtagaacactggcttgaaatatttaacagctaattggaaaatgcagtggtggactgtagttatactagggtataaataagattgatttgaatacttgtctctcctatttagaatgcagaaattaaaaatgataagataacatttgatctttgtatttcagtcacagcatattcactgttaaaatattacagattgaagattctgaaatgtctcgtgtaattcgagtcagtgagtaagttgaatattctttaaatttaattatttgtaattgttttgaagaacttttaaagtactttttttttcttaattcagattatctttatgtgatcttgctggttcagaacgaactatgaagacacagaatgaaggtgaaaggttaagagagactgggaatatcaacacttctttattgactctgggaaagtgtattaacgtcttgaagaatagtgaaaagtcaaagtaagtgtttctgaaagtgttattagcatattaaatattacaatatttaaactttcaacttttttgtttttagaaagttcttttttgatttttaaactgcttcttatgtaatgactgtgtatagattgtgattcaagtacttaagagatcttggattaaagacaatgatagaaatgtcagttgatgccagtaactcatcaggtaaagtcagtattttccatggcaaatctataccaatagacactgtaaatgagaagcttctaatgctggtttaggatctaaaaccactttattcttattaatgcattgtgtgtggttctagatgcaatagatttttacattaattagcattttaggctgagtaaatataaatcagccttcaccatttctatttagggtgtttcatgacatctcttatatacttgctctatactagggaacataacccagttaaatgtggttttctttataatttacatagtgggttattgttagtaagtagcagcagttaaaacaaacagccaggcatggtggcttatgcctgtaatcccagcacttttggaggccgaggcaggaggattgcttgagcccaggagttcaagaccagcctcatctctactaaaaataaaaataaaaaaattaaccaggtgtggtggcaggcacctgtaatccctgctaccctggaggcagaggcgagaggatcgcttgagcctaagatgttgaggctacagtgagctctgattgtgccactgtactccagtctgggcaaccgagctagaccctgtctcaaaacagaaacaaaaacaaaaacaaacaagaaaagataaaaagaaaactgagaaggactattacatctgaaactaatcactaccctaaagtttaatttcatgataggtggcttaattatttctttgtaaaatgtctcagcaccctgatttcatgagatgttttttaacttacaatgttttctgaaaattttttctgtaggtttcaacagcatgtgcctttccgggaaagtaaactgactcactattttcaaagtttttttaatggtaaagggaaaatttgtatgattgtcaatatcagccaatgttatttagcctatgatgaaacactcaatgtattgaagttctccgccattgcacaaaaagtaaatatttattttattaagcctcttattattagaatattaacagtttttcttgaaataaatattttttacttaatactgtaagcctaggaaataattgaaaattaaaaaggtaaatatttaaccaagtaggaagacatgagaaaggattgaaagttgcccatgctaggattaaaatgacctttagtaataagaattagtaataaacatcagttataaattaatgagtatttttggaatgaattgtctgctctgccattcatcttgttcatttggtacttctgggtgattggaaaaccctctgctaagattaatactgaacacttagcccaggaagatagatttttcctctagtttacatgtgtaagtagcttttttcctatcagaatgttcttttagggatggtgattcctgtttgtatgtttgtttgaatagtttttccttaacacttgagtgttcatttgacttaaatttataaaataatcattttctagtggacagttcttgtcttttctgttttaaaagtcacattgaatattttaacaggtttgtgtcccagacactttaaattcctctcaagagaaattatttggacctgtcaaatcttctcaagatgtatcactagacagtaattcaaacagtaaaatattaaatgtaaaaagagccaccatttcatgggaaaatagtctagaagatttgatggaagacgaggatttggttgaggagctagaaaacgctgaagaaactcaaaatgtggaaactaaacttcttgatgaagatctagataaaacattagaggaaaataaggctttcattagccacgaggagaaaagagtatgtattaagaactcatacttctatgcttgtcttcttattctgaagttaaggttaaatcttaaggctctctctcttcagtttttttcaacagtacactgaagtttttgtgttcaactttatattttgaaaaatttcaaacctatagaaagactagtacaatgaatactcatttatccttcacctggattctccacttaccattttatgagtatgtgaatacacatcttttggtctgtacaatttgaaaataagatccagacataatgacaccttacatctaaatatttgaacatatttttctaagaacatgggcattttcatcatgatcacaagaccatgaaattttcatacccaaaaaatttaatattgatacactaatataacctcgtatactgtttgtattgagagttccccagtgttcccaatatgttctttatagccactttgtttttgtctacagccagagttaacacattgcttttgattattgtgtttctttaatcatttctaatctagcactgacatttttgaaaagtgggtcctagttttctcatagaatacctgcaatttagatttgtttgattatttcttcatgatttaggtttaatacattagggaagctttttatgtaggttaagttgtaaattttccattgcatcacaccaagagccacatgatgtctgatttttccattcttagagatgctaagttttgctcacttggttaagataacagtatttcagatctgtattgcaaaaccatattatctgtggggtgttacttatagaccatgtgagtatcctttcactaagtgattttatgtattccatcagacctttattttgcagtctcaagtacaagtgttaaaaatatctaccaagtacctatgatcccatatcttcaaaaacactaattgtttgtcgtcttgttattatgataaataaataagatttaacggttgtttttttagcttctgtccaattatagtatttatttatttatttatttatttttgagagagggtcttgccctgttgcccaggctagagtgcaatggcacgatctcggcttactgcaacctctgcctcctgggttcaagcgattctcctgcctcagcctcctgagtagctgggagtataggcatgcgtaaccatacccagttaagttttttttgtatctttagtagagatggggtttcaccatgttggccaggctggtctcgaactcctgaccttgcgattgcccgcctcggcctcccaaagtgctgggattataggcatgagccaccttacctggccacctattcccatctttaattggccataactccgtgagtatagatggagtcctcttaccagtgtcctacaaacactagtagacctgtgttcatgggtgtgctttaatggtgttgacacatcacacatcacagtactcttctggattgcagaagtataagtagaacgatgatgtattaggctaaatactctcattttaataatttaccttcatgtccctgaaagcaattattgaacatatgtttggaaacaagaatgatagcttcagatgtagtacaagtcccactttatctggtcactatgtgattagaccgtgttacttgggcttctgtaatgtattaaatagtacctcctcagtgacgaaaggagcctttaatagtctagtttggctggtgcagtggctcacacctgtaattcgagcactttgggaagctgaggtaggaggattgcttgagctcaggagttcaaaactagcctgggcaacatagtgagaccccatctctacaaaaaagtaaaattagttaggcatgatgatgcacaggtgtagtcccagctacttgggaggctgcagtgggaagattgcttgagcccaggatttctaggcagcagtgagccatcactgcactactgcactctggcctgggtgacagagtgagaccttgtcttaaaaacaaagaaacaaaccaaaaaacccagtttttttttttcatttcaaagttgaaatttttgtataatgttggttagtaaaatttctgaaattactagagaaaaatatttaatgctatagtttatgatggattatatagtataaatgcttatcatataagattgactaaatattttaaggaaattcatcaaaatgtctaatatttgacatttaaaaatcaatatgattaggtgttggcatgctttatttttttcttctagagacaaagtcttgctctgttacctaggctggagtgcaatagtgtagttatggctcactgcagcttcgaaatcctgggctcaagtgatcctcttgcctcagtctcctgagtagctgggaccacagatgcatgccaccacccctaactaatttttaaaaatgttttgtagacatgaggccttgctctattgcccaggctgatcttgaacccttgggctcaggcaatcctcctgccttgcaaagcgctgggattacagatgtgagtcaatgtgcccagccctttcttgacattttaattaaaggattgggacttttaaaaaccattataaaataccttggtattagcatacatatacttaaattcgtttagctataatagccagcctaaattttttcagcaaaaactttatcagatgctaacaatgataaaacctaattattgaaaactattaaacttcccgccaggcgcggtggctcatgcctgtaatcccagcactttgggaggccaaggtgggtggatcatgaggttgagagattaagaccatcctggctaacacggtgaaaccctgtctctactaaaaatacaaaaaattagccaggcgtggtttctggcgcctgtagtcccagctactcgggaggttgaggcaggagaatggcgtgaacctggggggcggaggttgcagtgagccgagatcgagccactgcactccagcctgggcgacagagtgagactccgtctcaaaaaaaataaataaataaaataaacaaacttcccaaggtttttccacattcattctgatgtctccttcaatagttattatttattgttttactcagaaagtatgtagtttaaaattattaaaatagtattatgtatttatagtagagtgaaaaagaaaatctaaatataaagatctctcaaatctaccatgaatgttaatggatttttattatatattactgttttgtaacctggtattctttatataaaaataaattgtgaaaagtatgaattattaatataggttatcattgattacggtagtttatggtagtaccataattaaaccaatcctttaacgttggttgagttgggttcactttttcattatttaaacacaactaccatcacaaaacaacaacactgtgatcagcattcatacaaccagaacatggggttatattataattattttcagtataaattcttggaggcagagtttcaaagtctggatagctgtagaactattttcaaatataaagttgagacattggaagatctgtagcttagagtttattgtttaatttgttgttgagtaactttaaatagaaacattaaaaagaatatgtagctgtttccttaatgctacaatttatgttatgaatgtataatggtcatgttaagtgttttatttattgctttatttatatattgcacatttttcatgattatgtatgtgtttcaaaggctatagaattgctgttgacatctggatagttataaaagcctaatataagtttatgtaacatctttatttgacagattagtaagtgggtgttcttagcaacttctctggtgtatgcaatccttgggctttagacttttacaggccacttttaaactcaacctttagcatttaccagagatctgatccttatgcttcccacctgtgaaatatggatgataccaagctcacagaaagttgtggattaaatgaagcaaatatggaactccccagagtagttcttgatagataataaatgcactaattaactttacttattttcttagtatagctaaacagtgagacgagttaccaaaggtctatttctaaaatgtggaaaggccaacctgatttttcagttaacaaatctttgcaaacatataattttcagtgagaacattatcactattaaaaaggacacagaattacaattgactaaatgtaaagttttattttttgaacagttggacggtatttctcttgggatatatttattcttttataagaattttatcatttacatgtaatagaaactgttggacttaatagaagacttgaaaaaaaaactgataaatgaaaaaaaggaaaaattaaccttggaatttaaaattcgagaagaagttacacaggagtttactcagtattgggctcaacgggaagctgactttaagtaagttatttatttcatgtccaggtaaaaattgagaattttatttagttttttagtttttttttttacttagtttactttttatattaggtggcttctgaattctgatctctttatacaagcttgaaaatagctgttactggtctggtgcggtggctcacgcctgtaatcccagcattttgggaggcctaggcaggcggatcactgaaggtcaggaggtcgagatcagcctggccaacatggtgaaacctcgtctgtactaaaaatagaaaaattagctgggcgtactggcatgttcctgaagtcccagctgctttcaggaggctgaggcacgagaatctcttgaacctgggaggtgtaggttgcagtgagctgagattgtgtcactgcactccagcctgggcgacagagtgagactcttgtctcagagaagaaaaaaaagaatatagctgtaactaatcccatgcatggttatttaaattttctctcttttttaaatttaaattttaattttttgagatggagttcttgtgctgtcacccaggctggtattgagtggtgcgatcttggctcacggcaacctgcacctcctgggttcaagcaattcttctgccttagcctctcctgccttagcctcctgagtagctgggattacaggcacacaccaccacgcccagctaatttttgtgtttttagtagagacggtgttgctgtgttggccaggctggtttcaaactcctggcctgaagtgatccacccgcctccgcctcccaaattgctgggattacaggcgtgaaccactgtacctggactaaattttcttttaatctagaatatacttaaacttagatgtttaaaacaaaaacacaaagtagttcgttttctgtttcttaatgggattaatttgtattttgaagggagactctgcttcaagaacgagagatattagaagaaaatgctgaacgtcgtttggctatcttcaaggatttggttggtaaatgtgacactcgagaagaagcagcgaaagacatttgtgccacaaaagttgaaactgaagtatgttaattgaagtatttaaaaatatccagtgaggttttggtaccagggtttagtgtaccacatcaatgatgagaaacaccaagatagtttagaattaaaacaatgctttgtgtgtagctttattataattaggcatgtttttttagaagtgtaaggcaccaagaatttaaatataatgattggttttgaaaaatttatacctctgttatatatatatatatcttattttggtattgcttgaatcattgtgttgtaggcagatagattcttttttgagatttgtcttacttaacatttttaaataaaaagaattttaaaggtgtaagagacctaagacgtcatttacttgctgttctgattaaaacaaaaatgtttatgtataaaaagggttgcccttgccgggcaactaccgtttcttactcttttaaaattttatttgtttatttatttattatagttttagagttagggtcttgccgtgttacccaggctgatcttgaattcctggcttcaagcagtcctcctgcccagcctcccaggtggctgagattacaggtgcacgccactgtgctcagcttattctctacttgtaatataagaaaaattatccttttctgctgcttccactgaagctgaaattgatcagttttttgggggagttggtttttttttgtttttgtttagttttttaatcactcagttcaagtgcctgtgacagtgatgtccagacgtctgctgtcaagcaaaccttatgtatccttgacgtggtttgggattgactgagttgtgaaaatgtaggtttgtttcatgcactatcccaacaaaaccttttaagtctcattatataattgaaagtatacctgaactaggtaatcataattgttctataatgacttgtcacagtttgtaacattgtttttatgcgaaaatatgcctcatggtccatacagcagaaaataaataatggaacacaggtttttcataattggagttgcttctatataatttattttaaagaatttcaagtgatgaattttttgcttttttaaaaactgtctaaattagatggtaccacatgtaaagggtgaaccctactgttaatattaggcatgtggtttttgctatttttaggaaacacataattatgtaggatttgaagatattattgattctcttcaagataatgttgctgatattaagaaacaggctgaaattgctcacttatatattgcatctcttcctgacccccaggaagctactgcttgtttagaactaaagtttaatcaaattaaagctgaattagctaaaaccaaaggagaattaatcaaaaccaaagaagagttaaaaaagagagaaaatggtaagtggatacattttacttttatttagatattgtaaacacataaaaagtactcttggtaagtataagagatttatgtagctcatttaccgtagtgaccagaaaattctttcatctaggtaacatattttaatattttaccatttgtatgactttgtagtaatttactactaaaaatattttttgacttccatttattttagaccaatattattagaaaatgagcttctcaacaaaaaaagtcaaaacaagtgttaactttatgagtaaagctgtaaattttgttatatatatatattttttatgacagcgtctcgctctgtcaccaaggctggagtcagtagtggcatcacagctcactgcagccttctactcctgggctcaattactcctcttgcctcagcttcctgaatacttgggaccacaagtgtgcactaccacagcggctgcattttttttttttcttttttgtagagatgggatcttgctatgctgcccagattggtcttgaactcctaggctcaagtgatactgcctgcctcggcctcccaaagtgctgggattacaggcatgagccgtgctgtgcctggccttgttctatattctttataaattcttgcagtatagaagattcactgttgggatagagtgactactgtggagtggtttaaagtaatttgttagtttgatgcttcattctaactaggagggcattttctttttctgtcttcccccccctttttttttttaaagacagggtctcactctgtcacccaggctggagcgcagaggcatgatcatggctcactgcagttttccacctcctgggctcaagtgatccttccaccttagtctcctgagtagcttggactacagacatgtgccaccatgctgagggcattttatatacataaatagaattgtttgtaatatctgcattttaagaattagttgcaataactgctctgcccttttttgtgtgaaacaaatgggtagaaaataacacgtaagtggtgcctttgcattatgaaatgtacttaaaaagcactagctccttttcttctctgatgctatgccagttctttactatttagcatatgccacctatttttatcctgagttttagaagtggctttttctgaaacattaccctgttgtggttgaattagcagatttttttttaatgagtagggtgtgcttctagtgctatcaaaatcctttttattgaatgtaacagtaaagtgtcactagagcagcatatgtttcatagttattcagtgatacatatttttagatgcttagatatttattttcaatgttctttattttttcagaatcagattcattgattcaagagcttgagacatctaataaggtaatgctttaagttttattttgtcttgataaggtatttaattaacaaaggggtatgaatgatgactagatttgtttattttaaaaaataattaaacagtaatatagtctcttggtatgcatgggggattggttttattctgttattttttctgttcttctttggcttgagtcttcttatttcaacttgtatttatcctttcaaaaagctgaatattttaaaatatgatcagatataaataattcaagatcttggtatctaatatccagtatttaaagaacaaaaatgtacttagaagacattacacctactgtttatacaattcctatcttttcttgtattttttctacttatgaaaatagtagacactagttgtaccaattaccttaagctatataaatagaaaataaaaaatttcccataatgttcttcctaaatttaaaacaaaaccaaaccaacttgtttggaagctctttagactgttactttatgtatgtatttatagaacacttaccatttaccagatactccttcaagtgctttttattaactcatttaaatgttagagcaactttatgatgtaacttgcccagggtgacatagtttttttagttttatttatttattgtttttgaaatggagtctcactctgttgcccaggctggagtgcagtggcatggctcactgcagcctacgtttcctgggttcaagtgattctcctgcctcagcctcccaagtagttagggttacaggtggccaccacccccggctgatttttgtatttttcagtggagacgggctttcacgatgttggccaggctggtctcaaactcctgacttcaggtaatctccccaccaggtaatttggcctcccaaagtgctgggattacaggcatgagccactgtgcctggcccagggtgacatattaaaagggatagcagctaggatttgagcccaggcagtctggctccaaattcctcttatatgctatatagcttcttttttctttgtgtgtgtgtgtgtgtgtgtgtgtgtgtgtatgtaatttttttaaaggcaaaaataagatcatgctgtgcatagtgtgttgccactgattagctttatttaactttaaaatttgaaggaattataaaactgtttgcattattaatcatatttgcattctagttatcctaaagtatattcatgaaacattgctttttcttctttccaaagaaaataattacacagaatcaaagaattaaagaattgataaatataattgatcaaaaagaagatactatcaacgaatttcagaacctaaagtctcatatggaaaacacatttaaatgcaatgtaagaatttaaccttgtgttatattaataaattagataagcatatgttttggttgaaaggaaataatttaaaatagcttatgcaactaagactaatttattgagaatgttgaattgcttatgcaacattgaactcaatttactgttttccaaatctgaatttttgagaacttagacgagggtgtttgacttctttgaacatacttttccacaagatacgctggcagtgctttgcatgtaaaaaggaggagaatatgtagcctttggacgtttaagcctcagctagttggaaggggagctttgaggagaaaggaatttaggtgtacttagaaaaccagattataatgtttcagggaactataacatgaaattcagtaaaattaggtttttccttagaagcttgtttttattatatgtattgttgctattgtttatatgcttaatagcaaggatattttttctaaaaagttatacactgtgacatgtaaagacttaaagggttgtctttcatacaaatttagataatttcatattcagttcagcttagaatgatcagcttgtcttttaatccatgtcttttaaaatggcttttggttttctttttttggggtaagctccttcaaattattcttttatttagaaatggtaaaatatatggtaataatgtagtaagctgagtaaacttagagccaaacatcttgctttgttgaaaggtgcttttttatgtcttttctatgaccaaaagaagcaggcgtggtatcttataaaaagtgactgttgagtttcctttgtatcttgatagtcaaactctaatacccaccaacattccctgattcatctgaactttaaatgggcatttgataccacaggggtaaatgaggagcattctagaagagcactctgtctaatctcctatagtaggcctttcttttggtatttattagatacatgattcattctctggtttttctgtacctgaactgggagaaatatcctaatatttaatatgttaataataaactatttagtaataattagtatttaataaggtggaggagcaagaaacacttgtggagtgtccaacgtgtgccaggtactatgctagattattggaattatacagattaataaaatctactaccctaacaatcccccaataagaaaaaaacaacataaatatagttataatacaatgtgcagtcgtagtcaatgtgtgaagctgtgagtgggtggggagttaggaatactttgtggagatgaaaatgattaagttgagccttaaagggtgagtaaaatttagccttttgaaggtagaggaaggggacagtggtagtcaggagagacaagaaggtacattggccttccatgtaccagaatcagagtgcacaaagtcatggaaatgagaaatctttcagtgagtgcaggaaaatacaaacaatttgttgtttaggaagaaagtttgaagcaaggagaggtgagaaatgaggctaggagtagtagaataggataagatgaaagaccttgaatactgcattaaagagtttggggagtcagtgggggagtcattttcaccagaggaatagcaaagaggagtttttcatttgagtagatatttttggaaacttggaagataggattgagatggaattagactacaggcagagagaccagatagctacctcttggaagagttcagctaatagttgatgaggacttcgatttacggtagtagtagtagagattaaggaagaggaaattgatttgtgaagtaaggggatgttaaaattttgagacttggggcagtaaattaattgctgggcctcctggctctcgaaacttttatttggttagtcatcacatgctttttgctctcatctcttgatctggattttaagtctgttctttgatttggtaaataaaaacaaaaaggaaagtcagagacaggtcatttctggcgactacaacttcaaagaaaatagttggaaatttcacatgggattatatttattgctgtagtgtgtttgcataccataatatattagcaatatttaaggaagtgatagtaaaaaaatcaatatttgtaaattagttagtccttgcttgtaaataaactttatagattctagatcttgttttatcaactaacttaatacagtgtgctaaatttaaattgttcacttaaatacatacaaatatacaaagtagtttggaacttacctaattgtcctgattaacagttgatctagggtcactgttccacatcttgtcttgagcgcaaactctttccaataatgaaaaaatttagtttgaattctttgctttttctacccaagcataccctgggagcagaaaaccctcctttcaataactataacttctgaaggatagatttttggtgaggattgtatattttgaagcggggaaaaatgacgggatcattctgataggtaccaaggatcggggaaggaacaacttggacttgttatggagctgtgtcagaggtgtgatctgcctgtcccatgattttgtcatttatcagtgacactaagggactaattgtgagaaagcgtggagattgttctttatgacatcctttgtttagagatactagaaaaactttgccttttttcttaaataacccattactttatgactttaaaaggttatttttatctgtatttcctgctaatacaatgtttgctgattaagcggcactctatcatacactttgttttttcaaattgattgctacaagtttctgccttcaccatacatttgattactctatagacttgcgcttaaatgctgagttttacccttcttctaaatccatattataccctttttttggaagttccccccctctctcagctcccccactttctttctttttagaggtagggtctcatcactctgttgcccaggctgaagtgcagtgatgtgaccatggctcactgcagccttgaactgctgggctcaagagatcccattgccttagccttccgagtagctgggactgcaggcatggaccacaacacctggaattttaattttttgtagagacgggttctcactgtgtggcccaggctggtctcaaactcctgggcttgagtaatcctccggcctcagcctcccaaagtgctgggattacaggcaggagcccctgtgcttggttgctactagccttttcaagggaggcagtctgccttaaaaaaaaaaaaagtctaaatgacgtatctagaagctcagtttcaaagctgtctgtaggctgtatatctttgaatatatatcgacttaaagctaagggcaaaactatttttctaggagttgttaatgtttaagacaatactaatctttaagaggctttggctacaaaacaaaataaatagttgagttcatatttttcttttcaaagcacatttctgatgtgacttcagagatttatcttcttaagattctccagttatccccaaatgttacttatttgctagagccatcagttattttaggacgaaacttaagaaataacttagaaaatgtctcaacaaatttgaaaataaaatttttatggtacaccattgaaagtaatttatgtgatttgtacattttttgtagctttctatatgtgaattatttttaacttattttgctttaggacaaggctgatacatcttctttaataataaacaataaattgatttgtaatgaaacagttgaagtacctaaggacagcaaatctaaaatctgttcagaaagaaaaagagtaaatgaaaatgaacttcagcaagatgaaccaccagcaaagaaaggtactacttcagctgccagcagcaggcgtttaagaaagctaatttctaaaccagtaaatagaacaaggcaaacagaggggcattcacttgtctaaggaaaaatcttgagaaaatctaaacgtcttgaatttttattctggaaagttatacattttctagggatgggcatagttaaagcttttatcttaataaatatgcttttagaaattgtgcttttattatttctttcgcagtctatgtaataatttctgtgcttataatagttaaaactcattactttgattttataaatatagtattttctgcctaaatcccagcacattattttgttttctttgtttgcattctttattcatttggagaaaaggatattttacagtaagactttgagctaaatattattaataataaatgtattcaagctgtatttgtgataccaggagacagtctgatgaaagataatacatgttgaagattattttttaaaaaatctttaatagtaactgggcaagtttgttgtaaatataaagaagggcaaacctttgaattttagaggaggtagactctttagaataaactgaaaatcttgaggaaataaataggaaaatgtaaattgcaaacataagaaacgcttcaaaaagaaactcagcagcttttaagaaaatacagcaggcataatgccttattttaccccttcctctttgaggctggacagtgtaaattatacataataaaaccttgtccactgagcttttaaaattagtctgtattgaagaaaagagatcttggaatcctgtaatgaaattgcacaattacagcttcccaagaacatttagacaattgagtgaaacaaaaaagaacatgcattgcatttgagaaatgaagacttaacaaatacaggttgttttttgtatatacagtatcgaaggcaaaactagataaattctagatgggacagggaggtaagattcccatattatatagtgattcttgggtgggggcatattctcactgggggaaatcagtatcttgagagagctaggggattttaatttatcaaaaggggtcataggccgggcgtggtggctcatgcctgtaatcctagcactttgggaggccgaggtgggtggattccctgaggtcaggagtttgagaccagcctgaccaacgtgatgaaaccccatctctactaaaattacaaaaaattagcctggtgtggtggtgcatgcctgtaatcccagctacttgggaagctgaggcaggagaattacttgaatctgggaggcaaagactgcagtgagccaagattgcgccattgcactccagccagggcaacaagagtgaaactgtgtctaaaaaaatgaaagtggtggtggggggtcatagtattaaaaaaccttgagaacaaacaatcacataagttttttcttctccacattatggtagtacctgagggacctttcataaatgctttggcttttcctttattttgctcataacttcaactgtgattagtatatatggaaatgagtatagaaactcatttgtatatggcatggcagatttcaatttaatgagctttgtaatgatctcaaaagtgctgccttcttcatcgaacagattcattacatgtgcatcccatgggctatcatctcacaactaggatgcacaagagcctgtgagaggcaggctaaaacttaatgggtttgaatttcataactacaagaggtttgacgtttggctcttaaggaacaattacatgcagcagtgctgtcagttaagggctttgtaatgtaacaaactgatatgttaagatcccaaaggtattacagaagtcactgtcaacttctagaaattttcaaaaataataccccagaacactaattctcaaaacgttgcatgtaaaatacatcccagacttaccaaatcactatctttggtatttggtgccaggaatctgcattttaataaggtccctggataattcctcccaataaaactagaaaatcactcttgtgtaaataaatgtttttcagtgttaaagagagaacattaaaattttaaacataaagttaccataaagtaacaaaattaatgtaactggaatatgtcagattcatgaatttacatatatctagaagcagaataaattactattgcaaaaatcacaaagattatttgttttctataccatgatatgtcttagagatagaaaagaagaacatatgtggtatagttaagtttcaaaaatattacatttaggattattattctatttaggtttattgttcgtgatgagtgagatatagggagtctgccatcaaggagcttaaaatctagtagatgagagagacaaacatatttcaataaaatataaagagctgagatgcataggataatattcgggactcattaaaaagaaaaatgtaccatatactttttagagtcaattagataccaatggaaagtagtaagtgtctttttttttttttttttttttgagacagaatcttcctctgtcaccaggctggagtgcagtggcatgatcttggctcactgtaacctccgtctcctgggttcaagccattctcctggctcagcctcccgactagctgggattacaggcgcccaccaccacacccatctaatttttttgtgtttttagtagagacagggtttcaccatgttggccaggatggtctcgatctcctgacctcgtgatccacccgcctctgcctcccaaagtgctgggattacaggcgtgagccaccgtgcccggccagaaagtagtaggtttcttaactagaaggatttcaagccaaacctacattataattgtcttctgctcttatagattagtaacccttgtacttcatattatatctgggatcattaaacaagaagaatttgattcttacatagtgaggatatcacataaaaatacaggttaattaaacagaaatggtcagtgagggagtgaatggcggtcagaagaacatatggaattgattgtattagagcaaagtcgtgtagaaaattcacataaaaattgtaccagaacaatgttgtaaagtctacttgcaaacatcatataaacatcaaaccatgaagtataacaaaacaggaaaaaatttctaaaaacgaagagtcagattctggcctgttttgaagtaaggtttcgaggatctgagacactcatctgacccttaatggaaattgtatgaaatataaaaagatatgtagatataaatttatatatctagaagattgttaattatatttcaagatttaatcatggaatctatgaggaaagtttaaaagaatataatttatactgggcacttacgtggggtgagtttatttgtcagagtgaacttatgaattaaattgtagctaatagtgtatctgttctgggtataatttgatctgtactgattataatggctaaagttcttacatgtatacaacatttacgtagtcatttaacttacattacgtattaactcattttagtctcttagcattattctgtagagtaagttgggcaggtaagggtatctttattctagcaatatacatattaagcctgaaaaaggcaaacttttatgcattttcaattagttgaatccttctgtacagattttcaggttctattaatagttaaatctatccaatgcacagtgtcgtcaacccatttgtcatcttgatcttcacaactttgagataggtggtattattcctatatcacatttgaggaaacagtcgtagtatgaagcagtttattaatggttacagctagtaaggctatattatatgaattcccaaagttttaacatgtcccttctaattttagctatgaaaatttaagatactccatttgcctattgctaatatagtaaaagccacaatataattgtagcttaaaactgttcgttaggatatggaatgtctgcctagggtttctcgtcatctcctcctctctgtcccatattgaaatgacaataaagatttgtggtacaaaatttaaataatactgaaagttagaaatagctggtaatgctactcagaggtaggtagctgccatcattttggtgtacttcctttgctaactttgtattaccttgtgaaataataatttttacataaatgggctcataccacatgttttaaaacctgttttttctttttttctcaacagcttatttcattttttttttttaattagaagtttacttttacatgttttgtatgtttgaatattggcttatatggtgactttttggttttattaaggtttgccagattaataacaattttcttatttttaaagggtctatccatgttagttcagctatcactgaagaccaaaagaaaagtgaagaagtgcgaccgaacattgcagaaattgaagacatcagagttttacaagaaaataatgaaggactgagagcatttttactcactattgagaatgaacttaaaaatgaaaaggaagaaaaagcagaattaaataaacagattgttcattttcagcaggaactttctctttctgaaaaaaagaatttaactttaagtaaagaggtccaacaaattcagtcaaattatgatattgcaattgctgaattacatgtgcagaaaagtaaaaatcaagaacaggaggaaaagatcatgaaattgtcaaatgagatagaaactgctacaagaagcattacaaataatgtttcacaaataaaattaatgcacacgaaaatagacgaactacgtactcttgattcagtttctcagatttcaaacatagatttgctcaatctcagggatctgtcaaatggttctgaggaggataatttgccaaatacacagttagaccttttaggtaatgattatttggtaagtaagcaagttaaagaatatcgaattcaagaacccaatagggaaaattctttccactctagtattgaagctatttgggaagaatgtaaagagattgtgaaggcctcttccaaaaaaagtcatcagattgaggaactggaacaacaaattgaaaaattgcaggcagaagtaaaaggctataaggatgaaaacaatagactaaaggagaaggagcataaaaaccaagatgacctactaaaagaaaaagaaactcttatacagcagctgaaagaagaattgcaagaaaaaaatgttactcttgatgttcaaatacagcatgtagttgaaggaaagagagcgctttcagaacttacacaaggtgttacttgctataaggcaaaaataaaggaacttgaaacaattttagagactcagaaagttgaacgtagtcattcagccaagttagaacaagacattttggaaaaggaatctatcatcttaaagctagaaagaaatttgaaggaatttcaagaacatcttcaggattctgtcaaaaacaccaaagatttaaatgtaaaggaactcaagctgaaagaagaaatcacacagttaacaaataatttgcaagatatgaaacatttacttcaattaaaagaagaagaagaagaaaccaacaggcaagaaacagaaaagtaagctaaatgttattcaaaatattttaaaatacacaaagcattcattttgctatgcagctttaaaaaagttagatagtcatacttaatctggtaaagcgtagcatgtatgatgagtgaagaacttgaactttgtccatataaacctttggaccataggttatgtgaaaagatcagcttataaaaatcatatgaaatattttctgaagaactcattcatagtttggatattccaaatttgtgaaaagatataattttgtaaagattgttaccatttcacatgtatggtcctaagcagttaatgatgcattaccatagaaaagtggtttatgttttttagattgaaagaggaactctctgcaagctctgctcgtacccagaatctgaaagcagatcttcagaggaaggaagaagattatgctgacctgaaagagaaactgactgatgccaaaaagcagattaagcaagtacagaaagaggtaggttatttgaaaagttatgtggccagtttatgataaagattgttttccttatatatcaaacttagacattaatcttaggattgaatagaacatttatccactttataatttttcttaaaattacaagaacagttacttcacgagagaaaatttagctgatttaaacaagctgaagaatgtccaacattaagagaaatatgtaccttatgaaagattagtctttttcttctttaagaattgctaaatgtaagtccttacaaaaaagtggaaagcaacttgtttacagatagtacttaggagaatgtgcagtatgattttttagtttttattataacttaatttttaaaagggaatgcaatcacattattccaaatttgaaatataatagatgtatacaatgagaaggaaatacttcccactcctcgagctgtcaagtttaccttcacagcatcaaatgttaccaatttctttctttttctgcacttctccctccttcccattttcttgtatgaccacttcattttctgtcgtacttagaccttctctaaagattggagcacttttttttttttttttaaactttgaggtagttaccaaataatacttaaatgtgtaaggtctgacaaatattaatacaacaaatgctgtttctaccactataaaagtgactactgaatgttgtgtttatctaaactttaaaaaatataatttaaccatattttttaatctctaaacagtattttcttctcaaacttttatttttcacatcatatttctgagattgattttgtacagtcgtaattaatcattttcacctctgtatagtattctgttgtgtgacttagcgcaatttatttagtctcttgttgatgaccatttagattgtttattattttttgcccatagccataatgcaaatatcttctatatgctcttggtacacatatgcaaaagtttatataccaagtggggaattactgtgttagaggatatgaagtgttatctcatggtagttttaatttgcattcttttgattgctaatgaagtacagcttctattcatatttttatttctatttgtctatcccagtttctgctctgttgaagtcatttgttcattttaattgtgctgtcttttttttttttttttaaagtatgtagtttttatttttacttatttaaaaaaaatttactggtttattataaaggatacaactcaagaacagacaaatagaagggatacacaggacagattaagggggacagagggtggtgcagagcttctgtgccctctctgggtgtaccaccctcctaagacctcagtgtgctcaccaagtgggacactctctgaacctcactgtacaatagttctcatgactcaatctccaaccctcctctcttccacagagtttggtgggtgggactgaaatttccaactctaatcatttttggtcttttggtgagtagccctacccttaagctatttcaaaggagcctccactcaaagctatttcattagcataaattcaggtgtgattaaaagggggctcttttttctaagtttatttattttgttttgggacagggtcttactctgtcacccaatctggagtgcagtggcgtgatcatagctcactgtaactttgaactcctgggctcaagtgatcctcccatctcagcctccctagtagctgagactacaggtgtgccaccatgccctagctccttttaaatttattgtattgttaaagtcttttttattgctacttatagaggtatctcttttcaagtatagatagcagtccccagcctttttggtaccagtgattggttttgtggaagacaatttttccatggaccagggtaggggctggctgctttaaggatgattcaaacacattacagttattgtgcactttatattattattacattgtaatatataatgaagcaattatacaattcaccataatgtagaatcagtgggagccctgagcttgttttcctacaactagacggtcccatctgggggtgatgggagacagtggcagatcagcaggcattagattctcataaggaatgcacaacctaggttcattgcatgcagagttcacaatagggtttgcactcctatgagaatctaatgcctctgttgatctgacagtaggcggagctcaggcggtaatgtgagtgatggggagtggctgtaaatacagatgaagcttcactcccttgtctgccgctcacctcctgctgtgtggcccagttcctaacaagctatggatcagtatttgtctgtggccaggtggttgaggctccctcctcatatagatgactatttaacattactctaatgatgggtattaaaagtattttctatttctcaaatgtgtagttttaaagcaaataataataattatagcaatttaatctaggccagctgctatgctgagttgacatattatcttaatcctcacacaatatcgggtatagacactgtttttaacttccattttgttgataagaaaacagacattgagggatacagtagtctccctttactggcagttttgctttctgtggtttcagttacctgtggccaaccatgagctgaaaatactaaatagaaattccaggaataaacagttcaattgcaggtcattctgagtagtgggtcaaaagcttgtgccatcctgtcctgcctggagttagaattatccctttgcctagcatatccacattgttagtgctacctattaatcacttagtcatctcaattatcagatcacgtgtcatggtatcagggacagtgtttgtgttcaagtaacttttattttacttaataatggtctcaacatgcaaaagtagtgatgctggcaattcagataagccaaaatgttgttgtaaagggcttcctttaaatgaaaaggtaaaagttcttaacttaataaataaagaaaaaaaattgtaatctgaggttgctaagatctatggtaagaacaaatcttccatctgtgaaattgcgaagaagaaaaaagaaatttatgttagttttgctggtgcacctcactgcaaaagttatggccacaattcatgataattgcttagctaagatggaaaaagcattaaatttgtgggtggaggatgcaaacagaagtgtgtttcgattgatggtgtctgggttcaatactgtccactggggatcttgaaatactatccaatgtttcaggtatccactggcgatcttgaaacatatcccctgtggataagggggaacttgtccttgtctaagttcacttgtcttagtcttaataagacttgtctaagttcactcagtagtaagtgctagagccagaatggaaaccgaggcagtccttacatgcatctttgtgcagcacatagcctctattattgttagttatatagttgatgaagatggtgtttattacttgaagcctcatttttttaaacaaaattagcaaatattatgaatatgtgattatcatgtatgtattattggaacataaagcttaaaacaatgtaagaatcctctgaaaccataccactctgagctactataataagggcatcttcaagcctttttttttttttttttttgggcggagtctcactctgttgcccaggctggagtgcagtggcgtgatctcggctcactgcaacctccacctcccgggttcaagcaattcttctgcctcagtctcccgagtagctgggactacaggcacgtgccaccatgcccggctaatgttttttgtatttttagtagagatggggtttcactgtgttagccaggatggtctcgatctcctgacctcgtgatccacttgcctccgcctcccagagtgctggtattacaggcatgagccaccatgcccggccttctctatgctttttatggggcatcttttcatttaatttccttccatttttgagctctctagcgagtgtgaaaatggagttttggcagtaaagctccacaagggaatagaagagaaggctctgctgccagttagataacttccctctggaaatcctggcaagatgtactgaaaggtttcagagggggttggtatgatggaaactagtataaggatgtacctatattagcttttttgggtgagaaattaatatatatattagtccatagtacctcgatttccctacgtttatggcattagattaccggcaacagcagaaatcaattgaccttcacttgcgtgggtaccttttgattttgtgattgttccattttcttccctgcatgtcattattagcttttaaagtttttcttgtattcctggattatattactcaataaactttggaaatttgaatcagtatttttctctcagaatatctttattgatttttccttggtaattatttccctattatgtatagatgttatgataattcttttttgagagaacttaaaaagtttgagattcttaaataatggaacaagaaattgagtttttcatatgcattcttcattagagtattaaaacattttctaataatttgaagctatagtgtgtttgatttgtagtatattaaaatctgtcatttttcttttaggctgtaaaggatgtgaatctttgaacatagttgccatgaatcttaaataacaaaaagcagttagtatttttaaaatattccatttgttttataaacattattttgtaggtatctgtaatgcgtgatgaggataaattactgaggattaaaattaatgaactggagaaaaagaaaaaccagtgttctcaggaattagatatgaaacagcgaaccattcagcaactcaaggtaaacagttttgtttttaaagatgatttaaatgcattctcttggtatattttagtgtacaaaaaggtacaaatttgtttttaataacatcctgttttgactttttctagaatctagaaataaattatttaaaattaaataggcaaaaaagaaaaaaaaaagataaaattaagtaggccagtagtgactctcttctaatgaatagactatggaaaagaaaaaataataacttcatagtgaagaaacctagcagataccactttaaccaagtgtttaagaataacattaccattagtcatactgatgctgtgtgcttcctggtttgatgtgaccagaaaggcacataccctctttggtattctttccctaaatttataacctcagactcttcacgaaaaaacattagacaaacccaaatggaggatgttatacttactgcttcaccagtatgaagtataaagtgtcagggtcattaaagacaagtaaagactggtgaatgatggtgaagtctggagtgtaattaatagtagtataccaatgttaatttcttgatttttgataaatgtaccatggtagtgtaatatgataacattaagggaagctaaattctttggaactcttgcaaagctaaaattattttgaaataaaatgcaaaaaaacaaaaagagttgaggtcttacagcaaattccttttaaaaatgatatttaaaaggcaaaatccctttattgtatatggttattttttgcttgatatcaaccaaatggatgaggcaacaataaaaaaaatacatttgttatattattttcatgtttgcttttaaatgaagcaaactaatgaatagtcaggtataaatacatgattttaattcttaaggtaatcataataaagcattctataacaataggattcgagatctccatattccataatgattcactcttaagacttacaaagtgatgagatagtggtgacattagatgagattgggggtgaagtttggattacatgataagttacaattagaactgtaggatatctggtccccataatttaatcttgcctcttaaggcttatttttttccaatcttgcagctactttctaggtaaaaggggtggagagctcttttttccttcattttgagtttaagtttaccagtgaggaagcttttaatggtttttcttgttccttctatgttaaatacacagtagaacttcattttcccttgtttctgctttttgtggtttgtaagaaaacatttatctaaaatgttgagtaagtaaaataaccgggtcataacgtagattaaaagtataggctgggcacagtcgctcacgcatgtaatcccagcactttgggaagccgaggcagacggatcacaaggtcaggagatcgagactagcctgaccaacacggtgaaaccccgtctctactaaaaatacaaaaattagccaggcgtggtggcacacgcctataatcccagttactcaggaggctgaggcaggagaatcgcttgaacccannnnnnnnnnnnnnnnnnnnatatatctgttgatatctttgttagcctttaggtttctcatccttcaaggctccattttgaagaaacaaccctgtatttcctatttccattataaatactgcatatattatatattcctcactaggttcaatactcctggagagctgaggatctcagtttatttatttagagacagtcttgctctgttgcccaggctggagtgcagtggtgcgatctcggctcactgcaacgtctacctcccaggtttaagtgattctcatgcctcagtttcctgagtagccaggattataggcttgtgccactactctcagctaattttttatatttttagtagagtcggggttttgccatgttggccaggctggttttgaacccctggcctcaagtgatctgtccaacttggcctcccaaagtgctaggattacaggcatgagctacagtgcctagccttattttattcttttttttttaaattttttaattttaattttaatttttattttttgagatggagtttcgctttgtcgccaggctggagtacagtggtgcgatcttggctcactgcaatcttggctcactgcaatctctacttcttctttcccctgctctcaccctacccttttctccaagatgaaagacagttggaagcttgagactggtaccagctggtataccagctatataggagactgatttcaaacttaatattgagccctgttttcaagatccactgttaaatattgtgtttttaagttaatttgcaattaatttatattctttcaatttgtaggagcagttaaataatcagaaagtggaagaagctatacaacagtatgagagagcatgcaaaggtcaggaacaagtttgtacttctggaaccagaaaagttctcttattcccctcgcagggcatgcgatgggggtatgacttgcttcattggtgccctgcagctcaaacccctagggggagcatgcagacgggcaggtcttgagtgtgggctctgaccctgtggcagcatctggggttgagtgtttacagctcctgaaggccccagtgggcgtgttctacagggtgttttttcagcctagccgtccacaggcggcttgtgttaatcagctcaattagaccctctgccttattgcaaggacagagggctttctgtatcccgggattcttgctctagtgtactggaaaaatcggatcacacatgggcgtgtagaaggttttattgagtggagttagctctctgcagatgtatggggagccagaaggggatggagcgggaaggtggtcttgccctgggcggccggactctcctctgactgcccgcaaccaaattccgtgtcatctcacagtagatggcctgccagcatctgctggtatctgctggtgtgttcttccagtgtgttcctctagatgttcagctgcttgtgtgtgtgcctgccagggtctcagggtttttgtaggcacaggatgggggcgtggcaggccagggtggtcttgaaaaatgcaacatttgggtgtgaaaacaggagtgcctgtcctcactctgtgggcacaggcccgagggtggagccttcaccagggaccctgcctttctgtacccagcacttccctgcctgcctcccatatcacttccagtactaaaattacaaaacaggtagttgcaataacaactggttaacatttcctttgaaaattctgaagggaagtgagggcaacataagatgcagctttatcaaaagtgaaaagtagtgattctaatgaataatttgttaacttaaagcttattcttagaaaaataaaataagtagtcaaagcaacattgatttcttgtaacggccagtattttgtgaaaaataaagccagtcaaacttttatgtaggtcacaatgaatggcatagatttctggacgaaattgtgtaaagaataaacttcaaataaaatatctttaaaattaaaatgtgtattctgaacggacacttctcaaaagaagacatttatgcagccaaaaaacacatgaaaaaatgctcatcatcactggccatcagagaaatgcaaagcaaaaccacaatgagatatcatctcacaccagttagaatggcaatcattaaaaagtcaggaaacaacaggtgctggagaggatgtggagaaatgggaacacttttacactgttggtgggactgtaaactagttcaaccattgtggaagtcagtgtggcgattcctcagggatctagaactagaaataccatttgacccagccattccattactgggtgtatacccaaaggactataaatcatgctgctataaagacacatgcacatgtatgtttatagcagcactattcacaatagcaaagacttggaaccaatccaaatgtccaacaatgatagactggatgaagaaaatgtggcacatatacaccatggaatactacacagccataaaaaatgatgagttcatgtcctttgtagggacatggatgaagttggaaatcatcattctcagtaaactatcgcaagaacaaaaaaccaaacaccacatgttctcactcgtaggtgggaattgaacaatgagagcacatggacacaggaaggggaacatcacactgtggggactgttatggggtggggggagtggggagggatagcattgggatatatacctaatgctagatgacgagttagtgggtgcagcgcaccagcatgtcacatgtatacatatgtaactaacctgcacattgtgcacatgtaccctaaaacttaaagtataataataataataataaaatttttaaaaagctgcttaataatttagattcaaatcctaggtgctgaattatgaattatgcttttcttactcagattgtattgatttgttgtttgaaatattacaaaattacttttttctttttgagacggagattcgctcttgtcatccaggctggagtgcagtggcacaatctcagctcactgcaacctccgccttcctggttcaagtgattctcctgcctcagcctcctgagtagctgggattacaagcaccagccaccatgcctggctaatttttgtatttttagtagagacggggttttgccatgttggccaggctagtcttgaactcctgacctcaggtgatccacccgccttggcctcccaaagtggtgggattacaggcttgagccaccgtgcctggccacaaaatttcttttatagatgatacatatttctgtttttaaaatgatacagactcctctcctcctcattaccccttaacttctttgttctgtgagtggcagaactaggatttgaacccaggtgtgcttcactcttaagtctcagactctctttactaatccatgttatttgtacttggccaacaaaagaaagggtaacacaaccagattattacttatttagctgacttatacattggtggggttaacttggatgggtaacttggatgtgaaaatatatctctgcacacagtactgttttcttctgcctttcttaggccttgtcaccctaacatctcctatttcataggaaatagttcatagctatcttttaggattcccctttactttggctcctttgtccctcttggtgaatgtggacacatcttagatactctggaaaagtctacccttggaccaggttgccctatagtttttatcatattttaatttttgttttctttgccaaatatggagaagtatggcataggcccaccgtgactattttaatctgacttccaccttttctatgcttctaagtcacttgtaacctacatatgttaaaatctgtcagcattttgcaatccctgctttttatttttcattattttggtgttattgtacactcttcttttcctcagttatatttataaagtagtatttattgtatgtgtattttttctaaatataaaggtaatctatagctcctcccaccttttgaaactctcttgtctcagcttttatgatctattctgtactagttaccacttttctctcagaatgagtctcagccactttggtaacttgcctgattaagatgtcgttatctttttttaaaattattttttcctttagagagaaaatgctcttgtgatttaagttgtgtatgagacatttccctacaaatagacaacaaacaaaactatatctttaactcttaaggctttccctgcctcctaaatttctatttattcacggaatgcctttcacttacctatctttaatattgaattattaaacaatggagatctaatatatgtaacataaaatttaccttttaaaagtgtacagtttagtgggctttagtactttctattcacaaaattgtacaaccatcaccactatctaattactgtgtgtttatagtaacgtaaagtgacaagtgaacatttttgtcacttcaaaaagaaaccctgtacccatcagcaatcataccccattcaccccatccctccagctcctatcagccactaatctactttctgtctgtatgaatttgcctattatggacaattcatgttaagtcagttcatacaatatacggccttttgtgtttgactcttcttagaataatgtttccaagtttcatccatattgtgtatgtatccgtactttattccttgctatggctgaataatattccgcattttatgtatcagttgatagacatttgggttgtttccacttttggcttttatgaacatttatatgcaagtttttgggtaaacttatagttttaattttcttggggatggtaagcaagtgttgaatatgcagcacttgattgcttgttcatttaatagtcatttatttcactatgattgctcataactatccttagataatatctttagatagctatgatgagatatctgtctcagacttctttactttgctttattttccattttatcattttggtgtgtattttggggttctttcctgaaataaaatgtaaattactggagtcaatgactgattaaataattatctttttgcctttactgctctagtttgctagctttcaaataataggtgagtagccattagtgaggttaccattggtgttctggaaattttttaattgataattagatttgtaaattctttttctagtcctcagtttagagtcagaaatgcaaagtgtaagagggagggaattctttgaataaaattataattaattgtgtaatatgaatatatttgaaaatcatgctttttgaaagagatttatatgataatatgaaggtgactttaatcctaggaggaattctgttttactagcacacctgaaagcctgcatcaatggaaaaatactaaaaactgctcatacagttttctcttactgtttagtttgttttacctttgttttatgtgcactttgagggagccatctttgggtatttgtgttactaaaagcagcctgagattgagctatgcatttatagctttatcacctctgacatcagtaatagttggtaagagttctctgaaatgagccctgctactaggtgccatcaccagaggcaacaaactgatcttccctctttatccgtttcctgcagacagggttaatatatagttgcttacaagtaattgctgtagtcattcttcaagggccagaaacaattttaggaaggctgttattactagcttttcaaaagccatttctgaggagctggttttaaataaaaatttaaaatagaaacaaatatttgactctgaatatttttctagaaaaagtaactacttgatgttaaaaaaaatagttcaaattgggattgagcttttttagttttaggaggtaaaggttttagtttgattggagaatattaacactgaaaataagtattttgccaaataatggtttttccccctaaatcctaagatttatgttcatagtaatagttagttgtatcggaatagtttaattgtattagaaattgttaattttacctgaaaaaacttttttccattcatccactcttgcaatcatccaagcatccatctttacaccaaatatatatttagtatgtcatatataccagtactgttgtagacattgaggatattgcgatgaataagacaaagtttctgcctatatggaactaatattctattacagttaataaaaatgtattttaattttagaagaacttaagaaaaattggatatctagaggctattaatttctaaaatgttctcccccgatttttagatctaaatgttaaagagaaaataattgaagacatgcgaatgacactagaagaacaggaacaaactcaggtagaacaggatcaagtgcttgaggctaaattagaggaagttgaaaggctggccacaggtaaaacaagattgcttacatttctctaaatatactttttcatttaaaaaaaaatttcctagatttcttcccttgttaaagtagtacgtattttcagtgattgataatggaaaagtatttggtgttttttgaatgtcctattacttgtcattttccactgtgatgaaaattgtttcactaaaattatatgcagtaaaggagtaaggacactgcatgataacttacgaattatatattgcaagttatggatgataacttgcagtgttccctagatgttaagagtaagttttcaactgagtttcacctttgtcaggcttttagcattatcttgtatgttgatctcaataaatactttgatttcattgctttcagaataccatcagagtttttctagagtatatggaaaaatataacatttactaataaaaatgttatgtgtgattcttgtagaaagggcaagaaatttagaattaagaaattgtctagccattttatatataaccttggcagggtacttgtgcttactcagcctaattttcctcatttgtaaaatgtggctgatgatgataatgccatatgtactattgcacattattctttttttaaaatcatctgacttgaagattcatattgtacattattcttatcaagatcagatgagatgaaaaaatgtaatagtactttgtaaaccctaaaactctattataactgtattttggtggatgaaattgtgatgaggatgaggacagtgagtctgtgtgacttcatacttttctagccactttcatgggcatagaaaacttttttcttgaggactgcatgaagttttctatataataaggttgacaatgaatttattatactatactgtgaatactattcattggattcctgagaagtccctgtagttcctcttcactaagaatttagtaagaactcctaaaagttaaactatagaatagcctcagttccatcttggtctgtgttctttatctgggctctactgatttgtgtctgtagcccatgtcaagtgtatctctacatggtataacttttgcatatgctttaaaacataattttatgtcttcaaatcagaattggaaaaatggaaggaaaaatgcaatgatttggaaaccaaaaacaatcaaaggtcaaataaagaacatgagaacaacacagatgtgcttggaaagctcactaatcttcaagatgagttacaggtatgactttatgtatgtttttatgtatgaatgtatctgtcttcattatatttctaataagaggagaattcagtattttatatttagtaattcacttagatatgggtgaaataatacctggcaaatgttaatatgtaaatataacttttcagtgcacattgaaatgacatggggaagaaattccaagatatagcctattaagtgccagtgaaatatagtgattgggtccttagttttatgtttcacatatttaattcataaaccactgcttctaatgtccttgtgcccatttttctactccttaaacttcttactcatcaaatactgctgtggagaaaatgaccatcaggagaattattttgattactttaaatctcttcaaagtttaattattggaatagaattgtatatctgaacacatataaaactatactatatagaaggtattctattttgtgtgtgtgtgtttttttcttgttcagctttaacatacaacatatgggggaaactttttttttcataggatttaccaaatactatttcattttgtacattttattagaagtggcattcataacagaagctgtaggattgaaggaaacataatagttttgggagattgtctgcctctaaattttttaaaattctggctgtgtattaaacatatgctgaaaacaaatacaaaaactactttttttgttacatattatatattctagaatttacccttttcattgtgaaattccaaaagcagttagaacaaaataaatattatgaaaaaagtgtatcaaccgtattgagaatgtttgcattaaaaagtatttgtgtattttgcattgttctaagatgatgtaatcacattagtgtagattataaactttgtaatcctggaatggactgccatactttgtaatatagtgattttagaagttttcttttcgtttttttgagacggaatcttgctctgttgccaggctggagtgcagtgacgtgatctcggctcactgcagcctccaccccctgggttcaagcgattctcctgcctcagcctcccgagtagctgggactacaggtacacgccagctcgcccagctaatttttttgtattagtagagatggggtttcaccatgttggccagggtggtcttgatctcctgacctcgtgatccgcccaccttggcctcccaaactgctggaattacgggcgtgagccaccgcacccagcctagaagttttttaagtggtattattatttttatttcaaatgaagttctacttgggttttttatatatattattaaatgcctctgaacccaaagaatctgtggtaccagtttgaaaattactgatcagcagtattctctgtccagctcttctggatgttcttttaataaatatcctgttgcacaagttattttttatttggcatctcgtaggcccaggaatattttatttttagaaccatccagttagaaatgaccaccacaaacaaagtcttttttattctcttggcatttaggaagatttgagtcagtttaactgtttcagaaatttgaattatttattttttcttaaggtcactgataaaagtatttaaatggacttcatagcaaaattaacttataaatgaaatgcgtttaggaaagcaaaccagttattttattattttttaaataatctgaagctttgatcttgtcattgtttaaagtgaaacattaaagtttttatagaggtgaaaagtaatggattgtatgaaaatgttatagaaacatgtattgactactttgtaggcatgcgataataacttataccatttatatatacaggagtctgaacagaaatataatgctgatagaaagaaatggttagaagaaaaaatgatgcttatcactcaagcgaaagaagcagagaatatacgaaataaagagatgaaaaaatatgctgaggacagggagcgtttttttaagcaacagaatgaaatggttagtaacaattgtatctttgatgtatttcacctactttccttggtgtgttaaatgtattgctggaattaacagtttctacatggttttctgtttttggttttttaaaggcaggttgtcatctttataagataacttctgagccaatttatcttgacattcactaatgttcttgttttaacttgtttcagttgatttagcatgttgggagaataccttattgcttcttactgtctagatactgaagtaaaaaatctcttccttttgaccgttacagagtattccctattatattttaaaactttctgcattttgaactgtagattctaatactgtgtacattttatcacataaagtcacctaaatagtttgtaaaagactatatatatagtagaaatgaccttcagttttacatttactagctgtaggtcttgtaatgattgtcttagcctgttctttttttctaattggcacttagtctgacatgccatgttggcaatcagaaaaaagaagctaaacgttatcgttaatccgaggaaagctattgagcaacaaatattttaaaatgaaaaaccagtgtctataaaaatagtaacttcgcagtatcatattgtcatctgttggcatttcctttttttatgactgcatttgactaaaaacagttaaactttcctataaaaactgaaagatttccttccttctttccttccttccttccttgctccctccctccctcctttccttccctcccctcccccctttccttccctcccccctttccttccctcccctcccctccctcccctttcctttttcctttccttcttccttttcttcatcctgtcctccttcttcctttccttcctttctcctttcccttccccgtgcccatccccttccccttccctttccctttcccttttctttcctcttttaaagagacaaggtcttgttctgtcacccaggctggaatgcagtggtgcagtcatggctcactgccgcctcagacttcagggcaaaagcaatctttccagctcagcctcccaagtaactgggactacaggcacatgccaccacacctaggtaaatcttttattttttgtagggacagagacttgctgtgttgcccaggctggtctcaaactcctggtctcaagcagtcctcctgcctcagcttcccccaagtgttgggattatgggtgtgagccactgtgcattgtacccggcctgaaatgttaattttcaataaggtaaggacagtttttccactttttttcttccctagctttaaagctgcttttaacattgaatattgaacagagttggccagtttttattaaaatgaggctgttgtgagctaaactttccagcatgcttgctaaactccagaccatacatgtattctactccagaaatcaagcccttggttgaagtgtgtgtcctttctgaagctagagagtctaccattgaatgctctgtcctcatgtcacatggtgtaaatttgctcccataaaaaagtttactttttcatgaaatcattttatttacagaataaattttttgaaatcattttatttacagaaaagttacagaactagcacatagaattcctgtatacctatcacccaaccttcctgacccagtagtaagaggcaataagtaaaatcaaaacagaaggctgtcacagttgctccaattccaaaccagtggtttctctggtagcaatgccagcaagtaatcccactttgaatttttaatcctagggaaagctagtttactcttttctctcatatgtttctttataatcatacttaggttgtgtatgtgtctgccatacttaagaaacacatttttgatgtaatgttaatttttgatgtaaaattgtaacatataacatggaaaggaaatagaacatagttcagtgagttattgtgaagccagtacccacttaactaatacctatttcaagaagagaacactgttccaccccagaagctccttcttctgcctcttttccagtggtaataactaatctgtccttcagtgttacacttcagttttgtctgtttttgggttttatgtaaattgaaatatatgaatacatttgattgtacctgacttcttttcattcactattttatgtttgtgagaatcatccatgtttccatgcatgtatctggagttagtccactttcatttcagaatatttaagtgtatgaataaaccactgctaattcattttaatgttgaagatatttggattgttttctggttttggctgttatgaataaattttcctataaacatttttatacatttattttggtgcacatttgcatatatctctgttgtgtgtgtgtgtgtgtgtatatatatatatatatatatatatatatacacacatgacaattgctagatgatagggtatatatatgtgaaattctagtagaatgctgcactgattttcgaagcagttgtacccatttataccccaactagtgttgcagtagctgtatagtcccaccaaggtatggtattgtcagtcagtttttaaaatggttttaatgtgcttttccctaattactgatgaagttgaagattgtttcatttgtttattggctgtgcctatacaagttcccttacctgtttctctgttggattatctagcttcttatttgtaggaattctttatacttttcgggatagaagccctttttgtaatgtgttgcaagtaccttctttctatctctagtttgctttttctttcttactgcctttttatgagtaggagttctcataaattattattgtagatatggtagatattacaattattgtagataattttattagtattattgtagataattgtcccaatatttttctttatgaagcccaaggacttgaagatggtgtgttatattatttcctgaaagctttgaagttttttatctttcatatttagatactagaattgatttttgtgttggtgtgagatagtggtcaaagctcttgatgtttgttttaatgtgaattaccaattgatgtggaaatatttattgaaaagactgtttctttctcactgctgtgccacttttgtcgtaaatcatttgcccacgggttaattttgtatgtgttgtaagattagggttggggttctttttttttttcatttggttattctgttgttccagccccatttattgggaagattgtccttccttttatttaatttttttgccacttttttaagtcagttgaccatgcatttgtagatcgtctcttctgtcccattgatttctctgtctttacatgctgtcttgattattgtgctaacttgaaattatagataattgctgtcattttgttcttcattttcaaaataattttgagtattctagatgatttgcatctccatataatttttagagtcaccttttccatttccacacacattcacacatacctgaattttgataaaaactgcttttactctctagatctatttggaggagacatcttaacaatattgagtattttgatccttcaacacagaccaatctctctatttatttaggtgttctttaatctctttcagcagtattttatggttttatacattttctttatcagtatttcatgatttttgaacctgttgtaaatggtcttgttttctgttttcatttttctgttgtttgttgctattactgtaattttacccactaattttccaaacgttggcagaaatgttgatactagtttgaaagctatagctgtaattgtgtattgaaagaagttaccagtaagccgatttttggaatgagatgggatatggataaaaataacatggacatttaatttataaaatgatatgtgttgttttatagttaaatattttatctagactacttaatttgtcttgtaatcttgtttgcagctatatttatggtgttacatgtaataatttctaaacattcttagattcataatatatcaaggttgattttaatattttctttatttcctgattaggaaatactgacagcccagctgacagagaaagatagtgaccttcaaaagtggcgagaagaacgagatcaactggttgcagctttagaaatacagctaaaagcactgatatccagtaatgtacagaaagataatgaaattgaacaactaaaaaggatcatatcagagacttctaaaatagtcagtagtcttttttgctatgcctttttaattgaacatagtaattacttaattgactaactcttaaagaataaaaaagtgtaagtctcaatagaccaaaaaggaatcagagtatttaaaatgtggaaatttttcatgatttagagtcttgaaatttatcattaagattgatttgtcaatcaatgactgagatgtagcattttctccaatattttggttatatctctcagtaattagaaaatattagtatttctaattactttggtagagtaattagaaaatcaacaatttatggtttagtccccagtctgcgtttaaaatatggaaatgtgattcaacatgaactcttggtgattttgaatacttgggcccatccttaactttattttataaagatacaaattattttgaaagtaagcctaatggtagagagacattatgagtcattcagctgttacttttatattaccttgagactggaaatcctgaaagaggagagaattgccttttacagatagctgcttcccagtaaatagaatctgggtacatctgaagctagtctttctggaataatctgtacttaaaaatcttctgctttaaagccttcagacaataggaaaaatatgtatgtgtgtgtcacatcaaaagactattattgtaagagagattacttgctttaaaaagaggtagtattgtgttgtttaataatatatcctagaaagtcagaaaaactaggtatcaactgctgtcgctgtggttttgggacctttgagaagaattacttaacatttctgatctttatctaaaacaggtaatagtgttttcctaacagagttgtgaaattaatgaagattgtaaaacaagtagcacagttcttactccagtggaaatcaatatatgctagttactttcccttttatgaattcagtagagtctttcttatttggcagtaatggggaggtgacataagaggtttacttgacttttgattttgatggctgtgatgaggaggtctgtgttacagtttattaagtttaaaaatgtaatctatttctttataaatcgcctaagtagagtttagaaatagaactttatgactgagaaaataggaggaagaatgtgctgcaagaaaagatttagttttccttatggtcttttgtactgtaatgctatagttgcattcctgagaagcctccagtttttcaaaattgtgttatcaaaagcaactgttgggatactgagcaattctaactcagtacagaccttgaccatgccatttaacgtgtgtcgttctctatttcctcatctggaaagtaggaataatgatttttgccagacctacctgcagagttgcgatgaaagtaaagcaagagaatgtgggcagaacacttggaagttgcaagcaatctttcaaatttctccttagatcagagtcaataaactggaaagtgacccagcctttcctgagtatctgaggttgaaagagaaataggagggctaggtggtaattaaaggtgtctttacttagtaatttccattgtttagtttcatacaaatcttgattttatattctttatgtgaagttttcttcaatatattttcaggttacaatgccctgttgctttaatatttccttactttaggaaacacaaatcatggatatcaagcccaaacgtattagttcagcagatcctgacaaacttcaaactgaacctctatcgacaagttttgaaatttccagaaataaaatagaggtgggtatttggcagcacagtccacttatttattctctttatccactattactaaataacacgtacaagtaagttgctgaagataccttactgcacaattagctgtgtgtgctctgggctgtgtgaaagaaactagaggcttttgaggagaggtgaaattcttttgggagattatatgcccaaatgatgttaatctcatcttaaaagcagtagatttgttaatagaaacaaacttgatggtcagaaataggaaatcctactaatgagaaaatagggataatttgctctcataaaaggttgctttaataaacattgtgttaaatagtattttttggaattgtatccatttagtagctttgtcaccagtcttcaataacaactcgtgagtttccttaatttgtattgggcttagggttctgtgaataactttggataatatagagattcttaggttggatatgaaatagataaaaattctatgttacttaaaatttttgaagataaaattactttttaaatttctttttaaaacacatttattgggagcattcagagttgggaacctttttaagcactgaggatacgaacatcaataagacatgattgtcatcctcaaggagtgaagaatctagtaagatagatacataagtgaatgacttgtttgattttacttcatgggctaagtgttatagtagaaatataaagtgagtactccaaggaacactgaggaagatgaaatgaattttgcctgagtgtttgtggaaatggattaaagaaggtgataccatattgtatcttatgaatggaagcttattaagcagacaatgagaaggaaaagtcttaaaaaaaaaaaaaagaaatggggtttcactatgtttctctggcagctgaacttgaactcccaggctcaagcagtcctcctgcctcagcctcctgagtagctgggactacaggcatgtgccaccatggccaactgagaaggacattttaatctgggaaaataacatgagccattcattttctcttggtttttccttgacagttcttagtagtttcaaataattagcactaaccttggggactaatacaaatcataaatttcacagaaaagtttgaagtttatccataaacaaggcttaattcttgattgcatggacaaacacatataatggaacatttctttctccataaatttatgtatgttgtcctaaaacctcctggttccaattttctaattccagcagttattttatattccacaatttggggaatcatattgttaggctattttgtatgttcttgccttcatgtaatcgatatacttaactgggctgaaagtccaaaatgattaattcagttaactggtagttgattctgggaattccactggacttaatttgtggtctctccctgtggattggacctctcatggcatggtagctggtctgagatggggcattttgagggtgagtgtcctgaaagtgttctaagaggacaggacagaagttgtaatgcttcttatgattgagccttagaggaccataatgttatttctaccacatcctattggctataaggcccaaattcaaatagaggggaatgagagactccatctctcaatgggaagagtagcaaagtatttgcagcctacttctttaatataaccaggctgtttgtcaaagatctcagcctcctcccttggagatttctgatttactgggtttgtggtagagtccaggagtcttttaaacaaattctgtaagtaattcttatgatcatacaagtttgggaaatagcgatgttacccctaattttaacataccatgtgtgagcctgaagaaagtagatgattgctcaatctttctgttcttgctgtgatctagcacgctttttgtctttcccaatgcattgtcttggataggcatttgagagaattaattctttgtggtttataaatgtatactctacaaataatatttttccttttacattctgttgtaggatggatctgtagtccttgactcttgtgaagtgtcaacagaaaatgatcaaagcactcgatttccaaaacctgagttagagattcaatttacacctttacagccaaacaaaatggcagtgaaacaccctggttgtaccacaccagtgacagttaagattcccaaggctcggaagaggaagagtaatgaaatggaggaggtaaatacttaactgatgagtaaatttaatgaacaaatcttattataaagctgttatagtatagagttaaactgctatattgccctcctgttcataggcactgctgttagagaccaaaatcacaatttatgctatattttataccctttaaggatatcactgtgggccaggcgtggtgactcatgcctgtaatcccagcactttgggaggctggggctggcggatcacttgaggtcacgaattcaagaccaacctggtcaacatggtaaaacccgtctctactaaaaatacaaaaattagccaggagtggtggtgcacacctctaatctcagctactcaggaggctgaggcaggagaacaacttgaacccaggaagtggaggttgcaatgagatgagatggcaccactgcactccagcctgggtgatagagcgagactgtctcagaaaaataaagaatattactgtggtttaatggtcttcagataaaaagctatgtatattaaaagatatagcgtccttgcttcagttaaactataatacatcaaatgatggtggattttactggagagccatttcagtataccagtcctgttcatacttagtcactttccctgtattggaagagaaaagagggttatgtagaaatcagagaaactgaaatagctaacttgcttgtgtataatctttgtcatttaactaaaatcttgtctgtatggtcctagcaagttttaaaagagaaattcttttttcatcagccagtgttaaaatttgggcctctatgtagtggtaggctaaaagctattaacctcttcttactgcagtttcttgattgaagggttgccaaacctaccatgtcctagatgtggagatttggcaagtcagatgaggtttctgatcctgttttctcctttttggaacaatggattaatgtgttgaaaatgcttcgcttttgctctgcaagtggcagttacatttattaatataactattattactatttattaatagttactattaatatttattaatagtattatttatttatatatttttatttatttatttatttattattatactttaagttttagggtacatgtgcacaatgtgcagtttagttacatatgtatatatgtgccatgctggtgtgctgcacccatcaacttgtcatttagcattaggtatatctcctaatgccatccctcccccctccccccaccccacaacagtccccagagtgtgatgttccccttcctgtgtccatgtgttcccattgttcaattcccacctatgagtgagaacatgcggtgtttggttttttgtccttgtgatagtttactgagaatgatgatttccaatttcatccatgtccctacaaaggacatgaactcatcattttttatggctgcatggtattccatggtgtatatgtgccacattttcttaatccagtctatcattgttggacatttggattggttccaagtctttgctattgtgaatagtgccacaataaacatatgtgtgcatgtgtctttatagcagcatgatttacagtcctttgggtatatacccagtaatgggatagctgagtcaaatggtatttctagttctagatccctgggaatcgccacactgacttccacgatggttgaactagtttacagtcccaccaacagtgtaaaagtgttcctatttctccacatcctctccagcacctgttgttccctgactttttaatgatggccattctaactggtgtgagatggtatctcactgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggtcacctattcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcccaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttttctcaggtttgtcaaagatcagatagttgtagatatgcggcgttatttcacaagcattcttatacaccaataacagacaaacagccaaatcatgagtgaactcccattcgcaattgcttcaaagagaataaaatacctaggaatccaacttacaagggacttgaaggacctcttcaagaagaactacaaaccactgctcaatgaaataaaagtggatacaaacaaatggaagaacattccatgctcatgtgtaggaagaatcaatatcgtgaaaatggccatactgcccaagctaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttaactatactacaaggctacagtaaccaaaacagcatggtactggtaccaaaacagagatatagatcaatggaacagaacacagccctcagaaataacgtctgttaagtattttatttctccttcacttatgaagcttagtttggctggatatgaaattttgggttgaaaattcttttctttaagaatgttgaatattggcccccactctcttctggcttgtagagtttctgccgagagatccgctgttagtctgatgggcttccctttgtgggtaacccgacctttctctttggctccccttaacattttttccttcattttgactttgctgaatctgacaattatgtgtcttggagttgctcttctcgaggagtatctttgtggcgttctctgtatttcctgaatctgaatgttggcctgccttgctagattgaggaagttctcctggataatatcctgcagaatgttttccaacttggttccattctccccgtcactttcaggtacaccaatcagacatagatttggtcttttcacatagtcccatatttctcagaggctttgtttgtttctttttattcttttttctctaaacttcccttctcgcttcatttcattcatttcatctaaaaagcagagcgcctctcctcctccaaaggaatgcagttcctcaccagcaatggaacaaagctggaaggagaatgactttgacaaattgagagaagaaggcttcagacgatcaaactactccgagctacaggaggaaattcaaaccaaaggcaaagaagttgaaaactttgaaaaaaatttagactaatgtataactagaaaaaccaatacagagaagtgcttaaaggatctgatggagctgaaagccaaggctcaagaactacgtgaagaatgcagaagcctcaggagccgatgcagtcaactgggagaaagggtatcagtaatacttatttttaaagtaacttgttttaagcttaaaactaattacaaactctctagcaaaataatttttcttcaactttcttttacttctttgaagagtagtatattttcaagctgatgtaagagcagaaatagtattaactatactcctgaggctctctgtcaggtaataattttgctgagtgaatattattcagcatagtttttctgctacacatgtaacacctttagagattgttttatggagtcttactagttaacttttgttttatatttatttaattttttaaaataacattaaaacactgagtttcatcatctagttggctttttcttgatccattttttttcaacgaagaaggaaacaccgagtgtagttctcaagaaggttaaaatataaatattttattaattttactattggcatatatccctcatgtatatttcagaaaagatttacagattgttgtagatacatcatgtagaaactttaaattttctaactgattttactcaatcttcactgctataataaactaagtacatgggcccccatgaaaatcatttatgcaatcctattttctttttttcttccacatactcttttttttttttttaattactaagttctgtggtatgtgtgcagaatgtgcagttttgttacataggtatacacatgctatggtggtttgctgcacccatcagtctgtcacctacattaggtatttctcctaatgctatccctcccctagccccccaccccccgacaggctatattctaatccagtgaagactccaaagagctccttactgaccactatgtgtggaggtagcctcatggtctcttttcacttgcatcctatgattaccatctgtcttttccctgtcatggtgtctgcttcttatgacccttataacttctgctttgtaatttggattctgaggttcagtcatgatcttttctctgcttctcttcttgccccctttttcctgaacttttatctttggtacaactaggatttgcagcagttcaagtcagtgagtatatctgtaaagggctttgtcctatgtgaggttatttggggaaaagaagagtaagatgccatacccatgttgtagagaagaaagataatattttaaaagttttaacattttacctttggttatttgaagtttcgtttttattttatttttgatattgtcaaatgtcaatgagagaacttagacatagatgcttgtattatttgggagttaggcaataggtaggtatattgtatgctgtattttaaagctcagtttcaaataaaagatattccttccatgtttttcatttagcttatgtaatttcattacttgtgatatgtttgaaaaattcacaccttcagtcagggtttctcaactccagcacagttgacattgtgggctgtatacctctttgttttaagggctatctatcctgtgcattgtagggatgtttaacagcattcctgacctctacccactcgtggccaataatatccccttctccctggcaaagacaaccaaaaatatcttcaaacattgccattgtcctctgagttcaaaattgccctcggttaagagtcactgttttaagtgataatgtagctttttacaaattttcttttttgagtctagagaaataaaatattgtcaagaaattaactggtgctaaaattcattatttttaggacttggtgaaatgtgaaaataagaagaatgctacacccagaactaatttgaaatttcctatttcagatgatagaaattcttctgtcaaaaaggaacaaaaggtgtgtcttttaatttgtccaaaattgtagcaattatccagaaatccagttgtgttcaattataactcatttatcttctctttcctatacatctgattcagttgaaatgtaacctttagcatttggccagtagcatctactttatgtgtttacttctgactttaacactctgcctgtcaaactctttttgccattgtctgacccttttatccctgtccttatatacttaaagtttcctacctgagaattcataacctgtctctggcctctttaattcagctgtggccataactatttccttctaacacttctcatcaacaataacaaaaaatgttttgtttattaggttgccatacgtccatcatctaagaaaacatattctttacggagtcaggcatccataattggtgtaaacctggccactaagaaaaaagaaggaacactacagaaatttggagacttcttacaacattctccctcaattcttcaatcaaaaggtttgcagaaaattaattaaatgacctttttttgttagatgttgggtatattttaatacctaattgatatataaactcaacagctgttcagggaatattatacttcaaataggcattgtcctatactaggtactgtgggaagaaacatgtaaaaggatgatagatctaggtgttcgctatgtagtagaagagaaaggcttgtatttaagtaactgatccagagcaggctacttaatatagtaataggggtataagcaaaggtatgatagtattggagggaaaagagctactctgattagggggctttgggaaggtttttatgggagagatgggatttatcctgtgtattgaaatgtgggcaggagtacactctctagggtgtccaagggtgagaatacagtcatgggttcttagtttctgtttttggttggggcaggaaatccccttcctcatccctgttttctgcttatcactagagacagaaactaaaaaccatggcttcaggccgctaaaagcctaaaacaaaacaaaacaaaacaaaacagaacaaaaacaacaacaaaataaggtgggttggacaagtttgccagtattagtattatggtatatatcctcctagtgtttttttttctgtgcatatgtaaacattatctgtttatgtacaatatgtcaaaaacacattattttcataaatacctattgagtttagctgcagaaacagtatgcttagtgctttttttcttgataatataatgtggacatattgatacctgtgtatatgttaagatatatacacatgtgtgcacatatgcggaaggaatggttttaacacaggtggagtatcagaaaaatgtaggaaatgttcatgcaattacaggcagcaatacacatctggcatgtagaatgtggaaggactatcttaggggtgagatggagtagtgggtttttgtgaggttacctgaatgacagcaataggatgaattagagaccagagtgaggggtatagggaaggaaaggaactagaagcagggggcagttaaattgaatcaaatatgttgtgtgaaaatactttttgtcgaaggcttaccacagacgtttccaaactttgttggttcacagtgcccttaatgtctcagtaattaatttccattttgcctctgcacccaaagaaccactagtagtctcatgcattagaacttaagaccaaacaaccactgaaaattcagcttctgaaaatccagattgcaaagataatgtcataatgaaaagaaatgtaattcagtatcgttttgaaattgaactaccttgggctattgagcatcactattttccctgaagattgaaaatatcctgaggtgcttctgtaagtttgctgcagcatgccttagtacacagtttgggaacttctgacctatcagacccatttgtatatttacatacatttaaaaaaatatgtacatttaaaaaatgtgtttgtataaacagaaaatatctggagggacaaacagcaaactgttaaatatctaaatttggagaggagggacatctttctttagagtcctttaggcttactaccacttttatattaaaaagaaatatattttcaaggagaggtaggtacctataataagtatgtaatcagataagggtaatgattctcttacttcattgacttggttccttaacagcttccctaccaatgcacttgacatacattttttttttccttttttctttttgtttttacttatttctagaaatataagatatccctattttgaactgtaactgtaatacatatttgttgttttgggtcacttggaaatatagagagaaaagaaaaaatggagattaatttttaaaattctgctgctctgataaccactgttaatccatcacttagtatcactggtctcccagcttgcccctcttgtcatctcccatccattcatacatgacagaatgttcttttcaaagtgcagattgaattatgttactcctctgatcctttaatgatttctcattcttctgaatgacctgatttctgactctctccaatctatctcttattattctacggtttgataactagccagcttcaatcctgctaacttctgacagttcctagaatttgccagcttctttcttaccttcatatcattgatttcttttgctttttcctgtgctttcttttatctggaacacaccctggcttttgtcttagctggccccttacccttgagccctcatagctgatggaacgttattagggagacaccttccttcatcaccctgtcactacccctcatccccagcatcacttaatctttattattcaatcctattttttgtcttagcactttttaaactgtaattctttgctttcttattatcttttacactagaatataatctgcacggacaaaatgtctgtctagttcatactgtcagctcttagtatagtggctagcacatagtagtgatgagtttggctctaggccaacatatgtatgatttttaaacatttctattttttttaggctgtaccataggcaattacaaagacttacctgacaagcttcccttcctacaccagacttgatgcatagccaatgcattataatctcttaagggagttatagtcaaggatccagcatcccccaagctagtcatgctcttactcatatttgcatatttagcctgagtgcctccattcagagcctctttattgaggcctttggtggaggccttcttatggaggggaacaggagggggaaccttgaagacgcttttctccactgtaactcggtacttttccacgtatagctccctccaacctccagccctgaggtctataaaactgcgagagccttttgtttggggctgcctgggtggtaaaatgaccaccacttctatgctgatctgtattattctgtggtggactatagaagagggtgggtaggagctggtgctttctcaggtttagtctctcgcatatactgttgaaataagtggttaaaaagctgggttgttactttcattttggcttgttgtcttaactggcttctccgatacctggactctcagctctctcaagcccagctcagcccttaacaagtagtcttctcaatttagtctaatgccttaaatgttttttctatttaaaaaaaaaatttgatatcacatgtgtgtgaatttctatccaggaattttcccacatggaaatatgttttctattaaaaaaaagtactatgtactatgtacatagtaaggaatttaaaaattcctattctacttccctaaaagcaatcagctgttaacagtttggtttctctccatttgtgtgtggacttgaagtaaagggtttacaaagtattttcatgcagcattcattgtgcataactttatgcatgagcattgaactagatcatctaccaccttatttttaatgctgcatgatccactatgtatatatcctgctcttttgcttaacatagcataaacattttccaagtcattaaagatgcctgagattttttactacattgaacattaatcaaatgatactttatttgctttttttttgctgtcaatcattatttcatgttctcttgacatttactttttttctttgtgatttgtctattcatgccctttcaccatatatatattgcagtgtttttagtttgtgtatgttcattctttattaaggatttcaaaccatctttattaaggatttcaaatcacctttgcaattagaaaattatttcaggaactaattaacaattttattttatagcaaagaagataattgaaacaatgagctcttcaaagctctcaaatgtagaagcaagtaaagaaaatgtgtctcaaccaaaacgagccaaacggaaattatacacaagtgaaatttcatctcctattgatatatcaggccaagtggtaagctagtatttctgttttcatcaatgtagaactgttcgtgttctttttaattttttacagtggtttgaatttcaattctttagatctctgaaaacacatgctataaaggtcatgcttttagtctcacatgtgttaagtttatactaattaaatataaatactgtattaaatgtatataagcgtcatgcatttgcatttgaaaatgcatcagaggaatttatttccaataatagaattgtcaccatttagtaacttatttgcctccacaatctttttttctttttctttctcttttttaaatcacgggagttgtacaaatctgggcccaagtgttcctggtaaaaatataaaactgacattcagccatttcctcccacctttcccctaagcctttgaggatctattaggaagagactgtagttatcaccctgagtctatgattcattctcctgattcagaacagtatgtgctgtcacagggaaagctcaaattttctgtcatgcttgcatttgcttagtggatgaaagtgaaggtaaaaaaataattaaaagaaattaaaaaaattaaaaagaagtggccaagaaaaatcaggagaaaccttttttgccacaagagctttcagatatgagattgacacttgaatgcaagatgtaaagagttagggtaaattagggcatggtgttgtaagtaccattctgtcagtcatttttgagcatctgtttgattagtacctgatttcttcccttggctgaaaattgttttcttagttactatataatgtgctttctactttctaagttatacatttgttgccacgaaagatcatttcttaaaaattatttgaggcacttgtctccaaatattttagtaattattttaagttatatctgccttgaattcaatatggagtctaggttattttacttctagaatttgatagtgttgaatcttttacaaagtctgttttttaaataaatttttatagaagatggcatatctgtagtctaagtaaaaaaaattctccaatgtatcatttcagttactaagcacatgaacatgtcttactcattataaacaagcttttatttttattttcacttacaagctttgaaaaactatgaaatttttaatttcagattttaatggaccagaaaatgaaggagagtgatcaccagattatcaaacgacgacttcgaacaaaaacagccaaataaatcacttatggaaatgtttaatataaattttatagtcatagtcattggaacttgcatcctgtattgtaaatataaatgtatatattatgcattaaatcactctgcatatagattgctgttttatacatagtataattttaattcaataaatgagtcaaaatttgtatatttttataaggcttttttataatagcttctttcaaactgtatttccctattatctcagacattggatcagtgaagatcctaggaaagaggctgttattctcatttattttgctatacaggatgtaataggtcaggtatttggtttacttatatttaacaatgtcttatgaattttttttactttatctgttatacaactgattttacatatctgtttggattatagctaggatttggagaataagtgtgtacagatcacaaaacatgtatatacattatttagaaaagatctcaagtctttaattagaatgtctcacttattttgtaaacattttgtgggtacatagtacatgtatatatttacggggtatgtgagatgttttgacacaggcatgcaatgtgaaatacgtgtatcatggagaatgaggtatccatcccctcaagcatttttcctttgaattacagataatccaattacattctttagatcatttaaaaatatacaagtaagttattattgattatagtcactctattgtgctatcagatagtagatcattctttttatcttatttgtttttgtacccattaaccatccccacctccccctgcaaccgtcagtacccttaccagccactggtaaccattcttctactctgtatgcccatgaggtcaattgattttatttttagatcccataaataaatgagaacatgcagtctttgtctttctgtgcctggcttattaacatagtaatatccagttccatccatgttgttgcaaatgacaggatttcattctttttttacagctgaatgtttatgtcccacatttttttatctagtcatctgttgatggacacttaacttgcttccaaatcttagctatggtaaacagtgctgtaacaaacataggtgtgcagatatctcttctatttcctttcttttgggtacatacccagcagtgggattgctggaccatatggtagttttttgaggaagctccaaactgtttttcatagtgtttgtactaatttacattcctaccaacagtgtacaagtgttcccttttctctatatcctcatcagcatttgttattgcctatcttttggatataagccattttaactggggtgagatgatatctcattgtagttttgatttgtgttcctctgatgatctgtgatgttgatcaccttttcacatgcctatttgccatttttatgtcttcttttgagaaatgtctatttaaatcttttgcccatgttttttttttagtcagtttattagatgttttcctatagagctgtttgaacgctttacatattctggttattaatcccttgttagaaggatagtttgcaaatgttttctctcattctgtgagttgtttcttcactttgttgtttgtgttctttgctgtgcaaaagctttaaacttgaggtgatcccatttgtccatttttgctttggttgcctgtgcttgtggggtattgctctagtagaagtctttgcctaggccaatgttctggagattttcctcaatgatttcttatagtagtttcatagcctgaggtcttagatctacatcttaatccattttgatttgtttttttgtatatgtgaagagataggggtctagtttcattcttttacgtggggatattcagttttctcagcaccatttattaaagagactgtcttttccccattgttagtttttggcacctttgtgaaaaatgagttcactgtagttgtgtggatttgtttctgggttattctgtcccattggtctatgtgtctgcttttatgtcagtaccaggctgttttggttactatagctctatggtataatctgaagtcaggtaatgtgattcctccaagtttgtccttttagcttaggatagttttggctgttctgggtctttagtgggtccatataaattgtaggattattttttctatttctgtgaagaatgtaattggtattttgatagggattgccttgtaactgtagattgctttgggcagtatggacattttaacaatactgatttgtccaatccatgaacatggaatatttgttcatgttttggggtcctcttcaatttccttcatcagtgttttatagttttcattatagatatctttcacttctttggttaatttctaggtatttaattttatgtgtggctgttgtaaatgagattactttttaaatttctttttcaaattgtttgctgttggcatatagaaatgctactgatttttgtacattgattttgtatcctgcaactttactaaatttatcagttctaataattttcttgtggtctctaggtttttccgaatataagattatatcatcagcaaacaaggataatttgacttcttccttttcaaggatgccctttgtatctttttcttcttggattgttctagctaggacttccagtactatgttgaatagcagtggtgaaagtgggcatccttttgttccaaatcttagaggaaaggctttcagtttttccccattcagtatgatactagctgttggtctgtcatatatggcttttattatgttgaagtatgttccatctatatctagctttttgagggcttttatcatgaagggatgttgaattttttttgagggcttttatcatgaagggatgttgaaatgccctttcaacatgaattgaaatgatcatatggttttt

SEQ ID NO: 13752 - DNA, 10297 bp, Human
attaaaaatgaacatgagttctaacatctacgttccttgctatggtttccatggaaatagacatctgctctagggagaaagaaaatgtggggggaagcagtgtaagtgctttcaaattatcagtgttttgaaagatttatttcttttttctgtcacaacattaatagtcaggaatgtgagacttttgtgtggcaatttattgtacttaaaaaaatgcattaaatgagtgggaccttcctctgtgaacctccagatcaaatacaaagacttcaagataaaaagcctgttcagtgggtaaggacctcttgggcttgggttccttgctcatttgtgttgcctgcctatctgtcgctttcctgaggggtctcatgcccatccttctccaacttttctaatgatgtctgagattctgttcagaaaaatgacagacggaagcacctagccattttgaagctaagtttggtctgagaagaagcctttcaaggctcagtatctgaattattcctggtcctgctcacaggctaagtgaaaaccacttcgattggcttgggggggaggccgaccccacacaagggcgattgttggaaaaaatgccgcaacaagcatatttcaggcaacagcgcattgctaattgtttgctttgtgtagtgtgctgctgcttgtatgatccagtttttattgtcttgggcaccccttagttgtattttatctctggcacatccctggtgactaactaggcatgagagtctttctaaattaggactgttgtttcaggaaggttggtcacatttgtttcttgatttggggagatgcagctcattaataaaataaagatatctcttctgcttagtcaagatctcaaagcaggtgtcttggtgtattgaccaccaaccgaggacacggtcttggtcagagaatgggaggaggcggggaccatgttcatttcatttatttttttcccctttttgtgagagaaagggccagttattctaaggcacggtcagaccaatttcctttgtgcctttgctgaggttctgagctatccaggtcagggagaacagtgaccttgtggctcctttttcgatttttaaaaagaacccagtgctgctctggggagcacgtgctctgagaacaaaagcaacacttaactgcaatctgtgtagtctagaacggctattgctcttcctcccctatcatccgcagaaggcttggaagaacagatggagtctgcatttaagctgagtggctttgttagaccaaaggcgatcaaattccagagccccacgctttcccgcacaggtccctggtcaccggctcgggaacctgaggatgctggcaagaacgcacacagtgagggaagggccacgcccgcgacctgtgggctgagtggattagaaattacgatgatgtcacaatatgggtgacacgccggtgtcggtgtagggtgccgggggcagggggccctgcaggggcgtggagtggcattgtgctgtcacaggggctcgggcgtcttaggcacccatgtgggtggcgcactagaaggggcactgctctgtccgagtgctgcccttggggcgaggcgggcatgtggctctacaaggtggagtccaggcggccaaagtttggaaaggtagggaaggacccccccgccctccgcctgctccgccctgcccttgttctcgagaatggggagctggttcggacctagtccggggtccactgccacgccctcttccacggcgagaccacccccctagtcccaggcccacacctggggatgctccccaggcgccctgcaacccccggcattgtcctcctgccctccgggacaggactacacttcccgaggtgcttcggggtcccggggggcggcgctccacgcgggttgtggggggcgggggcggcacgtgccgccgctctcggccaatgcggagccccgcgcggaggtcacgtgcctctgtttggcgcttttgtgcgcgcccgggtctgttggtgctcagagtgtggtcaggcggctcggactgagcaggtgggtgcggggctcggaggaggcggcggctggctgaggccagcaagagggacgcggtcggcgggaggggctgggccgtggcagcgaccccctgctgcagggcggcgggcggggctgcgggcctcggaggggttggtgggcgggggtcgctccgctttgtgtgtggctcgggcggagcctcgcctttgtccccgctctccgggggcgcggctgttcgtgggcagggggctgggcgatcaccgggcgtccgctccggggtgccgtcgaggagacaatagggggcgtgggccctcgtttacctccctccctccctcccttccctgcgggccccgccgggttccccattgtctgaagggacggggcggtgccccagggaccagcggctttaggaccaaactgcgggcagccagggccgcgaccctccctgcgaccgtcccctggcgaccgcagctggtgattgaggggcggcgctcccgggccccacgagggttcttctgtcttcgcggccggacgcgcggacagcgtgggtggcggcaggttgggcatggggacggcgggaggcggtggcgagctcaccgcgggaccacccgggggcctgttcccggggcctgccccacccgctgaactgtgaagggggtggtggcggcggcctggaggtgtttttggcgggagttggggggggcgtccgcgcagggggagtcaggcaggggcggagttacccggattggaccgttagccccgcccacccctccccttcccacgcgcgcgggctccggggtgttgagttcggggagattcgaaaaggcgcggggaggaagggggcggggccaggggccggagcgcaaggcgtgctctgattggccgggggcgaccggtcctcttttcctcgcccggaccagggccacgcccatcctgggtccggtgctgcgtctaattctctgcttttcttaaatcttgtcgctgcctctgattttaattcctagcttttgggaacctgtcatcctacgtttttggtactagctggcgtctacaaaagtcataatgttaaaaagatcaacaagagatacagcatttttcatgacataacggcagcaaatataagtcaaaatctagaggttcataaacattttgcttgctgttgggcaaggaagcttaaacctgagggacaataggagttcaacattattggttactattagcttgggcgttttcttatccaccacgtcagacacagacaaagcaggggtgggtatttcatttgcacaatgagttgtaggcagtattaagatggctccgggggcactgttgagttgaatctggaatatcttcttacagtttcggtgaaatgttaaagagtttatgggggaaaaattcttcacccttgtgactttgtctgattttaaaaatccaagagttttatgaccgagaaagctcagttaacttgattttctggaaccaatatcatattcaggtcatatttcccaatgtttatttagtagattttgataatttttttcgtggttaatttagacgtctttattccacgtatttttctgacgatgtatgtagatgtgatgtgagatttttttgggttgatgacatatagaaaggcaaagaaagtgattgcatgtttttgaaaatcattttcaggactttccttatcccagttgattgtgcagaatacactgcctgtcgcttgtcttctattcaccatggcttcttctggtaggtaatctatttggaaaatctgaaattgtaatgggcttatgattttagattgagatggctcaggtcttcgcctttgatttggcacttatgttttggtcttaccaaaacctattttatgaataggagaagaatttaaaaatgattatcacttgaatgtgccgagagctcgtaattgtttattggacagtttggcttagtctgaagcaaaattgtggagtttgcacaagtcttttgtttatgaaagcgattgtcagatactgatgtctcaaaacagtatttattaatccaaaaatgttgagctttgtttttctgggagatggtttttattttttttgagacagggtctcaccttgttgcccaggctggagtgcagtggcttaattatagctcattgcagccttgacttctggagctcaagtgggctcaagcgattctcccacctcagcctccatagcatctgggactatcgacatgggccaccacacccacctaatcaaaaaaaattttttttgtagagatgggctttccctttgttgcccaggctggtctcaaacttcagggctcaagggatcttcccatgttggcctcccacggtgctgggattataggcatgagccatggtacctggccttgggaaatggtatttagataataatatcttgcctgcaaatacatcttcccctagtgtcagtagactgataggaataaaaaggggaaaaaaaacacaactttcctcatcagccctagtttaatacattaaattgatttgggttttagaaaattatagtacagtttattagaacaggagaatcctggttttctgaattataaatataatcaattctagatatccaggtgaaagaactggagaagcgtgcctcaggccaggcttttgagctgattctcagccctcggtcaaaagaatctgttccagaattccccctttcccctccaaagaagaaggatctttccctggaggaaattcagaagaaattagaagctgcagaagaaagacgcaaggtaaacgaagcaattcacagaaagcaggatattaatttatgtaatgggcagatcaattttatttctataacaggaagaaaacagaattgtagctacactgtgattattacatatgccagtgactggaaggaaataccagtcctcatttattgaactcctgttacatgcccgctcctttgtttatatttttctcctttaatacatggtgttgcctcaaataatggaaattagaaacagtttcaggaatgttaagtcgtttttctgcagtcatacaactagtaagtgttggggtcagaattcaagccctggtctatcttaaaccaaagctcatgcttctctcatgcttcctctttgaaaagatttgttgccagatgattctttggcactttggttttgttttttgagagctgtacaataacattttaaattgctagtgtgattgtgttgctcagctggtatcatggtagcttttctcttatctaaacaattctattataaagtaactatctttaaaagctaatcagaagaatcaataaatattaatatgctagttgtagaaaatttgggaaatacagaaatttataaatggaaattaaaagtattcattatcccgcttccgagaagcaaccagtgttaacattttggtgtgtttctttccattcaatgttactcattaacaactgtacataacttttcatttaactccctttctcaacaaccctgataggattgattttaaagctggggcaagtgaggcacaaaaggtaaggtaataaccttccccagaccagcatagtgatttgtagtatacacacacacccgcccgaagagcctcagtgcttacactaaggagtcgtcttctatgcaatagtgtgagttcatggagtaggaggaagcaatacaaccaaaggttggacagtggaaagctttttagacatcaaccctggccctgtagtcattagcctgtgctttacatagtaactggctaaatataatgaaactcccatcatgactaggatttggcagaagagaatcaatagaaccagtgtcagatgctctgtggttatcctgcaagtcagtggttccaatgtgttttgagaacaagctgttctgttgaaggggtcataccaaggtatggtctggtaattaatgcagtttcctgagacaaaagctaataagccttttccttgaaacaaatttttctgtcttaaatagtaatctacagacttagtcttgaatttcctatcattgttttatcagttatggttaaaatttttacaatgagctagttttctttgggtagcttttgaagttaaatagtgaaattctttacaataaaagtgccactcgcaagtacatattcctcaagtcatccagataccattaagcagtaaatcttacaaggatttccttaaggactaattgggtaagatttctgaacagataagcacttttccaaagttaaatacaaatactagaaaaagaatatcattttcacagtattttatgatagggataattcaggtcctaattttggtgttatttaaagggaccttattttctgccccttttcaatccccttagtaaattatttttattgtaattttaacttatgctgaatacattttattttttgaggcagagtctctgtcacccagggtggagtgcagtggcacgatctcagttcactgcaacctccacctcccgggttcaagcaattctcctgcctcagcctcccaagtaacttagactacaggcacccgccaccacgcccggctaatttttgtatttttagtataggtaggatttcaccatgttggccaggctggtcttgaactcctgacctcaaatgatccacccaccttggcctcccaaagtgctgggattacaggcgtgagccaccacacccagcctgaatacattttagagtgcctagcctattaaacttttttttccagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggttggtttcttactttgtaaaagggttgagcttggagtttgatgcaccaatgagttggcttgaactaagtgctttgataaaaggtgtttggtgtctttttgtcatccattttggggcttaacatattaaatgaaaggtatattttaagatggaatattcagtaattcccagcataattgcacagtccttggaagtccagtaggcagcttgttaggttctacaagggacccaggagatttgatgatgatgtctcagaacttaaattgtgtggttcccacaggctgtaatatatgcactgaggttgtgttgggcctctttgaggtgggggctgggggtcgtgacttgacaggcttttttttttttttttttttttgactgatgacaccttacccttcctttacaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgtagcaactcctgtgaaatgactaaagggaaccttaattatttctaaagtagcatttgactcgggtggttaaggttggcagatacgtcatcttgtatccagaggctgtaatagtccccattgtcagtgctttgcctctcaattcagggaacgcctttggcagctttcctgtgctatttgagaaatagcctaattatacatattttgtgcctctcagacatctgtataaaagctcttggaagccaagcacttatagcaaaagatgattgctaatactgcggtggggtccatgtgttgctaacgcatgtgcctctgctgcttgggctgtatcttgagattggggttttaccaaacttattcatgagaacaataacagcctacctcaacttacctcctaagattgttaggattaaatgggtttgtggcaagagagcacacttagaacatagatatttagcattccgtataaatcacgattactgttttcaaccagaggctaatgagtgatctaagtttatactcttgagttggaaattatgcagtttttatattccttaaattgacttttaaatttacttaaatgatcaatcagaggaattctgaacaaagcttggtttaaggagttacgcccatgtagggcaaataggagcaagtgcaagtatagttgaatacaacaataggttctgagcaatatctaaaccaagaggacaggatgaggcttgtgtgcagtggtgcagcacagttcatcttggctcctgtctctggcacatagcaggtgctctgggatctttaaaataccagttctgaatagatggggaatataaagagggcctgagggtagaaacttggcataatgatacgaggtgtcctacaagtggcagtgagcttttgttcatctaagacatttagggagggaaactggcctcaggagaaagcaagggaaggatcaacaggcctgaaaggatgcctcatcagttaccacccatcccatggtggccctgacttcctatcagagggcgatcctgagcccctgccttgtgacaggcttaagtcacaggaaactgaaggggatgcatcttaccacagaaatagaagctctggcttttctatttcaccttgacctttggagaagcacttagtcctgggcccccattttctcctggataaaatgagatggttgggggagatcagttaagtaactttcactcccccattctttgcatctggcttggagtgaagaggaggagcggtggcacctacgagcttctggggaagtgtctctgggtatgcattcccgggcccggcattctctgccatcacgggagtctgcgtctgtcccagtggggccagcctctcccagcagtacttccaatagattggcctaataaggccagagtggtttgacaagcagttggggctgtcaccaaggagcagactccattccttttgtcttgaatggaaaatgaggcttgtcccttcctgaggattttgtacttgggccttatggttgactgggctcagtggagagaggtttgaaggacgtgaaggaggcccttaaattaacatttgacaagcacctagattgtgctccacactggcctttgcgctagggatggagaaaagatggggtgggaccagcatatcacgtgcccatgtgaggggaaggagagctgtagaatgcttacttacctgagggtgaggctctcgaccacatacttgtactcaccagggtgctttagtgctttggtgaaaggagtgaccacagagggctttgtggtctgggaagctttgagaggagaaaggacatgagcttgtccttttggaagtcagatgaaccttccaagccaaaccccaataaagcacttaattgttaaacacttagtaagcctgtgattgccacgtgcacagagaacctgccatagttaatggcctttggcaggccctccaggcaggccccctccccatttttttattctaagcagtggaggctctttgaaggcttt

SEQ ID NO: 13753 - DNA, 130724 bp, Human
  misc_feature (1)...(130724): n = A,T,C or G
ccgttgtgggtaacccgacctttctctctggctgcccttaacattttttccttcttttcaactttggtgaatctgacaattatgtgtcttggagttgctcttctcgaggagtatctttgtggcattctctgtatttcctgaatctgaatgctggcctgccttgctagattggggaagttctcctggataatatcctgcagagtgttttccaacttggttccattctccccgtcacgttcaagtacaccaatcagacgtagatttggtcttttcacatagtcccatatttcttggaggctttgttcacttctttttattcttttttctctaaacttcccttctcgcttaatttcattcatttcatcttccatcactgataccctttcttccagttgattgcatcagctcctgaggcttctgcattcttcacgtagttctcaagccttggctttcagctccatcagctcctttaagcacttctctgtattggttattctagttatacatttgtctaaatttttttcaaagttttcaacttctttgcctttggtttgaatttcctcctgtagctcggagtagtttcattgtctgaagccttcttctctcaactcgtcaaagtcattctctgtccagctttgttccgttgctggtgaggagctgtgttcctttggaggaggagaggcgctctgctttttagagtttccagtttttctgctctgttttttccccatctttgtggttttatctacttttggtctttgatgatggtgatgtgcacatgggtttttggtgtggatgtcctttctgtttgttagttttccttctaacagacaggaccctcagctgcaggtctgttggagttttctagaggtctactccagaccctgttttcttgggtaatagcagcggtggctgcagaacaccagatgtttgtgaactgcgaatgctgctgtctgatcgttcctcttgaagttttgtctcagaggagtacccggctgtgtgaggtgtcagtctgccccttctgggggggtgcctcccagttagcctgctcaggggtcaggggtcagggacccacttgaggaggcagtctacccgttctcagatctccagctgcatgctgggagaaccactgctctcttcaaagctctcagacagggacatttaagtctgcagaggttactgctgtctttttgtttgtctgtgccctgcccccagaggtggagcctacagaggcaggcaggcctccttgagctgtggtgggctccacccagttggagcttcccggctgctttgtttacctaagtgagcctgggcaatggcgggcacccctcccccagcctcactgctgccttgcagtttgatctcagactgctgtgctagcaatcagcaagactccatgggcataggaccctccaagccaggtgagggatataatctcctggtgtgccattttttaagcccgtcggaaaagcgcagtattggggtgggagtgacccgattttccaggtgccgtctgtcacccctttctttgaataggaaagggaactccctgagcccttgcacttcccgagtgaggcaatgcctcaccctgcttcggctcgtgcacggtgcactgcacccactgtcctgcgcccactgtctggcactccctagtgagatgaacctggtacctcagatggaaatgcagaaatcacccatcttctgcatcactcacactgggagctgtagactggagctgttcctatttggccatcttggctccacccctataatacatctttttaactaataccatttaaaatttcacatgcaatgttcctataattttatttctatcaaaaatgcaataaagcattattagtgtaaacttagcagagtcacagaaactgtggtcagtcatgagtcaagaactgaatgtcgtgaacttattaatacttatttggatgtattctatacatctatacaaattaatactataatttggatttatttttgtccttattttctagacactgcaaatggatgtaaacaagctgaacataaccttgcttcggatcttccgccaaggagtggctgcagctttaggactcttaccccagcaagtgcacatcaatcgcctcattgtaagatacccacatttcgcatttccaaaattcaagccgtgtgtgtggtttttttaatcactaaagggctcatgctatagttgtatggctaatgagccaaatccggcacgtcatgtttttgcaaataaaattttatgaaacaagctatatctgctcatctacccattgcccatgatgccttttgtattacagtggcagagttcagtagttgcaaaagattggctcatgaagcctaaactgtttatcatctggccctttatagaggaagtttgttaactctgtcatagttcaagtctaggtcctgtggtaaatatgaaagagcccaaaacacttgccttaccaacctgacactactccgaaaatattctccattagagtgaaagcttctatatcaggtaaggcagtttccagacattattgatatactttcaagtatatcaggtgaggcagtttccagacattattgatatactttcaagtatatcagtagaacaatggacattgagtgcacaaggcagggcattttaaataaagaataaagaactgaccctgaggactgcagcccaggtggaatgcaggaattggtagtccaggaaaaccaagagaaaacttgaatgggcatctgagtgggtaaagtaaaaaaaaaaaaaaaaaaagtaaacccaaaggatctgttgtatagggcccagtctaggcctatatgtcaatcacccacatccattatttcctctctttcctcggtgtttgggaacctggatttcatgcaactacatgttcccatctgcactggaaagtgggcgtgagcaaaggccaaaaaaaaagtaaattcagatcagatgactgtctttctgtaaaaagctagtcacctcagttttatgtgaaaaggaactttgggatcactgtacaggttttaaattgctcttaatgtccactgcaatgggagtctaagcaaggactccatgttcccccagccttaaattgctgtgcttctgctgcatggagctcagctttctattgcacccatctgcattcactatggagggaatttgctttttgttttggtttggggtttatgtttctttttattttttctgtgtgtagagagtgagttgtttcatttcttcataaaaatttgtattctgtgaatcaacaatgttctagaagtaaacaagctgttaaaaagttttaactcataccacagaagaagaaatacaacattcccctgaatgagtgaaggttacccggtggctcacgcctgtaatcccagaactttgggaggccaggagggtggataactggaggtcaggagtttgagaccagcctggccaacatggtaaaaccccatctctactacttaaaatacaaaaaattggccgggcatggtggcaggcatctgtaatcccagctactcaggaggctgaggcaggagaatcacttgaacccaggaggtggaagttgcagtgagcagagatcactccatggcactccagcctggacaacaagagcgaaactccatctcaaaaaaaaagaaaaaaagtcttggatctagatctagattttttatatatatacaatatatacatataaaaatatatatgcatcaacctgtgcatatatattttgctaagatatatagagagatgatatagatatcttagatatacttttatacatattaggtttaatgagcataatagctgtttgcaagggtgaaggagggatttgccagactgaggaaggaatatgcttatcatatcctcagagaatgttagtagcatggttcaaagtagttattataatagctagagttacaatacctgacatagcaaagcatgttgattagcatcatgtgttttggagacagacaaaaccatacttcatttccagtgtggccatattccatgtatgtgaatgtgggcaagcctcttacgttttatttgtaaaatagagataaccataatacctatcgcttagcggtgttttgagcaataaatgagataaaagatttaaggtaaatagcatgttaggcacaacacaagtgctctgtacctacagtagttgttattgggtcacaaactatttaaattgttataaacatgtttcacatcagtatttagttattgtctgttgttctctgcaaacatgaaaaaacttttactggcttgctagtagtaaactgatacttcattttataccagctaaaattctgataaagcacattaaaagaaaactttctagcatgagagctctccatgtgtcagaaagaaagctaagaataatttccttctattagtgtgttgtgtaagttgtgaaagataatattatcaatcgccatggttttgtctgctctctgtgtgtgtgtgtgtgtgtatgtgtgtgtaggatatcagacatttatggtaagaaattctctgactccatttcagctaatgaggtaatactaataggaaaagtctcatgacatcactacataagatatgcatttccaccaaatgaccaattttaaatgtgtgacatatttgacgtgaagaacagtatcaggaaaaggacttcaaagatcatctggcaccatcttctttagctagccaagccttcacattaacacaagttataaaaataatagagagagtggtgatgtctaatatgtaattttgtaattttactattactttggactttaattcatttgattttaaaatgcttctttaaacataattactcagggaacatctgaacaatctacatcaaaaaattacaatatggaatggtaaatgaatcagcatgcaagcatgcactgaaatataaaattacaaatcttggggggtggcaactaatggcaagaaagctatttgaagattttagactttggactggtaacattaagtctatcagagaataactaataaatataatctccacaaagccttttaggattctagaattctgacttcctttaatgtttctaaaggacaggtaaaaatattatccaaagttgtttaaaatgtctataacaaatacaaatattctgcttttattagggaaagaagaacagtattgaactgtttgtgtctcccataaaccgaaaaacaggaatttctgatgctctgccctctgaggaagttcttcgttcacttaatatcaatgttttgcatcaaagtttatcccagtttggaattacagaagtctctcctgaggtatgttgttgcacgaaacaattcatttaaaaatgtgaacagttagcatgctatggtaattcaaccccaagaggctttgagatggaagttgtttattgtatgttatttgataataaaaatttccctgagtgtcagaattctctgatctttacattgtatatgtttacttcttaaggaaatgcactttcacattaaggttttcactttttggcatttttcttcttcaaacctttgtggccttataacttattttgacttatccagtaaattttctagaagaaagaagatttagatgtattttgtcaattgatcgcttgaaactgatatgtcaaataaacaaaaatacatttaaacctttctttctctacaggtgcacccctcccctcattgtcgtcattgtcaaaatggtcaccagatattcgccttttcccataactttgaaattaatttgaaatgtgatttttctttttctgaagaaactatagttttttaaagaacttaagtcttaagaactatagatgtttcttcatagtattttccaaatttgtcgcttttaaaaaatttcctctaccacctccaccatctcactcctgaatggatttaatttcctttccaattctattactccatcccgctctaacaaacctactgaaaggatcatcatcctaaatacgtgtaattcaattcatggaatcatgaaattaaactggagggaatatgtgtaacaccttgtagatacagaaagtatggcccatagaaattaagtgactccctcaaggtgacagaacaagagaggcgtaaagcaccacctaagatctaggtgtcttttttttctctcttatagaggcagggttttactatgttgcccaggctggtcttgaatgcctggcctcaagcaattctcccaccttggcctccaaaagtgctgggattacagatgtgagtgagccatcttccctgtccaaaatctagatgtcctgatccctggtctattcacctttacagtaaatcacactgcctctcattttagtatcacaggtgtggtataaaaagctctgggtgggcatggtggcttatgtttgtaatcctaactactggggaggctgaggcagcaggatcacttgcacccagatggagtttgtatcccaaagccacacgtaaaatgtgtgtgaccatgggcaggccatttaatctctgtgaggttgtctgcctttgcatggtatcaacctccctgagccttagtttcttcaaatccaaaatgggtatagcacttataaacttgaaatatggattgaatttttaaagtatatgcagaaattctcacacagcctaggtagcagacaaatgtaatttgaatgcaggatgacttggcacaatgagaatatatgtcatcattgaaccatcactgtcacaaccacccccaactggtcttcctgcatttggttttgcgcctctctctgttctgtttccaaacatacccaatgtgttttctttcctgccaccaaagtaatctttctcaacataaatttggccatgccctcctaatttcgtgattcttctctggctttcaaaatactacggaatgaagtctagatttcttaatatggtatatggtcctttgtatgctgggctttataattgttgaacaacactttcctagtttacatttcagcaattctaaactcgatagatctatgatacaccatattctctccttccttcatgcttttgtatgtgttgtttcatctacatacctttcgtttgtttttttttttttttttttttttttttaagacggagtcttgctctgtctcccaggctggagtgcagtggtgcatctcggctcactgcaagctctgcctcccgagttcatgccattctcctgcctcaaccttctgagtagctgggactacaggcgcctgccaccacgcccagctaattttttgtatttttagtagagatgggatttcaccatgcatacctttcatttcttaagatcagtctactgtgtagcaaagtatcccttgtacctccacagacgaagatgctccttaccctgtgttcccgtcaagcttaaaacaaaaactccttattccatattagtctttaggctcatctctacactgtgggttttttgagagcttgtgacatgtcatttgatctgtgtcttcattgccttcatttagtgcctggcatgcaatgggcacacaacaaaactgagtcaacaaatagtcatgctgggcgcgttggctcaagcctgtaatcccagcactttgggaggtcaagagaagaggattggttgaggccaggagtttgagaccaacctgagcaacatagcaagactctgactttacaaaaaaagttaaaaattagctgggcatggtggtgtgtaactgtggtcccagctacttgggaggctgaggcaggaggatcacctgagcccaggaatttacggttgtaatgagctatgatgaggccactgcactccagcctgggtggagtcccaaaacaaacagacaacaacaacaacaacaacaagagcaaatagccaagtactgtgctagctaatatctaaagccagaaaaataaataaacaagaaaacaaacaataaatgatgtttgttctcaatgaatttatgcactaatagggcaaatacgacacaaagagataataagaatatagttctatgaataaagttactacactgtgccatgggtgccttggagaagagaccccttatgctttagagaggccagaggagagggtcaggaggaggtgaaccaccaggcccctcccagccttgcccacgtctgaatctgaagcagttccgcttgtgcacaaagccaaaccccattcccacagtcaaggccctacacggactgactggtacacatcttgcctaggacaattctttaaattttagaaagaccgttggataaatgtatcctgcttcccataagcttttagagaatcatgtaaacggccttccctgttgctttattctcagtttaaaagccattctgaaggctttaagaatagagcaacttactgagtcactcagatttgcaaaccaaaagaagctccctatacaaaaagagctggctttaaagcaagtacctgggcatcctccaatataccccagtccagtgaaggtgaggtacttagcttaatggcctctcacagagctactagctcacaatagactacatttgaataaggaaagtgttttgatgataaatgtgatagattctcataaaattgttggaatctagaaatctagaatttagaaaatatgcattacagaagatgaggaagtatttgaatcagatataaggagcatatcatgaaggacggagggattatttgaaccttttgtttgagtactcctagaaggggccaggcattaccctttgacctttgaccagaatctctaaatgcagaaacagggaaaagctgtctgtagtgagcaggcaccccagtggggaggtgcttggtacagatacaacctaaagaagccctgcaaaaatattgattgatagttgcttaaaactggtaaatgctattctgtgagttttcttacaactttattcattttttctgtggttaatcttttataacaacttatacctcaacccattttttcacattttaatcttaaaattataacatgttatggcaacatattcattaacagaaaaaaaggatcactggtattttggcttttcatcctttgcatgaattatagaacatcgtgaatgatgtctcaaagcatctattcctaaacttacgttaattactttcatggaaggatatggttttttattgttttttcatatgcttgattttttaaattgaaaatgactcttcagaaacaaaaaaacccaactagaaaactgttcttgtttagtcatttgttttcatttgtaatctgtttcttaaaggaaaagacattatttcctttatatatttgtatatgatatctagaacattataggcactcatatagataaaactagacctcctcttgcctaataagtaaaatcccaggaaaataaaattaaatgtttttacaaaatgaattaaatacctattaaaacggtaagttctgtgttgacatttttaaaaatgattcaggaattttgttgttgttcaattgcaaattactccagtttccaaatcttatatttcaaaggagaaagtgaccttctttaaataaaagtccaatgtgctaactgataccttcatgaaatatttacaaagaaaaaaagccattacatacaaatgtaaacaataatgtgtgagtttaatgattattccttcaaactaggaacactagcaggtagtcttgtctaaattagtgtagacctagccatacagtgctgaggagacatacaatcaatattaacctgtattcgaccattcagaacaattgctcacattgtgcacagtacagtggaagcttggcatttatccaacaaagccatattgttataggatacatctcatttatctgccaagtcaatcaaattaaccagatactttgtaacatttgcacttcattcttattctgtgtacttcctctctcttaaagaggtgtatctcctagatcctctgtatctctgaatcgtctctcctagcatttgggatctccttctgcatctgagatcagaattgattaaaatatttaaaaagaaaggacaaaagaaagaagaatgagctatagtgcatcaaattattaaacaggatatagagaagccattgttaactatacagaaaactgaccaaattttaaataatagaacaaaacccatcagcttctttcactgcaactaagttaaagggcaaagaaatgtagctatgaaataataaaacataaagatgatatagtggcattggcttgacccaacaacagagcctctgaattattcaactctcggccacctgacaaaatataaaaagcatggggttaaccctatgcaaaggttagattgaagattcttgtgaattatagtcttttgatttgtgagctcttaactacaaacttgtccatttattaccctgcccttatcaagttttttagatctctgtacaaatatagtagtgttcagcaggagtagcatgactcagaaagaaatctatttaccaagaaagtgcagtgactaagttctaggagtttaaaacgtgtctttctaactgggagtgggggatgggagggtgggagttaattctttcatcattactgcttcagttaaaaaagaaaacaaaacaggtttgtcttaagcagaaaggaacatgttgatattctaggagttgtagaactacagcaagaaaaaaaaatgaaccaaatcgggttaggaacacaaaatctctttccacccacctaaccacccctttttatccaaattttacatgggcttaagctcaactccttatacttaaatttgacaaatttatgctgcctacttgaaggcttaactagtttgcttttatagcaaacaatggatgctattttgttgcctgtaaaaaattcatttccatatttatacctgatttctgcaagagttttctattagtttccagctatgcttatagagacattggaatttaaaaaaacgatatggctgacgtcaaagaggtgaaagaaaatttgtcgcttgaacccaaagttgttttgcagcagggtacttggtttctaatcattttatcaatcaagtgttttcagattctccatcgatttatcatttatatatctttaaaatacatacctaaatcatttcttgtatctatgcatctatctatgtcttagaaagtaggccagatactattctactataattagtgagcacatcgctgttttacaagtaaagaaaatagaatcctgattacgttagcatttaataaaggctttctccaaataatttttgtaatcaaaattgaactcaaaaatcttttctgttcagccttgcttatcttcccaccaaaacacacttgcattccagaatgaaagttctcataaaatatttttcaaggtaaattttttgtctgatttataaatgttgggtatattttattttttaaaagccttaaaaataaattagcaatgatttcaaagttcagacacctacaagacgtgttttactccaggccttcttaatcactggaaacaataaccaaggacagacatgtactctcactaaagggaataaaaaggcacccttcaacaaaatgaaattttagatgagttaaagcatttgacttgatttagcctttatatgtttttcccaatcatggactatttggtttcaagttagtttcgttaactataaatctatactgtcactaaattatacaactgaattttaatctaagaatggattttagtcaatgtgcttctttaaaaaaattaataaaataaaattaatagagtcatgcacactttattcatgcttcttctctgctcttccacccccaaagtggaacaaaaatgatacaaataaagataaacctgtgtattctaccttttattgacaaataattctgaactttttaatgttccgtattactttagaaaaatatgtgatattctaacaatatgtattcttgagatgatattttagtcaggttttgacagcagagactctatttgaaaaaaaaaaaagatgtgattaaaagaaagaaggaaataatgctggcattgttgctgtatttattaatgcaccacaagcttttgtttgcacttgtttcacttttgtttaaaagtaaagaggtagtacagcacgtaatccagggtgctgatgttgtgggaggggacttaaaacagagtaaggaaatcagaaacaatttcctccacacagaaaagaacagaactctcttacctatgaaccaggtagtttccaagagagacgctgagggatgtttagaaagcctgggacctgcagatgccatgtcaggcacgcttgctcctgcataggagactaaataatctcgatatataaggatggcagtctgttgtcttagatcagtttgagaagcagctctggcagcggggggtgtaggtgtgttgcactacactgaatggaataaggctaaaaatatgtttagtgtctgataagaacgccagttttctcaagctctcatttaacgtcggactttctgttttgcttttaaagaaaaatgttttacaagggcagcatgaagcggacaaaatctggagcaaagaaggattttatgctgttgtcatttttctcagcatctttgttattatagtaacgtgtttgatggtaagtttgcttctttgtatattttatcctttgctcagcccactgcttgatattagtgggtacattgccattcaaatgaatgttaaaatgcttccgagcagaaggaagactatgatcctgctagattaggaatatttcatatctgacatcagagcgattgctaaaggagagcttatggaattaaggatgctgacctgaataataaggctgtaattgcaatgcagtttttagtaacttgatcaactctgagaatgaagctttagacagtgatttactgaggtcactgaagccctcaaagtcagtaaagtctcacgggcacactttgggtttactttatttctccttttatatcatctttatggaactcaggaaaaaatttaaaaagagatatgtctttgagacaagattactccctaaggaatggttgatttccttatttttaaaaggacttgaaagcattctatgaaaaggagatgattataccctcaaaggctaagttaggtagactactaattcatttttaaggtggataaatagtacaaaagtataaatgtatatgctggaatagctctgtaagtaataatgtgtagcctttaaaagcatgtttctaattttaaaaatagaacccaaaacaaacttaacccactaaattaagcagtactatttggcattgaatgaactaacggtatctttagggtagaataagatgtttctactcatttgaaaatttcaagatgtaatataataattagagtttacaaataggttttaatgtcctttttccctgtgagctatgttctttttaattttgtacatttaaataaatacttcttccttagtttttaagtgccccccaaaagtcattatgttacttatttctctccacaatcaacaatgttgctaagtgttttattggattttgtttatttctgcttcccctactgggaaggggttactgttagaaagattggggctccctctggaaagacaggctgcatgggctaaacttagaggatataaaacaagcacagtcttaaacagggtgaagataagcatgttttctagagtttaaaatatgtgaagtaacaagagtaccctaaatcttccaccataatgaattcagaggtagctcctatgggtcaagcattaagaaaaaaaaaatttctaagaattgtgactcaataaacaaaagaataatttagaattgagtaaaaactgatttttatatttcacatggcagagattaagaggaaagaattttaatgagagaaagtgggaggttttgggaaattatggcagcgtcttctgggcatctctgttttaaaggacatagttccttgttatggttaattgcattttaatatacgtgattcttcctttatatgggaaatctcaagtgctgttccctctcttgtcagtcacaattagggtgtttttctgctttgcagatgagaaaggataagagaagggggagaatagaaaggaattgaaagtgataaaagtggaaaatattcaggggatcaatggatgtgattcagaagagcaaaggcaaggatagaagaagggaagtgggaaagcagagtcatgcccagcctttgagtactaaagggcagcagaaacagagcagagcttgctattaacatatagaatgtgtttcagattctgcatttctaactcagggcgtgctcatgtactgaatgtaactagataaatgcctatgttggtcttgtggcaaaaggacctatagtagtcacaccctcaaccacttggggccagaggatgactcttcttttcccaatatttgcaaaacatcaatgtaaaggtcagaaacttagggaagtcgactctaacgttattagaacaaatcaagaaaggagcatttcagaagtataggtgattgctctctattgggttagcaggtggattcatctattcattcaatcaacagattcctgcagaatattctctgcgggtctatttgttgctggtgctgtgggcaaaggagaaaacaagacagataagatccctattttcttgaagtctttactctagagggagacatagaaaataattaagttaattttaaaaaatcaaatggtgaacatgctatgtgagtccaactatatgacattcaggaaaagtcaagcctatagaaaatatcagtggttgccagagatttcagagaaagggaacgattaggtaggggacagcagattttagggcagtgaaactattctattttctgtaatgatgaatacatgacattatgaatttgtcaaaacctgtacaaggtatgaagaatgagctctaatctacactatctacactatggactttaataataatacatcaatattggttcatcagttgcaacaaatgaatcacaccaatgcaagatgttaataacgggaaaatgaagagatagggaagaagggtatgtgagaacttggtattttctgctcagtttttctgtaaacctaaaactactctaaaaaatagtatattaatttaaaaaatcaaatgttgataagtgctatgaagaagaaaccataataatgagtgagtggagcagagcaacctgagatgtttgagacctatgggtgaatatgtgagtaaaggacccctaggcagagggtactgtgggtgcagttagaataagcttagcctgttcaggctctaggggaagaatgttttaggcagagccttgatatgatctgctgtgtgtgtttaaaaatcacattttcttctggtagaaagtggtggtggacagaggatggggagagttgtggaaggaggaggatctttctggaggcttctgcaatatcccagtgaagaagatgctggtggcatagaacaggggtgggtggtggggaaggagagaagtgaaggattgagatctatttgaaagtagaaccgacaaaacttgctgtgtcccaatcctcagcaacaggggtaaaattaaggatgactcctaggttatttggcttccctgactgtgtggaaatgttctcatttcctgggagagggacacgttcagaatgaggatgagcgtgttcagatggttcttaaagaaatgaaagaaataattagatggatttcaaacactgtcttaaattttaatttgaaggagtcacttttaaaagtaacagggggaccaagtgcagtggctcacgcctgtaatccctgcacttgggaggcagaggcaggggaattgcataagcccaggggtctaaaactagcctaagcaacacagtgagaccctgtctttacaaaaaaaaaaaaaagggtttaaaaaatcatccaggctgatggcacatgcctgtagtcccagctactgaggagactgacggggaggagcacttgagcccaggggtttgaggctacagtgagctatgatcatgccactttactccagcctgggcttcagattctctgcctctgaaaaatatataaataaaaacaaattctgaaaagtaacagaggaacccgcagcacacagacgggaagttcatattcacaagaaaagaagtactacctaataggattagcacaaagccaagtttatctgatggaacttaccacagaggagtcaagagttcatgtttagggacatgtcaaagcgattatctaaaataagctcatctttctaagtgttcaaattattttgataataagcttgatttaaagtaagtgtttcacgtgcatttctcagtgatacttgtactatcactttcgtgattctgaaacacatgtattccaactctgtttcccatagttttgttgattccatgacaaaggaaagatataactcagaattttccccctggcattgattatatttataacaaatcaagtgcctccatttgcattggcattcctacatgccgtagaaatgaaaagcatgggttttattataaaattatataggtaaattgctgtaatggaaggttgtatgtgctatgtaacaacaacataagacttggcagaatttttgaaaagtggcatattgtttactttccttaaaatacaaaaaaaaaatgttgccaggcataaaattagacaggcatgacattttcaaatatgctgacttatttagcacctcacaaatgtgaatgtgcagtgggtggagcgacaaatagaaaaatacagttttccaagaaaaaatgtgtgggcaacttccaatccattcagtctgttttagatgaaagaaacttactaagaagaattagttcttaaacttgaacaaataatagaaagaacaccatttatcatctaaattagacatccaaatgtccttacaggtttattaacaagtacaaagacatttatgaaatatagctagagatgtctacaggccagattgcttctggaaagcagttttagaaatcacatgaaaatagttgtttggatcaataaaaacactggcatgttagacccataggagagtcatccatatgggagggaaagagtttctctagttgtagtctggtagccgcagcaagaaatcctacattgaaccacctgctatagccttaacatcatgtaataaatacatgtcaaaggtggacataattttctcatttgttaaatataatccctcgggatgaagggaactaggaccagattcctaactggaatgattggttaggtaggcatatatctcaaattaattttcaattttttttctgtattaagaagaatacaattgtcttaatagtaataacattaaaaattagtttcttccatttattgcacacttattggtactaaactggtactaaatttactgtagtgctaaatgcctaacatgttttagtttcctaattttacttatgagaaaactaagattcagaaaaaataaatgacttgaccaagaacatgcaatgggtggatatgggggtggcagagtagaaagtggtaaaaattcaaacccaagtctatctaaattgaaagtcagcattctttaccataattccatttgttttcataaaggagtcaaactgtggttgttgttttttgttgttgttgttgttgtttttagtcttatcactctgtcttgtgaacatatatttctggccacaaataactccagtagtagcagatgcgaatggctgtatttatcagagccattctacccagatggaactggtaaatgtgtgccacattatacctctgtgctgtgggcacacctctatttttgcacttagtactttgtactgaacataatttttacacatttatcttttctggaagcctatgaattcccagaagacagagttctgtgttacttttgcatctacaatatcttgtttatggaatgtagtagggattgactcaggattattaaattaaaagagtgaatgaactctttcagaactaattgtaaaacactgtaaagaacaaatgttaaagactagtggttggtggcatcgttttgaaatctgaacacatttgacagaatgttttgtgttactcatgagatttttgaacgaaaattttaagctgcagaaaagcttcatcgaatttttttagcttcctcccatttctgtgttcctctggtttttttattcccactattattttctttctcttgctatagtttgagttttacagctcctctcattcaataatctgttctcttttccttttttaaattattacatgactttattccagtccaagagtcaaacaagctcttggagatgaaggcaaaatgttgacttgccattgctacggtaagcttttaggttgagtttttcaacaaagtgaattcccatagagaaatatgaatatgctatattccagatctcaatctgtgcagagaaaaatctctgacacacttttccagatgctttcggaaagaggtttcaaagaaggacatgagactttggaggaaacaatagagttgaatgatcacatacctggaagtcacaaaacttggattctaggttttctttccaaacctccataactcatccaatagctcaggacttaaatgtgaaatgaggagattacaccacaaaaattttatgatcccttacgtcagggttttacaaacaacactactgacatttcggagttactatttctgttggcgggggtgtgtggtgagcctttccaatgcattgtaaaggtagttagcctctgcctaccagatgccagtagcaccctttcccttctccttcccccacaccctgaaaatatgacaaccaaaaatacctccagacactgccaaacgtttcctgagggcaaaatccctgccagttgagaatcactgccttatagcttaatttcatgacaactaccctattgccaagtagcaatctcttccattttttccatattttttcagacagcccaatctcttgagtatttttaaacactatcttatatacatcatacattctccaggttctacttttccctaattaaagatgtagaaatcagtttgtacacgtaccacacagagacaggttgcaaagttgacctgtaaccagacatgaagtaaacagatgactgattggaaaatatgttacaaaggtttctcatcaaaaacataagctcatgaatggtaaggaaggactttggactagactttgttttacactaatataaatcataaaattgacctgtcaagaacaattgagaaggtcaagatttccttggctttcccattttcgttgttgattcatatttctccaaaatccaagtgtaaacaggcaagcaaatgttctcatatgcatattatatttagatgtgaagagcttaaaatatataatatatgccttatcttctaagtgtatttttgtaaaggtacagatatatttgtttcttcatttgggaaaataactttcttgcaactaaaacaatattttaaattctgttgcctcatcgtttagtaattaaatgtttagctgaacacaataagcctaaaatatatgtatcatctgattgatactgttctagtgcaggttttgtttttacaccgtgaaggtcatggaaactgaagagaagcagtgagttaaaaaccttagacactatgcacatgataaaggcattcatcttcagtcttttccatcctatagcttaaaaaaacacattacacttgcttgaaagtagttattataaaggtaagaagaccttttacttaatatcagacatcttttctttctcattcatgtgataaatatttatcatgtgaatattccaaatccacccttttttcaaaatttaagctttaactttaccctaccagagtcaatgaatatcaccagtataaaagtttccagattacaaggaggtggactgacataaaaaacaataaaatgtctttcttttcttaggagttcaatgtttaatatgcatttctagttctatctcgtaggtgcatagtcttttcccttaaggagagctcgaggttacagtgagctatgatcacagcactgcactttcgcttgggcaacagagccagatcctgtatcgaaataaaataaaataaatattaaaatttaagagggcaaagtggtaagaataaaaattctggttgtccaaattattctttcatagataccctaaatttaatttgtcaagtatttaccagatactcaagttgatatatgactaatgcagagatttaccaacataagaaactgtggtttatggcataactattattttattaatacttgcaagactacttttttctactaagccatgttggatgtatatctccatttctataaatgtcatagacgtgtgttttacggttattccttctgtaagcctaccatttccccatgtgaccaaactaacatctggcatttttcataaaattggttaaatttacttttgaatatatctttgtggaacagattcatgtgcacaattatttgatacatatgtgcagcataactggaaataccaagtgtactgtcttgagaaaaatctcaataccatgaaactgagaaatcatctctcagagggctttgtttactttatcgttaagcctttattttggtttgtcggccagggtggggtggaggagatcatactcttgtttagtgtgagaaaatgtgacaggagttttttatatctccttctatagattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcaaagctaccaccgctacctctgtttgcccttctcctttcaaaatgaagcccataggacttcaagagaggtaagagcttgttctgtataccctacgtgtggctttttataaaaagagtattcatcaactaaaaaagaaagaactagtaatgattgacataattgggtagaattgttcaccactaaatggacagtcagatgaagtagtgtttcttgtctcccaaaggaatccaactgtgttagataaaatctgttaggtatgtctgattctgctaagcttgtctagattcaagatggtatagatccaagcaaagttcatcttcaactacaagacaatttctagcttattgaggttcactgacctcacaagatgctatcttgtttaattgtcatgaaactctggtaggtagaagactgagaatgaactcagagtgtttcctgcaaaagcccacgttgtctggagttaggcaggagttgatgccacagattaattttttttaaagttttagctctgcattttttaaccacaacaaacattcagtatcaagatccatgacactggacgggcgcagtggctcacgcctataatccaagtactttgggaggctgaggtgggtggatcacttggggccaggagttcaagaccagcctggccaatagccaggtgaggtggcacatgcctgtaatcccagctacttgggaggctgggatgtgagaattgcttgaacctgggaggcagacgttgcagtgagccgagatagcatcactgcactccagccttggcaacagagtgaaactctatctaaagaaaaaaaaaatccatgacattatttttgttgccttaccttttttgtgatgtattatacatgtgattcactttataccaatacatttccattaaacgcaaatccaatgtaagaaaacttggatttgcaaaatacataaatgagagactaattctttgcctctcaaaaatattaagtaaagctttcccatggcgtttcttaaaataagaagctttaattttatatttaaaacatgacttgtagtgtatccaactttgaacaccagggtagtgggagagtaagttctcaaagtaatatcccaggttcattctcctcttattttccatgtctccattttctaaccccatatattttgttgcctgaggtttttaaatcacatatataaattttgaatatatttcccatgatacatcacaatgccctatgcaaatagttatggtttgcacacacaaacacacccttcagaaaatatagcttgggattttaagaactgcagaatacaaaattgatccttcataattatttgaaagtattgccaaggaacaatggatgacataaaaataaaggaatgtgtttatctctaaaagtccttaaacactgaaccctttgactccacaacaggaagaaaacagagattgatcaagtcattctttccacctcctcccctaaaatacctgtggtttcttgatgggcaatgtaggtctccatgtgacattcacttacgtagatatcactaaattgctttttgtgattcagtgtggaaaggtagagaaaatggaactttctccctaaggctaactgggagtcaggagaactggattccagacccagccctgccgttcctgggtttggtggcctcacctgagtcattcactcatctggacctcattttcttctaaaagataaagaggtttaacttgattttttagcttctttctggttcttttactctggtcatccacattatttttgtgcttttatgtttgcttcaaagaggaactttgaagcacagacctgggcatcagtgatgaacgaagggccggtggcaagaaagggtctgcaggcaataggaggccatgttatctatagtagataacaatgaagggtcataatgaaactgattaaaagacaaatttttattatcatcatgcactaccaattctaagcaaggtcagaataaaattgtctaggaaagtagccattcccagcatcctgccctctgtagaccactgctggacatgttggtctacagtttaaaggagtataaggttaaatattcacttattcatttcattaaagtgaatctttgagaagggcgaatacaaggacggaatcatacccatctctttggtccacgtgggggattctagcagagcaagtgtgtaatcagtgttaaatagatcctctgtccccttatctacaacttcactgcatcccacacttcacctcctactttgttccacctcagagcaggaaaagactattctctccacaagggctccaggtcattcacctcaaccctagtaacttcatcagttttcctcctctaccttcagctgtaccctcttttctaatgctgttccctcagcatacaaataggttctttcttgtattaaagaaactcccttaatccagtgcctcctctggtattgtttttccttcctttctcaaatacatgtcttaaaagaacagagtgtacttgctgcctcattgttcttctcccacctttcattctcattgcttctctcacatcctcgattatcaagttaattatcaatggtctcactaccaaatccaaagcacatgtttcatttcccatctagcactagtaactatctccttcttaaacttctctcctcctttggcctcatatatatcatttttctgtttcttgcatggctaccttcggtctcctccagattcccttctcttgttaacctcagagtttcattctgtgtcctcttctctccttcctgaatcacccaaccatggccacttcttatcttaccaccttttagtgattcctgaaaaagtacctttagctcaatctacctttctgttgaaatccagacccatatttcagctctgaactctgtgtcactactctgacctttcttaaacactaccaacttacaacattcagaaatggaactcaagaccttcctcatcaaatcctttctcttctttttaaattgtgagtctctgaaaccagtaatatcctcagcttctccgtgttgtttttcccctccccatatagccgaacattatgaagacctggcaccttctcccaactgtttcccccgtccaaccccaatcccactgagaactcaggatctccctaattctagccagtctcctcctggtccccacctcgaattctgtttttttccagtccactctctagacctcttaaactggttttctaaattatatttgagtgtttttctctttataaaattcctcagtgtttccacactgccttcaggaagaaactgataacttctacttatgaaatatgaagccctttctgatctggcctttggcagcctatgttgacccctatttcctgctaaacacccccttggactcatcctgctacttggacatttttccaggtaccatgccattctcttttaagcctaagaattaatacttgcctagaacctgtccttttccctactccttgcccttgaaaattaccaccaatatagtgggcatgaatctgggtctacaaatcaaaaaaacaagaaatgcaattttatttttctgtaactcaacctaagcttttttgctagatgtcatttcacctaaatggtagaaactcaatctcagcccttttctgattcatctaacctacttctggtttcctagggtttcctctacgttttaaggagactttctcaacatgaagagtaaggcccctatctgccttgatgtcatctgtgcacattgtcatctgctaaaatgtccattatctctttggttctcataagtattcccaggacagttaccaccatgttgttccctgttgctattcatgcagccccttcatttccagcagttgctttctccttttctctctctcttcctctttttcagttgtatccaaaccactgttagatgcccaagaatcatctcactattctaccccaaatggaggcataggaaaacctgggcatatctaaggcatgatcccccagaaacactttccagccatttctcatggctctaccaaggatcacagtcctcctattgagggtcccccacttcccagggctcagcggtgaaggatccaggggtctcacctgcacccacaaagcagccgttctaacacttcaccctcccctgagcccatgggcgttttcttaggctttgggaatagaaaaccctactctggcttatttcatattctaccttatctgacatccacaccccgagacgccaccttccaccaaagtcctggcctttagaacacaaagcccatgacaggactcaaatttccctgctttctgctctcagatttcttcaaatgcaataaaacaccaaaaaaccctggcagcccgaatacagcaaaggtccaaaggtgaaagagggagtaggaatacagggaggggcattcaagcatcacttcctcttggaagccaatttgaggctccctctgcctcctcctccttcctccagcccactactgattcagctacctctcttctgtatggaggctccccgctgctttagttccataacccagtgtgcatacagtatttatagcacttctttgttgtctttaagttctggtttactaatctgttgtagccaatagactctaagcttcttgaggacacatatatgattgaattgtctccttatctgttacatatagaacataatttctggaaaccaggagctcctggagataaatgcctgaatgagtgaattaaccaattaatgattcttttttatgactaacctcaggttaactcccagcagttactgggaaacactttgcttattccaccatcccttcctgttctattctcactcccatttttctaccacaattccctgccaagatggcataatgaagagttttaagagtgaccaaatttgaagaatgtacagtgttccatgcagaaaacttttctggcagttttaagccttaaaatttaatttatatatatatatgtgtgttctaatggtgcctttaaaataggctcatgtttaatagctctccatcttttgatcctggagtgaggtaataatcttctacttattgcataaaagtatggcttcattaaaatcaccaggagaccataaagactgcattataagtcacttgtcccaatcttttggatcatgtcatataaatttctcatccctgattgggagaatctatcactttgatatcattaatcataaaatataattttaaaattaaaagataagtcaaataagatctagagactaaatggattgcttaactgagtataaagaatacactctgaaattatgaagattaaagaatcttataaaaagaagaacatattagccaggcatggtggtgcatgcctgtagtcccagctactcaggaggctgaggtgggaggatcacttgagcctgggaagcagaggttgcagtgaactgagattgtgccactgcattccagcctgggtgacagagtgagaccctgtctcaaaaagaaaaaaaaaaagagaaacatagcaattcagtcttcttttctccctttttcaaactaatcgccaaatcatattgattcttgctcctccaactttctcattattgattatctctttctgtaatcatcaccttggacccagctctcattacttcatgattaaattgttgtgtcatataattgtacaaatgatattaggactaatatatgtaatatgtttcatatatattattttatttcatcttatctgtctgcatctaattctctttcccccttcaatagtcttcaggtttatcttgctataacaatctttcattatcatactttgctgtgcaaaaatccccatttggctccattttcttacagaataaggcatagaccatcttgttgggcctcagatgtcctataccatctggccctgatcatttgctccaaatccatttgcaactacatcctaaaataaaccttctattccatgctctctgtttccatccccatccccctctgagtgctgcgctcctgtccacatttgcatttctgtttgcctggtccttcctcttccctcagcctaccgatctctagtctccagagcccaacacaaaacttaccccctaccactggccatgtaacctatttgtgcccacagtgatgtataacacctataaattctcagatataccactcctctggcaatgattttaattgaacaatcattcagaaagggacttgaactggtttttaagtggtttgtcttgtgttttcagcagatgacaagaattttaagaacaggtactatggctcaagatactctgtgtctcctgtggttcctgtaaaccctggtacatagtaaacactcaaaaatattatggagttaattaatgttgcttcacatctgaagatctcgtctgtttctaaagaatcttccataagaaccaatagcttaatgataaactatagacctgagtctcagctaatactacctctgacacttattaaataagtggctcaacggattaattaagtcctctgtagtatagttttcccaatctataaaataatatctgctccaccttcaaaggatactacaaaattaacaatcaatacaaaatggcatggtgtctttgagaaggaaaaggaaatctaatattctttttgtttttgttctctgattccatttcacaagcctacactaggtcagttatacttttgaactcaggagttgaagctaattttctactgaattgctacagttgagcctgtcatataacattatatttttaactgtcaattaacatagttttgttcatcctatttgtaaatatacagttacatgtaatttataagtacatacttataaattggccagtaaatgttatctaataaataacagtatcaatttaatcaattctggtctaacaaatgcattcatttctcatggcgagtccaggtacaaattcaaacacttgctctgtaactaccacatatataagttggaacctgtttattcacctgtattgaggagcatagcatgtgccttgcacagctcttgggacagttaagctacatgacaaatgtcacatggctggcacagtgtgaggccacagttagttcatgttccctcttgtcttttgtcccatccttgccctcccaaaatgctccactgatcactctaagggaaattgtatacatgctgagttccaaattcccattaaatgaggaatcacattcaaactctagaaagtacattttctagaacttatgaatctgaaagattctgcacattttccctttgggctactgtatggctaatggccaattttatggaaaggaaatcaacaggcaaattggatatgttcacattatttcctcatttttctcacttgattttctattacaagtaaacactgtgcaaggagaggtagaaaactgtccaggaaggaagagtggcacactgtaatatagcactctccatcctgacttcatttctcagtaatcagttggtgggccatcaggactatgatattaatgggtgtttttttctatcaaaacggaggtctcagtaggcccccaagggttgctgatatccaacgaacaaacattcactaacttttcttcagctgtaccataatagggtatacatgttatgatttacaataaatactgtgaaaatgatataacacccaggattgtgagtctaaaggtttccttaggggttgctgagcttgggagatttttatcagaactagaaatttgtctgcaatggtggaagcaatgaaaagacagtacatgccatgaaaatgttgaccattctacattcaaactcaaaagattttgtgtattacaatttcctcctggcaaggcagaatgtcctgatgtatctgcctcgctttccctagtagaggtacatttcgatgcttaaagattttaacttggagaatctttaatcattcctccactgatctctttttgggacatatgagtaaagagaagggaatagaattaatatgactgcatatcagagcataaagtgtaaaaaataccctggaagttaaaatctgtattcatggctgcaaatggtggctcacgcctgtaatcccagcattttgggaggttaaggcaggagaatcacttgaagccaggagtttgagaccaacctgggcaacatagtgagaccccgtctctacaaaaattttttaacaaattagccaggcatggtggtgtttacctgtactcccagctacttaggaggctgaggcaggaggatatcctgaacctgggagctcaaggttgcagtgagctgtgtcacaccactgtactccagcctgggcaaaacagcgagactttgtctcgaaagatagatagatagatagatagatagatagatagatagatagatagatattcattaaatagacccataatcgaaaatggatccaactctctcattttctgtcaaataaaaatggggcccagaatctttctcttaggtctttggtgaggttctgtaaaagcacagcctgagacaagggctcttgtccaaatgatgtgttgagaagatgctctcaggggaagcttattaggaaagcagggcaagcagaacagagaagaggacaagcaaagaggtggtggtagcagccatctaccctcagcctgattgcacagggatctctgagcatgagtggcccctcatggacagttgtctcaccttgaggtgagggggctgagcctctgcaccctcatgccagccaaccactgactccaggccacccagggatggtggaggcataacttcctaggcacctctggctcagcaacacccatcagctgagggggctgctccagcgaagtggcagctgggcaccactaacaggctaccctcccagcagtggggcaggagaggatggggcaccagctggagaaaggcgacctgggtggggcaccaacagcattactgtacttgccaaaggtcgcagcagagctaagtttacactccaggttcctttgattttcccaggccattatacacgtaccacacggcctccttcaaataaacaccattcattctattggaacctatgacccagccccattgaacacagtctatcaaccatgactcagttgctcagcctgacaacatgagggcttataaacataaaatatagcaaacacgtagaagtaaattccagtttaactccaaataacatcaataaaaataacaactcagtatgccctgttgacccttcacatgcattatctcatttcaccaacccaagggactttttatcccctccttagagtggaaactcatgctcagagagtataagttatggccctaataacttaatagtaagtcagtaggattgtgagggtgacaaatagaatgcgaacccaagcagtattgctccagaggctgtactcctaattaataataaattggcatgctttgggggttgggaggaggcgtacacacctataatctgtgggaaatcaattttaaaataaactacaaatcagtatatttagcaagtaggtatattatggagcgtcacactgtttttcctcttagcaaattttatgcttggctttcagaatatttttcagattttaaatcaagcaaagtgcaatttcatgaggtggactcaaaacactcatgacagataaccatttcactgccattctagaagcacattgtctgtctcagttttttccttaatctgatttttgccattctggaggcctggtggtaatctgacataaatgaccaagaggaaggtgaacacgaatagagcaaagaagccaaagtgagggggctataaggcaataattcagaatactcaagtcagaaaaggatggagtggtctccatattgttcaaacatcctgcataataactcgcccacttcattgtgtgtgtgattgtcagtggaggtggcaggaacagcagagaagcacatggtcatgcctgcactaagctgctgcccgtgctgctgtaatagaaggatgcagagtcacagctgatgggttggacactaacctgccacctgccaaccactgtgcttatgtatgatctcagacaaccttcacaacatcctggaggcaggcagtatttctatgcccatcttgcagttatgctaacagagagacttagagagataagtaatatgctcaatgtcacaaagaaataaaaatctagccaaagatacaatcttgacaacctgcttacaaaatctgcacgtaactaccatgtcttacctttttctaggtgatacagatgacaaaattttaatcttctgatatggtttggctatgtccccacccaaatctcatcttgaaccgtagctcccataatccccacatgtcatgggagggacccagtgggaggtaactgaatcatgggggcaggtttttcccatgctgttctcatgatagtgaataagtctcacgagatctgatggttttataaagggcaggtcccttgcacacactctcttgcctgctgccatgtaagacatgcctttgctcctccttcaccttctgccatgattgtggggcctccccagccatgtggaactgtgagtccattaaacctctttttccttatagattaactcaatctcaggtatgtctttattagcagtgtgagaacggactaatcaccttctaacatttttataaaatattttcatattcttatacttgtatggggatgtccagagctgagggaggcactggaaacatgcacaagcccttcatgaacagtgagcatcaagctgttctctttatttgtcagattttatataggtaggttggaattctggagggttatgaacaaaattttcatagggttttttattctaaaaaaataaaagaccccacaggaatgaagaaaaaggaggcaaaagttttgaaacctgcctgaaaattaatggtacgtcatgagacaaaaatgtaatcttgttaagtgaaagaaatgacagtggatacaacccagggtgagtaaaacaggagccaacatatattatttaagaattaaaagtagaggagctttgcctaaaaaggtaaaaattggccactactcattggaaagcacaggcctggcataatttctctccaagcagaccctgaaatgtttaagccattgtagtctaatgagtcctgaaagtgtagacctggcagtggctctaagaggaatcacagtaattgctcctttcctttccttgccttccctttctctacttgtggtccctggcagagcagcaggaataagtcccactgagtcctctaactgctgtatctgcccccagaccacccctcatacaggctgcttcaccctgaggttcaagcagaaaggacttctcagcccttccaccctgacccccaacaatccttcaacatccattagcctgcaaccccatccaggacactgcttccagctttacagggtactctccatttgcactcataccatgggggacaaaatctaactaccctgggaactcttttggcaattcagtagggtgtgcatttctataaagttctttttgtcttgaccctaaagaagaggtggtcgtggtacaattttttgagattcaaattctctgattcctctacatgtgattaattagagtttcactttggagggtactaaatgcagtgctttttaaaatgagattttttttatttttgctaggggaccatgttccaaatcttgatgtataggttgacagaattaggtgaaatggcctgttctgaagaagcgttttaatcagggcaggcacagataattcccagcataagctttgcttcctattttaagagcgaccagttctgaatcttagatactgtgtcaggaggtttttccttgcagccagagacttttgccttaggagtttttggaaatgtgtcataaagctatgtagttcagggtcccactatgtgcattttatgaactgcccaaacattgttttcctgggaagtgaggcaccactctcctctcatcaaattcacccagatattagcacatgacctctagagcagaacagtgaagaatcacaagttactcatggcaggcgacttgaacacaattatttttcaactgatgtgggttttttctgtaacataaaatatacacttcaatttatttatataaatataaaactatctttttctggaaatcttataaaaaccactttaaagtgtcgttcccatttagcaatgcagcatgattatctgggtacaatctaaacatggagagagcactgttctcagacacatcctgatgaagctcacgattggaggacgtggaattagttccctctagtggagaacttcatgttgacacagttgttagccccttgtctcatggaaggaaaagaaaggtgaaatctttttttttcttttttttttttttttttttgccataatttttctttttttctttcttttttttttttttttttgttgttgtttgtttgtattttttttatgacagcgtcctctctggcgggtaaggcataatctttttttggtatataccttagaaaacaggtctcagtgtagtgatgaaacagctttaacttgagaattgacaaattcttgtgaacacttttaaatatgatatactttctaacaatgcttggcatccaatcattttcatttctcattattttaagtaattttaacaacagtgtatcaaatgaaattattgttccctaataatgtcttatagtgtatacatttgtttatttaaggaaacctttttttccaaatcatggattaaaacacagccctcaaggattctccccttttccaggccctccccatcccacctgccttacttttcatttcctgcgttttccctctcggctttgatttccctcaaggcggtgtctgtagcacaatgcctaccaccttgtacgtgttccataaatatttgttaaatctcaatatgaaaaaaggaacaagttcttggacatcaagttaattttataggaagaaatatgttttaaaaaaataaaaatagatgatgcgccgggcatagtggctcatgcctgtaatcctagcactttgggaggctgaggtggtcagatcacaaagtcaggagtttgagaccagcttggccaacatggtgaaaccccatctctactaaaaatacaaaaattagccaggcgtggtgacgtgcgcctgtaatcccagctacttgggaggctgaggcagtataattgcttgaacccaggatgcggaggtcgcaatgagctgagatcatgccactgcactctagcctgggcaacagagcaagactctgcctcggaggaaaacaaacaaaaaaaaaatggatgctcaccaccacctcgcccttgccccacagaagcctgtggtgctggcaggttgcctggcctcattagacatcgagagggagccccttggagctgtgctccctgcatgtccttggcaatgtcacgctgcacctggggctctgaggggagctcctaaaaccctcacggtccctgctgtgaatatgatcttctgaatcatttgttttactcttgttacgttggctcctaacttagcatgttgttaccaaatccctattcagaggaatattttttcctgacagaatccttagtctacttaaggtttctaagaaaaaaaagttggaattttaaacccaccttaatcaaaaataagagtaaaaatgatgaagtactaaaggatctatgagaatgaatacattcaaagtatggcagaggcccactttgcctgaaggaatatacctcagatgtggatccttcatcttgtcagtctccagaggatggtcagccctactcaaacacctgtccgtttttccaggcagctctttttttcattgcccaaggcagctttttaaaatcagtgttgctgtccttaaattctcttctcccatccgatacatagaaaaatacagaatctaggaataaaccatcctaaattacctctcttgttccctgaccccatcaagaactcacacatgtgtgtgtaggcacacgtgcacacagtaggatctcctgagagcttattcgtttttgttttcctacttcctaataccacacacataatagaggttctctaaaaattgactgaatgatacagagttagccttactcatgggagttagacatattcgtctatttcagctctaaaacatccagttgattctagaaagcccagagaaagggagaaattctcacttgccacctccttcacgggtgcttaaattatccaaccaccctatgtggccaattggtttttaaggtctgtggtcgtggcccctctgctcctgtttaatgaataaactttgtaaactttaagagactctatcctgaacctgttaatacagcgtaaatatgcatcaagacacttaagaaaatatcctacaattgagtggttccatattagtgaaagaatggtctagaaatctagagagaggtctcagacaaggcgattgcaagtttctccaggtgaggcaatacttcctcatctttgaacattgtgtagaggggtgactgtccttaccattgctttcctatttgtacatgtttaaactccaacatttttttttcatttctggggagggatttttcttccatccaaatttttgatccaggtaatcattataatcttgaccaatggtttaactttccatcacagtttcatagaagagagttgtttatttcactttaaagtatattttctttcttttccttcctccttccttcctctctctctccttcctccttccttcctctctctccttcctccttccttcctctctcttgccttcctccttccttcctctctgtctccttcctctctctccttcctctctctctccttcctctatctctccttcctccttccttcctctctccttcctcctcacttcctctctctttcctctctctttccttccttctgtctctctctctccttcattctctgtctctctctctccttcctccctcctctctctttctctatctccttcctccttccttctgctctctctcattctctctccttcctctctctgtctctctctctctctcccccaagctggagtggcgtggcatgatcctagctcactgtaacttcaaactcctgggctcaagtagtccactcgccccagcctcctaagtaaataggactataagcacatgccaccatgtccagttaattcttttattttttgcagagatgggggtctcactagctgatctccaactcctggtctcaagtgatcctcttgtctcagcctcccaaagtgctagaattacacgcatgagccactgtgcctggcctctgatttctaccttttttttttaattcatttattcttttgagacggggtcttgctctgtcacccaggctggagcacagtggcatgatctcagctcactgcaacctcctcctccagggtccaagctattctcctgcctcagtctcccaagtagctggggttacaggtgcccgtcaccatgcccggctaatttttgtatttttagtagagacggggtttcaccatgttggccaggcaggtcttgaactcctgacctgaggtgatccacctgccttggcctcccaaagtgttgggattacaggagtgagccaccaagccaggccttctaatttaaatatgttcttccatatatgacctgcaggtggcagagtgaaacagcactatactgtaaaagtaaaaatcgaggcttgggtgtgacagaaattctcattagaacttacatcctctagggtgatactagtgaaatctagtgtgggcagggtgtctcacaaaatctttaacacaatgtcaataatagtttgcttggaattattattttttcattgtttttttgtcatccactagttgtatccccccaagaggataaaaatatcaaatgacattatgaaaaatatcaaatgacattagaacgtcaaaatcctcaaaatagaaataacaagtaaaataattaaaacatggcttgaacatggttattggactcctcaggttttttttttcttaaatcattatgattcttcataagaaagtaaactgtgtaattcagtaaactaaattgtaagctgcttggaggtaaggatgtctcttttttattgccatgtccatgtatttgtattgcctattaaggtgcctggtgtacattagaccttaataaatgcttaatttcgtccttcattcccactcactgttggtaaaagtggttatggtgggcatagttataatctagaagtaagtgttaatattttagagctgggggcctctcaaaaggccaaaaatatagcattttacagttgggagaaaccttagagtagtggtccccaaaactcatttaacatagtcctctagggaaactttgtaatatttctagatattcctatctaaacagactttccagatggaaaatattctagagtccaatccaaattcagcttcaacagctctggtccagggttggggaaagatgatactcagatagatagatagatagatagatagacagatagatacaaatagatcatctctacatgtaatctgtataaagatctatatatacacacatatatgcaaacatgtataacatatttaaatatattcattaaatgcatgtgtttaaatacatttaagtttaaatgcatatatttaaatgtctatggtgtatttgaatatatttatattagtatatatttctataatctgtatttaaattattcctatttgggaactgtaatctcagtctccctggtccaggtcgcaaggatgttcccataactctacagctgttgcagagcctctgatgtgaaagcagtggccataacccttattggaagcagagttctagaactgaaacaactcatggattgcaaacctggaagcttttctaataattttctaaaatcagtttcatttttggccccgtagtattccaacagctcttacctactctattatactgggttcctatagccatattcattactaaaattgttaggatcacaggctgttggtgccagaaggcatcctctttagtgttgtgtggacaaggaatggagataaagaagttaactaattagtttacaaagaactttgagaattgaaggaagccatctgtcagtacaggttgaatatccctaatccaaaaatccaaaatccaaagtgctccaaaattcaaaacttattgaacattgacatgatgctcaaaggaaaggatcactgtagaatttcagattttgaatctttggattagggatcctcaactggcatatatatatatatatatatatatatatatatatattcagattttggaatatttgccatatacatacatacatatatatatatatatatatacacatatatgtatatatatataattgaataacccagtacaggttgagtatccctgtatcccttatccgaaatgcttgggaccagaagtgtttcagattttggattttttgtttttttttcagattttggaatatttgccatatatatatatctagagacagagagagagagagagatcagagaaggggcctgggcccttctctgatgcctcaatgagctgagctctgtatatatcaatcacnnnnnnnnnnnnnnnnnnnnaaatattccaaaatctgaaaaaaaaaaaatccaaaatctgaaacacttctggtcccaagcatttcggataagggatacagggatactcaacctgtattgggttattcaacaatagaactgtagctggattcatggctagctatggattatttcacattttgataaatcagtacttttcaattatgctctatggggccttagggaagaggtaggctagtggggcctgggcccttctcctgatgcctcaatgagctgagctctgcatgcacttgttttgattattagacttacaggtatgatcttattttctttcttaaccaagagcccccagctttgaaaagagtttgattaccactgatacagttgtttactcagacagtctgctcgggctaaacatgttcaagtgaaatcaaagacctgagggtgaagtagatcatgtgatgttcaagtacatgtgtctttctcacgttttggccattctgtgccgtttggatgcatttttctatgagactctgggtctgagtcctctattggtgcagtgatgtagctaggcagtattctctgccacctatcattcccctcaatgtatccaagacatctttagagtttcccagggctgttcataactaatataaaattttcaattctttctagaaaatactctcagacacactttttactggccacttggaaaacctgatcacaatacaaaagtatctgatagcttcttttatgaatttttctttgataattttttaacaaattaactcataagttatgtacatttatgcttagaagttaattctggtttttttaattcttataacccattttaaaggctgtgttttaccttatctttataattaaggtcttcaatcaatcccttttctggaaactactatagtttcccagagaaagcaatagttgtttagcaaaaacctctgtccatgaggacatttgaattaataagtgcctgagtgttttattttgctgagagagaaaaaaaaaaatcgggactaggaaccaaaacttagttccatccaattaggatccttccatgacagcacaaaacccttaaaatttgtgagacaatttcaagatttcttcttccacgataccgaagtctgacaatatatgctgtacatgatcaaatacacaataatgaatatgtgacttatgtttaatactagataggaattttaacatacatgttctttcttccaaattccaaaagcttattccactttcccccttctctcccctagccatcccctgcgtaaatatacaaatcttagaaatattggagagaaaaaaatgggaataagtaggaagaaatgcattttgtaaatgcagccaggcgtggtggctcatgcctgtaatcccagcactctgggaggtcgaggctggtgaatcacttgaggccaggtgttcaagaccttttagcagagacatggtgtaatctcatctctactaaaaatacaaaaataagcctggcataatggcatacacctgtaatcccagctacttgggaggctgagatgtaagaatcgtttgaactcaggaggtggaggttgcagtgagctatgatcacgccactgcactccagcctaggtgacagagtgagactctgtctcaaaaaaaaaaaaaaaaattaaatgcagactatcccatgatgatactgataacagataacatttatcaagcacttactacattccaggcactgttataaatactttacatgtataactcataagagtcaaaactaccctatcattattttccccattttacagaaaggaaaaccatggctgcaggaggttatgtcacttgctcaagggcatccaattggccatgagaggtgtgcaataaatatagaatacaggtggcctggctccagaccccaaattgtcaaccactgtacatacatttctagggccttaaatttctacccaaattttaagcctgattttgccctaaaaactgggcatatgataggtttttgttgcattaaattagattttttgtataattttcttgaattaagttgactaaaatatatacatatgtatatattttacaagtgtaatgtaaaatgttttgcaaaaacataaagcagactgcaaaaaaaaaaagcatcattctttactgggttttagcttggatcttctgggtaatgtcatacaaagaagatgttgaaaaatatcacttgtgatcatcatctatctatgatgtgtacattataagcaatagtattgacaatgattttactatttagggttcaacaggcgcagtaatgtccctccttagcgaagagagacacatcattgaatttaccttcaaccagggctgtgcattcatcctagaatttgacagagtctagaaatattggcctgtatgtctcagagagccagatatttaactctttgacgtttaaaattttgtaacacttggtaaaggtaaaaaataaatagactaagggatgttttaccattactctaaagaaataaccaattctaattttttttaattcttttcccccattttctctgttctattaaaaccatttgtaccacaaggacaattgtcagggtacaacaactcacctaagttggctctcggtactttttccccctaataatcagtccccaaatcaataactggagaatctgaatttttccatgtgctaaattctttgctgacagaagtacaagaacttaatacattggggaggtggggggacttctatttcctggctaaaatatagctgcttttcctagatttggtggataattttattctattgtgctttatttattcttagtagaacttgtgggattgttttcaggataatgtcagggtaattgttcacaattgagctatgggccaacccaagggcattctcctgagaatagtttggctaaaacatacaaaaatctctcctcttatcaaaaatatttcttcttaaacataaagataagtgaggaaaattttgacatgagataaaaataacaaaatcagtcagtgactgaatgtctcgtatgctcttagtacatagctagatggcaaataaatcatgtctcccagccctgtctcttcatgcttattttataataggaggatataatataagatgcccttctcataccggggcagggtgcactcaacaccctttctttctcaggaaggtggaataggccatgaggcagtacaaaatattgacgaatatgagatttcaatatttctccagcccttattaatatttttaattttaaatgaactgtgcaaataacacatcttatagaaattttgaaagcatatttaagcaaaaacaaaaataaagattatttcctagccagttgcaccaccaaaatagccaccattaacattatataaatatatatatgtgtgtgtgtgtgtatatatatatatccagacttacatacacatacatatatatacacacactacacctctagtaactgctaataatagtaacagcaatgatagcaattgcagcaggagcacgcaccaacactacttgtaacagtagcagtagcagtggtaactaccaataggggtcagtaatagcaacaacctgagaatatatcactacaatggccagaaacacagaggaagctgcaacaagggtagcagtagcactgaaggtgtcttggtagcagaaacagcagcaatagcagtgcagtagtaataaaaaacattaataataccagttaagagttacactgttgcatttattacgttatcaagccctgttgtgtttcacacatattatctcaattaagcctcatagaattccagtgaagcacgtgcacaagttgtatccccattttacagatgagaaaactgggcacatacaggttaagttgcccaaggtgacacagtcttaaagggtagaacctgaatttgaacccccggcagtctggctccataatccactcttaaccactatactggtagtgacagcagaagtagcatgaattctaaaattcagtatgaggagtattttgcaatttatatacacttataaaatgaatgaatacattttggaagtgattctgaaattggaagaatagaatgaaaggatatgaagtaacttaaaaaacctcttataaccaaaatggtcattttttacaacttccaacttagactatcaaagaaagcatattttgcaaacattttgctctcctatttcattcttcctcaaaaatctgtatctttttttgtgtgtttgtctaattttggggagtctctcactgtgaatttttaaaaataaagagcaaattgccatgctccttaatttatagacatgcctctacatatttaggtgcttaacaagtttctgtaaataaatgaataaagcaataaaaaataaaacttcagattcacactaaaagcaaataaaattgagttgggccatgcacataccactccaataagaatgttatttaatgctaatgcaaaagcagctaaggaaataagaaaaatctttaaaaaaaacaaaaaggtaaatttgttgatgctttggttggttctcttttgcttcctataatcccacattttgaaagttttatttgcaacctatatttgtaatatttaatctgtgtgtacacttgagactgtccttataaaaaggattctttctgcctcttaaaagctataattcaagataaagtgaaaaccaagtcgctataatgcataaataagattttatctttggaaaaatgagaaaatattgagtcctgggcaaaatttatgacctctaacataaatttgaattgtgtcctttttaatgatttcagattgccagaagtggcaaaattagaaaaattaagtttacatacaaaatagcttaaaaggggaaaaaaaaaagccctcaaaaagttctcttggaacttttctgcttagggttgcaagctgaaattttggtgatgtgccttgatttaatttccaagtctcttatctgtagtttattcttgttactgcagttgctactggtttttaacttgtacacaggaaaccagtgccaatcaattttgttcccaaggtgacaggaaaccctggttggtcagatgttgattgtgcttgctgttcatgctccacccatcatattttcttcccttttggctgaacttaagacaaattaatcagtggtcgacatctggcagacagttttggtgtcttctcagtgatttgttgacccgcacatctaaacagtaaaaactcagtgcgtaaaacttgtaggcactaaatataaatgctgccaagaatctttttcagggacttgggtggaaggcccatcttttggctttttacttgaaaatgtgaattttcttgagtaatgaaacatctgttcaataaatatctcaccttctttatgacggcgggtggcttacctcactctattgtaaattccagatatgaactgtgaaacagggggcaaggaagggctcagagaatgttaagctttttaacaggcctctgctgcttgtaattaatctttagccacctgcatattttcttcataatgagtcttatcccaaataaacatatccctcgtcactgaacactctgagagaaaatgttggtacccagattctggcaaataagataactcataaataaaagctaagcacaaagtcaagccggatgacctccgcgtccctccaagtcaagcttctttggagtctcctctttcaaactcatggtttatgactcttaaaaaagaaaaattacaaactgtttactagccttgcgaactcttttcagaaatcatttgttttaacgagagtggtactaaaatataggtctaattttatcaggtctagtgacaggagagatcatgagaaacatacaagaaatgttatctctatataggaagatgaaggaaggtaacaatgcaggaaggtgggatttagataaacctaaaaagggcaggtatgttggaccggataggcttttcctgttcctaaaatgtcttgtgctcttacacaggaaaagcattcttattcacccgaggcatttgcaagtcctaggcacaagacctaaaaggaccctgggttctggtagtaagaaagcaggaaaggagtgggtgggaaaggaagcgtccacggggggcgcatagccgggacagatttttcaaagggtaaaaaagcctttagccatttttcatctatgcctccctcattttgaaaacaaactctgctagtttgttcttatttcttaatacaatacttcccatgccaaaatttggatacattttaaattggggtcaatttgggctgtagagtctctaatgaattggtcagcatgttcatgctctttgagagtctgctgccctcactgacctgccagttccaataatcatccaactatcctcccaacgattcctttcctggatatattagcagggcgaatttcaatccactttgtttatttgttcactacggtatcttccatagaaaagctaggcctgtgaaataaagattaaacgggctagaaaagtttgcggtgttatgaatcctatactgtgcagaattcataattccagttttgcctagtagaaaaaagcccaagatcataaatatttctaagcagtcagggaaactgcatttgccaaggccctataagaaagctgatggtgaacccaaacagaatcctgccaaatacctaaaatgtgttgaaatatattttataattcctcccccacaatagtccaccttttgatttgtgtgataatctatttggacaggagctatccaccgtgtgcctgctcttctttccacctgctgttccatcagccgaggaaagggttgtgcccaagggaggtggctgtccattgttattcacaatagcggtgcccctcatgaaatgctctgccaggatagataaattacctattcttagacagaagttttatatatgtgcaatgttgactgactcagactctaatcaaaactgttctcttggttctcctcagtatatttctaactcctcggtatatttctaacctatttctaactggagaactttaggatatttggcagtaccatgtgtaagtaagagcttttgcaggacttccaagcaagagaagtaacaatgggtatatgcctgcaacacatttcttttaggggaatatggcacgagtgtttttgtggattatctggtttatataagatatgcattttaaataactaaacctgtgttgacatgcttatactagaaagcagtgctgttaaggagcacctctatataggcaaaccctattcagtgaagaaccaaatctgagctttaatctgaaaccaaatagaaaaagttattggagtcgaagatgagggagtggggtgaaataagattatgtatcaagcatattcaaatataggataatatcctaggtcctagtggtagtaccaataagaaaaatgtacctgagccaggtgtggtggctcacgcctgtaagtcctagcaatttgggaggccaagcctgggggatcacttgagaccagttcaagaccagcctgggcaacatggagaaaccctgtctctactaaaaatacaaaaattagccagctactctggagactgaggcaggagaatcgcttgaacccgggagttggaggttgcagtgagctgaggtcatgcaactgcactccagcctgggcgacagagcaagaccctgtctcaaaaaaaaaaaaaaaaaattaccagggtaacagagcaatacctctacatagagaggaaaaaactggaaaagacttggtaagtctatgcctatacctaacatttgtggagcagttgctatatgccaggtactgtacaagatgcatcacagatatataaaatcatttcctcctcatatccacctcaggtgggtaaattatatcatctcaaatttaatgataaggaaacggagacacaggcattcaagtacatttccatggtcgcagagtacattactgcagagataggattcgagcccaggtaatgtgcccccagatctcacgcttgtttctatttcctgcttcccctaatgactaaggcacccgaggatttttctttttccaccttctccatattcataattagactatattaaattttttcagtggaggaatggaagcattttaaaataaaataatctcttcagcctaacacagaccaattccactttgagaagagcgatggttgcgccttgcaccctccaggtggcgcttgtgcgccacttacagacaggagaggtttcagggtcgtcggcagggtgggctcttggttttgttcaaaggacatttgagcattgtttctctgtcctcaacaatcctacttgagacacttgttgccattgtaagatttaaaggcaaatcagataaacaaagaaagggccacgtaccaatcctaaagctgacgtggagcagccgaagcctcccttcgcagaggtctgttaatggcatccagagaagacgcgcagtcactgtgggttcagactgcagatgctcttagcaggggtttccagctgggcgcccgtggccctctggaaggttctcatttggtatccatcggaaggccttttatcgcttgttagtaatgatacagatttgttgtagaggcaagcaattctttcagtatttaagcctttgcaattttcattatttttttaaaaaaatgatttttttttttgcccttttgctccccttcctaacaaaggaaattgttaggaactatattactaatgtaatttagtcaaggggttgtcaaggagttccattaggatttggattgaaaagggatttctaggataaagcaccgttttgctgtagatatgatcttctggaaaggatggggccgggcagcctcgtgaagtttgcattcgtgaactttgggttcccgtaatcctacggcatgccttatcgaggacagcctaggagcgaattggcagtaggttagaaagcatgattagaagagggaaagctgaaatggccttcatgtcggctgttttcctccacaggatactgggtgattcctgtcctaaccagatactgattacttaaagcttagcccgagagttcttgtcaaaaatgatttccgtagcgtattttgacttgctgaggtctgaagaactttgggaatttgttaggtgtggatctgaactccaggaaccggtcaggagtattcagtaaatgaactctatccgtttgaacagaatgtcttaagcacctcgtttttatctcattcacacttctccgaatgtcctcatctgacatggagaattattggtggaaaatgtgcgtattgataattcagacatacgaaagcaaaaaagtccaaaggacttatcttcaaattgttttacacaatatttcaagcatgtgcaaaatggtataaatatgtttcaatctgtaaatttatgtattcttctagtatttccccattataattgaatccttgttttgtaaacatttcacctcatctacaatatacacactcaaaatatttaaattgttgaaaactatttttagcatgaatacattttcttcacataaaatacaaaggattaatgtaacatctaactctttaaaacattccaccaaatattcaaccctgaatggtaagacacaaaaaaggtgtgtatttgtgtttaaaacagtggaccggccaggcatagtggctcacacctgtaatcccagcattttgggaggctaggcaggcggatcacgaggtcaggagtttgagaccagcccagccatcatggtgaaaccccgtctctactaaaaatacaaaaaattagctgagcatggtggcacacgcctgtaatcccagctactcgggaggctgaggcaggagaatcgcttgaacccaggaggcagcgattgcagtgagctgagatcgtgctattgcactccaacctcagcagcagagcaagactccatctcaagaaaaaaaaaaaacagtggaccatgaggtatttattttaaatctctcttagaagtatagcttccagtgttaaatctatacaatactttgttgtctcaaatgttcggcagacaagaagcaattccaattctataaaaaatataacatttaaatcaaagtaatgggttttctaaaagtcattttatcctgattcagacagttagtatttgagagacttttcaaataccatggctgtatagtatttttaaaaagaagattgtatttttcttttcttagcatagatgcctattcatgccagaaatcaataagcattattacaggaaaattactgaccaattatcaggttttatatgataattgtttaatatgtaataaaagcaaatactattttttttcctttggaatcaatgcaaaacattatgataaacagaagaaataattcatttctagtcagtttggaaactcctttgtatttcattcttattttccttttcacacctacaaatccctgccatgcacacaggaaatgcccggatgcatggaagaaattaaaattaggtcaattgtgttccatcttgttaggttagccaggcattctgtagatatgggacatgttctgtatttaacaattttgtcctgtgtcttgtattgactttgtcaggatgtgctgcatgtcctgtactaagcattttttcattaaattacaaaaatgtgatagagctatttttcaaaatctaactggggcgagtcttgtgcttgtgtttgctcaatttggtgaccctatcccttgtaatcctttgttagagtctttcagtacttagactcatttgtgtatttcttgagttcattttcatcagaaatgatcattttcagaatgaaatgtcactggtatagcttaggacagcttaatatgctaagatgacagagttagctggtatcagaagttattctcacctaacactctctctttatttgaaaagaatgttagtgctcaatgtttttaaagattttctgtgttcattattatgtcattcacagaaacatatattggagatataataaaaatgtcattattgagtatcagaaattaagagttgtccagataaatattatgatttttatattaaaagatctctgatgaaaagaaataatgaattaactcataaaacaatacctgaggaagaatagtatgttagagaaacaaagaatattcttgtagccgttgtttaaaagtctgtttttacatattcttcactgccatctgcctgagagaaatgttgaatatagtaagtttagaacattttaattttgtctttatggttatagtagtgatttggatgatatattcttgcagtgagaacttaatgattaccagttgcatatctatagggaagactgaagtgtcttctgtgatacacaaaatgattttattttatgggacagggacttgttctgtccccaggctagagtgcagtggcacaattatagctcactgcagccttgaactcctgggctcaagtgatccttcctgcctcagccttccaagtagctggtattacagccatgagccaccacgcccagcaaaatgctattttaaataatctttgatgaatagtacttgtagctgatatggtagataccataggtcctaggtgcttactgtcttgtatatccaaagtggctgaaaaaagttaccattacctatgtaagtctagataattgagagagtggtctcaaagtggggcatgtgcatcccaagaaatgtgtaaaatgatccattagggtgtaaaacatatatattacaaaaaaagtacatttatcttgccctttcctacttcaaattttgtaaatatttcataatttgcataatacataagtataatagtacatgtatataatttacaaatacataaatttcattagaggcaaactttttttttttttttacttagaagacagacaatagaaaaaaattgaaaattattaacaattctacccaaaaatgggagataaagttagagtacatatatagtggacccaatctgagtgttttctagcatgtctagaattccagtattttaatgattttatcctgttataaacacttagaagctgatagataaaagaggtaaagaggctgctttatgtaaggttgcgggaagtcagggaccccaaacggagggaccggctgaagccttggcagaagaacctggattgtgaagatttcatggacatttattagtcccccaaattaatacttttataatttcttatgcctgtctttactgcaatctctaaacataaattgtaaagatttcatggacacttatcacttccccaatcaatacccttgtgatttcctatgcctgtctttactttaatctcttaatcctgtcagctgagaaggatgtatgtcgcctcaggaccctatgataattgcattaactgcacaaattgtagagtacctgtgtttgaacaatatgaaatctgggcaccttgaagaaagaacaggaaaacagcaatgttcagggaacaagacagagaaccttaaactctgaccaccagtgagccgggcggagcagagccatatttctcttctttcaaaagcaaatgggagaaatatcgctgaattctttttctcagcaaggaacatccctgggaaagagaatacgcgcctgggggtgggtctctgaactggcccccctgggcgtggccatctgttatggtctgtagactgtaggggtgaaatagaccccagtcttgcatagcgctcccaggcttattgggaagaagaaattcccacctaataaattttggtcagaccggttgctctcaaaaccctgtctcctgataagatgttatcaatgacaatggtgccggaaacttcattagcaattttaactttgccccggtcctgtagtcctgtggtctcgtgatttcaccctgcctccatttgccttgtgatattctattaccttgtgaagtacttgatgtctgtgacccataccctgttcgtatactccctccccttttgaaactccctaataaaaacttgctggttttacggcttgtggggcatcacagaacctactgacatgtgatatctcccccggacgcccagctttaaaatttctctcttttgtactctgtccctttatttctcaaaccagccgatgcttagggaaaatagaaaagaacctacatgactatcggggcaggttccctgatatcgtaatgtcttaaataacaaaaaaaaaattattttggcatactcaatatatagaagaaactttttttggagacagggtctcactctgtcaccaaggctggagtgcagtagcgtgatcacggctcactgtagcctcaacctccctaggctccagcgatcttcccactcagcctcccaggtggctggaactacaggaacacaccaccatgcccagcgaatttttgtattttttgtagagatgggcttttgccatgttcccttggctggtctcaaactcctgggctcatgcaatctgcccgcctcagcctcccaaagtgctgggagtaaaggtgagagccactgcacctggtctataggagaaacttatattatgttcgtacagatacatttgcatgaataaacaaatatacagtagaagactttccatggcaacattgttggtaatagcaaaaagaattggaaataaatatctattaacatatatatataattgtgcatttaattatgaaatccacattgttgttctaataagacaaattttccaatatataatgtaaagtagggaaaaagttgcaaaactatatgaaattttatgatccaatttatatttgtctttgtaagtgcgtgggcaattgaaagaagggtacataacccaaattgtggtgagctgtgagaagcagagccagaaaatcaggaggcgggaagaactaggggaagagggctttctttttcatttgcttccttctgcattatttgaaaactttagtataagtatgtattaattttataattaaattaacattttaataattaaaacaagatattgttttctttgaattaatagatatttatatcatagatatgtctattcaatataaaatgaagtgagactagaacagtaaccacattatttgaataataatgtaggcagacacagtcatgaagaccacagagataccttcaggtatctacttcagaataacttagtgccaaaacttcacttttaatctatgctgtgtctccataactgatgggataagacctactacattaggagggttgctctgcttcactccgtcttccaatgtaaatgttgctctcatccaaaacacgctcagagaaacacccacaataaggtttgaccaaatacccaggcaaaccatggcccactcaacttgacatataaaattaatcatcacaaatactatcagaaagtgaaaagacaattcatagaatgggaaggcatatatgtaataagggtctagtgtccagaatatacacataattttacaacacaaaataaaaagacaacccaaattaaaaatgggccaaggatttcattaggcatttatccacagaatatatataaatgtccagtaagccaaagaaaacatgctcaacattgtcagtcattagggaaatgtaaccaaagccacaatgagatacacttcacacctactaggatggctattattaaaaaaaaaaaaaaaaaggcagcagcaagtattagcaagaatgtggagaaattggaaatctcagacattgcagatggaaacataaaatggtacagccactttggaaaagaatttggtagtttctcaaaaagttaaatgtagttaccatataacccagaaattccattcctaggtgtatacccaaaagaaatgaaaacatatgttcatgcaaaacttaaacacaaatgttcgtagcaaaataattcatactagccaaaagtagaaacaacccaaatgtctatcaactgatgaatgaatacacaaaatgtgggtgtatccatacaatggactatattgtgccatgaaaaggaatgtagtactgatagatgctacaacatggatgaaccgtgaaaacatttatgctacgtaaaagaagtcagacaagacacaagaggccatacgttgtatgattccatttatacgaaatgtccaaagcaggtaaatctacagacacagcatgtatattagtggtttctagagcctggagagagagagaaatacagagtaactgccggtgagcagggagaatttttttggggggagtgaggaaaatgctttaaaatttattgtagtgatgcttatacaactaagtgactataataaaaaccattgaattttacactttggaaatgtgaattttattgtacataagttgatctcaataaaaaagaggagggagtatatataactttagttttctatcataaatattactcattaatattatataaaattggttgggaattgcttctgggcattttttcattttgtttgatttggttaaagcatgctaatttagaacatttttatttctggaaaagcaaagggatatatttcttatagcaagcataaaaacgtcctttacgtgacaaatttcagttcactctaaaatgtgtatattttgcattccagaaatacttattttttaccagtctatctgctccttggacataatatagataataaaacacagtatcaaaaataaaaactctttacttcatctggtatgcctaatatctgcacttgagtgaatggctatttgattttcagggttatcttgcaattattttatctgacactggatgaggaaggacccagaaaaaaatgaattattatgaatggcatcaaatcaacaaatcccagttacttatggggagaggtttattttaactattggcaactgtgttaaataatttatatttaggcattcatccatgtactaggcatcaccgataacatgattgtgtatttatactggcaagaatctgatcacggtgatcaaatcaagtgcattctcttcatttaattctaacacagcccttccaggtaattggcgccttccttccttccacctgaagactgatgatactttaaatataatctgtggccacagagtaacccagcaaagtcattgactctccactggccaaaaagaagccactccctactctgaaattccaaggtgaaaggccagtgacttgtagggagcaaaggtcatcctggtttatttgcaaagcacctaactgaccaaagcccacgattacatggcgggtggtacacttttaaatgaacactgaacaaacacagagatgtatatttaaataacttactgttcttgggtaaacatttggagaaactctggagagagtagattttcataattttgattgagagttcattttaggtaaaggcagaccttgatgtaccctgcttaatgacttaagatatctgctttttatatcaaatgactgagatggaatctagaatctttcagatagatattaaagggtacttttaaaaatacataatccttggcataaatgtaaaaattttctttgtgaatacttaactttataaatgtttctttccaatgactaaaaacaaatttaaggatttggaattaaaataaagggctcttttttgacttctatgttaagttcaggggtacatgtgcaggtttgttacgtagataaacttgtgtcatgggggtttgttgtatacattatttcatcacccaggttaatacctactaccccttagttatcctactacccctaaatataaataaatatactaaatataaatatactaaataatcctactaccccttagttatttttcctgatcctcttcctcctcccactctctaccctccaataggctccagtgtgtgtttttcccctctacatatccatgtgttctcatcatttagcacccacttataagggagaatatacagtgtttgattttctgttcctgtgttagtttgctaaggctaatggcctccagacccatccatgtccctgcaaaggacataatctcgttctttttttatggctgcatagtattacatggtgtatatgtagcacattttctttatccagtccatcattactgggcatttaggttgattccatgtctttgctgttgtgaatagcgctgcaatgaacatatgtgtgaatgtgtctttataatagagcaatttatattcctttgggtatatgggattgctgggtcgaatgatatttctgtctataggtctttaaggaattgccaccgtgtctttcacaatggttgaattaatttacactcccaccaacagtgtataagcgttcctttttctccacaaccttgccagcatatgtcattttttgactttttaatagtagccattctaactggtgtgagagggtatctcattatggttttgatttgcgtttctctaattatcagtgatgttgagatttttttcatatgattgttgactgcacctatatcttcttttgggaagtgtctgttcctgtcctttgatcaccttttaatgagattttttttcttgtaaatttgttaaggttccttatagatgctggatattagacctttgtctgatgcagagttggcaaaaattttcccccattctgtaggttgtctgttatactctgttgatagtttcttttgctgtgcagaagctctttggtttaattaaatcccatttgtcaatttttccttttgttgaaatcatttttgacatcttcatcatgaaatgcctatgtccttgcctatggcttgaatggtattgtctggattttcttaaaggatttttatagtttgggtttttacatttaagcgtttaagccatcttgagttaatttttgtatatgatataaggaaggagtccagttttaattttctgcatatggctagtcagttctcccagcaccatttactgaatagggaatactttcccattgcttgtttttgtcagatttgttgaagatcaaatagttgtagacgtgcagccttatttctggcatctctattctgttccattggtctccgtgtctgtttttgtcccagtactatgctgttttggttactgtagccctgtagtatagtttgaagtcaggtagcatgatgcctccagctttgttctttttgctcaggattgtcttggctatttgggctcctttttggttccatatgaattttaaaatagtttttctagttctgtgaatagtctttctcaaaaattgttgtaacagttaaatgagataattcaggtaagccatttcttacaaacttggcttaattaatattaagtgccatcattgaatctataaatcattttgggtagtatggccattttaataatattaattcttcctatacatgaacgtggaatgtttttccatttgtttgtatcatctctgatttacttgagcagtgttttgcagttctccttgtagaagtctttcatctccctagttagctgtattcctaggtattttatccttttggggcaattgtgaatgggagttcattcctgatttgcctcttggcttgactgttgttagtgtacaggaatgctagtgatttttgcacattgcacattgattttgtatcctgaaactttgctgaagttgtttattcacttcagaagcttctgggctgaaactctgggttttctagatataggatcatgtcatctgcaaacaggatcatgtcatctgcaaacagggatagtttacttcctcttttcctatttgaatgctctttatttcttcctcttgcctgatttctctggccaggacatccaatactatgttgactacaagtggtgaaagcattcttgtcttgtgctgattttcaaggggaatgcttccggcttttgcccattcaagtatgatgttgactgtgggtttgtcatatatggctcttagtattttgaggtatgctcctttagtacctagtttattaagagtttttaacatgaatggatgttgaattttattcttttctgtatctattgagatggtcatgtgattttgtctttagttctgcttatgtgatgaattacatttattgatttgtatatgttgaaccaaccttgcatcccaggataaagcctacttgatcacagtgggtaagctttttgatgtgctgctggatttcgtttgccagtattttattgaggattagtgtatcaatgttcatcaaggatactggccagaagttttctttttttattgaatctctgccaggttttggtatcaggacaataggtgtcatttctggccttacaaataaatgaatatatttaatttatttgtaatgatcaggattaaaagggttctttggtagttgattgcataaagagacaggaggttattcattgtattgtgctacttagaaaatgccgtgtgtgtgtgtgtgtgtgtgtgtgtgtgtttgtatttgtatttatatttaaatcagctgaaattcaaagaagacttctcatttcacaaggaatggcttagtcattgagatttattaatttttttagcatctttttcttaaataattatataaactaggaaaaattaacttaggaactaaaaatagaactactatcattttgttattttgttgaaagggaaacagcctcctcaccatgagtgacagtcaaaacaataccaaatgacaaaaaaaaaaggagtaaaaattaatcatccttggttacaaaacaaagcagtacattttcttcctttttctgaataaaattaacataggatgtaactttaggatgttaatgctcagactttattgatgcttaaacaagattcaaactgaatcacaactgtaacatttacctatgtaagcttggcttctacactccaaattttcagactcctgtttaatatagtccccccaattcctgtattttcagaggactggaaaaaccgtcaaagcacagtaattacatatagcatccccctaaccaattcatttgcaactattcatccacgcagatgccaaaagtgttgctctccatctgttcatgactgggtacaacaggagaactcaagtcaaagtctttggcctcaatgtgttcacactttactgcaaatcatttctagtgaatatgatatatattggatacatattgggaaaattgctaggaagtctcagaggaaagagcccctggcatttggaggattgaacctgaaagtgttggggcaagcacatttgaggcatagagaacagaactgcaggtagattgtctgcctgggacacaggtccggatgagaatgtgacaggagatgaggatggagaaatacacagtagatagattaggaagcatcttacgtcaaaagggtagctacttgcaggttttatcatattttcagtgctcagatattccagtgaaatctggaaaaaatctactgaactaggagattttagagttaggaagccttgctaaggaacaactgcaaaggtctgaaccaaagaggaagagagtttgagctacatcaatatcagcgagctccaagagtctgtcttcatgcctcttccacactgcgagtgcccactgacttctccaaactcaagagattttgagttagtttttaagacttcttgactgaaaagtaattagggaaatgcacaaacattgaagtacaaggatgttcattacagttttgtttataatggtgaaaaaattgaaaatgactcaatgtccaaaaataaagtattggttaaataactatgacacatctcaataatgggatactatcaaatgtttgaaaacagtgtttaaaaaaatttgaggacatgaaaagacattcatgatatagtttttttaaaaagtaaatcatatgcaatggttctgtgcctacttcctttttttaaaagtaaatcataaaagaatatattgaataaaaatctagatttttgtcatacatataaggacttgaaggacatacacaaaaaatgttcttagcagttactctaaatatgggtattatgaaatttgtaaaatctctatttttagctttagttaacatgcattatttttgaatcatgaaaacattgttaactttaaagacattaggtataaatgttaaggacttgaagtatgaaaaatagtcccaacttagacgaccattgattttgcatgtgtgatactgctgctaactcttaatcactaaccaattttctcaactttacctccctcaaatgttcatcagtgtgtactcatgtagctcccacatagctgtgtaaatagagagtgaagcaaaaatcaccatgttattattaattatgataataattcatatatgtttattatatcccagacattagggtggaagtattcacatattcttgcttatttatcttttatggtgtgagtcaattttgtgagttttattattattcccatttgcagattatgcagtctaaggtccaagttgcttaagcgaaatgcagaacaatgattgaacgcattttccaaggtcaatatttcaagagtaatgtgacaagttcaatgtatctggttcttttaaatgattgttttgaattttttttgtaaaataagggtgtagtaaattttgccttgtcctatacacatataaaaggtcagacatctttttatgaattcaaaacttttatagattcaatcaaaaggcatagcaacattctacctagtgaggtgtaggtcctttcaggtaggaaaatgaatcatttcctacactaaaaatattctctatgttaaaagattttctttttactttagggtgaaattcatatatcatcttcctgggttcatgcctggcatcttttatatttattattatttcttcccttcaggatttcctttgggaaattttattatgaatggtcacaatacctactcatttatttcagttctcaaaattggtaacactccatttatgtcacaatttaactttcctagtggtccgtgtttatttctgttttatcctatcatctttcaagtgatccagaaagagggttggtactatgtataatttactggaagataaagagatggaaacagcataacattattaaatgccattaacctcggaacttaaaagtcatagaactgggagttgcaaaaactgcctatgccactcagtccacacaaagtaaaagaattccatctctccatttctccacttttgtctcctttgttattcaaatgagcaaaaacttgtttttttttcctttttcattctgtttaagtagagttattctagaaaactatgtagaaaaattgtatgtgcaaaattaaataagttgtgggtgagagggtttaaggtcaccttttatgatcaagccaagattgtcagattcatggccactgtaacacacaaggatgaatagttggactaaaggattcaagatcacattttcagttctgaagacaacatcaacattaaagttcttgcttctcaccacataagatttgacgtgtacactaatgaagacaactccagacaaattatatatactttttacagaaccaaaaaaaaaaatctcggaagtcaaatctgtttgctttcattctgtactaaattcttcttataatctttaaaatccatatttttccgttctcatttcaagtatttcaagataagcagctgccaccatttcccactgaaacttaatttcataatccaacagtttcaaaagtacatcttccgggactacaagaaaaaatgatcatctgtttcattttgtcctcttccatttccattctttattggttgctaaatgaggtatactgcttgaagtctcactgttctcagtgaccaaagtactgcaaaaaaagtagcatgtctgagaattagagcccgtagacatgatactagaaattttagccctttcttcctaaattcagcttctaaaatctagcattatggtccccaactaccgggaaaataaatgcctggtttctgagttattccaacactcagttgtaatgttactgtatttttagctacgttttcttcccacctctaagtcattagaaactgatgtcattagaattgaacaattttgacccaaagttgtttatattctcttgctgaaatggatgtgtcgccctggcccataatatttatacatattttcctttttagttaattataattagcatgctgtttattgcattccttttacctttccctaagaatttgctttttccttcaattgtttgcattggtatcttttgaatttcctccctcttatttattttttggcataaataataattggtgctgcagcaggagcttgataaagctttttattatgttcccttttgtccaacagcaatcatgaggcattaaaaaggctaaacagtttgcccacagttccaagacaaaataaaagtaaagctttcagtagagttcgttttcttgctttccacattccttttttattaaaggtatagttctcctattatttatgttgattttttttctaaattctgtcaatttttttatacgtcttaattagaattttcccataagtttatatgtttatcttgtttttgaaatgtctttctgactgtaatatataaatggttattatttaagtcagttagcatgaaaatgcttccacagctctctgcttaccacagaatccttagaaaattaactcattaaatcaaatagaccttagacacgggatgtcaaaggcttctaatctcccaggtttaggcagcgtatactgtgggaagtcaaaacagaaattaatacaccctgatgatgttctggatcctcttttatctggctttttttttcgttatttatgtatttatttatttatttatttttgacatggggtctcactctgtcacccaacctggagtacgacagtggtgcaatcttacctcactgcagcctcgaactcctgggctcaagcaatcttccggcctcatcctcccgaatagctgagactacaggcaagcaccacaacacttagctattttattttttgtagagacagggtcttgctatgttgcccaagccagtctcaaactcctggcctcaagtgatcctcctgcctcagtctcccaaagtgctgggattacagatgtcagccaacatccctggactatttttgggctttttatagtcttatagtgtctatgactgttgcttctctctcatctctcttacataagcctgctccccaatttcaaaatacatttttatacaagagaactctagctcaaactgcttctatgctgttcttcaaagttgtattaatttattctcctacactttttttcctaccagattctttaactctagaccaaaaactcacctattaaacgtttgctttcaaagcccaacttaaatgacttctacctcatgaatctgctctgaccactccagatggaagagatctcaccatctatagcacaagcatcactccattgacagagggcagacaattttgtctcttgaggctgaaaatttgactgaatggcatggtgattttaaagggcataggactagccatcccttaagcggcctctctcaacttcatactaaaatatctataaagcttgcaaaagctgaattctcacaaatgccctaaatattaagaccaatcggcaaactattatcagaatccgtaaggattttctatcaatttgaagtccagaactgaactgaaaaactttaaaaactactttcccactaaaaatagattaaattcttggtccatgagtagaaccattctttgctcttcttcaactatttgcctcctactcagaagcacaggaaccctatcaaccaccaccaaaaaccaaataagaaaaagtggagtgggaaaaatatccctctattaggtaggcaggattttatgagcatctagaataaatgctattccctaatccctaacccagtgatccaaaagagttaagaagaataataggatgagaaaaagttttcagaaacataccccccaaaacatataggcatatcaatattcattttttaaagccagatgtgagggcaaatataaaattaacaggaaagaaagtaatattggtaacatttatagtgaagatatgactaaatcccttcaaataacacaatggctgcaatgtacaaggtaaaaactgttagaaggaaaaataacaagcataattattgtggaagactcacatacatatctcaggctttgacaaatccagtagaaaaaaaaaaaggaaggaaagaataggttggaataaagtaatatcttcaataaaataatggtataataaataaggtgatatatatgtatatatgtgcagatagatacttatgaacatatacagataatcaaactagatgccagcaaaacatctgtgaaatatttagaaaatgatgtagtgtttatctcgaaaaaaaatcaagtagtttcaaccattaaaaggccagccattctctaatttccacaactataactagaaattataaggaaaataaatgtctaaacttacagatatccatcaaattaaagtagaaattaaaatctcaattacaaaccatttagaaattaacaaaaatgacattacatatcaaattatagaatgacaacaaaaatgcaaccagaggcagattcatcagagaagaaaactgatagattttcgttaatggattttgttgttgttgttgtatattccaataattttccactgtttgaaattaagctcaagccactgtaatatttcttaatgtcgcattccagagtaagtattaaaataccagagggaataatttgctgggcctagcatctactcttactgtctttactctcacatattttggcctgtttttccctgctctctacttccttgagccgccaactgcttggcactatatttgatctgacacacacctacggcccctttaaatgtaacagtttttgtaaacaccatctctgacttcaatcctcagtctctcacatgctatttcatagttaccccttggtccacacagctaatattacttgtaaaaggcatcctcacttcctactcaggactcagggtctgtgtaagttgtaagagcatccccttgccccccagcgggaaaaggggaattatgagaggaagataaattgtaactcattttaagggtctgtgatttctatggccccttataagtttaccacaaaattaaatgaattcgtgtgtcaattcacatatgcgtgcatacatatacacataaatagaggatacagaagccatctttttttatttttatctattgttttatttatttattttagagccaaggtctctctctgctgcccaggctggagtacagtggcaccatcacggctcactgcagcctcaaccccccgggctcaaatgattatctcacctcagcctccctagtagctgagactacaagtgtgggtcaccacatccagctactttttgtatgttttgtagagacagggttttaccatgttgcccaggttggtcttgaactcctgaactcaggcaatccacccacctcagcctcccaaagtgctgggattgcagtcatgaactacctcatctggccccagaagccattttttagggattcactcagaagatatagatatagatatagcttttcctaatttttttttacttaatttttcacttaatattattagccaacctatgatttctgtaataagtatatgcattcataaattatagcatattttctcaatttagagttctttccaacaacaaaattgttattttcctgtaaaggaactatgggtagttgctatggccaaccatgatactaaaagagaaaatatagttggttgttatttctgtaaaagttctcactgaattgtgtgcatgtacagaaagacaagtttttgcaatcaaaataagtatgtggtgtttaaacataacattcttctccaatgtagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggtgagccttctatttattgttcactcttcagtcggtattttgatacatggggcactagagacgtatggaaatgatactgtcctatacttaagcagtctacagtaaacaaatggcaaagtgaaatggttttagattcactcagtctcatccactattgataagtattaaaattggaatgtagagctaaattaaggcagaatatgcaagaattggcgaggcaaataagtggtatagggagctgggcagagaaggggcattccaggacaaagaatagccttgctgtcactgtctggggaattaaactgttcagtttaactggaacattgaaatcaaggtgggaagtggcaaaagttgagcctcagaagtataaaagaaaccctagccttaatatatgtttaggagcttggactttatcttatgttttggatagatcattctatttgcagtggagtaggcactaaaagggagcagtttagaggctctagtgttaatcctgtggaactgcgttggtggcctaaactaatatagtagaagggaaaatggaaagaatctgtaggaatctacaagaagtgggattaattgaatgaggcagccaaaagtaatggaaaagtcagggattgatattcgtgtttttggtttggccaacagggtgcatatggtgccctttaacgaaataaggaacacaggaggaagaccaagtgtgggctaaaaagaatgatgaattcagttttagacataccagtgttgctagtgaaagcttaaagcatgataacatacatcaactcagagaacatgaagtaagattaaaccttcttaggtctaattgttgcccaaggagaatattgactttgttgatcacctcttgcatcttaagccgtattggttgagtacaataaattgattattagttcaggcatttgcagccatcctaatggtgacagattcagcaatgggttggatctactattagccccatcaactattattaagtgtccaaagtaaaatacaaacatgaaaatcagactctgtggtgtatcatattttacatgtgaagaaaatgagacctgtaggaatgaaagaacaagtcagtggtcacacagctagccaaaggcacacctagagctttttttttctagaactgcagacagctctttgtttatgaaataagaccttaccatagcccactttcctgaaaggaaattgaaggccagaaggagtacacaggagaaagagaatgctggaagatgacagactgtcagtgtgtgtcagaaaacagaaggtgagaaggaagaaggggaggaataaagatattacctttgtggctttgcccaaagacactgacgtgcttgaaattaccaaacatgaacatgtgttttccattgaatattcaacaattttgcttatttttataacttggaacaaacaggttaaaacatttagttggagcagagaatagggataaatatcatggatagctagcataatgcaggtaaaggaaaaattattttaaaaataagtaacttggggccaggtgttgtggctcatgcttgtaatcccagctactcaggaagctgagatgggaggatgccttgagcccaggagtttgaggttacagtgagctatgattgtgccactgcacactgacctaggtgacagagtgagatcccatctctaaaaataaattaattaataaacgaatagctgtttctctctgtagaacaagcctcaaattcatagtatagtccagcttttctcaaattttcagaatgactgaaaactaggataatttgaatgaatttaaagatgatttcttctatttcaatcaatattagactgttaagttaaattttctactggagaaagtttaagtagtaaaaatatcttatttgatcaaatatttaatgtttatcagtcattaaataacataaaagttattttgttcatgttaatcttatcaaagttagagaacatactattttgtataatcaaatctttaaacaaatgtttgtttggacccttttgaaaactttggcttgttgctttatttgtcctggttagctacagatacacacctttttagatctaatgcacttacatacagccactcttttcctattgttccctgtccaatcacttgaggcatataatgtatactctgataaaataagaatagtaatgttcttaagtgggagaaacagtgtttgaatgcccttcactaaaaacagtgcatttataacttaaaatggaacagtccagttataaaccatttcttaattcaaaaaaaagtcatgtcatcacttgaattaacaaaaaagccctttatatttaccattttgggaaagaggttttaataatcctaaaagagtcactattagtgtgaaaagataatctattatagtaaaatttttggtactaaagttatgtaaaaactggaatatatttgaatacattgttttttaaaaaaattcactttttagcatctgtctaatctttctagcaattatgtcacagcaggattcttaaaatctaaccagtgttatatgtctccttactgactacatattaagcaatattttctaacacacagagctgtttcttagaagtcagcttgtccggatgcagctgatatgtttaggaaaggaagggtgttggtccaccagaggtgctagatctgttgtttttaagtggctttgaagtccaatagaactctggatcagatgcccccctgtgaagattttctttgtggcagtattagatacactaatttgatattatttatttttgcaggaaataccaatgaactttgtggatcccaaagaaattgatattccgcgtcatggaactaaaaatcgctataagaccattttaccaagtaagcttcttgattttataatttgcattgtatggggggcaaggggagggatagccattaggagaaatacctaatgtagatgatgggttgatggatgcagcaaaagcaaaccacaatggcacatgtatacctatgtaacaaacctgcacattctgcacatgtatcccagaacttaaagtataaataataataataatttacattgtaaagcacaagacaagtcttcccattaacccttacctcagcatttccaattcttacaacacccacttcatatcaaatttggaattacaaacacatgtcaagactaataatcattaaaactatctgaagttaatgattttacctttttactcttattataatgtccaggtcacaattccaatagacacatattctaaaattttgttgtgccacacattatggctacctgatttttgtcaagggtcaaacaattcaatgggaaaaagagagtcttttcaacaaatggagcagaaacaaccagatatccacatgcaaaaaaatgaagttgaagacaaaaattgactcaaaatggaccagagacctacacataagagctagaactacaaaactcataaacgaaaacagctgtaaatctttatgaccttgaattagtcagtggtttcttagataagccaacaaaagcacaaacagcagcaaaaaaaaattgaacttcattaatactaaaaattttgtgcttcaaaggataccttcaaggaagtgaaaagacaactcatagaatggaagaaaataaatatttgcaaatcatgtatctaataagggacatgtagctacaatacgcaaatcttacaactcaataatagaaacacaaacaacccaaaaaatggacaaaagatttcaatggatatttctccctagaagatgtacaaatgaccaacaagcatattaaaagatgtttaacatcactagccatcagtgaaatcaaaactacagcaagatagtactttatatccatgaggataactataattttaaaaatagacaataaaaaatgctggcaaggatgtagagaattggaaacttaacactacagttttaagtacagctacagctacttaggaaaacagtttggcagttccttaaaagataaaactgagttgctatatgacctggacactctacttctaggtaaatattacctaaaagaaatgaaatgtgttcacacaaaaatgatacaaaaatatttataacagcattattcataatagccaaagagtggcaaccatcagctgagaaatggatagataaaatgtagtatagtcacacaatagaatcaataaaaaggaacaaggcactgatgaaccttgaatgaaccttgaaaacatcatgctaagtgaaagaagccaggcacaaaagacctcatattttgtagtccatttatatgaaatgtccagatagctaaatctatacagacagaaaatatcttagtggttgcttagcattaggggatatggagaatgactgctaaaggacctgtatttattttggggctaattgaatgttataaaattgatttacagtgattgttgcacagctctgtgaaaatttaaaaaaaaatgctgtgatggcacatgaaatggggggattgtatggaatgtgaattatttctcaataaaactattaccaaaaaaatgttgctgtgcatgacaatgacctggagtccttgttagtcctgtgcccaaccccagggattttgtttaagtagatctgctgttgagcacagaaaactacttttagcaaacacctaggtgattccaatccagatgaaaccaggatccactttgagaaccactactatatgtgaaactagattgagcttcatggaatttattaacgtcaagcaatgacctgaatgccagggaccagtaagaaataagaaacagtctataaaatcaaggaggtcacagactagaaacgagagtcatataaatggtaattatgctcagtgcataggccagaataaagatactgcccaagcagtgtaggagttcagagaggactgagtaattaattctgtccagagaaattaggcaaaaaaaaaaaaatggagaggaagtaatattttctatgactaaacaaacagatatagttggagttttggcaaaatcagtaaacatctcacgacaaagctcaggaaagatggagccacaaagtctttttaacttttgacattgaaatagcaatcttcataatttagttcattaattcattcataagacaccaaattctttatattcatagtaatggtgatgtaataaagtaattaaacaattactgttaatactatctttggccttccccttctggtggaattggaaatacattgttaaactataacatatttttaactgctctatatagttaaatttatttacctaaggtagagtcaccattgaaggttattttatgactatacttggccaaaggggatgaaagtgctgcgtgttagaatttgtgttttctctctccctctctctctctctgttaaatttttatctaaaatataccaaacataagtaataagggaatatacctccatcacaattatatatacccaaaccatcatctaattttagaaggatttggaaattattagcattagttcaaagttcagccttctccatttcctgcccagatgatatcagacaactgcttcatagtcctgtgtcagtttttccgttcacagaactgggtggaccgctggattcagggcacctgtgctgacagctgatgttgcaaatgatggattttctgttgaaaatgtctgcaggctgaatgccccacccaccaccctctgttgcacaaaatataatttaggaaatatagcttagaaaagccacactattgggtgaaagcatccaaaaagcctggaatgaatacacaaagatgttctttatggttttagactgtaatatgagataaacttgaaatattacataaaatgatgattattaaatgatcaagaatttaagcattatgattgtttttagttttaacctacactaaactcttcttagttctaaaagcttgacagcttgtacataatagcaacattatacaattctgagaatgccttgcaacagatatatggataggcaagaatcaattatgaataaatcaatttataattataaattaaattatagtcatttctctaatgacagtgttatcttggctgagattaaaatgctaaagtcaagtttatatcaaattattttgcagtgtaaacaaatattagtgataaaaatatgtctacatcctaaatcacaaaagtagtaggaaaaaacaatcatacatcaatagaaaattattagcagacaataaaatataatactgtaataataatcatacatcaatagaaaattattagcacacaataaaatactgtaataataagtttaaattttttatttttactttagattcagggggtacctgtgcaggtttgttacaagggtatattgtgtgatgctgccgtttgggcttcttctgacggcatgacacccagagagtgaacatagtacccaataggaagattttcagcccttctccctttccctccctccctttttttggagtcccagttactattgttttcatctttatgtctatgtgtatccagaatttagctctcacttataagtgagaacatgcaatatttggttttctgttcctgtgttaatttgcttagaataatggcctccagctgcatccatgttgctgcaaaggacatgattttgttcttttttatgacttcatggtgttccatggtgtatgtgtaccacattttctttatccaatccactgttgatgggcatctaggttgtttccatgtctttgttattgtgaatagtgctgcactataataataaattgtatgcatatttcttttatgcagtgtgttgatacaaatataagataatatagatacacttaaagaatgccatttactcaggtcatcattttatatttaaaattttaacatctaataatgtttcctacttaaattatgtttccttttttattatataaagtacctagcacagagtagatatgcaaataagtgaaccactcattaaagcaacaagttatgtagctaaagcaagatactggaattagatttgatttcctaccccaacaaaaacatttataatttttggcaggatatttaatctccctatgccatcctttattcccaaaagtagtgataacaatactctcctacaaggctaccgagaaaattaaatgatagtatgtgtaaaatgtctgtcaaagttccaactaatagtaagccctcagctaatgttagtttctctttccctccctatctaactgaagatgaatccatttctaacctcagaaccaattccaggaaataggggtaccatctatgtatagagaagtttacagttttaaaagcaaagtactcaagagccccattttcattcatttataacagtagtgatgaaaacgatgatgattatacattttttgtttaattcttggcttttttttttagtacaagctatatattacaagagtttttcttggaaacctacatttccccatactcagttatatgttgtattcttgcatttgtaaaaggaagtagttggagccacacacagtggctcatgtcctggagtttgagaccagcctgggcaatataataagaccccatttccacacacacaaaaaaagtttaattactagcctgggcaacatggcaaaacctcatctctaccaaaaaatacaaaatgtagccaggcatggtggtgcacatgtgtggtcccagctacttgggaggctgaggcaggaggatcacttgagcccgggaggttgaggtcgcagtgagctgtgatcacatctgggagtagccactgcaattcagcctgggcaacaaagtgagactcccctctctgaatttttaataaaaaggatttggaaacttctaaatacttggaaaatactgtaagttactaattaccaacataatttagctttacagggaaactgtttctaagcagtttttagctttaccagtaaatcatatacatcataggcattataaaaactgaaggaagcaggcctcttttcaagcctgaatggtgtaggatgtttatggaaacttctaacaatcagtggatactgaaaggcatgaaagatttcttgtcctctttgctaagaaaagaaaaaaatatctagaaagtcaaaaacagggctttaactctttctcatagaaattaattctgacattaaaccctctgtgagccacatcccaaatagaaatcacaaaggatacaaaagtgaattaaatacagcctttgccctctaggggctcaccacactccattgagggcaggcagaaatttaagcacttaaaatacaagatgataaatactaaaataaaactcaggggacccaagcaaagaagagaatgcctaattctgcctgggaaggtcagggagaacttcagaaagacagtattttctgaattgagccctgagtaatgaggaagactttaccatgcagagaaggcaaaggaaacaatatgtgcaaaagcataaaatctgcaaaaacatagaacatttgggagattgccctaggtccatggggctagattatatgatacacgtgggaaagcagctgttggtgaggccttgggatgatcattaaggatctgctctatcttgctaagtacccctcttggcattcatcttctaggcctgcactgtcaagtagagcaaccagaacccacttatggctaggtcagtttacacttaaatgaattaaaattaaataaaattaaaactttagtttctcagtttttactagccacatttcaagtgcttgaaagctagaggctacattttttggacagcacagatagataatattttcatcacctcagaaaattctattgatcagggctgctctaaactgaattatcaataagtatataaatataatagttaagtatgtaaatacagtaggtataataaaattgagtccaacggacaaataggattatatacaataccttcttggaaattcacagggtccattaacatactgaagaccctgagaagtcctgcagtaaaaagaatatggttcagatttgtttaacccaatgtttcccatatttatttgggtactaacctctttttgtaaaagatgacttaatttataagtcatatagtataattctatatgttatagaggtaatgatttacaggtaataaatattttgggaaatactgctatgggcaattgggaagtatggatgacatttagacaatggaatcatgtgatcagattttgttttacagagcaccttgacagctatgaggaggatggattggaaaaaagcaagattgaaggcagggagaccaggagatacttgagtcctagtccaagaagacagccatgcaaacagagaggcaagacagaccccagcgtattttaggagacagaacaggcagaatatgctaacattcaaatgcacagaaactctacacggactgtagagctgtggcagcacacctaacctaaacaatagcagaaagctgtcaggaacacatgaagggcatgaggagtttcacaaacctgtggtccattcagaaggaaataataaatagaaaaagctggactataaatgaggagaccgggctggtctgaagtatgtatttgagagccctcaggatgtgcgtaataaagtcacaggaatgaatgagtcactcaacaaggcagtatcaagtgaggataaaagagggtcaagttgaatcctagaattagcaacatgaaaaggggcagattaaatgagcaggagattggaaagaggccaccgaaaagggagcaggaaaaccagaacgttgtgtcccagaatctaagggaagagaaaactcgaaaaaaggatatacagtcaacagtttttgaatgcttcagagaggacatgaacaaaaataccacaatgggatcactgggcttaacaacaagagggtcagtggtgaccttagcaagggcagtctctgcacagtgctagggttaggatagatcacagtgtacatgaggaggattgagttgcagatgagcatggaggaagtgtgtgtataataaactctttcagaagtttgcctgtctaaaaaagaaaagcaatagaataattgctagagaaggatatatagaactgacctttttttaaaaaatagaagagatctttaaatcagtgcagtagacattcactgaaggtctgctatgcaagacattagatcttataaagatggtgaaaaatccccatccctgccttcaaaaagctcagagtgtaccaggtcaaagaaatcataaagagacgaattagtaatattaatgtatgcaaatgatggtaaaaataatttccacattttccgtaacactttagtccacaaagagtctttcaactcttgatggaaagtgattttagaatttaagacaatgttgctagcactaaacgaatctaaccaatatcagatacttgtgctgtcagtgaacaaaccgctacatatgctaactaaagacagcttcttccaaatagtgaaaaagacttctgtccaggccatgtgtttgttgtaggtcagaagaaaggaaatcagtgcaataagcaatttagggctatccagactgaactaatcactgcgtgcattctaatggcaatgttatggggcctgagggcttagttttagactaaaatgatgattaccttttgttatgttgctaaaacgttattttttatagatcgtgataattattggacatgcgaactccaactctaagaaaccctgaatttgacttctgaatatatacaaaccccagatgtttgggatgtacctattctattaatgcctccctaggcagaactgattttgtgataatactattcttttctgaaatatttttgccagaaaacttatatatactattaaccacaacccaaataacagtggtttaaataatttaaaagtgtttttccctctcaagtatacctgccagggttgatatggcagctttgccatgttatacctccagactaatctctctggttacctcgccatccctagggtattacctttgcatggtctaagatcctgatcaccatgaccacatcccaggcagcaagatggaatcagaagtggtagaagaagaacatcactcctcactttaatttcatgatctaaaagtcacgcgcatcacttcctctcacctgctataagtgaaaacttagtcacatggccgcaactaatgcaaggggtggtaagaagggaagtcttaagctgtgcatcctaccaagttctcagccagaattgggatcttattgctaaagaaagacagggatggtgactactaggagacgactagctcttaaagtacatatttggatatgcgtactattgtgtgctccagctattgacagcaaaaatgccagacagcacggagcatgcttggcaagaagcttttagggcgctgtatagccaaaggctcccagcagggaacctcctccatgagattcttggtggagagtgtgcaataaatgttgtttgctccactgtggcttctcctccttgtttgttattttgtgatctgccaagagttttgatcaataggattgacggaagatacgtataaacaatggaataatttcactctcaatgttaaaattcagctccacaggtgttcaagaccccttggaggaaaaagataaggtaacaaaaagcagtctagcagaagtctttctacattacaaagggtgtaatagattttatgcagactgagaggttttaccaacaagggtagatttagttttttggaagggaggggagctaaagcttatattatttggagattactctttaggttttattttatttttaattgaaaataacagttgtatatatttatggggtaaaatgtgatgttttgatacatgtatacattgtggaatgatcatatcatgctaatattaatgtatccattacctcaaatatttatttattttttgtggtgagaacatttaaaatcccattatttcagctattttgaaatatataatattattattaaacaatagtcaccatggtctataatagatcgccagaacctatttctcctaactgaaattttgtatcctttgaccaccatctcccctttccccattcacccacccacctagcctttggtaaccaccattctactctctatttctatgagttcaacttttttagattccacacataaagaagatcatgtctctctgtgcctggcttatttcatttagcataatatctgtgaagtctatctatgttgtcacaaatgacagaatttcctgctttttaaaggccagatagaactccattatgtatatagaccatacttttaaaatccattcatctgttgatggacactccagttgttttcaaaccttggctattgtaaatagtgctgcaagaacataggagtgcagaaatgccttcaacatactgacttcagttcctttggatatatactcagaagtggaattgctggatcatatggtagttcattcatagtttttgaggaatctccatactgttttccaaaatggctatgctaatttacattctcaccaacagcctaccagagctcccttttcttcacaaccttgccaacatttatcttttatctttttgataatagcccttctaacaggtatgaagtgatactgtggttttaatttgcatttctctgatgatttgagatgtggaacattttttcgtagatctgttggacatttgcatgtcttgtttttagaaatgtctattcaaatctttatcccttttctaatacgattattttcttgttattgagtagtttgagtttctgatatattttggatattagccccttcttaaggtatgatttataaatattttctcccaatctgtggatttgctgtgcagaagctttttagtttgatgcaatcccctgtgtctatttttgctttcattgtgctttcagggtcatatccaagaaatttttgcccacatcaatgtcatggaactttgccctggaagacactcttaaaaaatgaatacaacattatgaatacaaaataagatacaaggttcttattgaaaatggctcatgcaagtgagggtcagtctgcccctgaccaacaattgtaggaaatgtagagatagatctgttaagactgtatgagatttgggggaaaatgaagtgcttttgaaagtttggtgctagcttccatctccatagggtctacattttgaaagctctgaaggacaagactgagattggacttatttccagaatgctttaaagagggtagtttgcttcagtaccagtagccccaacatatctcttgaggaggaattttgataagttcaaagcccatgtctcaagagatttccatgctgatgagcataggaccacaattccttgttcacagttaggttatatcctgattcgaacagtccttacctgttccactgtaagtttctctgtagtcaccctacttcctttaggtcacccaaaaggacatgctaggatcttttgcaaagtgttttggttcaaactgaatgaaagcctgcctcgatcaacaggattcttggatgccacctaagggtcttcccactgatttccagaatttattaacatcttctagacattgcttccatatggcatgatcaggagctattttacctgtggcctataagatcagataagcatcttggtcttcacaagtcaatctaaagctttaagcagaatgggactttctcctgccaaagccagatcccttatagctcaaatctactttatccatccttggatagaagctcctattacttgttttatttatatatataacatatatataaaatatctttatttcaaatatcctagtgacaaattagcaaaattttactatatattttcaacatcatctttgataatggccttgttaaattctaagtttggtaatctggtttcaactctctgcttcatttcttactgtgtgaccttgggtgagttacttaacctctctgtgctgcaatttcctaatctaaataaagagactgttaacagtatgtacgttatagaattgtaataattaagtgacctaatgaataaaatgctgttacctgctctacctgacacatataggagtcaacaatgagtgcaatgacaataacagtgatcatgatgtcactccagagttttgtgactgactccttattggtccctatattacctatttattgctatggaacaaattaccccaaaatttagtggcttaaaacaatacacatttatatctcacaatttctgtgtgccgggaattggggagtggcttagttgagtgtctggctcaaggtctttcatgagatttcaattgagttgttggccaagcctttggtcagctgaacacttggctggcactgagggatctgcttctaagagggctcattcatatgctatcagctggaggcctcagttccccactatttctctcttcattgggctgcttgagtgccctcaaaatatggccattagcttcctccagagcaagcaactcaagaaagagcgcaaggaggaaactgtaataccttttatgaccaagtcacacaccatccctactgccatattctatttaatttctgcccacattcaagatgagaggaattagtctctactacattcttttagaaggagtgtcagataattggatgactacatttttaaaccatcaccgtcctcatgggctggttagcctttttctgaaactaattatggcctttattatctttaaccccagttatatataaagtgaaatttaaaacaaatgttggcttgccaagtcctgttaaatttttaattatttttagctcccatttaaatatattctatgaaactttcttcgtctagtacttcctacctcacctcctctttgtctcagttttcgtggggaacgtaagagattgtgtttacccagaagatgttcaatgatagtgtgttactaaaaaaatatgggaatgggagaagtttttctttgctgcacccctgtttttacaccacactccactgagaaaggaagctgaaaagcattgaatttgctgttttttaagaaagtaactaagcaaccactaggatataacattttgtattttaatcgtcagcttacatagctatcttcgcatgagagctgcagcacagcgtagtggctaatggtaccctagtgttcgtgtggattcaaagcctgactccattacctacttcttggctgtgtacctttgggcaaattatttaacctatcttagtttcctatctgaaaaatggggaaggagtcttacccattatcttaggtacttttattaaagttacaagaaaattaaatgatataatatctgtaaagcaatgagaacagactctgacatctaataaacaataaatgtatgttgtttgttattttatgagcagactgaaaactcactgaaatgaatcatagttttttgttttgttttgttttgtttcgtttttgtttttgagacaggctctccctctgttgtccaggctggagtgcagtggcacaatctcagctcactgcaaccttggcctttcgggttcaagcaattctcatgcctcagcctcccaagtagctggaaccacagacataagccaccatgcctggctaattttttttttttttttttttttttttgagatgaagtctcactatgttgcctaggcttgaagccccaggctcaagggatcctcctgcctcagcctcccaaagtgctgagattacagtgtaagccactgtgcccagcctcgaaatgaatcatgtttatctttatctttgcaacctccctcttcccctggcttgcctatcctcacacagatagcacgtaatagattattaatctcatccatctcggaagatcaggagatctggccaggacataatggtcagacaaggtgaggttcagacctgagggtctaaatgagatgagatagtaaaatataaataattggtagagtatagcctgatttacctccatagggaaaggagagagatgggagtgaggagacctggtacaaattccagatcaaaagtataagagtgggcgcaaaaatgagaaatgaggtcgagaaccggaacagatgagaaatggcctgaaatataaactcatcagcttaggcttatggatgagctttatgtcaggagtgaagacaggcccaaatgtccctcaataaacatatggatcaagcaatggacaccaaagacaaacattgacatgcaccagataatcaatacataacaggtttctacttactggttattggcattctaaggaactttaaaaagggtaaatctgtttaatatattcttttttgttttcttcattagatcccctcagcagagtgtgtttaagaccaaaaaatgtaaccgattcattgagcacctacattaatgctaattatattagggtaagtaaataagtacaaatttctttctggtgacttcctatttggaattgttggttttattttctttttcctagagtagattaagcttggtttaacttgattaccagcaagatttcattttgtttggttttttatcttagtcataatcaacattgttaatgggtcttttatgatgactttcctttcactgtgagtctctggcaacagtgctctatatgggtactctgctggggactgggcattacaaccctcagtaccatgtgctatccttaacttgctgccaaaatacccatggaaattgttgtactagagtcagtgaagccgtaacctgtgttgcttttgtactagcccagctatttcgttgaagatctttcacctacactttcactgcaaggcatgaacttaaaaaccaatatttttgtttctttactccatctagggctacagtggcaaggagaaagccttcattgccacgcagggccccatgatcaacaccgtggatgatttctggcagatggtttggcaggaagacagccctgtgattgttatgatcacaaaactcaaagaaaaaaatgaggtatgatctttaatcaagttctgaatgttatatgtgttctgttgctatagaagagatactgtgttagtaaaattgccatggacttagatttaagatggaaactctgagacatttaaaggctaagtcacttaatacatcccaaatataataagtgctattatcctatgaatgtcaactttctttcagacaagtcaatatacttggcatatacatatctaatttgtacccacaaaagaaataaggggccatgaattatcaccctaatttataagcagataaataaaaccttattcattcacacccaagtcatttttgaacacctactatgtgacaggtactactgtagtcattggggatacaatagtaaacaaaacacaccaagatccctgcccttggtagattttaactttctagtgggagaagacagacaaacaacactacacataataaacttataaatagtgtaatatatgagaagagattaaatgctataggaaagaaagtagagcaggctaagtggaatgggtataccaggcagtaaggagggggtgatggggaattgcagattacatttaataatgcaaagagggtgggcaaggtgagcctcattaagaaaacgagatttgaggacagttacagaaaccaatcaactttctcaatatcttcataataagaaatccaagaaagacagaatttgatttcatttccatactagtagtcttttctaaggatttagcttgcagaatacttattctgtattttgcattataaaaatacaattgtaatattcctgagggctgatatccgaggtaccgctttcattttaggacaacttactgggattatttacagtctaattttaatcagcatttcagtgtttgttttcttgtcaaaaatattgtaccagggcttcaccatgacagtaagaatttaagaaaactaagcattcctttataagcctttggtgattataatccttgagtacagcataatcctgctgctaatggacatcatctaggctcacaaaacagcaatttatatgtgttttaaagtttgtgattttcttatatttttgctacaatagataaaactttttttcctgaactatattctggaaaaatagcatatttttggccagtagataaggttatatactcaattcactacatggcttactaactaaacacactatattctggaaaaatagcatatttttggccagtagataaggttatatactcaattcactacatggcttactaactaaacacacttctatgaatctgatattaaagcctgaggtggcattataaaaataacccctaatattctcagctgtttcccacacagtgtcaatctatcaacatattaagccactgacaattccttcacagttgtttaatatgcatgacatttttatgatagaaaagatttttcaagtttaagaggtgtattctctgtatgtgtacatttgtgcattcctacatagaacttatgtaatacagcagactagataacctgaaaaacctctcactacaaaaccagttacactgtgcagaatatgaaacagcatgcaaagaagagctttgaaaaaaagtaaaggaaatcccagtgcttaataaaaagagactaaaaggcataaaaccagaaaattaaacatattgtaatggtaatacaagaactggagacaaagcctgatcttgcaggagccaggtgttggaactgagaccttacataaagtgagcaccttcaaaggtaacacctccagtaaaaaagtgaacaacggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaagtgaacaacaaaaataaatctgcctactaatataggatgatgctaagaaattcgcctaagtctggccttcttatggtataaacgaaaaggctctcttgagtatttaaagctgagaaatcacagaattcaaaaatcaagaaacaccaagtgaagtcattaacataaaaagtaatactaggttggtaacgccctatgatactttacagaaacgaaggcaaaaactttctgatgcacatactctcagcatatacctcacagatttccatagaaaagcccagccagggcaaagcaagagagccgactagagaagccgaatgctcatacttcccaccaaaaaaaagagccaaaacaacaaataagaaagtatgtttgaactggagtgtttgagggagcacactggaatacagtaggagagagacagaaatcctgtgagacaaggagacctttagtgagggtcacatagagaagagaatgaagcactctgcctctgccacaccgccatctccccagccagtattagctcagaacaaggagatgcatccccagtggggactaggcaagcaagaggccccagcagcccccattaatgtcacagacatctgcactctttgttgctgagaatcctgcagtttctacagaccctgagtccagtttagggagctgcctgacagccacatggctgcaatgccccagagaaggagcccacattgtatcccctcatccctgtgattcaagctgcagctatatgatgccattttgaaaccagagccacaactagagtacatcctgttccaggggccagtagccaccatctcttttcattcctaaggctacactgccattacactaccttcacacacagtagtacaccattcccttgctgagttgctacagctccctaccccctgggaacaagctcctaggaggtgttccacctttcacatcctagtgactgcagcaccctgaaccctgtctctcagagcctagatccagtgccccatccatgaagcccatatagcaccttgccctcaaaggaacagacaatcttgatcagcagagaaaccaagtccaaactggcctcatgcgcagtcagcatgctcaccagcgaatgcaccattccaaagcgagtcccacccaaaccagtggaccagcccctgcatgtccctggtgcactcaacagttgggtgcactacttctaaggatgccccaacctgagctggcagacctgtccgcatataccaccagtaagctcaccagctgggcatgtcattttcaggggacttctgctctgagttggcaagccaagccccatgcttgccagccaagtacactgcccccagagaatccctaacccaagctggcagactggctgctgcatgctcaccagccatgtatgcatctcacagcgggtccccaccttaaccagtggatttgttcttgtgctcaccagccaagtgtgctgtttccaggggtgacctgtcctgagccagcaaactagccacaccaaggccttcagaggttatcaataaagttgactacagcttaaaaacctgcagagactacactactgcacacacatagagcaaaagccaatgtaccctacccaaccaataccctcagacacatctgctggtgaaagtcattcccttcaaaagtcactccataaaattaaaagagttgaccattccatcagatgcacaaatatcaatacagggatacaagatacatgaaaaagcaaagaaacatgacaccatcaaagaagcagaagaatcctccagtaactgacccctaaagaaatggaaatttataaattgcctgaaaaggaatttaaaataatgacctgaaggaaattatgaattgtggatgggggaagggaaagtctagaatatttgtatgtgaccaaagttaagttgttatcagcttaaaatattctaagttctttttacataagccccagaataaccacaaagaaaaaaattacagcagatacacaaatcaaaaagagaaatgaatcaaagcttatcactatggaaaaccaccaagtcacaaagggaaacaataaaagtagaagaaagaaacaaagtatctagaaaacagttaacaaaatggcaggagtaagttcttacctgtcagtaataatcttgaatggaaatagattaaattttccaattaaaagatatagagtggccaaatgggggaaagaaaaaaacgcaagactcacctatatgacgtctataagaaactcacttcacatgtaaagacatatagactgaaagtgaagggatgaaaaattgatatcacatgcaaatggaaactaaaagagaccaggagtagcttcacttataccagataaaatagacttcaaatcaaaaatcacaaaaaagcacaaagaagatcattatataatgatacatgggttaattcaacaaaaaaaaaattgtaaatatgtatgcacctaacactagagtacccaaatataaagagcaattatttattagattaaagaaagagatagactgctatatagtaataatcatgaacttcaacttcaacaccccactctcagcaatggacagatcatccagacagaaaataaacaaacattggatttaaaccacacaatagaccaattggacctaacagatatttacagaatatttcacccaacaactgcagaatacacgtttttcttaacagcacaagacaagccttaacaaattttaaaagatcaaaatcattttaaatatgttttctgaccacaatgttataaaactagaaatcaacaacaggaagaaattcagaaactttacaaatattgtttaatgaaaattaaacaatatgctcctaaacaaccaatggatcaatgaagacattaaaagggacacttaaaaattccttgagacaaatagaaagacagcatatcaaagtctttggaatacagaaaaagctgttctaaaagagaagtttatatcaataaatgcttacatttgttgaaatgtaagtgaaagatgataacttaatgacacacctcaaggaactagaaaaacaagaacaggctgggcagcgtggcttacgcttgtaatcccagcactttgggaggccgaggcaggcagatcacttgaggtcaggagttcgagaccagcctggccaacatggtgaaaccctgtctctactaaaaatacaaaaattaactgggcctggtggtacacacctgtaatctcaggtactcgggaggctgaggcaaaagaatcaattgaactaaggagacagaggttgcagtgagctgagatcatgccactgcactccatcttgggcagttgggagacagagagagagactccatctcaaaaaataaaaaaggacaagaacaaattaaacccaaaattagtagaaggaagtaaataagaaagatcaaagcagaaataaatgaaatacagacagaaaaatacaaaacatcaataaaaagaaaagatcatgtttgaaaacataaaactgacaaaactttagatgccacagaaatgcaaagaattataaaagactatggtgaacaatactacacgaacaaattggataatctaaaaaaaaatgaataaattcctggacacatgcaaccttccaagattgaacaatgaagaaatagaaaatctgaaaacgctaatgagtgaggaaattaaatcagtaacagaacctatcctggccgggtgctgtggctcacgcctgtaaccccagcactttggcaggccgaggcagccagatcacctgaggttgggagttccacaccagcccagccaacatggtgaaaccctgtctctactaaaaatacaaaaattagctgggcttggtggtgcgtgcctataatcccagctacctgggaagctgaggcaggagaatcacttgaacccgggactgggaggttgcagtgagccaagatcatgccactgtactccagcctgggtgacagagtgcaactccatctcaaaaaaaaaagtatcccattgaagacaaaacccaggacctgatggcttcaccaatgaattctaccaaacatttaaagaataccaattctcctcaaactattcaagaaaattaaagaggagagaacatatccaaactcattctacaaggccagcattaccctagcacccaaaccagacaaggactcaaccaaaaaagaaactacaggtcactctgatatacatgcaaaaatgctcataaaatattagtaaaccattagtaaaaatcaatagcacattaaaaacatcatccgctatgatcaagggaattcatcccagggatgcaagaatggttcagtttacacaaactaataaatatgatacatcacgttaacagaatgaaggataaaatccatatcatcatttcaatagacgaagaaaaataatttgacaaaattcatcccttcatgataagaactgtcaacaaattagatacagaaagtatgtacctcaacactaaaaagtccatatatgacaagcccacaacaaacatcatattgaatgtggaaaagttgaaagcttttctcctaagatctgggataaggatatccactttcaccacttctattcaacatagtactgggggtcctagccagagtaatcaggcaagagaaagaaataaaaggcaaaatcggaaaggaaggcgtcaaactatccctgcttgcagatcatatgatcatatatatggaaaaccctaaagactgcaccaaaacttgttagaactaatagacaaatttagtaaagttcaaggatacagatttaacattcaaaaatcagtagcatttgtatatgctaatggtgagctagctaaaaacaaaatcaagaaaacaattccatttacaattgctaccaataaatagagatacctaaaaataaatctaaccaaagaggtgaaatatcttttatactgaaaactataaatcattgatgaaggaaattgtagagaacacaaataaacagaaatatatcctgtgttcatggagtggaataattaatattgttaaaatgtccatactacgctaaacaatcaatagattcaatgcattccctatcaaaataccaataacattcttcatggaaaaaaatttttaatcctaaaatttgtatgaagcgacaaaagatcttgactagccaaatcattcttgagacaaaaaaaaaaaaaaagctggaggcatcatactacctgacttcaaaatataccccaaagttacagtatcgaaagcaacatgatattggcaaaaaaaacaaatacatagaccaatggaatggaatatggaacatagagcccagaaataagaaaggattttgaatattctcactacaaacaacaaataataaatgtttgcagtgatggatatactgattgcctttatttgatcattaacccatatatacatgcactgaagtatcacattaatatgaatatgtacaattctgtgtcaattaaaataaaattaaaaaactctcagcaaacataagcctacaatcaaaattatgaggcatacaagcaaccaataaaaaccatgagaaaaaatcagaagcagcaacaattaaatagattcacataaattaaaataactgaaataataaatgtaggctactcttttaaataattaagcacaaaaagcataaaaaatttgacacaggaacaagttactatccaaaaaggctatgaagatttaaaacaacaaatactagaaataaacattataaagacattaaagtttaaaaaaatcttattagataggtttagcatcaaacaagacacagctaaatgaataactaatggattcaaatataaagctaaggaaaatacctagaagatcaaaatgacaaaaaaataaaaaagagtgtctaagagacatagaggatagtatttgatatccaatataccataacaggtgttttagaaggagaaagaagaggatatgagaaaagaagtaatatttgaagaaataatagatagggattttccaaaactgatggaagacttgagttcaaaaatctaaaaagcacaataaatcctaggctgaataggtaaatgtaaatcacagctagacacatctctggaactgaaaaagcaccaaagaaagtaattactcccaccagagtaactaaccaaaaaaaaaaaggcttttctatagcaaaactagaagccaaaaatcagtagaatattacctacaaagaactgaaataaaatacttgactacccagaactttatacccaacaaatctatcctacagggccaggtgtgaaagacattttcaaactaacaaaaatggtaagaattcaccaccaaaaaaaatcttaccaaaacaactacaagggaggataaaacagaatgaagaagaattcaatccagaaaaaaagtactcaaatacaagaaataatagtgagcaaagaaagtaaaatatgaaggtgaaactaaaatactggataatgatagtatttaaaatttgagaagatgaggaaagttaaaatatttctgtgttattcacgaaaagagaaatataagccaaggttagacttttaggtaaatatgcatgttcaaattttaagattagccactaaaaggatggaattagaatgtataatttccaatctggtagaagagagaaaagacagaatttcgaaaataaaccaaaataaaagggaaaacaaaaggtaatatagaaaaatcaggataaacttttacctaattgggagatagaaaaaaatccaaatcatactaaatataaacaaataacttgcaaattaaatatcagagattaccaaactgataaaataaataaattcagttaaatgctgcctacaagaggacacagaaatgttaaaatggaaaggatggaaaaaaatacaccaaactaatactaatcaaaagtcaagttagataaaactgactctcaaaagaataattctcaaaagaatattctcaaaagaataattactagagaggttaccagagataaagaatgtcagatgaaaatgaatttcaaatcaaaacaatcattatcagagagcttactagagataaggaatgtcaatctataacactaaaatgtgaaattcacaagtaagattctaaatatataaatgcataatatacataacctccccccaaatatctgaagcattaatgggcagaattaaagaaggaattgataaatcaccatcacactgggagaaaacccaataaaaatcagatattagtatttattaagcagacaaaaaataaaaatatagaaaaagtttatacataacctttattcaaattagcaagcttagtttaagaaagatatatagaaccttccaatcaataatctcataatataaattttcaaagcatgagattttgtgaaaagtgaccaactacgactatatagcaagtcttggcaaatttccaggaataactgtacatatatgcttcgattacagtgcattaagttagaaataaaaagcagaaagataagattaaaaaatacactttgatgcttaaaaaaagttttaacacacacacaattcatggatgaaaatgaatttataatataactgtaaattacctgcaattcagggatgatgcaaatactacacatcaaatcttgtgagatgctgctaaaaatgctcatagaaggaagtttataggcatgaatatgatattataaaagaatttgtgatctaagcaacagacttaagttagtaaaagaactataaaatgaacaggagagaaaaaaggaaggaataatgaagaataaatgttaaacataaaacaaagataaaaggattgatgaggccaggcatggtggctcatttctgtaatcccagcactttgggaggctgagtcaggaagattgcttgaggccaggagtttgagaccagcctagacaatgtaatgagacttatatctcaacaaaaaatttaaaaattagccaggggtggtggtgcgcacctgttgtcttagctactcagaaggctgaggcaaaaggatccctggagcccagaagattgaggttgtggtgagttatgattgggctactctgcacttcagcctggccaacaaaatgagaccctgccttaaaaaaaatttttaaaaaggattgatgtaaacaaaagtcaattttttgaagtctaataaaataggcaaaactagcagaattaaaggaaatgcaaaaaaaaccattaaaaatgactataattaaagcagagatttaaataaaagaggacactatgaacaacttcatgcaatatttagcaccatttcgtagatctgagcaaaatgccttacccctgcccactttggtttgaattttctgagtaaattgtcataaaataaatattatttcaaagtgcattcatgcccttaaatatttcttattatttctatttcttcttctattacaaataaaatcttataaaatcaacatagcaccataatttatgaaactatttgtaaatataagtatgtaaatgttttaaaacaaataatattttccccagaaaaattacttacttattacatgcaatttagtgttgcatatgtactaaggattaacacttggcaaatgatatgtgaaacaatatctcacaaggattacagaatacattgtaataactgtgtaagatacattacggtgtttgttcttttgagcatttcaatctttgaatcttgtaatgtatgtttatctgtgttcactcttatagaaaaagtcaggaatgtgcctttagtgctttacctcattcttgaatcagggttttagcaggacagaaactaagattgctggttaggcagaagacatttcctagagggtgtgtaatatgtgacatattttaaagaaatccaatagggatgatgtgagcaattattaatatgccaaagccccagcagacggttgctctcatcctccttctccaagaccaaggatgtcattgtaccagaactgctgtataagtcaaatatatatttctttctttctttcttttttttttttttttttgctttggcccgacgtatttattgaagagagctctatccttctcccttctacctagaagaggaggcttacagggctggcacctgcccacacctggcattcgacatttccctgggctaagctgagtgggagcagatgcccccatcctatgaccagggcctgtgcaggagccatcacaccaccttgctgatgatgacacctagttcttcaatttcacactggacttcatctcccttcttgagaaagacagaaggtttcctgaatacaccaacacctggggaggtcccagtcaggatgacatcccctgggtaaaaggtgacaaactgggagacccacgctatccgctcctctgtcttgaccaccatctggttggtgttgttgctctggaccacttccccattcacttggcagcaggtctttaagatgtgtgcatctgctacactgtccttggtcaccaaggcaaggcccagagggtagaaggtgttgaaggtttttcccagcagccactgtttcccatcatgtctcatttgccagtcatgagcactcacgttatgagccgcagtgaagccagccacatgggccatggcatctgtggccttgatgtgcttgcctttctttccaatgaccacagctgctccacttcccagtctacctcctggctctctgatgggaggaccatctcatcatagggctccacaatggagttggcaaacttgctgaagttgatcggttccgtgggcacgggcacattctgttctttgcagtggtccacataattcatgcccacacacaccaccttatctggccatgtggctggagccagggaggtcacttccaaccatggtaggactggcaactgggcacccaaggctcttcttgccactgagaggatggcctctccctgctctaggaactgtgtcatcattttggggagcatagagtcaaaggcattgaggttgataacccttccaccattctccatctctgggcccaagtgaggccccaccaggtggggtgcctggaactggactagtctcatgtctctggagggttgaaagggccacttctgagcctgcagcagagctgtgagcaaccttcttctaccagagaccagcatcagagcctggcggcggtggctggtcctcctgcgctgggttagtgcttgtggggccagaggtcaaggacagcaggtgcctgagcactggcaccaatgactgcagctagccggggaactgcatgcagcagcctcaaatatgtatttcagagtgacacagagttggtttacctatgatgctcagagctctccattcagtatctgcaagggaataaagcgtatcttgttctttctttctcaagtgcagtaattgtcctcagagataacctgttgttaccattctcagatttcagtctttacaggagagccaaatggatctgtggaaagctagaattttttttaacaattcctacaccaatgggtggttgaagttttaatttttttctttgaccacataattcagaaattggagaaatgatttttgtttgcgtgttacaatttttagcctcctgtcttttttaatgtctgagatataccttctggggatatcaaagtcaaacatttatgttatatgtcttttatgtgtaatctgctttgtgctttttttccctacagccagtcataatcccaaatattacaataaaaattttgttattttttattattcattactctttaaaataaaaatttctgtctagactctccaaagacgtaaatataatacaatacaggaaacgctgatgttttacagatcaaaatgatactgagaagtctggcacaaaagaaatacacagtagacttcacactaccaggaaaattctgtttaccaaaaatgtgccaactttcaattgtgttaagcgtcattgtttggaaaagacaaaaatcatttcctccaaaaaacatatggagatggagttatctttagaaattcccaggctttatagtttcatgcaactttctactttctagcaaataaataaatgaataattgccatctcttatttaataactccaatattctcatgacctcaatgtttataaaatgaaaataaattaaaaatgaaaatatacatagctgaaaaaacagttaagttgcaattaaagagattttattgctggtaagtttgagttccttcatttagataaatctcaagagaaagggaattcctcttcagagaaggaaacattgaaatgacagtgttcaaattccactgctagagaagacatagtggcttaaacctataaagctggaactgcaagagcaatccaaaatggcaagtagtttttgcacacttccagcgaaacaaagcccccatactacttctggaagttacttactgcatttctctcccctttcagaaaagaagggaagtaggtatacatgttgaccatattacatacacagtggaagatgttttctagccactaccatttattgatcatatgtgctaagcacaatttgaacacacataaattcagtttattttcctctaactctacaaagtaggttttactattcctatattataaatgagaaaaccaaagctcagagagaatgagagcctcaaagttagtgagttgatggagtccaaatttcaatccaggcttgtttaattccaaagcccaggcacttaatcattgccccaacattataaggagccaaataaagaattaagacattagaaggcaagcaacccacttttggtcccaaagagcaataagaccctgaacctatctttcatgaagtgaaggaattactggataatttggcctaacacactgctctcagtttaacacagctgtactctttctctacatttacatgcatctttcatctgagttaaactacttgacttaagtactctaagccccattttgcccattgacttattcagtactttgcaaacggttcaatctcaaaaagccacataaggagccatatattaactttttccttctttcattctcttcccttttctatctgctaaaattatagaaaatattcattttaattacacatgtttggccagaaagctcatatgatacctatgggtctgaaaagtgagtaggtgcccaagggggagacatttaaaagatgttccattgtaatcccagcacttcagaaaaccaaggtgaaaggatcacttgtggccaggaattcgagaccagcctgggcaacataaggataccttgtctctacaaatgaaatttttttttaattagccattgccatgataggaataaataaacaagccaggcatggtggtgtacaaatgtagccccagctacttgaaaggcagagaccagaggatcgcttgagcccaggagtttgaggatgcggtaagctatgatcgtgccactgcactccagcctggctgacagtgtgcaagcttgtgtgtgtgtgtgtgtgtgtgtgtgtgtgtataacatatatatatatggcttgtgtgtatatatatagcttatatatatatatagctcgtatatatatacacacacacacatagcttgtgtgtatatatatatatataaatagcatatatatataaaatagctttggaagatatatttaagtgttccagcagtagaaaccacagtgcttagtttctcatcgaatgggagtaagtgagagcttgacttcaggacttctggtttgggaggttgagtggatgtgatatcagtttcatctttaacctgttaagtttgataaatgttggagacttctggctggtaaagtcttttaagtctattaagcagttagaaataagggtactctggagaaatgcacaggtgagagagatcagatgtcatgagaaggtacagcattggtgtaaagacaataaaagagggtattgtattatgatgtatattctgcttttaacattatgagtattctccatgtcattaataattcatcaaaatgttaaattactagaatttcattgtgtggatgtgctaaaatgtaatcatttccttattgataggtacttaaattgtttccaatttattgtccacaaaaaccttaagacctcattaagtcaaattgcagctaccatatatgtctttgattaattaaatacattccaagaaagtttttttggaaatataaatattgactaagcaactgagcacagcccatgtttgcctttacaaaagagtttctttatttaaatttttatttttaattttgtgggtatgtagtaagtatacattaatggagtacattgccttaaatttcattataaaatcagatgtgcattcattcagatagaaagattggctactcaatagatatgtaaattttactttaaaataaagtggactttattaaactatatgtttgaggagaaaataaattattctggtaagatactaataagaaaatgttaagtgtgccatgttaaattctaaatgcataaaatgaaaatatatcttctctatcatttataattagcttaaaaagtagagtaaaaggtaatctagaaggttcaacaaatatacatggaaagctcagaaattggactgttggatcttctgaagaacaactgtttatggagcactaacagtgtgcttgaaaattaatctttatagtaaacatatttgtaaaccccattacaaatgagaacactgaggcacaggaaggcaacttgcccaaagccaaacagctgactcccaagctgctgctgctcctcctcctcctcctcttcctcctcttcttcatccttatcctcctccctcctcttccttatcctcctctcctcctcttccttctcttcctcctcctcaccattacactatgctgctgcctggaatccacttatggtgggaaaggatagtctacagtgcaagaagtgattgcatccagaaagtggtatgtatgattgcttacattcaaggttagaaatctataaccattctcttttggaagaggagatagacaagacattttgatcaggttttaaaaaaaacgttgaatctgtttattcaaactagtggacaattttgaaagtgtggactaggattatgagggagaagtcatcctcaatttgcagatcactgtggagtagactaaaggattcatgctttgaaaatgaatgaaaagaaacgagcaaaccaagtcccacaaccagagggtctatccaaacaaggtcagagaaggtattattgtgggagtccaacctagcaagcaagcagaagagagtccctttctggtattcagctttcctttggaggatcagaattagatattatgaatgctgtcgctggtcaactggattcatgagcataaattggagtcacaagataaattaggatctcatgcaggactttgcttatgaaacacgaatccattcaagatagattcaacaggaagcaaagagaccaaagccaccacaagcatgaccaaggccacctagcctctgacttagggccatcatgttggtggagaggcaacctggccaccactgtccagcagtgacaggcagcctaatttcatttcatgggtaaccagggggttgatgggtatgctgaccaagcaattaagggtggctagaaattcagatgctgactgcgcccaaacaaaattactctcctgtccttccaggcatgcatatattccaaatctaactttgcaccttaatgtttaatccacagtgttatgtttaaactgcattagcctgctttacttccaactatagttagaagccctcttgtttaacacagttaatcagccaggcacggtggctcatgcctgcaatcctagcactttgggaggccaaggcaggaggatcacgacgtcaggagatcgagactatcctggctaacacggtgaaactccgtctctactaaaaaatacaaaaaattagccaggcatggtggcgggcgcctgtagtcccagctactcgggaggctgaggcaggagaatggggtgaacctgggaggcggagcttgcagtgagccaagatcgtgccactgcactccagcctgagtgacagagcgagactccgtctcaaaaaaaaaaaaaaaaaaaaaaaaaaaaaaaaaaaaccggaaaaacacacagttaatcaaaaatggtcaatgtgagaatcataaaaaaagtattttattttaaaacatgtacatttgttcatattcaaatgtgtttgtttattatggggttcagtcttatgagtgttggtctgaagatggagttctagatcatatagtttatgtcaatcacattgtttatatattatcaaaattttccattttagtttatttaaaatgaaagagaaaatagaaaagcctatgaaacaatataaatgcagttttctatttagattttttaacttagagacaaatttctgtcattgtctcacctgtccctgatttgactgtagttttctttactggtttacttttttcaccagtgaaaaacttacgcaacttattcaattatctcataaagctcttttctcttttaaacctcatattttattgatttctgtaatatgtaattaaattactggacttcaataataagtacacctgccataaaggtgttttggtataaaaacaacttgaggaacacagagatcaaaagatggtaacagaagtactgagctcagtaggagagtgaaccaagactatgcaaggttgcatgtgcctcaacatatttgacagagggaacaggtcattggtcaatgctgtggttaagtagcattggttaagagtcagtgtggaaatcaaagatggaaagtttcattcataaagtgatattttcttggaaaattctagccccccaaggcaattttcccctaccaaaacacctgagccttcatgtcctcatctgaaaaataatttaaataataataatacctgctacccaccctacctacttcaaaggattgtggaaggggctaaatgatatgatgttggtgaaggtacttaaatctctgagcctatgtcagtaatattccatcggagcaccaggaataaaagtagctatagtaataataattttagacaacctgacccattctatccctctcatgtattaatataacccaaatgaagctaagtatgaagattttatttacttagagccacattctatgtgatgatacagatctttagcttatagagcaatatctctgatatttaaatatatagaaactaaaaagaaaataacttaaaaataggtttttttttttcaggcaactaaacaactagctagaccgcctcctcacatagccctaacttggtgggggccagaaggagaatcaagggaagaaaaaagatcacaaaaatatgagctggcggccgggcgcagtggctcacgcctataatcccaggactttgggaggccaaggtgggcagatcacctgaggtcaggagttcaagaccagtctggccaacatggtgaaaccccgtctctactaaaaatacaaaaattagctgggcgtgatggtgcacacctgtaatctcagctacttgggaggctgaggcgggagaatcgcttgaacccgggaggtggaggttgcagtaagctgacattgtgccactgcactccaacctgagtgatagaatgagactccatcccaaaaaaaaaaaaaaaaaaaaaaaaaaaaaaaaaagaatttgcattgctttgtgttacatcctacttttgctgtaaaccaccagttacaaagcactggttaatgtccagaatcttttcagtcagagtttgataataacttgtttgcacaagagacactgtcctctggaaacctatttttttcttccaaattatggattcttagaattaatagataattttactgaaaggataagcctagctagcaaaagaatagtgatgatttggggttatattctgctaaatagcatgctattttgaatcacctacaattagtgtggtttcacagtattatctgtaaggcagcatttttcttccctgccttttctgcctcttttatctcattgttagcaccacaataaagaaaccctaaaaagctgtacaggaaaataatttgaacatgaacttgtactcttagaaacaactgcatttgcagctgtcccccacctcatattcaaaagtacccacacttatctggtctctttttctgtcatctaaatgagggaaaaatgtattcagtgtgtaaaaataagctattgtatctcagaaaggagatgggatgctaattaagggttgtttgaatgaacaagtcacattgcattgtctactgggagctgactgccaattgcttttttggtaacgagtcaaaaaaaacattcaagagggcccccggcaagcttgggagagaagcgagcagcatttccatttatcaagtaggtgcagaagcctgtgcaagtattaagagtcagggtgcaggcggcaagctcctgctttgcagcttttcttactggttttgagagccaccttcctaaagagggccctgctgctcaggtctgatcgtggacaatggggcacgtacgccagactgctggactactgaatgaatgcctctttctttgttcaataccttttccaagattctttgtcattcttcttggactcatcgggaggcatgggttttaagatacacagtagctcgggtcttacagcgaaataattgatgcttcattgaaagaaaccaggcaaattggtttgtatgattacctttaacaaagtgggaaaattttagacatttggcaactcatagatttcgagagaaatgagttgctctactttaaaaaggtttcttctcttaatgttaacattaagtcagccagagtaagtcttttggtctgatagcctgagagtctcaggtggcatgtaaataaagctgaaacaatttacttcatttagaaaaagggtcaaaatgtagaggatgtaaatgtgtttttattgtaatggatgaaagaaactgattctgctaggtgaagtgacttccttcgctgtgctagcttgtagagtagtggtacttagcataatagagccctggaggtgtgtttctgatactttgtgtcacttttccttcagttctataattttgtgagtcttttgctgctcttttaaatctataagtatttaaatttttatcaagtgtattcatatgcctttgacaaagatgtgaagaaacaagtgtcctgggtattaaaaggttctgattgaaggcaacaaatgaaagaatttctatgtaaatgtatgtatggttgggagaaaataagtgctatttaaacatttctaaaattaacattgcttccaagagcactcaaaataaaacataaacatttgtcattttacattctttatcatcaaaatttgtggtaaaaaatagttattttacagttgtttaaaaagcaaaatgagattatatgtatgcttgaatctcattttgcaatttttatttaataatgataactgactataataataccaaaataatatttaatgcatgaagatctaatcactttgggccaaaaacctatcacccagtagttttaaaataacaacagcaataataacatgttgtaagtgcttactctatgcctggctttatcctaagtactttccagatagccaataataaagaaactataaccaaagggtttaagtatcttgttcgtggattcacaggtaatgaatggtagaaccaaaatttggactcaggttccgagttcaaagcctgcgccttaaccaccatgctatgttgccttgcttgcagtataattattgtcactcttttaaagctcctcaggaggatccattataaaaatatttttaacgtaatttttgtaaattagttccataagtgaaaaaaactgttggtccgggaaaatataataccatagttgtattaatgatcattatatctgccttacatataaaggaaacttggttgtatgccacctaacatattagatattctcattagacataagtttgttgaagcaggaaaatgtaactttcctcaattattgtgggaaaacattcttttatttctagtcagcacatgataaattctaatatttggatctcaatttcttaactcttaaatttcttaacttcttaattagttcttaatttctctgaggagttttgggtaattctgccttttttttttgtatggagccagcagtgacagtgtttaataggcacatatgaaactgatactttaaaaaaaactgttgagatataatttatataccataaaatctagctgcttaagatttacaattcaatggttttagtatatttacaaaactataaaaattgatatttgatattttaaaactaatgatataaaactcttgagatgcttgaatgaaaagtactccatggctaataaaagccattaatatttgctgtattctctttcccttcctccagaaatgtgtgctatactggccggaaaagagagggatatatggaaaagttgaggttctggttatcagtgtaaatgaatgtgataactacaccattcgaaaccttgtcttaaaggtaagattatgtagctatagccatctacaaagtagatgatgttagaggattacatttctactttgaaattatttaagtactacaaatgcaatttaagcaaattaaataatgttaagatcaaagagaaactataatcattccctcatgtattttttgttgtcaactactattaatatgcagtataattaaatgaatgtaagtagacattaagaaaattcattatgtaggatgttgtgatcctctaatttgcgttaataaaatatctctgatttaaccttttgaaagcttttaactaaaggctgtgctggagactttaccatgattttttttaatgtcattttgatctaagcagctttgcgtaaggcctggaagctgtgaaagagaaaatctgcatttgtgggtggcagtgggaagcaaggcaagcctgaagtgttgatgagatcttcagaagcgtggagttacagtaatttatagggactttccccagacgagattatgtcataggaaaactatcttatttaactcatgggcagcagatgctgagaaatgttaccatggtattatttttgcttctggagaataatcacccaaaaatttcgatcttatctgcagcctcactgctgggatagaatcatcacaaagaggaagaaaacaggggcagagctacagtgatggcttttgttgggaagtttggaataggaaggcgtttaccaaaacctgtttttcaacacatgttctggagtgccggggaagtttggaataggaaggcatttaccaaaacttatttttcaacacatgttctggagtgcgaggttcatgccacaccctcacccgtgctgggtttggagatgaggtgtgtgggccctcacccaagtgtttccaatagagggatctcatgtagcttctttattgctgtgattcctcactcctattaaatactggagttttggatgagtgtagaagtattagcatgactgatatgaaattaagtgttctattgattaacatgtttataataacttgtcaggaatgctcatagagcaggaaacaaaatatatctcattctttcttggctacattttcacctaccatcttgtttattataataaattataaatatatatttagcatatgttacttatatgatctatattataactataggtagagatgtaaatctcaacaaaggtatgactttctcactttgcaaacaggttactgacagtaaagtcttctcaaagtaaaagggcactcttcaaaaatcttctaaatttttttcccacctagaaataaattgccagcaagatgggggtgataaaaggcattcagtattgtggtttggatgacttttagttctacaagtgaatgaggcatttggtggctgttgctattttcagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcaggtaagacgtgtatggtcctttctgtctaagcaatggcccattctttgtaaagtcacagagcaggtgcaagtgggttttgcttcctggatgtgactttgttggcaaattaaatatttattgaaattggttaagtctgtaatatttgagtctgaatcaagattatgctgacagaagtgaagtcatgcttttaggtcatttttcacaaacaacaattacacagtcggcgaaatacaagttcgtaataaatggctcagtgaacaggagacctattcagcagttatctgctttgaaacttatattgattgatttagtctcatcagtcttgtacacaccaggaataaagatgcactttttgaaattatcagtggcttttttgttgtttcaacatgacatgtgaactctgcttggcttgtatcttggtaacattactatttcaagtttggtgaaaaccagtcaattattttaagagttatctccagaaaaacaggttgaaacaaatttatgaaatgagaagtgagcaagtcaccaaaggaaaacaaagtgctgttaccagaacatggagcactagaggccaagccaacaacagcagcagggtctgtgctggttcctgtccctaatttctagttcaaagctctcttcctaaaactgatacctccttcccctaattttccttttaatgtaaccaaactgaaggcagcatttttaaagtaatttatatgaacaactatttatttatttatttatttatttatttatttatttattatgagacagagtctcactctatcacccaggctggagtgcagtggcgctatctcggctcactgcaacctccgcctccttggctcaagtgattcccctgcctcagcctccaaagtagctggaattacaggcatgcaccaccacgcctggctaatttttatatttttagtagaggcgggggtttcaccatgttggccaggctggtctcaaactcctgacttcaaacgtgatccacctgtcttggcctcccaaagtgctgggattacaagtgtgagctaccatgcccagccagccatttattcttcatgctttctcaaaataatttgggttgctttgtttaaccgcataggtctcttaagtcagcttttgatgatatatttaataaatatattattttagagtataattttagcctccttttttgagattgtgtggtttaattaagagtaaagtttactatgtgtctatttatccaaaggtagataatactggctttatcctaaacttaacttggagccaaaaaaacaaaaacaaaaaaacagcctaactgactatgcgttagggctggaactgtcccccacccaaagtcattaaacactcaggatatctaaaatgaactagtcacttcccctataaaaccagctccccttctgattactatttctgagaatgagactatcttttttccagtcactcaggatcccatgttgacagttatctctggtcctccttttaactccaacatcagtatctaatcagtcactagattggctttcccttcaaagcttctcccataatcaccatttcctgtccagccaccatagttcaggcccttctgacctcatccatgtattttagaagtagctggtaaaatgcacacacataccgcattcccccatgctctcaccgccaccatggcctacctgtgccctttctccgtctcaccttacatggagtctctgctcaaagcttgtcaatgggccaggtgcggtagctcacacctgcaatcctagcactttgggtaggccgaggcaggcagatcacttgaggtcaggagttcaagtccagcctggccaatatgatgaaacgccctctctactaaaaatacaaaaattagccaggcgtggtggaatgtgcctgtactcctagctacttgggaggcggaggcaggagaatcgcttgaaccgaggaggcagaggttgcagtgagtcaagatcccgccactgtatttcagcagcctgtgcgacagagaaagactctgtcttataaaaaaaaaaaaaaaaaaaaaaaaaaaaaaaaacctagagcaaaagtccctaacgttgaacctatccataaaccgcagaggtcagtgaactccttgaaattatttggacacatttgagtatgtaaacttatgtgaatttttctgaagagtggaagcttatagtcttcatcaaattcttacttaaaaaaaaaaaaaaggatgtatttcaaaccacttagccttccatataagatcccagggtacctctctatctttatttcccatagttccactaaaataactttctcttcaagacaagctgttctacttattgttgcaaatcatatttgctgtttctcattaattcttttcttctttcattgtatatcattgtcgtacctagaatattctctctcaattataacagccaaaatacctgccattcatggggcacagttccaatcctatttcttcaatgaaatgaactttctgtggacacttcagctaaaagagagccactcctctgaattcctctgcactcacattcaacagaaaacaagtgccaaatgtgagaaataggtgctatttgagtgccaagaggggagcaattatttccaaccatgggagctgaagaaaacctctaaaaattggaataatgctgaactgagccttttgaaataatcaatgttgtggttttaaaaggagggagggcatttctgaccaagaaaacattgttaacacagaaaaattggaaaaccaaaagcccaaacaattgacgtaagtgaaaatcatggcacacgggagggaagacagcaaaatacataaggcttgaaagttagtcacattcagattttgcaaggtcatgaataccatggtagggaggttagacattatgctatagttaatggagccatctataggttttgagtagggaatgatataattaagtccctatttcagaaagatgaacttagcagctgtgcgaatttgtcaaggaaaagacttgagacttggaaactataatgagatcactgctaatcatgaaaaaaggagatgttgaaaacgtgattacagtctatagaaaggaaagcatgaatcccacaggctcagcagagatggaaaatagaagaagtggtaacagattggatgtgggaggtgagaaagggagagatgtaaaagatggttccaagacttctaggctggaaaacttgtggcagactggtaatgccattgagggaaaagataattaattctgttttagatacattgaatttagatacattgaactgaagcaagtccaaaatagtaaggaggagatggaatgacaatctagagtttaggaaatttagggagtctagatgtagatttgaaagaatcttttacatagagactgttagtggttaaaactgcagacagagacagagagagcacgtgtgcttgtgaggttgattttatggacatatcgtctaaggcagttgaatgtataaacccaccaggacagacatcatttctgttcaattatcatgtctatacaaatctcttggaaatatgtgcctctagctgcaccctctcctaaaatgaatccaatcttcaattgctcaattattcactagacttctgaacatcagtatgtccaaggcaaaactccccttccctgcctccttcaaattcaccctattccagcatgcacttggcctcagggcatcaccattcttctttctctccaggcctagtcatctttgactttttgcttttctccctcttcagctccagtccttcagattcacactgggaatgtgcctaaatcttccccctcctttctactgcctgtatcttgcctaagtgcagaccttaattattttttattttttctagaacaattataatgcctttttactgttcccccaactcaccacttccccccacccctctcatcctactacttataattaaatgtaaaaatatattttaagcacttagcacagggccaggtttataatactcaatatgtgaatactacttttaactgtggtttcagatttaaaagtacccttgtaaaagaatgtttcttatctttgtcattttcccccactttttaaatttcttttcttttcttttcagtgcaggaataggtagaacagggtgttttattgctacatccattggctgtcaacagctgaaagaagaaggagttgtggatgcactaagcattgtctgccagcttcgtatggataggtgagtgtcacagaggcttgccttcagagcactgttttcattcacagcctgatctcatcagcctgacttcatgcataaacatctcaggctccaaggtcctaaatctctgtagagatgcttgtaaaatgcttaagtatatgcattatattaaaaagcctttttttctctcttttttgagacaaggtcttgctctgtcatccaggctggagtgcagtggtgcaatctcagctcccagcagcctcaaactcctgggctcaagcaatcctcacacctcagcccccgcacgtagctaggactacaggtgtgcgccatgcctggctaatttttttagttttttgtagagatggggtcttgttacattactcaggttgttcttcaactcctgaccacaagtgaatctcccacttgggcttcccaaagcgctgagattacaggcatgagccaccatgcctggcctgaagttatttatttatttattatttttttgagacagggtctcactttgtcacccaagctggagtgcagtggtgtgattatggctcactacagcctagacttcctgggctcatgtggtcctcctacctcatccccccaagtagctgggactataggcgagcaccactacacatggctaatttttgtaatttttttttttgtagagacagggtcttactatgttgcccaggttggtctagaatgcctgggctcgagggatcctcctttcttggcctcccaaagtgctgggattacaggtgaaaggcactgcatctggctcccaaagttattttttaatccttttattaaattgtgacaaaatgcacatgacaaaatttatcatcctaaccatttgtaagtggacaatttattagggttaagtacattcacattgttgtacaaccaatctctggaattctgttcatgttgaaaaactcagtatccattaaaaaactccccattcctctctcagcccaactggtaactgccattctattttctgtctctgtcagtttaaatgctctaggcaccttttacgtaagtggagtcatacagtatttgtctgtttgtggctggcttatttcacttagcataatatcctcaaggttcatctatgttgtagcatgtgtcagaatttccttgctttttaaggctgaataatattccattttaggacacatattttgtttatccattcatcaattgatgaagacttcagttgcttccatattttgactattgtgaatactgctgctatgaacatgcgtatgcaaatatctgttcaagaccctgttttcaattcttttgagtatatacccaaaaagtgggattgatggatcatacggaattctatttttaattttttgagaaaaccatcatagtattttctgcagtggctgcactgttttacattcccaccaacaacacaggagggttccagtttctccacaacttcactgacattttattttctgctttgctttttttgatagtagccatccttatgagggtgagatggaagagtcatttttatagagatatggtttgatcacctttgttataatctccatttgttttgaaaacaagataaacaagaaacttctcttcttccttgctccacaactaagcctgcctgggtaaatggacgattgagttagtgatggagaaagtggacagatgctgcttcagagaaggcacaaaatgatgagcagcaggcgtctctgctcagtaattcagtgtactacagtggaacaagagttttgttggctaggtatggtggctctcgcctgtaatctcagcactttggcaggccaaaacaggaggatcccttgagttcaggagtttgtgaccagcctgagcaacaaagtgagaccctgtctctaaaaacaaacagcaaacaacaaatgtttactaatcacctcatatgcctaggcattggtctagatgctgcaaatacagcattaaacaagaattttctgctctcttagaatttatatgctagcagaaaaagataataaacaagcaaaataaaccaagataatttcagacagaaataaatgctgtgaagtaataaaacaaagagggacacaggcattgattcccttgagcttcagccctatgacctagagttttctaaaaagataaaattatacactaacctttctttttttcctggagacagagtctcgctctgttgcccaagctggagtgcagtggcgtgatcatggcccactgcagccttgacctcctgggagtacaagcgtgtgccacactcagctgagttttgtattttttgtagagctggggctttgccatgttgcccaggccagtctcgaactcctggactcaaacaatcctcacatcttggcctcccaaagtgccgggattgtaggtgtgagccaccgtgccaggccatataattacctttcgagatttttttttcaacaaatatgctttgagcactatgtgctatgtcctggcatttcaataaaaaagacaagaagattattctgaaaaatgagataatatatgtaaaacacttggaatagagtctggcacatagtaagccctcaataaatgtttgttatgttattatcatctttattattaaaattatctgtgaagtttctcttacctctaaaaaaataaacattcaaatttccctatccagattagtttttcccttcccatctgtaacattcttgtctcctttttagacagtagcctctaagtctttctaaccgtatcttccctctttgttttctactatgtttgtttctttctttattattttctctttctgttagcatgtaaactctagaagcagttcatcatggcgattaacattctgggctctggaaacagattgcctgcctgagtttacatcccagattccaccatttttttggttgtatggccttgggcaagttactacccttctccatgcctcagttttctcatttggaaaattggagtaatagtagtatatatttcctattattattgtaaggatgaaaagatgatatgacctatgtgaaatgcctggtgtgtaataagcattcaatcaagtttccacagttgttatcactatacgtagcaaggaacctaacatgtgcctgtaaactggaaatagtaatgtataactcacaggacttcagccacatttaaatgacattaaacctgaaatgtatttagtagaacactcagcctacattgcttatcctctctttaccccccaatcctgcttccctcttaccacaccccacatgtaactgcttccaaaaatgttttcttttggtacataaaaaagatcagttccaattatcccttctcctcttataattgctgccttaatctcctgatattcctttgccttccatcctgtgtagtccacctcagctggaataggatcagttgcttcacttcaaattttagggcctgtcttcacacaggaaaggggccctaactctgagggggagaagcagcactcagtcagccagagctgctcccacattgactttcatctgtcctgatttgtgcttctgtagacaaggctgccacctgagaccccaaatcacccggggactccagttcataccttggagtcctgtgttcttgtttagtgccagaactccatgaatgccaaacacatgcatggatctaaagtgactccaaaccaagctggcctccagcaacacctgttctgatcctatttggaagaacgtgctgaaaaacaggcttggtttgctctttttcttggctcttgttatgttaccattaattcttgcctgctcaccctcccatctcccacctcccctgcccactttcatagcctgacctccaccttgggttccacttcccagtcacattcccctttcaggtctaacaaattgtcctctagttttgaatggaattacaaatgcatttttttaaaccacatcacaatgcctcctctatctgctccttccttcctaaagcaaatggtcagaaaccttagccttggccttccgtcaccaccaaggtcttcccagaggtcttgtcttttcacttctgataggatcttgaaaacacatccaacttctctgctgatctgaagcctataggcacccaacccccttgagtttgaatgactgccaatatatgcatcaaaatcattctgatttcttcatcaagaccctttctgcattctttctgagcagctgtttctgttgtttatgaaacagatcctctccttgaaccttcctttgaaaggtctttcctccagcctccttccttcacaggatcaacatatgttttccttttcttgtctcttccttctgttgtacactcttctagttgttatgaaaagcagaacagaaaacctatccctttcgtttcacctcatcttacttctttttctcccccattattcttgcctcttgttccagtccttcagctttttcctatcatacctcattttaaaaattccaatgtgtggctaactgctgccattaaccatgtttttggctcatggcagtaaagggaaaactggtctcagccaatccaaatgtctaccgttatgcacttgcagcatatctttcttcatcacttgttcaaaccttgtccccaaattccgattttcctggctatccttaccttcagctctgaatctgtccagagattccagaatgcactatgtatttaatacatacagaatgtatttaatcatggactcttcaccatggtcttcaaagcacatgacttatttaactcccaaaataaacccaagtgaaggaaaagaagcatcttggcctaatttttttttttttaatgaggaaccaaagaattcgagatagcgagtaacttgtccaaagtcaagtagcttgggaagtaacaaaatggacctattggaatctgggacatttgcctgatctctaattatttctctgatctttatcaatcttatagaaaagtaaataggcttttggaatatgtttattgtaaaacttcttgacaaaaacatatctctttgataatactctgccattttaaacaaatgagcccaggagttcgaggccacccaccctgggcaacatagcaaaactccacctcttaaaaacaaaatgcaatgacaacgggacaccataatttttaaaacagtttttagtataaatgagagctcctttatgaatagttggagtgacgttgtcggcaactgccttaagagtacaatttgagggacaaaacattgctgcttcttaaaatatctatctatggaggatgctaaaatgtatagcgaatgtctaaaatactgctagtaaagagctaatcttggatggattcttttaaaagaattatctttttctaaagtttattgaatctggagatgggagatggcataacacttcatatctactatgctattaacgcttcaatctaaacgaagtgatctgttcttttcagtgtggtagctggagagagtgtaactcctggcattaggaatacattcagaacttgggttttggtgaagggaaattgaagagggcttccgatgctggacacgccatggcgaggtccttcaatcaaggagactgttagataagctcatggcttgtcttgggaaagcaagcggcactaagacagagctgaagagcactccaagggacactgtgggcaggaccagctacataatttgtgaggcccagtataaaatgaaaatgtggcatctgttgattaaaaagtatcaaatacttcaagacagtgacagcaaagcattaacccaagttcagggtccttctcagcacaagaaggtgagaggtatatgactgcactggtcacgatcccttgaagctaactctgtcttaggatatttttagaatggaatgagtgtttgtattagtttggtgccaaagtaattggggtatttgctattataattatttttgcaccaacctaatagatgggcctgcatcctgtgttctgtggaacaggcatctgagacctctgcacagagtggtgctcctgaatcctgcatacattcatccattcaacaggcatcactagacatctgctactgagcatgaatcaggcacctgggtgtagaaaaatgggtgtcttaaccagctttcccagtttcccagattgtccttctcaggacatagtttaattaacaattatttactgagagcctcctaagccaaaccctcttggtggcgttcaggcacaaagtaggttcttgactaagttcggggaaaagctgtttatatatatatatatattttgttttgttttgtttgtttttttgagatggaatttctttcttgtcacccaggctggagtgcagtagcattatctgggcccactgcaacctccacctcctgggttcaagcgattatcctgcctcagcctcccgagttgctgggattactcccggctaatttttgtatttttagtagaggcaggatttcaccatgttggccaggctggtctcgaactcctgacctcaggtgatccacctgcctcgggctgccaaagtgctgggactgcaggcatgagccatggcacccagccctacactatatttcttcgaagtcttccccactcggagactcacaataagcattaatgcattaaaaaatctaaaatcttcccaatgtagaaactcctttaattttatttaagcactctttcacatttatttgaccacagatgaatttcctcaagaaccatctaaatgagagggaaagaagttgtaataataaagataagctgttctttcaagaagctttgtggtgaagagaagactagagataggatagtaatttaagcctgaacctggacccctaaaaagaggaaaagggcccggcacggtgtctcaggcctgtagtcccagactttgggaggatgaggcaggcagatcacttgaggtcaggagttcaaaaccagcctggccaacatggtgaaaccccatctctactaataacacaaaaattagccaggcatggtggtgcacacctgtagtcccagctactcaggaggctgaggcaggagaattgctggaacccaggaggcagagttgtggtgagccgacttcacgccactgcactccaggctgggcgagagagtgagactcaaaaaaacaaaggtggtgggaaaggaatggtggaaccaactaattaaaagcagctaagtgtaataagagagagaaaagacagaaccagtatatcagaaggctgatattttgtattcggcagaatacgagcttcacaggccttcctctatccttttctactcttttttaacaacctccaaccactagcaatgaaggctgcatactgtgcatcttattcttataatctacccctctccacttgtagctgcctcctctgaggagtccaggtatggctaacagcaaagaaaaagacaaggcagtgatttggatacttgaaatggggctcatttcatgaccgatcagtcaagagcttgaacactggataggattaaaattttgatttccaccaccaccaccccaaaaattacaatgcctggtcattgtaatttaacatgaaaagaacaagcaatttctactcaagttaaaaatctgcattttagtaataaattcaaatggtctggttcagagacgaatgtgttatgctgaatggatatttccagtataacaatgacaaaaccatttggtagattcctcattctctggcaagacattatttttattggctttgtgacaacttctattaatagatgctcagttctcattgcagattcatgagtctgtgattctccttttactaatacttttgagcatattttgaactaaaataagatttcttttttttttccaagtaggagttcaaattcagtgcaaggcacccacgaatgttttatttagaagggcattaagggatcatcccttcattcccactgcattcgcttttaattaaaagatgaagtgggtggtatggcaattgcaactgaacactggtaagactagcaaaagaatgaggtgccggacatctctggactagatgtcaaggagcttggtgcgtggctctgccccctaattttctgtgtgaccatttgtccactctaggcctctctgtctacatagtaaaaggagatgtggggcgtaacagtgatctccaaccttttctggtataaaaaccagaaatatcttactatcaagagtaagatatttcatggacctccacctgattgttgtattttaatgcttgcaagttaatattcattgtgtgactcacaacaaagcttaagtggatgtcaggactcctctaacaagatgcttttccatgctggaattcagtgattgcagagtgaccaactggctttctgagatccctctcagctcttgctttctttgagtctttgaagatttgtttatgtggagaacaatgggatagccgcaatagtcataacatttgccaaacatctcctaggaaaagggtgggtttttttttaaaatctagcctcaggaatatattgcccaaagttttcattctaaaggaagaatccaaaaccaaaaaaggggacatctccaaggccacatgaccaattttgaagtttttataaaacactctgaactgaactttcaattttgctcaaattagattgactaaattctggattttgggggttctgctgttgttttctgcagtgggaagcctaagtgggttacactcaagatgaagagagaggaagttcacattctaatcctgccttcagcaatgaccctgaactagttgctatataaaccaggaaaaattgtttatctctgattattttagtttagattacttattaatatctgaatatgataagtacaatgaactttctgttggccagcattgttgcaaaagggatattttgctcaatcacattttcctattaacaggagattaccgtaaatgtataggtcaattttttaaaattatagttgaaaaaaagatccataacattagtactaaactgaacacagtataatcattttttattacttagaaagcccttccatataatacttaaaccttctaatctcaaatatcactaaattgttcaactataccacctagttaaaaataccaattgctataaagctaagccaaccagcttcgctgcatgtagctcttgctaaaaaagattcatttaggcttgggtatgtcaaggttctacagtttgagatagtgacagaaggtcatttacacatttagcatgagagatgcagtgtctcagtttattactatagatgatgtttatattttaacatcagacagtgcttcacatgcatatagatattacagaagtatgactacaaatcaattcgtgactatcagaagacatctaagcaggcaggaaaggaacatattccattgcagattgacctcagataactttttcctcatcgttttccttttaatcccattggcaactggacactggaagaattttaaaacagaacctgggaagtgaaacatataaaataatatcttattccaaggccttttttttcctcttttttttcttcctgagtagcaggaaattatctgtcaaatccttctttttaagagtcaaggatggaatttgtagttgcctgtacatccttaccttagagggcttaaactggaatgacatccaaaggcctcacttgtggcttcccacacaggataaaaagatgcttccaatgtgcatcatatcattgtttaaatgttttgattagtcacttcagttcgatgattttcttttctttttttttttaactacagccatctcagaagaatatatatgccatcaatttccaaggctaatatatgtccccaacatattttttgtttccaaaacctggttgaaataatttcaaaactaaagtttctgcttgttggtctaaggtttatcaactgtaaccttacatttatccatatttctctgcattcccaaataatcacaaagattcctctaattaatgaacttcaaagatctcatttgaagatcaggaattcaacattttgatttgcttattttaaggacacttggagataaagccctagaaattggtgtggatttacttgacattataattcctgagatcacaacaagaggtctactttgtaaaacatattatgctgactgaatcttccaagtggctgccaggacattttccttcttcctagcttggagttaattaggtgttaacttgagtgttcagaggaaaacggctaattttcagaggaaaaaaaaatggaactcaaaatatgttagactcatcaattgaattatcatttgatatatgctgatttttatgacctacaaatactttagaacacatctattttggagaaggtgtctatgttcaaaatacctggtcagaattggccaaatttacatttaagttctccctccttgatatgacatctgtgtaaagccatgggaaatcctctgtccaaggggccagacacaccttacagctgaccccggctaagcacagcagacagtagcctcacttgactcatgcccaagctcttggaactttacccaggaggcacattaacgtccacaccttttgttctaaatttactgtaccaaactttaccaaaagaattccagatttgaaaataataaaaagcaaaggagcataagtttcattgttagcccagaagtgagtcatcactgcagaatttcttctgtctactgattagaccggatacgggctgggcggtacgacaggaaaggctgttgctctctgtatgtgtgagtgaatagtcacaaaaggtcaaaattttaacatgttaaaagccaaatctctctcctgggcatctggagaggtttttttcaaaacaccctcccagtagcaaagggaaaaaactacatttttttttccctttctaacctgagtttacccccagctgacacagctacgtgctgttctgcacggagactgagacgacactgatctttgtatttggcagggctaatgtgatatgagattatctgacatttataggagggtagtatatctgaatcctctctggcctggccaaacacagcatttcatagtctgtgggcacaaagaaatccaagccacgtggctaacaccacttttgcaataaagggaatgactttcttccacagcatggaatggggcatcattaggatgaacaaataatttatcatccaaaccaaggtacttctgagagtgaaaggtgacccaattgataatgacaccaggacaacaccaatgaaccacaactcttccaaacatggttaccctaggtgtcgtattaactaagaataagaaaaataatacacggcatttatttagtactcactgaagggcagttactgtgccaagagttttgtggattctctcatttaaaccttgtaaaacttgaagccttattagataaatacctaaataccttattagccaggccagtggttttcaaacttctttgtgaacaatggaaaactttttgcaggcagaatcttccacagaacaccaacacagaaaaccaataaaaaacacaacttccctggtcaaagctgggattggcatctagtcctaatgacccatcctcctcctctgccctgcccagggtcctcagccacctttgtagaaccctgggcttctggggattctgtgaatagccttcagccagacattgatatgctctgattcatttaatcctcacaacccgatgacgtttgtcatttatgccattttacaagtgagaaaagccaggttgggaaggactaaatgacttgtctaaaatcatttagctaagtaagttaaaaaaacaaggattcaaacctgaatctgtcagactccaagcctactattttcatcatctgcctccactgtgcctgtcttctaggctggtcaatatttagaaagatatttggaacttaatgggcaaactaatgtcctctgccagatttgctcttggttctccagggtctttgggggcctcactccagagcctcctaaccagtcctatttgaccagatggtaccaaagagtaacaataacaataacaataataatagttgacatttatggtattgatatgtgcttggctatgtgctaaacatgttaagtgatagtcccatttatttctcacaacaatgctataaagtaggaactattgtttttattgtcgcatcatttgcagatgaaaaaactgagcactgcagagattgtgtagttgggtaaaatatctagtaagtggtggagacagaatttgtcttgacaacagtgtatgctgtctttttccctcttaacatactctggtcccccctggtaatgaacttggcaccattctctcagctagctggggttctcttgacatttttatttgaccttactcttttttggtaaactaactcctgcttagcagtaggtattttcacttaatgtattatacctcctgggaaaacaaacgtgtactggaaaagaaatatctgacgcacaataaaattttaaagagtttatttagtaagaagccagtcatacattgggaaacaccagaccaaaagaggtttagtgttccaatgacaaaacgccagaggcaagtatttattgggaaagtacagaaacaaacaatttatttggttggtttgcaattacataattgccttttttcaggtactgtattggaaagtccttactgacataacaatatgtgagttggatgcttatgattggctggggttatgttttagttctaacataagcatttatcagatatgaacctgaggtaagtttcacttctgtttgcaatttaaggtgcatgcatattggtgcacacctgtagtcccagctacttgggaggctaaggagatcagttgacctgggaggttgaggctgcagtgagccacgatccagccaggatgacacagtgagaccctgccccaaaaagaaaaagaaaaaaaaaagtaagaaaaagagtacccttgtttctcacctcccagaaccactttgtattgggaactttatatcagtaatatagatccagattttagcaaatccatgaaacctatctgacctaagagcttcctggagtcaagtcagagctctcctgaggatgaataactatagagctctcttgagagttccatagttaaccaagctttatacatttattccataaatatattttgtatacagacactgtactagcttcttaggtgtttctttttttgctatgaccagcctatctaaaaaactgcatttgccaggcatggtggctcatgcctgtaatcccagcactttgggaggctgaggtggatggattgcctgagcctaggagttcaagaccagcttgggcaacatggcaaaaccctctctctctcttaaaaaacaaaacaaacaaaacaaacacaaaaaacacacacacacagaaaaaattagctcagtatggtggcatgcacctgtcatcccagctacttgggaggctgaggtgggagaatcacctgagcctgggaggccaaggctgcagtgagctgtgattgcatgactacactccagcctgggcaacaaagcaagaccccatatcaaaaataagaagaaagaagactctgttgacctttctaagaatggattacctgttatagagcaaatgctatcctctggcctcaacctcctgtgtagttgggaccacaggcatataccaccatgtccagctaatttttcttttaaattgtagacagggtctaactatgttacccaggctggtctcgagctcctgggctcaagtgatcctcccactttgggctcgagtgatccatccagcactcccaaagtgctggggttataggcatgagccactgcatccagccaatagactattctatatatcaatatatgcaataggacatttatttaatattttcagagatgattatgatgagttcctgaatttgaaccagcctccagtgaatgcatcctggaataccttttgctttcttttagcctagagtttatctgttttcacatgacatgaaaatagcatgacctgggtaattcatttgacaagtatttacctaggactcgtaagtgctttttattgttacaagtagaagaagaccatgccattatgcttgtaggtctttaaaggacctacaacctagttggaaataattatagaatgggattagatagtatatatcatgatatcaacttactcatattaaagaccctactttgtctctttttctattttttaataatgccttagataaaaagatgtaagggatccttgttaaatacctgggagacacaacgctgggagtgagaaatggaagactaatatattgacgatagatagtgatccagtaaacaagagcattgtgctgaaactaacaagttgaaattaacaagaataaatagaaagccttgcatttagtttcaaaaatccagtagcataattacaggatgggagaaagctataatgtccacattcaaaaaaagtcttgttgactttttatttaatctacaccgtcagttagtatcttaaaatactaccgagaaccaggcaccatgtaggcactgggggacctcaccacctgatgcacctgcaaacacagatctattggtctctaacgtgcagctggaagagaaaataagcctgcttcatagatctcatcagaaggagacacaactctctaagaaggtcatatttgataaaatagcctgtagaagagggagactagagtggtgagtgacagaaaaaccaggctgtacagaaatattgagtgaccacaggatgtttagtctaaagaagaaaagattataggactttgatggctgttttccagcctttggagagctgttgtgtgactacaggggagccttaagacgtcttttgggttatttcagttggaccaatgcggtgaaagttagaaaggacagattcatgttgatgtcttaaaagttttcctgccaaccttggaaaaggctgcctctaaaattgcaagatttctaaaaaagctatattgtcagtgactagaatggatgatctctaagaattcctctgatgccagtttttttcatttttattttccaaattaagtgggaggtaagagaacttttcatatactttcctgaagccttcagacctgcaagaattttgccagcccacaattaatgagtatgcttctccatcttccccactttcactggctaaaacaaccttgatttagtgaacagaatgtcatagtaaatatactccaaccattaaattacaccactgacccacttagggtgaaacagttattaaattctaaactgtgtctccattcattcaccagttggacatgtaaataccagtgctgaccagaacatacaagaaggggaaaatcttgcctcaaagtgaggtaaatggtgagaggaagctgacagaccagagcctaagaggtggagcacatagaagcttccacatactgtctgcagctcaagagggagtaatggtgccctgagctgtgcaaatgccagaggaagggaggcacctctcagctccctggagctaccctaatatttactgtggtggtgtctcccaagcttcacagttcaagccagcatcttcggaacacctgctatgattttagatgagcccagatgtcatcacacagctaagaagataaaccattaccacattctcagctggccatttctgttgttcacttctgaccaaggaatacttagcccagaaggttgccttcaatgcaacaaaatgtacagctctaggggaggaagaccaattaaatacttctgtcaataagttgctgtcaccaaaaactgtgaatttacctctttattttttgccaattacatcattttgacatcatgttaattttcctggggaatcactgtttagtttaaaacaaggaagttttactgctctaatattgacatagattgacaaataaacatagaagcccagtttttattattaccattaactagaagtcttgttacagtgagacaagatatcttgtttttaagttgaagtgcctaaataatctgaaagttattttgaatgatactaacaaccacttggaaaaatctggttaaaacatagagttaaactaaaagataagatcagttgcatgattgcagagttacagagaatttacaagactttaaatagttaccgatagtgatgcttttatacagtgagcaggaatagtaacatattaatgtctggtaactttgtcaagctaaaaaatcataattataggactggacaccgtcgttcaagcctgtgattccatcactttgggagcccaagacaagaggatcacttgagtccaggagaccagcctgggcaacatagtgaggccttgtctctacaagaaaaaaaaaatttaaaaattgtccaggtgtggtggtgcctgtggtcccagctacaccagaggctgaggtgggagaattgcttgatcccaggaagttgaggctgcactgagctgtgatcatgccactgcacaacagcctaagcaattaaggagacgttttctcaaaaactaaaattaaaaaaggatcataattatgaagggggaaaatgtgatataggtattatgtatataaaaacataatgagaagcaccgttatttctcatgaaggcaagtgctttctatgaatccattgacaaggagggtgctgggcagctagtgatgataatggtgataaccaagaggaaaatgtcacagcagagccaattccctttttccaactcatttaaggacccacccactattgtgtttagacaccccgtacaccaaaaggctaaggttgcttctgtacaacatattcaaataaaccattccaaggtagacttcattttacttgtagaaagcaacattttgcagatgagttttgtttggtttgtctccgtcaatcaattttaagccaaatgtataaaccattttaacaagagatgaatcatgaggcacctgagaagtaatacaaatataccagctacaatgaatttatttaaccttcacagcagtagttactgttactatcctgctttaacagaggaagaaactaaagtgcaaggggtttcgaggaatttgtccaagatgcatacagctaagaattggcagaggagggatttgaactcaccttggctgatgccaaatccaagtacttgatcattaggctgtaccacctccccagtaatgttacacaggtaaaaattaatcacgtgcctagtgtgtgctgggaactgtgttaagccctttatatacattaccatgttaactttgatagttgagacatttggacacaggtaagagggataacaaaagaaccactaggtcgactgttctatgtgtctttggcataataccctagcttggatgaaatctctgtgttacttgaaattgcaagattttagcaaaatcagttattttatgatttcttccttgcagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcatggattgtggaagactgggcaacatatttaagatttccagctccttgtgtatatgaatgcatttgtaagcatcccccaaattattctgaaggttttttgatgatggaggtatgataggtttatcacacagcctaaggcagattttgttttgtctgtactgactctatctgccacacagaatgtatgtatgtaatattcagtaataaatgtcatcaggtgatgactggatgagctgctgaagacattcgtattatgtgttagatgctttaatgtttgcaaaatctgtcttgtgaatggactgtcagctgttaaactgttccctgttttgaagtgctattacctttctcagttaccagaatcttgctgctaaagttgcaagtgattgataatggatttttaacagagaagtctttgtttttgaaaaacaaaaatcaaaaacagtaactattttatatggaaatgtgtcttgataatattacctattaaatgtgtatttatagtccctcctatcaaacaattacagagcacaatgattgtcattgggtatatatgtatttactctctattattgggcataaaggtggcttctgctccagaactctatccactgtatttccacatcgtgagtcattttactttaaaagggaaaaacaaatttgtagcaactctgaagtatcaagagttttaactacttgtctctcttttgctaagaagggatttttgaatatgctatctacctggaatctctctctcaacaaaaggtatatgccttcaggaatgatataatctgtcccattttcgaggctccttataaggacatttccatgtatgtccttacatttctgaaagctttcaatcttcaagagacaaaaaaaattaaaataactaccctcagcaaacactagctgttctgctcatatatgaatttttaatgcagcaatgttgactttgtttcatactgccaataaactcttaatactaaatactgagtaaagcatattcttttttttttttctatttggaaagacgccatcctctgtttggggaagaccaaagtagataatgtgatgggtttaattttagtgtctgcatctccccagtgaagatgacgatctcaaaatgtaatattgtcatcacttgggagataatgatctagaagtgccatcattatgtggttttcctcaatagactcgcagcatatcattatacaaacagtacatgtttatgtctttatatcacttgtcatagaccctcatcaattacatggcttatgtttattcagcagaatcacatcacctgaagagatgtaatgtttcaggaacattcaattatctgagatttcaattcctttctttcttcttgaggttaagaagcagtcacatgccaaaggaaaggtaggtgaggtcttaacgagatttactctgctcttgaaggctggaatattttctacattaaaaaaaagaggtaatcataatcccttctttctaaggaaacagacaaaaggacactggtgtaaaacttccccaaacaattcaataggaggaagtgctcgtcactgacttttccccccaccatgaaggcacatttccttcctagtctttgcttctcttatctgggagaattttttttttccccaagcgaagcatgaacagttgctaagtggaaaatggaggctgaattttacatggtgattcttacctgcttgatcttcaggaactcaggtgagtgggtctgcctcagtgtcctgaggcatttcttcaagatctagccaaggagtccctggtctttgaagtgtctgaaataaggtagaaggggccaggtctccatggcagtttagccaaagacgatgaaaagcaggaataaaaggagccagctatgcccatactgttgagatttctctccaaaagaaaataaatgctctcctctcatcctccaaatgcttcaggcagcccctgaaatgatacatttagagcagagcgtaaagaaccccgaggaaaagtttgtattattatataacagtctgtggctttccccaagcctttttccgacccggttatagttttattttcttttgtgttgaagaaagaaaattgaaggaatatgattaaagggggtgaggaaatgtagtgtgttttatttggaagttgtcatttgggagggctgaacattttcatgagcgagctgggcaatttaagtaaaacctcattgaaaatggtttctgagccagagtatcttgctctttaatactgatgtttagcaatttgatgtttaattttcttacactggcacatgatgatttttagaaaatctattcgtatttgagagaaaactgtagatattgtcataaaatagagaaatgctcctctccacgactaaaggaaatttagtttgtgataatcaatactttcattggctgcaattagctaggaggttgtgcttggagaagtgggaaaatttgttttattttttgataaatgtatgcaattttaaaaaattgttattcaaactatgaaatttgtatataaatactgcaatgtgaatttaaagactggaaaagggggtgcttttttaaggtaagggaggaagcttatatcgaatatgtcaaatggttaaaaagggagctgagcatttcataacttcagcatatctaactaattgggctaaaatatactatatactttggatggttttgtttctttccaagcttcctttcattttccaataagaggtgtgcttttttcccctaaagcatgtgaaaattaaaaaaaaaaaaaagatggggagttaagtgtaacatattgacattttatatcgtcagctttggaattttaaatcacatgtgttaaatatgagaatgttcacttgaaatgatagaaataacaaaatataagtaaaactagtgattttatttagctcatttgtgggtgggttcttccgttttctaatgggcctcataatttgctacatagtgctttatgagc

SEQ ID NO: 13754 - DNA, 17828 bp, Human
ttccggcgagtattgtgtgtcgcgccgcggggcgggggcgaggggaggaggaaggagggaggcagcgctccggcggctccgcgccccgcactcccggacccgaagccgggaaggtaggtgctgtcccgccgccgcgcccgagcctggggcctgcgctcgccggccggctccgcaagccgcgtcccagcgccccgcgactgcgtcaccggccccccgcacgtaaccacagctgcctccgcccgcctcgggcccgggcggacgttttgccgccccggcgacgtcagcgcgtccggcgttgcttggctaccccgccgttcccccgtcccgctgctgctcacctccccgggtgaaactctgacgcagtcaccgcgggtctcggcagcgtcatagcggcgggcatcccatctgcacgtcacacctctttctcacctggacacgcatcccttcctaccctgccagccacgacgtttcctctttcccctctccaatgcccagccccagatctggcggaagaagatggagaacgggggtgggacagagttgtggacaacctctcaggagagggtcgcaaggtgggaccctgaacagtggtagaaacaaaatgagattgtccctgaagtttgcccttcagctgagacacaaggagtagaggaagaggaaggactaacgcagaggcactcaaggtctcactatgactgtagttgagagtcctctcccttcttccctaaccctttccccatttctctcaccacttctttgccagtctagatccgtcctggtgccttactgtgcatacagttctactcgtctcaggtgaggaggccacttaatttgtaaaagactgaggaaggggtaggatcaccacaagtcaaagttggattcccacagatagaaatcatctgactgaacttctctcctattgctgacagaagaaattcaaatccaaagaagttatcagttcctactccaaatcaaacacatttgtgtgtgccaacaatatatacaggaacaattgttgttaacctacctcattacatggccacttatctctcagcacatagatctaccaaatttccttccttccagtaggtccctggagaaggatgggggtcgggaggagaaaaggttatggggatagttaaatcaacttacccatggctaaaagtatggatgttttaaggatggagtagggggccagccttgtgttttataaatctctcctatgcatttccaattcttctgaggctgcgcttgagggagatctcattgcctcttttgtgtctcttaattcgcaaccactccaggacctataagttggagacacactatgcccagggtgttagttatcaatagctatattgaaagattccagtcactacaaatagactcgttgctctcttttcaagaagttgttggcctgagctcagcaatatttaatatggttgccataatttatcagttttcagcagttctgagtgtccagatgaacacaagagaaatggaatgttgcgtgaaatgtcattccaagaagagagcagatttcctttaggctagtctgatggataaaaggaagaataatttcagattttcctgaaaagaggaggttgcctttgcctcattcattccatttgttagcctttagagcagtggtatctaaccctttcaatatgaggactctctttgcttatctgtggtggctgataaaaattatgcatggaccttctgtggtggtgatagaacaaaagttatgcatggacttttttttttttaagcttatcagctgtcattagtgtcaatgtattttatgtctggcccaagacacttcttccagtgggcccagggaagccaaaaggttggatattgtgatttagaagaatgagagaacagtgtcagagaatcaagcttagactccagtggattaatcataaagctcttataacattaaactttaaaatatggttaatttaagaaatgttaatatttttatgacattttttacttctcagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagaggtaagagacaagatagatcaattgggggttgtgtgtcagtttactaacaagaaaaaaaaggttgatggctgggagtcacaagttttgaaaatggagaaacaaagaggttgaattgattggaagagaagatggagaataacaagaaggggcaaatctggagttaggacttaacatagggataaatgtcgggtcagggatgcaaaaaaaaaaaaaagaaaaaacctccaattaatatttttattttctctgtcctcttccccactcccaagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggtggggaagcagacacacgatgtcagtgtgggtaaaaagggagaagcggcagaggatgagatactccctaggtagagatcgtaagctcctactactcactttgtattctcagagctgcatatgcaggggcacacagtatgtgtgatcagttgtcctctagcctgaaaaagagcaatggtgagaagtgccctaaaatttctctctgacttttgcaatacatgtgagtcttatgggtgaatattggtatgtgtggtcatatttttcataaatgaatgaaaccacatggaaaagattaaacttaggaagaactgaaaagtagtctggtttcttcattctgcctgcctgctcagaatgctccttgttttcacactggttattgggcataggtaatatcgcttgagactgatacctaccggactaagctgaaccattcaattgtttgcagcttctctaggtaatgggtaacatggcatatcatttaacttactgctgagacaaaggaaaatgtttgaataaagggaacagagatatgaatgtgttagcattttatcatatactttgcttagttatgttactcttgaaaacaagatttcaggtaacttacagtataataaccatgtttttattgtaggtggacagaggtggatgggaggacaggtttaaagagagatattagggtacagaaggttgcttggatggtaataggcagttgcctcagtaagaaaatggaaagagttgagaaaggacacagagttgatgacagctatctcagattcagtaaaaggacagttgggtgagcagagaaggtgatgtggacaggctagtggcaggaggagggactgtagaaagttgacatcccaaatgacaggcaaggaaggaagtcagatcaagaggcagtaagatggctaggaagcaaataaatggtttaaaacaaatggtttaatctctgaatggtaggtataccagtcaaccccaaatgtcacctctcccacttcctccctacccctcaggaaaaactgcagaagtgtctggagcccctggaacagaagctgcaggagatcactcgctgcaagtcctctgaggagaagaagcctggtgagctcaaggtaaaggcaggcaatcccatgtaggctgctctgaagggtatttgcctatgagggaattaactgtacactatttaatccaccagttccggttcattagaaaaatgcagttctcgccggacatggtggctcacacctgtaatcccagcaattctggaggccaaggtgggcagattgcttgagctcaggagtttgagaccaccctgggcaacatggtgaaaccctgtctttactaaaaacaaaaaattagccgggcatggtggcacatgcctgtagtcccagcgacttgggcggctgaggcaggagaattgcttgaacctgggaggcggaggttgcagtgagccaagatcacaccattgtactccagcctgggcaacagagcaaggctctgtctcaaacaaacaaaaaaaacaaaaaaaaaaaaagaaagaacaatgtagttctctcaaaaatgatggcattttattaggcttgattgtcattaaacattgtacttaaattacttgtcatgaattaagtattaagagggatttaagagatgaagaacagacagaatatcttacatctggtgagctgagagagttcgtgcctcttggtctcctttttttgttaaagcagcaaaggaggctttctgctgagaaggcagggatgggagtttcttagaggacttgaagagaggagaatatggaagattcactggggagaaagggaaaaggagctgaccaagagtctcagaagaactatctaatgacattaggaccacattcttaaaactcaagtaagcttacatatgctagaatgttctccccctccccatcctccaccataggatcttattcatctctcaggcgggatgaaagccacttcctatgcagcctttcctgacccttcagaaattaacattcttaattttcatacaattttgcacctcttttatagcattgccttatttgtagcatggtattttggtgtctgtctgtcttccattgaacagtgaacaattatcatttgtagcaaaaataactagaattgagtcctatgcattaattcattaggtatccgtaacattccagatttatagggttgttagggtcttagagttcaggccaaattgggataagtgagacatagaaaagctacgagaaagagacagaaggaaatcctgaggccatctttagtaagatgtaggggtaaacctagatattctttaaggtaggtattattaccttcagcttacacagaaggaaatggaccttgggtaagtgactagtccaagatcataaagccagtaagtggcaaaaccaggaatactagttcttcgtgaatcagtaaatatttgttaagctcctggtttaggccaaacccggtatttgacactggggaacaatgatgagcaaaaacacagttcctgccctccttgagcttaaagttaagtggagaaaataagtaatggcacaaaatgcacagctgcaagttcataagaagacaacatagaaatttggcctcattaaaggtttcccgaagaagtaatgagtttttaagagttgacatgtagagatcaccagaagctaaatccaagttttgattcatagaaacatgaatttttaaatgaatgataacatttcatcagaaagcaagtattattaccttagtgccttatacattttagcaaagtaagcatttgaaattttaaaatttgaaccaattttggttagaaatgtgaacttttaaagttttttgttcttttagaggccttccaagaaacctaaaaatatgaaaatggtgcttattgctagtcattaactttcttcttcatgttgatcaccttcttgaaggtaaaggatggagagagaaatatacctttttaaaaccttctaaatgcttgaacagaactgtcctgttttttaaactgtaaattgtcatttcagtggtctccaaaactaccaccaacattcctcttgtgaccatttgaattctccctccttctccctcatcagactcaatgcccctttaaaaaataatttgtaattatgctgaactgaaaattacaggtaatataacctatgtgcataatgttaaattttaaagagtctatcatgtccaaatataatataatgaaacataattgatgataaaatgtggtatgtaatatttgggcatgactaccctgaacgactttacagtgtagctggttatatgcttgcccctatatgtgtcattatcagcaacgccataaatacaaattcagactgagatggatgtgtgccaatatgattgaaataccataagtagcttagctcttggtgatatgatttttcatagtaataacttttggtaaagttctaagtataacaatataatcttgggttttattcagctattgctgaaaaattcacgtatagtaaaaccatgtaagaattactctgtgtttatactatataaaatggcattcaagcccaggcctatgtttttgtttttgtggtttttttttttttttttttttgagacggcgtctcgctctgtcatccaggctggagtgcagtggtgccatctcggctcactgcaagctctgcctcccggattcatgccattctcctgcctcagcctcccaagtacctgggactacaggcgcccaccaccacacccagctgattttttttttctatttttagtagagacagggtttcaccgtgttatccaggatggtctcgatctcctgaccttgtgatctgcccacctcggcctcccaaagtgctgggattacaggcgtgagccaccgtgcctggccgcccaggcctgtgtttttgaatatccagcagaacattagaaaatgttgcaggtcagttcactatgccggattgtctcacacattggaggagtgcttgcgtcattgtcaggaacttccccaaccatggaaaacaagaagatgtgcctatttccaaaatatcctcagagtgtgttaacagcttcatcaagaaccactgccctaaaatatagagtgaaaaaaagagaaaagattaccggtttataagaggaagggcctttttgcttcctatttatcacagtcatgaatgttaaacttacacccatacctaaacaaacacacatgcatgcacacacatgtgcaaacacacacacacaaaggctgtgttttattgagggcaaatgtgagaatatattttgttcagatgtacactgagaaggcagtggtggaaagtgaagcagcaagtggccctaaactagaagagctagtcagcctctgccaggaactagcttgaatccacaaatgccacgcttgtcaggcccatcctggctttgcatccccactctctctccaccctcaagcctgcctttcattccctatccacttccttctagagtcccagtctctgcttctcactttgcttcatcatcagtcacatgatgcttggggaattctttctttagggagatcactatttgttgtagtggagatgcagaagagaggatgtgctgataattctcagaaagtgttatggctggtgtttgagtcctatattatcaaatttcaggaatgttagaggcttaagtctgtgtgctggcttaaagaaagcatgtttcaaatttcaagaaactaaattactaacaaacttctgtaacctgttcctggggtaggaattgccagttctctgaagtgacttgaaacaatttaacaagttcagccctgaaatctacatatgtatattttataataacccatataactcttactgattcttacactttcccagttctctggtttttatctggtgcatgtgttgcaatatgcaaaggatgacaatcttatttttaactttttattatttgtactttcctttttgtttcgttgttttttgtttgcttgttttgagacagaatctcactcacccaggctggagggcagtagtgatcacagcacactaactcaaactccagtgttcaggccatccatcctcttgattctttttgagtagctaggactgcagatgtgcattgccatgcccgactaatttttttttctttttagttgaaacaaggtctcactatgtttcctaggttggtcttggcctcaagtgatcctctcacctgggcctcctaagcactaagtttacaggcatgagccaccatgctgagcctatactttccttttctcgacagattgaattaactagaactttacagttgataataacacagatatctctgatatctgtaatagttaatgtcatcatattattgagttctttatcttaaattaaaacaaatatatatatccgcagtggtcttcactaccaagtcatcagtaggggggtgatagtgatggagccattctttacagaaggaaattccaatggaataaaaaatgagtgttctgttaaaccattttctctcattttctttctttcttttctttctgtctttgtctttctgtctttctttcctgtctgtctgtctttcatctcgatctgttgcccaagctggagtgcaatggtgcaacaatttcagcttactccaacctctgccttctttgctcaagccatcatgccacctcagcctctccagtagctgggactacaggcatgcaccaccagactcagctaattttttgtattttttgtagagttggggtttcaccatgttacctaggctggtctcaaacttctcatcccaagcaatccacctccctcggcctcccaaagtcctgggattacagtcatgtgtcaccacacccagcctttgttaaaccattttcaatgaaactggaagtctgtgttaattcatacatatggtgggtgagagaaaggcttccttataccacactgaccctgctgatacaacatcttccctctcttctcagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggttcgacctttgcccctgcatagcccctcaggctgagtgcagcgtagctttgcgtagcctgggatttgtcagcctgggatactcattcttctgctctccttctctaaatccagttctttctgccaggtgtactcaaagggtctttgctacggaaaagtgatttctcccatccccttctaaccatttttgtgttcttatctctggtcagcaattatgtgcttaatctgttccaaagaaaagattcattcttttgaaaggagggaagtctagcctgagttagtgaaaaactatgcattaaaaattttgtaaatgcagttaccattacttttaagtcctgaaatttgatttatgtactgctgaaaaaggacagaaacatagtttaaaggatacaggcatacctcagagatattgtgggttcagttccataccacttcaataaagcgagtatcttgataaagcaagtcacattaattgttgggtttcctagtggaatcatatttttgctggtggagggtcttgtgttagtattgactgatcgaggtggtggttgctgaagattggggtgactgtggtaatttcttaaaataagacaacgacgaagtttactttcaactcttccttttatgaaagatatctctgagcatgtgatgctgtttaatagcattttactcaccagtagaacttctttgaaaatctttgaaaacccacatttgcagttacttacaacatgggagtcttgaacccctaaaagtcatccataagggttggaatagacttcttctaaatgcctgttaatattgatattttggcttcctttcacaaatcacaaatgttcttaatggcatctagaatggtgaatccttaccagaaagccttcaatttactttgcctagatctatcagaaaaatcactatttatagcagctttatgaaatacatttattaagacttgaaagtccaaattacttcttgatccatgggctgccgattggatgttgtgttagcggacgtgaaaacaacatgaatctcattttacatctctatcagaacttttgggtgatcaagtgcattgtcagtgagcagtaatattttgaaaggaatctttttttctgagcagtaggtctcaacttaaaattttcagtaaagggttgggcacggtggcttacacctgtaatcctatcactttgggaggccaaggcaggtggatcacctgaggtcaggagtttgagaccagcctggccaacatggtgaagcccaatctctactaaaaatacaaaaaaattagctgggcatggtggtgggcgcctgtaatcccagctactcgggaggctgagggaggagaatcgcttgaacccgagaggcagaggttgcagtgagccaagatcatgcagttgcactcctgcctgggtgacaagagtgaaactccatccccccaaaaaaaacttcagtaaaggctaggcacgttggctcacatctgtaatcccagcactctgagagatcaagccaggaggactgcttaaggccaggaattcaagaccagtctgggcaatatagcaggaccccatctctacaaaaggtaattttttttaattaaaaacattcagtataccatgctgtatacaggtgtactgtcatgtaggctttgttattccatttctagagcacaaggaaagtagatttagcataattcttaagagccctaggatttttgaaatggtaagtgagcactggtttcaacttaaagtcaccagctgcccttgcttctaataagaaagtcatcctgtcctttgaagctttaaagccaggcattgacttctctcgaactgtgaaagccctggatagcaccttcttcaatagaaggctgtttgttgacattgaaaatgtgttgtttagtgtagccaccttcatcagtaatcttggcaagatcttctggataacttgctgcaacttctgcatcagcacttgctgcttctccttgcacatttttgttacagagatggcttcttttcttaaaacaacctacctaactttaaacttttcttctgcagcttccttacctctctcagctttcatagaactgaaggagttaacagccttgctctggattgggctttggcttaagggaatcatgtgatcttatatccagatcactaaaattttctccatctcagcaataaagctgtttcactttcttatcattcatgtgttcactggagtagcacttttaattttcttcaataacttttccttagcattcacagcctggcttggtgtttggcacaagaggcctagctttcagcccatcttggctttcaatgtgcctttctcactaagcttaaacatttttaggttttgatttaaagtgagagacatgtgattcttctttcacatgaacacttagaggccattgcaggattattaattgatataattttaatatcgttgtgtctcggaatagggaggccagaggagatggagaaagatgagggaatagctggtagtggatcagttagaacacataaaatatatttatcgattaagttgttcgtcttatatggatgcagttcacagtgcccccataacgattacaatagtaacatcaaagatcactgatcacagatcatactagatataataatgaaaaagtgtgaaatattgtgagaattaccaaaatgtgacacagagacatgaagtgaacacatgctgttggaaaacatggtgccagtagacttgctcaacacaggttgccacaaaccatctatctgaaaaacatacaatgtcaacaaaacacaataaagcgaagtgcaataaaatgaggtatgcctgaaattgtttaaataatatattgcttttgatatgtatatattaataatacctctaaagtgtttgaaatattttgttctcttacgtaaatgaatggtgttagcaaaactagggaacatattttttatcttagagattagattaccagcatttgaagcagtgaggcttcattgtacatttatttttatgttacgtattgcttggtatttgttcctatggcctttcatgtatgtgtgttctgccttccatattaaactgggaaatccttgtgggacagagatttgtcttctttgtcttctggaccccaagtattcacaaatcagtattagcacacagttattaatgtgtttattcttgcttttttttttttctgagagagtcttgctctgtcgcccaggctggagtgcagtgcatgatctcggctcactgcaacctttgcctcctgtgttcaagcgattctcctgcctcagcctcctgagtagctggggttacaggcgcacaccaccacacctggctaatttttgtatttttagtaaagacagggtttcaccatgttggctaggctggtcttgaactcctgacctcaagtgatccacccgtcttggcctcccaaagcgctcagattacaggcgtgagctactgtgcccagccagttattgatgtttattaactaatgcaagacaggggataccaaaccgtaacaggaatgtgtgatttgttcctatgccaccagtctggaactctctgtacttatcctcaaggagagtgagatatgtggttggtacttgggggacagagtaaagaattgatacaatccctgtcccttatagggagctcccagcatccttgaggagcaaagacaagcataaaagaaatcattgggaagtgatataaatgaccaagcttcatgatgaccagaagttgaaagtagggattaggttgggagaagtgcattcaggtcccgctggagctcttcttgcactgtgtgaccctcagtttatcctatccctattttatagctgtggaactttggggaggagggggaaccttttgccttcaggaccactgaataccaggaccaatattgctttcttttctccttccttctaggatgtcaaaagtaccctggaaaagtaagtgattgttgtatctctctgagtgagttaggtcttggcttagagaggaggggtacagtcaggagtttgggttgggggtgaggttgggaaagtcatgtagtgtgtctgggcagggtatgggagaatgttcattgtgcccatgaagccagttagagaacaaattattgggaataataatcccttttcccctttgaacatcaggacttcttgagaaggagaatgataaggtagaatcagattctacttgtgccagtgggtggaattgtgtccaaacaagatggcaggaggaaggggttgggagagcagggagggcaatcatccatttgcatgaaatacaggaatattcctagaaagttcggaggctcactctcaacgatctgtccacgggatcataaggctctccttggattagtaaaagaaatcaacaggtgagcttttcagggaggaggaagaaagtgggaagatggagaattttaatttctccctaaaaatgttaacatctgaatagtcacttggctggagcttctccctaaccctgccctttcttcccctatctccctatccctcctagatgtgaaaaggtgaagaccatggaggtgacttcagtatccatagagctggaaaagaacttcagcaattttccccgacagtactttgccctaaggaaaatccttaaacagctaattggtgagttgttcccaaaaggaaactagaagaaaccactagagagaagaaagtttttaggtcctaccttatatgggtttcagttatcctatgtctcacttttcttactcccacacacacctacccctttatctggcttttagtctcaccctgagtcacagaacttggagtgagaggaagccttaagcgttatctactcttaggtccattcttttctaaatagagacccagaaaggttaaataatttgccaaagtcatcgggtagagtggttatataatttaccatgtaaacttgcataaccttcaaaggccgggtgcggtggctcacatctgtaatcctagcactttgggaggccaaggctggtggatcacttgaggtcaggagttcgacatcagcctggccaacacggtgaaaccccatctctactaaaaatataaaaattagccagatgtggtgttgggcgcctgtaatcccagctcctctggaggctgaggcaggagaactgcttgaacctgggaagcggaggttgcagtgagctgagatcacaccactgcactccagcctgagggacagagtgagattccatctcaaaaaaaaaaaaaaagaaagaaactgaaagggagtgtcattatattaatgtgaatatgcagggaaaatagtcataaaccaggccagttcctggaaaacacacatggtcaccctatccctagaccatatgctgtcttgctcggcatccttcttaacactttccgtttttttctgcccctcagactacaccttgtacttctctacatagtgagataaatgataatgtcagagggagatgaagagaggaccaggcgggaacctagattaccagccactgcagactcaagagattattatctgtttactttagggtcagggtgagaagtgagccattgctttctccccttccttaggtgacaccatggattgagaaagttaaccaaaccaggttgttctggggacctttaagggaccaggctctgtaaaggcaggctggaagagtgaggcaggggcatttagctattcccatcctcatctagctccccactctggcttctcccgccagcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtgatctctgtgttgtgtggtaatttggtgacagccttgtactgatgtgtaagaatcactgggtgttagacatgcatgttcctgggtctcacccttagtggttagtcaaggtctggggtgggccggacatctacattttatttatgagacagagtctcgttctgtcgcccaggctggagtacagtggtgatctcagctcactgcaacctccgcctcccaggttcaagcaattctcctgcctcagcctccagagtagctgggattactatggactatagccatgcaccaccacacccggctaattttagtggagacagggttttgccatgttggacaggctggtctcgaactcctgaactcaagtaatctacctgcctcagccactcaaagtgctaggattacaggtgtgagccaccgtgcccagcctacatctacattttaaacacaccactctcatttgagtccgaaaacccttgtgaaactagttccagaggaggtttcagccatgtccttcctcccagctggagccctgcttgtctgtccccgcctggcactgggtctgaaattggagagaagtcatcctctcctgacttatgctgccctccccatctcagggttcattgatcttctacccctccaattcatgtccctctgcttctgacttcagtaactgatagtcactatgagtcacaggacaccagacagaagaactggaagatagaagaggtcagagggaggggtgtgaggtgaatgtcagtgtggggagtggggtgaagtttcaggggcaggggatgctgttgacagatttctgtgctgtacctaagcctaggagttagaaaccattcactcagaaagtgaggatcacctactgtgtgtccagcactgcataacaggaagtgtgtttctttggtaggtggaatagtaggagtaaactgtgctttctgaggaccgggagtccttttccctccctccagcaccct

SEQ ID NO: 13755 - DNA, 24166 bp, Human
ctgggccacctctggagatcctaagtcagttggtctaggtatgttttgaagactcaccagtttgaagactacaaatctgatgtgtagtcaaggtttgaaccattccacaagatgataaaggattccttcctatatttggtgcaaagcaccaagtgacacttaggaatattttagacaagagagcttggttcatgattcaacattagacagatattctggcacaaatatgaagaaccctcaattttcccctgtgggtcagccacaagaccagggcaatttaacgccttgtctcatccacctcccagctggctgctacctcctgcccctctttgagccctgtggggatttctagcgttcagagccctggtagtttttgtggcctgcactgtgcttcagagcaccactgatgctcggctccgtggggaaagtaagccaagtgtgaccacaagaacgcatcatccacagtcactgggatctcctgggacagcctgggatccaggcctttggcctggccagtaggggtgcagtcactcctagtatgcacatccagatcacttgctttttgccccgaattctggcctctccaggtttgttagaggtgtctcacggaagtttaccccatggagagtttgcttatctcagattaaaatatggggattaatctgggacccaggagcccttaaatggagtacccacagggaatggagctctaggctaagtgctttgggattacaggtgctttgctcttgtttggaggtccagacatatgcttgagaagcagcttgggatactcaagagaggcctgaactggtaccctggaggccaggatgaaaacccaggcctctccatttactttcttgggccccagagtccacatttgggattcactgtctaccagggcacctctctgggtggcatctaggagccggaggcaggccagagtttcacccaggctggagtgcagtggcgcagtcatggctgtctgcagcctcaacttcccgggctcgggagatcctcctgcctcaacttcctaagtagctggaactataggcatgtgccatcgcacccagctaattcagctaatttctttttttggagacaatgtctcactatattacccaggctggtctcaaactcctgggctcaggcagtcctcctgccttagcctcccacagtgctggaattacaggcacaagcccccgtgcccggctttcagctagtttttgtagctcatagtgattattcttggagccaataatcgtgcatgcatccacatcttgaaattacatggtgtcaccttgaccagtctgttgacatatgcagattaggtatttatgagatccagagacttataggggaggggtggatttcagggaaaagggaacctcttagagaaaggtagggagtgtctgcagttctgcctgtgaggagggtaccaggacattgcagggcttgtttgttgcatcttcctggttctatagaattgcagctagcttctggtttattttttcatttttattttttgagatggagttttgctcttgttgcccaggctggagtgcaattggcgtgatctcagctcactgcaacctccgcctcctgggttcaagcgattctcctgcctcagcctgcccagtagctgggattataggcatgcgccaccacacctggctaattttgtattgttagtagagatggggtttctccttgttggtcaggctggtctcaaactcccgatctcaggtgatccacccgcctctgcctcccagagtgctaggattacaggcagaagccaccgcgcccggccgcttctggtttattgaagagacagaaaaataccccctcacccccagcagggatgtgtgacctctggtgcaagggagttcatgaagtgacttcttcaggttcagaattctcatctgagtaaagggagtgggggtggagtgggtcatctctgaggttttttttttttggctctgattttggtttctgtctgcccaggagtcaggaatggagagaagggtaatggttttacctcttattgtggaaacctgttgagatcacagagaatatactgacggcataaaagggcagaaccatagcagggtgcggtaagttggggaagagtttttggagagggtgaattttgcattggacctgacagaattgtgtatggggaaggggagcggttattctggtctgctcacatctctcatactcaacctcatttctcctaattctgaaatcttgagatcctctatcactaagaaggaaaactactgtccaacagggacactttattgctcaccccatatgtgaaagtttgtcatagctaaggctagggtgcttttggtcagtatcagcagaatatatgccccctttcttttgtcagcattactccgcttacaaagcccttccatgtagatgacctcatctgagcttcctaacaaaggagctggtattagaccccattttacagtgtgcctgggtagggaagagagtgtagtggattgagcagaggccttggcaccagacactgcttcctagccatgtgctcttgggcaagttgcttaaccctgctgagcctcagtttcctcagaaggagtctgtataagcaagggaagggattggtcatagaagtggtactgtgtttcatttatctagttatggcagactctcaaaaacaaatggttctatacaactaacattgtctgcaattcccctgaatccattcacttgttcagtaaatgtgtattgagcttctacaaggtgtcaagcaccatgatctctgtatcagtgatttaaccatttttgatggttactacagacctctttaagaatgtgatagaaaactgtagctccctccccagaaaacttttctagctttttattttgctttgcagtgagccaagatagttccactgcactcgggggacagagtaagaccctgtctcaaaaaaaaaaaaaagaaaggaaccatttcaaattaggtgggagacatggagctctaaatactacagcatccattgcctagaaatacaggtattctcagccgggcgcggtggctcacacctgtaatcccagcactttgggaagccaaggcaggtggatcacctgaggtcaggaatttgagaccagcctggccaacctggtgaaaccccgtctctactaaaaatacaaaaaattagccggatgtggtggtgggcacctgtaatcccagctactagggaggctgaggcaggagaatcgcttgaacctggcaagcgaaggttgtagtgagccagattgcgccattgcactccagcctgggcaacaagagaaaaactccatctcaaaaataaataaatatattaataaataaataagaagtataggcattctcatacataacctcagtaaataccattaagaaaataattttagacatggtgcagttgctcatgcctataatcccagcactttgggaggctgaggtgggaggatggcttgagcctaggagtttgagaccagcctgggcaatatagtggcaactcttctctacaaaaacctttaaaaattagccaagtgtggtagtatgcacctgttgttgcagcaactcgggagcctgagatgagaagattgcttgagccagggaggccgaggttgcagtgagcccagatagttccactgcactctgggggacagagtaagaccctgtctcaaaaaaaaaaaaaaaaaaagaaagagaggaaataattttttaatatgatctaacacccagcctacttacaaatttcccacaatagttccaagactatttttataaccttttttttctttttacaggatccaatcaaggttcacgtattgcatttggttattatttctctttagtctgtaaaaatcaaaagcagttctttcgaaggtttttttttatgacattgactttttaaaagactaggccagttgccatgtgcaatgtccagcattctggatttatctggttctttccttatggtgtggtttaattcctccatcggtactttttcagttataacatacttcagagtattcctttcctttatattttttataaactggaagttagatctaaagtcttgactagattcattcaagtcaaacatttttggcacaaacacttcataggtaatgttgtgtgattcatatagtgccatgccagaaagcacatgccactttgccccgtctgctgatgacgctggatttggtcacttagttaagataaccactggatctcttccttacgaaggtatgtcaggaagtaatccattcattggtgctttggcaccatgggtactatctcatcccccaaaacttttcacctaatagttttagcatctattgatgatccttgtgctattataatggcagtcgcaaaatgattttctaattctgttatccctcttctacttatttgctgattaatcttacagaaggttattcttctgtaatccccagacaattttaggtatctagtacatatgcaataatttttagacagtttcaggaggtttagagaccatcaaaccccagcatggagcctgggtgatgaggtgtcctgttttgcatggaagaagagctgtagctgagctcttcatagtccttttattgttcttattttgcaagtaaattgcaaaataagttcccaacccaaagataacacaggctatccttcaacaaagaaaaacctcagcttttaaacttctaggccatttggcaaagaggcatgataaagggcttgaaagcccacagacacgcccagtaccactcctttttcctctttccaaacacttgcagtatgttacaactgaaaaactgctgagccaggcttatttcctcaacagtaaagccaaggagttggaccaggcaattcctagcatttctttctttttttttttttgagatggagtctcactctgtcacccaggctggagtgcaatggcacgatctcggctcactgcaacctctgcctcccgggttgaggtgattgattctcctgcctcagcctcctgagtagctgggactacaggtgcatgctaccacacctggataatttttgtatttttagtagagatggggtttcaccgtgttagccaggatggtctcaatctcctgacattgtgattcacctgcctcggcctcccaaagtgttgggattacaggtgtgagccaccgtgcccggccaattcctagcatttctaccagcattactaacatgtaggaacttgatattactttcacttgacagttaaattccttgaatccttcatttgagctttgaaggtgcttgattttcccctcattatgtctcttaaagtcacacatacctagatccattagtgcttccagttggaatttattatcagcactataagaatctcttatatttatgtagtccttttacgttataaaacactttttatgtattattgtactagaccctcaatgagtggacgttatatccctgttttgtttactcttgggtcttatagactgggggttttatttctgtcccattaatgtcactactgacagaggccactgaactctgttgtgatggactttcaccatacataatcattaatagtattgatttgcctgtaattcaggttgcttcattccagcctcgcagtcacctctgtgccctgctggttgtcttcccagcgctgctgtagttgccttccatggatctataggagagcaagtcctccaggtactgccctgtgacgatgttgttgaactctgtagcacgtgtgtcactgtggctggttctgctcacttcctcttttgctgccacttttgaatttaactctttgtttgtggtttggacactcactggatttggaaaccaggggttgtgggttctctcctagatttccgtctgtgtaccaggcttgtgcttagcacttttcccataattctttcacatgacctgcttagaaacccttaaaggtaagtatcactcttcccattttacagatggatacactgaggctcagtacttaagtgacttctgtattgtcacacagagtcaggggcaggaggctgctcttgggttagatgtgctgaggctcataacctcagcctggaactgggtcaggactacaaaggtaaacagaagcagagtcctttctgtgtgtccccgctccctgtacaagccaaggcctcacagcacatagcagccacagccacctgaggattcctgccatctagacgaggcagttacagccaagaacaagtccactgaggctaagctgtgctcctctggagggctgtgtttagagtccagccttctaggggaagcaaattaaacccaaactatagaacagcccagggaaatactcacaaagggaaatgctgacagtcagactcctgaagcttcctgatgcttctcgagttttggtaaagaacctcagtgctgtttgtttgtttgttttttaatgttttctggttttttgtttgttttgagacagtctcttattctgttgcccagtctggagtgtagtagtacaatcatggctcactgtagcctccacctcccagattcaagtaatccttctgccacagcctcctcagtagctgagactacagatgcatgctactacactggggtattttaaaaaatttttaaatttttttagttgagacagggtctcactatgttgctgaggctggtttcaaactcctcggttcaagtgatcctcctgcctcagccacccaaagtgttggatttacagggtgagccatgtcacattgccctctcttagttcttgaaacctgaaaccttgaggagcaaacaaaaggggtctcttggccaggtgcagtggctcacgcctgtaatcccagcactttgggaggccgaggcaggtggatcacgaggtcgggagatcaagaccatcctggctaacacggtgaaaccccgtctctactaaaaatacaaaaaattagccaggtgtggtggtgggtgcctgtagtcccagctactcgggaggctgaggcaggagaatggtgtgaacctgggaggcggaggttgcagtgagctgagatcacgccactgcactccagcctgggcgacagagtaagactccatctcaaaaaaaaaaaaaccaaaaaaaaaaaacgggcggtctcttgactctgtcaggacccccatgactgctcgtgtgtcttgtgctttgcacagttgagtgaaggagcactgtgtccacagtagacattgtagatttatatatgtatcattatgagtttcccagcaggtagtgagagattttttattacagttggtgcattacagcgattttccaacagatagaaggaaagggtgttgaggctctcccaacagcaaggtataggctagtggctgtcctgctcttcactctaccaagctaatctttctgggtttccatatccttatctgtacaatgaggaagttggactagatctataaggtcctcttctcgttgacattgtgtgaaccttgtaggagctggtggtgtctgtcgattgactgagtgctggagctggcagccctgtgcaggctgccacctttgcccctttactgtgcttgctcctgactctatgtcgcgtctccaaggagaagaagtcctcaccagtgaacggagacctctctgaactaagaataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggtaagccctcttcacccccgagggtgccttgccaccttctctggatgctccaccttgcagtcctcagaggactcagcctgagtctcccttcctgccccagcccagagcatccacctgttgccactgcttgtttttccacaggaaaaaatcctgaaccacctgagtaccctaaggagggacagagacaaaattcagggcttccaggcaaagggagaagctgatatcctggccgcgctggtaagtgaggctgtttcaggaagccctgaggcggtgcgcccgtgtagggcagggtgagcctgggcaagtaggcggcagctgggaggtgtttctaggcgctgctcacagggaggatgggtgtcagcctggcagtagcagacctgggttttagcccaagtgctgtctttctgagccgtgtagtcttgggcctgtttcttgtctgagagacaagtgggctgcctggatgtcagctagagtcccttccgttttctgtgactgtcaccttgaaggcagggcccatgtccagctgctggttctcttctgccaggggactgaagaaggtgtggcttcattcttcctttcaaagagagagagagagacaaggttgcctgagagtggagagggtttagaaggagggagctggctccagggtaagaactgagagggaagggctagaaaacagctaaggcaggtctgccaattctgatggcactgtatgtagtgaggtccaggcccaggatcatggttgccagtacagtgggacctcctccatatctgtgggttccgtagcggcgaatttacccaaccatggatcagaaatattcagaaaaaagaaaaagcgtctctactgaacatgtacagattttttttcttgtcattattctctaaacaattcagtgtaacagctatttatatagcatttacattatattaggcattataagtaatctagtgataatttaaagtatatagtagattttatgtaactattattccattttacataagaacttgagcatccttggattttggtatccttggggagggagatcctggaacccatcacccactgataccaagggacaactgtagttagaaaacaggcagcacattatgtacttgattagagatggggttggggggaactgatcaaatggttctgattttctggggaactgtgtatgttgaggaagtgggcagtggaggagtagtggggtcagggccagtggtgagtcattaggcctagggagagggaaacagtaagctagagacagccaagtccaaggacccctccaggccctcagtgtgcatggctgcccccagctcagcaccagtcaacagggccactgaggactcccccaaccccagctggggaggagatttggaggcaggaaaggacatagtccctaagcacagacgtcacacaattttgctgaggaaacaggatgcagtcttacatggcaggggtggggtacatatagatattttagactgaacagtggggtgctgaagagagggctggtcaggcttagatgacattaatcaagcaaaacttcctggaagaggtgacagattttgtccaggagggaaaagtgcgtcggctcatgagtgagacccacagagtttctctaggggccccagagcgtactggtttagctagaacagattgtggctgaccagtcaggtggagacagggttttgaccatatagtggtggggtgaactgaactaattcattactggagtcttctttgagaagcggagtgtggaccaggaaccctctgtagctcctcccactccagatcctgtagaattcctgaacgggggtagcgaggtgaacgagccagccttgcacacctccagcactgggccctccaccctgagcagaggtgtcagcccttctccccttcctgccccctgcagaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggtgagaggccgtccctgggcagggcgccagggaccaggacggtgggtcccagccctgccattcacttgcaggaccttagaagacttgggggctcagttttgtcatctgaaacatggagatgataatccttactgctgccaattagtctgtagattgcatgagcataaaatgaaataactggcatgctgtcacttcaaaaaataaactttttacacaaaactgttcaaaaaactaaatggtatagtagaaaatggaagggaagattattaatatcatttaccatcctccatcctcatcactgccatcacaagccctcttaacaagtcattggcagacacttagcagctggtggaagctttttatggtgttgtggttgggggtggctgagggagggctgaccagcagctcctctcaaagacccagaggatctggaagagatagggtaactggggaagggagacagagatggccaggttttctttggcccatgggattaccacacagagaacaagatggaaagcagacaagggggcctcggggcacctcctagaggagggggctttgatagtgagaaagggagggtttggggctgaagaactggctgtgaagctgaaatggcaccacatctcctcccccccgggagcctctggggatcacacttaccctgaagagggcccagtcccctttggaggggtagagggctcaaccttcctgctctcataggctgggaggggaggggctctctgatggtattcccccacttgcactgtttagggtggctgggtctgtctgtcagcagcagagccacccaggatctctaggaaggtggagtcccaggctaatggcagggcaatagctaggagggagagatagcaaggcagactctgcagtatgtgcactgggacagactgcagaaggaggcggccacctgctcctcattgttgtgaattcagatgtacagaatgaggactggcagggattttagaccttccagttcagcccctactgatgaagtcactgaggtccagagagtgggaggagtttgtcccaggccatggggtgggtgtcaggtcacagcttgagcccagatgtcctgactcctgggctctgagctcttgttcttattttgtccagaatgtctctctggccccctcttttcctccagatgtcattctgttctctcagatttctctcgtcatactctttgactgggtcattttctgcatctccttttgcccgtttctcttctccttcctctcctcacgcccctgccatgtgtgaatgcctactgtgtggaacagaggcacacagctgaggatgtggtggggctgaaatccattgtgtttgcccggaggggtgccttttcctaatgcacccagagaagtggccctcagagcagaagcctggccctcaatgactcagagcactcagattgcagctctccctggggtgggataaggtcaagggaagggagagaaaatggtgtcagcttgaaactagtataggaaatgttattggtactggtaggtttctttttttgttttgtgttttctcttttaattttagtgctatataatgtatatatttatgggatgtagaggtttttgtttgtttatttttgagacagagtctcgctctgtctcccaggctggagtgcagtggcgtgatctcagctcactgtaatctccgcctcctgggttgaagcaattctcctgcctctgcaacctctgtctcctgggttcaagcgattctcctgcctcagcctcccaaatagctgggattacaggcgcacatcaccacacctggctattttctgtatttttggtagagtcagggtttcaccatgttggccaggctggtcttgaactcctgacctcaggtgatcgcctgcctcagcctcccacagtgctgggattacaggcgtgagccactgtgcctggcctagagtgatactttgatacaagtatataatatataataatcaactcagagtaattagtatatctgtcacctcaaacacttatcatttctttgtgttggaacattcaaaatcctctcttctagctttttgaaaatgtatagtaaattatagttaattatattctccctgcaatgctgcacaacactagaatttattcttcccatgtagctataactttgtatctgttaaccaacttctccccaccctcctctccccagcccccttcccaacctctaatcattactattctactgtcttacttccatgaactcaaatttattatggatgaatagtactccattgtgtatatatgctacattttctttatctatctgttgatggatgcttagattgagtccacatctcaactattgtgaatagtgccacaataaacatgagtgtgcaggtatccctttgatatactgattttcttttctttggataaatacctagtaatgagattgctggatcatatggtagttctatttttagttttttgagaaactctcatactgttttccgtaacggctatacttatatgtagaaaaacctaaaggccccaccaaaaaacccttagaactaataaacaaattcagtaaagttgcaggatacaaaatcaacataaaaagtctactgcatttttaatacaccaataacaaactagctaaaaaagacatcaagaaagcaaccccatttacaatagctacaaaagtaaaataaaatacctgggaatgaagttaaccaaggaggtgaaagacctctttaatgaaaactataaaacactgatgaaagaaattgaagaagacacaaacaaatggaaaaatattccatgcttgtggattagaattaatattgttaaaatgactgtcctacccaaagcagtctacagatttaatacaatccctgttatcaaaatacgaatgacattcttcagaaaaatagaaaaaaaactaaaattcatatggagtcacaaaaaaccccaaatggccaaagcaatcctaagcaaaaagaacaaaactggaggcctcacactatcttacttcaaaatatactacagccagttgtggtggctcacacctgtaatcccagcactttgtgaggccgaggcaggcggatcacgaggtcaggagtttgagaccagcctgaccaacatggtgaaaccccatctctactaaaaatacaaaaattagctgggcgtgatggtgcgcacctataatcccagctactcgggaggctgaggcaggagaatcacttgaatccaggaggcagaggttgcagtgagccgagattgtgccactgcattccagcctgggcaatagagtgagactccattaaaaaaaagaaaaaaaaaaaatatatatatatatatatacacacacacacacacacacatatatatatatacacacatatatatgtatatatatacatatatatgtatatatacatatatatatatactacaaagctgtagtaaccaaaacagcatgtattgatataaaagcagacacatagaccaatggaacagagtagagaactcagaaataaattcacatatttacagccaactgattttcaacaaaggaaccaagaacatacaatggggaagggacagtctctttaataaatggtgctaggaaaactgggtaaccaaccatacgcagaaaaatggtattggtagattttgtctgtgtgcttatttgagtttgattgtactgcgtgggaactggacagctacctccctaattagcattaatattttcccagagattatttggctgtcaaagtatagtaagaaaaagacctaaaatagggtccagaagtctgatagagaaatacaggtgaggctggtgtggtgattcacacctataattccagcactttgggaggctgaggcaggcagattgcttgaacccaggagtttgagaccagcctgggcaacatagtgagatcctgtctcaaaaaaattaaaataaaatagaaatacaggtgagagggagaagcagcaggacaaaatgtgtaaaatagaagagaccttttgatagaggtgataggaaaggaaagacaaacctatgggctgggagcatcaagaagacattaaagggattggggtgacaggagaggcccagagagacactgcatcctgccctggtaacccgggcaggccctgcaggatcaggtggcatgcttgtaccctgcttctcctgctgtacacccccgtgaagaactttcttgatgctctctgttagtaaccgggcacatcccctccgggagcttgccatgactcattgccgcagccccactgctcggctctgcctgtttcatgacagcttcagatgtcttgggtgagaagagtcctccaggagacttgggcggatcacttccctccagaggccctgtatgtggctgtggatgggggctcctgagtctttcagcctcttctccgcagggccagccctgccctggctctcgggacccaccctctctgggctgctcacaacctttaacctttagaggactcttctttctcctgtatgattctctccctttctactgttctaggaacttccatgtcaggaaatatgcccaaatgggcctctggcccacactccagctactgctccattcatttgctcttttatgccacctttgtcagcagagctgtcaggacacactgtctgttttgttgcctgtcctctgaagccgccttggacttacatgttttgaggggcatgttagaggacttggccagaaatgtgctaccagtctctgggcacttgcttcatagcggggggttgggatgtgcctctgacttcttgtcttattcctctggagtaaagctcacaactcttcccaaacttttggaagcagtcatcagcagccacaatttgttaattccatttgtttcccaaatctcaccctctccaggaagccagcctgcaccccaccggcccctgctcccatcccccttcactctgctctcttttcccgtggtgcgtatcactcacgtagtatgatgtatttgctacattgattattgtctgcttccccctgctagaatgtcagctctacagaagtagggatttgtctctctctctcttttttttttttttttttaactgttctgaggcttctagatgagtgcctggtacctaggaagcacttaataaatatttgtggaatgagtgaaaggaaggcaaaaatcaattaatacagggtattaaggaggcttttgactcacaaaagggaatctgagcatctcagaatagccctcttcccactcaccctgccctaccacctgtctgtcacagagatagcaccaccattctcccccctgtacaaaccatgctctgttcttgtttatccttgaccagtatgtccagttgaatctgtctctaaaatacctggaatgtattgcttctctctttttctccctactgccaccaccttagttcaggccatctttagctctcccctggtccacggcaaaagcctccggaccaacctccccatgttcctcttgcctccttagtcccttctctgtggggcagccaagtgagtggtcacttagggttttggctcactgctgtacagtgacgcaaacagaatagaagtttatttctgcctcagttaacagttcagaggtgcagggtctagagctatcacagtagctgtacataagcttatccaagggactgggttacttccatgtggttcttccaccagcttctagggatgttgtcctctgctgcgtggtcaaagttgggctcaccaccaccatgtccaaaattcagttggggtaaaaaggaagtagaaagcaattttctttttttaaaggacaatgcccagaattatggtcattgctttctatcacattccattggctggaacttagtctcatgaccagaccttgtcgtaggggatctggaaaatgtagtcttcccaggtggccgcctgaccagcaataactccgggggttctattattaaaaggaggaaggggagagtggactctggaggttacacagcagtctcagccacatgtagagcggatcacacatatcatgcccctacttgaaacccttggtgggtttccactgtacgtggagcaaaagtgaaactccttaccatgcatatccagccctgcgcagtctggcctctgccgttctcaccaagccctttcctgttttaccttacctctcttcatccggccagtacttcttatccgtcaattctctgcgcaggtatctcccagagaggttgcccatgtcatctcccagccattgtggcttctgtcattgtgccgattttgtttgttttcttgttgttttatgcagtgaccccactggaatgtcagctccataaaaaagggaccacatttgttttgttcactgatatgtcccatctctgctacagtgttgggtgcagatgcattgaagtcttatttgattcatattgatacttgtgcttttttctttcccttctaggacacgagagacttcctaaacaggtaaaagagtctcctctccatggcgtacctcatcccccttgtttatgttcccccgcttctgaccaggtgcatttgaattcatggggagtggtatggtgccagaggtactcacatcccatggttcatcctgatgcctttctgaggagcaggacacatcattgagaactggagacttgctctcctccttatgagttctctgtgtagccccagctccttggcccactggccttatttgaggtgggacagagcagagaggttagaaacatggcttagtagacagagcgccctggatgtggagtctactgatgttctgaagccctggttcagctggtgtctttgggccactgtttttctgtcacttgtttggggataatcatacctttcctctccccttcataattgccatgaggattgagagataagtatgaaggaaagtaagaagagctgagtaacagcttgttatgtatgtcatcttcttaggtatccacggaagaagttctgggttgggaaacccattgctcgagtggttaaaaaaaagaccggagaattctcagataaactcctctctctgcaacgaggcctgagggaattccagggtaagggttggggagcgcacaaagggtgggagtcagagcagggctacctcgtagaaagagcgcacccagctcctttccatcaccttgtcgatcctcactcttctgagggcctcttgtcttagacatggatccctatcaggaaattgatactgcccgagcaagaaatgggctcataaattttcgggacttgagtcattgctgtccttttttctccccagggaagctgctgagagacttggaatataagacaggtgagtgtctagagggtgtttcccagatgtacatcaaatatagaaaactccgcctgcagagattctgactgctcacttttcccccaggtagccccttttgcaacaggaagaatttcccagctgcacaatagaagcccccctccctctttgcactttctaatcagcctactctttagtctgcagtagaggcctctgcttgctagtctgatccttctctgccctgtgtttgcttttctttttcctatcctcacaggtcctaccaccagtccttttcctgtggccgagctttctctcatcttcctggctgcatggctcctatattcagagcaaacagcaggggcaacctaagaccagaggccatatccaccacaggccccactattgtgccccctctcagccctgcagttaggttgtacactgcataccaaccaccaaggagcgccatccacatagaccaagatgtgaatggtgccccttggattgtgaagactggtggtctcctcctggctcactttcacacttgctttcgtgagaaccattgaggaggtcggcctgtctgggagcaaacgaggccctgagagcttcatctagttcacaggataaaatcccatagcagaactgagttagcagtggttaaaccttaggtggttgtagcttctttattaatgtctgagctgtctgtgaataccgtcaaattttacctatcaggttattctaattatagagaatcctatgaggatgatggtgaggattatcccactctgtcagtacctgttcagggtttcttgaaccatcttacagagcaggctggtagttttgaaactgaaattgaacagtttacagagaccctgaatgcttgtgttacaacagatgatgctttgcaagaacttgtggaactcagaggccacatctgtcccaaatttcttttctttttttttttttgatacggagtctcgctgtcgcccaggctggagtgcagtggcgcaatctcggctcactgcaggctccgcctcctggggttcacgccattctcctgcctcagcctcccgagtagctaggactacaggcgcccgccacctcgcccggctaattttttgtatttttagtagagacggggtttcaccgtgttagccaggatggtctcgatctcctgacctcgtgatccacccgcctcggcctcccaaagtgctgggattacaggcgtgagccaccgcgcccggccttttttttttttttttttttgagatggagtcttgctttgtcttccaggctggagtgtagtggtgtgatctcagctcactgcgagccccgcctcccaggttcacgccattctcctgcctcagcctcctaagtagctgggactacaggtgcccaccaccatgcccggctaatttttgtatttttagtagagatggggtttcaccatgttagccaggatggtctcgatctcctgaccttgtgatccacccgcctcggccttccaaagtgctgggattataggcgtgagccaccgtgcccagccccaaatttctcttacatgggagctcacctgtgtaattacctgacatcatctgacagttagcacagagagtagcaccttccgccaatttctacttcaaagatatcggactgaatatgacattaaagatcaagctgcaaaaggggatgaagttactccaaaacaatttcatgcatttgtaccctttctgggagagctttatcataacctggagatcagaggaacaaatggacaggttacaagggcagatattcttcaggttggtcttcaggagttgccgaatgcccgaatgccctcttttctaatcccatggatgacagcttaatttgtgcaataaaattgctgaagttgacagggtcagttttggaagatgcttggaaggaaaaggaaggactgatatggaagaaattattcaggaaattgaaaatgttgttatagatgcaagctgtggcagagacatgaaacagatgctcttgaagcttgtagaactccagtgcagtaattggggtagagtccatgcaacttcatcatacagaaatacaacagccaaaaaagatcccaattactatgtgaatgaaccaacattttatagtggtcattcacatagttattgtgtttcatagtgttcctttcactgcagctgatccggattaccaagaagcatatcaagagttacttgaaaaagaggactttttttctggattatgaagaaaatggaacagatttttcagggactggtgatccacacttggatgatattaatgatgagttggacccagagatccagagatagaggaagcttatgaaaagttttgtttggaatcagagcgtaagcgaaaacagtcaagttaaatttcagtatatcatgtttataaagcagtttagttatggtgatttagcagaatacaaagccagaaaatgtgtcacacttataccaaattaaggatgttgagttatattactaatgtatgcaactttaattttgtttaacgctatctgccaaaataaattttattccctctgacttaaaaaacaaaacaaaacagtgatgctgtttttttttttttttcccttgtccccacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaacagcctggagatctgtatttgtaggtctatatctatattatatctcaaatgccaccagacctcagtctggctacagagaaattccactgatagcagtagccgaaggttttccttctgtgccttctgtaacagtgtaactttgctttctgttctctgcacacatgctgtcatttctggaagtccctcaaaaagagcctactgcggaacacagacgagttgttgcgtggctccacctttttattcctcctgcagtggtgcccttgagctgaggtccagcgttttggagcaagtgatgactctccctgagaagggagacctccagtatagcacacccaaaaattcttccttggaaaataagcactgcctcagaggaaatagaatgtgcagagattcagccttgcatcctaacacagtcaactgtttttcttgtcctttctgatttttttttttttttttttttttttttttgagatggagtctcactctgtctcccagtttggagtgcagtggcgccatctcggctcactgcaagctctgcctcccgggttcacgccattctcctgcctcagcctcccgagtagctggaactacaggcgcccgccatcacgcccggctaatttttttgtatttttagtagagacggggtttcaccatgttagccaggttggtcttgatctcctgacctcatgatccacccacctcggcctcccaaagtgctgggattacaggcgtgagccatcgcgcccagcagtcctttctgattttttaaattgccatcttaaagatggaaaagggaggattatacgaaactacctgtaaaattacgctagtggcaaagagcatatttcctctctgttctctaagttgtgggctcatgtaaattttccctttttattttttatattcatagtttttcattttgtataactctacttgcacatatggtaaactttctacagtgcttcttacaaataggaacatttccctgccccatacctccctccaaagacccagttcatacctttcagcaaactattttgtgtttgccttgctgggattacaggtgtgagtcaccacaactggctgaatttttattattttagagacatggtcttactctgtcacctaggctctagtgatggtgcactcgtagcttactgtggccttgagctctggggctcaagtgatcctcccacctcagcctcccaaagtactggaattacaggcgtgagccactgtgccctgcctgaattatttcttgttgacttttcctcctattttctgtattctctcaaatctgttatctccaggcttcatatgtctcctgaattcatttattaagtacccgtgatgtgccaggatgtttctaggttacaacagtgataaggttaacaaagttctgcactcttggaggttatattccagcaaatggtgacaggcagtatgttaaaattgaaaaaaaaaaagtaattagcactatgcaaggaagtgaaataagtctgtgatagatagtgacctagtatctattttataatgtgtgatcagaagggagttccctgaaaagatggcatgagagctgaaatcagaatggtgagagggaaggtctaagatcacatcagctagagggaacagcaaagtcctaaagcagggacaaactgggtacagaaagagtgcatttagagtatggttatgggagaacagaaagagccatagattttctcttttttttttaatagagacggagtctcgctctgttgcccaggctggagtgcggtggcatgatcttggcttactggcaacctccgctgcccaggttcaagcgattctcttgcctcagcctcccaagtacctgggactacaggcgcacaccac

SEQ ID NO: 13756 - DNA, 10887 bp, Human
tcagataatcagtttcaaccacatttatctagggtttagtatttttatattactacattcaattttaataaccctctaggcaaacattattaccttcattttacagagaaagaaatgtaaactgactttccaaatgtaaagtgactttccaaaggtcacaaagctagaaagtatcacgttaaggacgatcccagtctcctggcttaaagccctacgctcctcccacacctcatgccaagaccaagatctgcagccacggtccttcacccatgcacacatctgtggataaaaccaggccttcccccattctcccactgggtgatcagcctagccccttgtggttgctccctttttactctaatcactttattacctccccttcccatccaatctctgctcttcctgccacgagtgcagcccaggaactagtttgtccaatacaggagccaccagccacatgtgtctactgagcactgaaatgtggccggtctgaatggcggcatgctgtatatgtaaaatacataccggatttcttttttttctttttctttttctcttttttcttttctttttttttttttttgaaatggagtctcgctctatctcccgggatggagtgcagtagcgcgatcttggctcactgcaagctcctcctcccgggttcacaccattctcctgcctcagcctcccgagtagctgggactacaggcgccggccagcacgccaggctaatttttttgtatttttagtagagacggggtttcaccgtgttaaccaggatggtctagatttcctgacctcgtgatccgcccgcctaggcctcccaaagtgctgggattacaggcgtgagccaccgcgcccggccaacacaccggatttcaaaggcttttcacaaatttaaaaatgtaaaatatcttattaatgactttttatatggatcacatattgaaatgataatattttggaaatataggactaaataaaataacatcattaaaattactttcacctgtttagactatttttatatggccactaggaaattttaaattgcatatgtggctcactttgcgtttatgttgaatagcattgctcggaagacagatctgacagcaaattatttatggtcactcaccttcttacttgtgtgcctagggcaagctgaataacctggctgggcctcagctttctcatttatgaaatggagatcctaatagcactgatgttgcagagcagacacagaaataagatcatacttttaaattgcttgtatcaatgtaagttgtaccgtcattgtaaataaattctggccaaattgcttgtatcaatgtaagttgtaccgtcattgtaaataaattctggccgttagtagttttctttctcctccccatcatagggaatattccagcctcttttgaggcctgcagcaggccagttgaggcatcaccattgaagttgctggtgcagtgtacaccctggcacaaggaccttatctgagcccccacactctcctgcttgctgatgggcaagccctgggctggctgatacctccaatctctttggagacagctggccatatggcagaaaggctggaatggcatctccactctgtgacccagtctcccacttgcccccaaaagaatatttcttctgacagtggacagctgacatatcaccactttccttctactgtgagtgtctctggatgggcagaaaggaatggccagcccctggttatggtcatctaaggtcacctctgaaatgctgtgagcccctcttccttcctctcctctgctatttcccatctctgctgttggcaggagaatagaaccctggctgccagagatgcaagtgtgtgacgatatgggtgctggtgcatatttagtatgtgcctgtgtccagccatgtgcatgtgtgggtgtgtgagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggtaggaaaggggaactgggggatcccagggtggactggactggactaagagaaacagcagagttgtggattatttaggccacccggaggccaaattctttctccttacttacatgatcacccaggcaatagacccaggcatggaaaattgtgtttatgttttatgtttttttgagtgtgttctgtgttcacttgtggccaacagataacgggagttcaacaagtacttgttgaatgaatgagtgaccaaacatgagtgtgtgtgtctgtgccatggatcaggtgtgtctgaagtttgcatttgagggaatgattgtacaaacagtgtgtatatgtgttaatgtttgcatgtttagaagtgtgtctggtgtgtttggatgggagtctgagtatgtatatattcgagtgtgtaagtgtaactgagagctcctgtttgtgaataaattcgtgtttacatatattcaggctgggtaaatgtatgtggcatgccattttatctgtcattaaatgaatgtgtgctggttttagttgtttatgcattgtgcttatgaattatgttttagtacaagtctgtgtgtggatgtcttaattagttaattagcagttgatagtgagaattctaatatatctttgaacacacatatttatcgtgtgtgtacctgttcctaactctattctggagcaaataattttgaaaacaatttatcaattatttttacattacccaagtttcttctcccctctggagtcatacacagataattgatttcagtaacaagggagggttgttatttacacatgttcctttgggatgagtcggaaactcagaatgatttcagtgcggggcatatcaaactcagtacagaccccagataccacttacccgaagcaaaacacaatagaatgttaaacctgaagaaagactcaagtgggaaaaccaagtcacagcctctaatggcacaggataaagggggaaagtcctgatccaaagtcttagagacaaatcaagaggaagaagacccaaagggagtaagctgtcagggtggtgaaggctcggggattgtcagctaaggaagggactcctctcctggggccatttcattcctggaggcagagggtcagatgaccagacaaacctgaacaaatcattttccatcttgagtattttatgttccttctccccaggaacaaatccataagtgtcttaaatgtctaagaaaagagagagaggagattcaagaaatccagtcaagagaaaataaaaggatgcaagtcctcctggtaagtcatcaccccttccccaggttcctccccttcctcagggtccagtgtcttcctgaaactgaggcaacatagattatagggctttgaagttattatgagtttaaatcctgactctgacactaactctatgacctcaagcaactctccaacttcagtttacttatctgtaaaatggagagtaaaaatcatcatgacctcattgaattactgtaagcattaaatgagattgtgactgtaaagtagctcagggctgtgcacataatgtgcttttcatacaagacaggaggtagggtgtccccaccacctcctcctacacctcctgtaagccctaccccttttagaagctgcagcagatggtgctgagacaacactgtgagtcttgcttctcgaaatgggatgacaagtgaaaaggaaaccatgacacagttccagatctacctggggacaggggaggaagaggagcagagggagaaggaggaagcaaactttctcttgggcttgcctcctgccccctcagactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggtgaggcctgaaccggaaccctgccccacctgtgctgtcctgtgactcttgcatctttgtcttgcctaagccatgtctccctgactcacacatctctgtatcccagatgggaggtgggtcagaggaccagaaagtctcaattctagttcatgcttttccaagagttccctggtcactttttgctctctggtctccacctctccgtcccaccatctgccaaatagggaagatactttccttaaatatttcacagggcttttgtgaggatccaacagtaagatggaagtgaaagtagcactttgaaaaagtattaagtaagttgcaaaccattctctataacctaaatgtcaccaaccaccagtcaggaagtttgtcctggtctatttcacttcctcacactggaggagaggtattggggtccccacaaagtattggaaaggcagcatgacttagaatgatgctcttaggactgagaaacaggagaccttggtatgagacttactttgcctccagtgagcaggggaaggtcacttcaccatctttatctaaaaaataaaggctttgggctctgatccacagagatgggtgagtcctaatgctctgtgactctatgcatctggtatccttttcctgtccagggctagaaatatattttgtcttttccagtcataagaaaagtgggaggagcctgggcaacataacaaaaccccatctctacaaaaaaaaaaaaaaaaaaaaagaaaattagccaggcatggtgacaaacacctgtagtcccagctactcaagatgctgaggtaggaggatcccttgagcccaggaggttgagtatgcagtgagccatgatcacgccactgtattccagcctgggcaccagagtgagaccctttctcaaacaaacaaacaagcaaataaaaaataaataaaataaaagtagaaaaagaaaggaaagaaaaatggaaaggagaagctggaaactgaatttctggtatctctttctcctaggacatcagaagcactctaataaggtaagcaatatagtttctctcttttctttttccatataaatatacatacatgtactgcatgcctagttattgccacacaggtatataacattctcacttaaggatacaaatttacatataaacctctatatacccaaatgccttctcaggtatatccatagatgcccaaaaatgggcagtgggattcatcctagaggaagtacgtctgcctgcaggaactagcgccatcatgccctattagaagatgaccagctgagtctggagacattattaaggatgataattcccagacccagccatttctgtgcccctagatgtgaaaccagaaagtgccggaaaccggtggctgtgtcgccagagctgggccagaggattcgggactttccccagcaggccctcccgctgcagagggagatgaagatgtttctgggtaagagaaccccaggcctccacagagcgcaggtggccatgaagcctgggtttaggagtggcctccacgctccactgctgaaaggtgtgactttggcaagccttattccttcctgtgccttgatttccttatttgcagatttttataaaatctgcctattaggatattgtgacaatgaagaaagagaataaaggtgaatatttctggtgaaaaagttaaactgattttaaaataattcaacaaatctgattagtggtcattaagcaatatgaaagataatgattaacaatatatcattcttaataagttaaaaaatcccacagcaacatttgtaatatgtgataagtttttgatgatgaacattgttaattaatagccaacaacagtatttatcttgaccctgtggtatctggctcgtccctccttccttctcactttctttctgttagtctggctcagagttagacggtcctacggggactgtgctccacttccttttccggaacagggagtggtggtagggtgtgggggagggtttggatgagagtcaggaatgggacatggctctctgccaaccacctcctcactaaccatgacagaatgaatgatgacaccaattttgaaatgacccacccacagttatgtcaccctagaaggacttttcccataattccatttcctgcaaatactccagtgacctgtcagtgaaggaaatttcactctaatcaaaggctgacctttgactctccccaaaattatttccaagtggaataataaataaatgaacccatttctctattcactaagcagatatttcttgagcatttactatgtcctgggctctgcgggtacagaggtgagcaaggcagtcatggtccctgtttgatcagggctagggcagtggggctcccaccagcagcagcagctgcattgcccaggaaattgttagaaatacagatgttcagctccaccccagagcacctgaatctgaaacagatgtgttttaacaagagctccagatgattctgatgcaagcttggaaccactggtctagaggattccagcttacattcttcttcttgtcccttccctcttcttggcctcagttttctcatcattaagtgtctgatggttttgtaagactaataaaatctcatcctggtttattttctttacagaaaaactatgctttgagttggactatgagccaggtaaggagcctatgtcaggatgggagagaatgagaagtcctcggaaaggagagaaaattttgcaggatttgcactatgactatgttatgactatgacaatagtcataacaaacacccatggatacatatacacatcatatatattatatatacacatatgtgtgtgtatataatacatgtgtgtatatataggttgtgtgtgtgtgtgtgtcacattgtttgtaaggctctcaggagaaacatgaagaaaggacaagcacatacacatactacattcgtggtatgaagctcacatcctgatctgcgcatgtcgagtagatagaaagattaatgcagaatgggataaagtccatctgggaatgctttctggataaaggggactttgatctgggtttataatcacctctttagaacgtaaggaacccctgcttcctctcagatgtcatttcacagatgacagaaggagggcggcctgtgggtgggaaaaaaatgaacagaatggaccccttcaaggctgtcatttctcaatcaaccagcctaagaccctgggagtcacggagttgttggagggggttctctaacccacagatggacctaaatttatggaagcttctcaatttatgaatactaaaagtaacaaaacgcaaggctctgcagcagtttttggtggtaaaaagtggtcctcagactctgacagtttcagaattactgaggcagagtgaataacccaggggtgagccagagagcctgccaggagggaagactgtaaatgagtcaccagtgccctgggaggaaaacagggaggaatcatgaagtttggactgaagggagaaatgtcgctgcactgtgggatagagatgggaggaggggagaatgtggtatatcagccccaggagatccaagctggcacgcacagctttggaaaccaaccaacttgcggtgagcagaagagctttcccgaggaccacactgaactaaacgagagctttcacatcctctgaggcaggcttttcaggctttacctgtgtgcaaatcacctgggcatcttgttaggatgcagattctgagagcgtatatctaacaagttcccaggtggttccacactgttggcccacgtaggcactatacatgtttttggtaataataacactaacaggaggggcccagggggagtttctatgccttccttggaggtaatagcatgtctgctgacatctgtcccttttggttatccccacagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtggtgagtatagacctggcccatgggggcagctgcaccgtgggcgtggtgagcgaggatgtgcagcggaagggggagcttcggctgcggccagaggagggggtgtgggctgtgaggctggcttggggcttcgtctcggctctgggctccttccccacacggctgaccctgaaggagcagccccggcaggtgagggtgtctcttgactatgaggtgggctgggtgaccttcaccaacgctgtcacccgagagcccatctacaccttcactgcctccttcactaggaaggtcattcccttctttgggctctggggccgagggtccagtttctccctgagctcctgagaaggagcagttacctactctcctctaagtacaggactcatatcaacccaagtaccatgtggacttgatccctggctgaatcacctggatgacttggaatagaaatgactgctttagaagatgggatggggccgggtggtaagggatagaagagaggactctcaatctactgatcaagtcctttccccaatgcccagtggatggccagggtacctggggactcaggctgctgccagttctgctcaccaccatccgtgcttggcacagaagtagctgcatagaaagggcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatatagagaaaaaaaaaacctgctctatatctgaaagagctcttgggaagacagagaaacataaagaggaaattacagcacagtgtggtgggtgttacgggaagtccaaccccagcattatgggagttcaggggaaggggcatagcccagcctggaaggagagggtgagtgggggatggctttctgaaaagggtggtctaaaggatgcctatggtcaatagggaaaagaggggaagaagcatcttaagaagaggaaacagcagagaactggctggatgacctgtgactctggagcactgggttgtctccattgtcattatgggcagatgtgtgccatccccagccgacgccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgaactttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagtgtaaactacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattagagattgaattgctttccctgggagtgtgcagtatctcattaaaatgttgtatattcaaaaaaatacagacacacacaagtgcctatataatgataaaacatatccaaagcacccaaacctgtgattccagaaaagtagatcctatttttgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgaga

SEQ ID NO: 13757 - DNA, 65485 bp, Human
gcgaatagctggagacccctctagctctaccattttttgattctaattaaccaaaaaggatattcgaggtccccgctacaaattctgaacccttggcttcccctccaaactcccacacaaactccaccccatcctgcctgtgtgtctttgggaggatcatttccttctttggtcttggtgtccttgtttacaggttgagggatgataagagtcacctgatctgggcaagtcaggccataaataaggcttgtatgtaaaggtgcctagcatagttcttggcaaagcaaggatcagtcgatatgattgcattggtttgtgcatctgggaagaatgagcagactgcatactgtgtgttagggtgtagggaggaatcagacgtgaccctgccctctagtcatctgggtgcacagattctagattaaaggatgtgggggtggtaactaacaaggagatggagaggaggtgtgcagttcctgggggatctgatgaagaattaaagcagaagggtaggagatggagaatgggaaggcatacctgaaaccctaaagcaactcttgatgagtaggcattggcaggaggccccagaacattttctgaccctcaaacactgagaatgcatgtctgctggggaatagtagtgagggggctaagggtatgggggtgttcatgcctgagtcaggggctctggatggtagaaatgtctgggagttctgacggaatgggggtgaggaggcctaaagataacctgttcatagtctttcagggccttaaccattatggctggggaagtgggaagtgccgatggggtatgcagaggagggcagctgtgatagtacatttcatcctgaaagcactacatgtggataatgacggtagtgatgatgccctaattttagtgtcatggcaacattttccaaggggatggaattgggtaccctcattagtgtcatttttgtttgagagatttcaagagtctatctaggtgtcattttaaaatctattgaaaaaaaatcttgaatgcaggtcactgaccagttggttccatgtaactgcactgccttctgctaccactaaagcaatgttatgacaacctggacaagtcatgggaaacctatgtgagacttagttttttctttttctttttggagttgggggtctcactatgttgctcaggctgatctagagctcctgggctcagacaaccctcccgcctcagcatccccaagtgccgggattaccgatgtaagccactgcacccagctgagacttagttttttcatctggaaatgaaggcgacctttgtgatcccagtgggcccttgcacttgtgtataaggtgattcccagcactgctcatgaaagtagtgatggcagagtagcctctgctctccattttatttttggggtggggggggcagtggtggaggggaggatgaggatgatatttccattaaataagtttccttgttgcttttcttcaggcaccactgacctcgatggaaaaatgaagtccctggcccaggaaagagacccaactctgtggctgttttggattagtttgtacaatgccctgcagacctactctctcaggaggctccaagtgaccaaatgtgacaagaaagttttttgtccaaggcagtttggaagagaagttggtgaccgtcgggataccacagccgccccaggacggcctggttgagacattcactggagggtctgggtgcagcccgctgcctggccggtaggcggcgcgcacaggccgtggggcccgggtctgggcgtgcgcgcggctggtagcagcggggccgcgcacgccagggtccgggagccgggccggtgcccccggagccatttccgggaggggcgaggccggcggctgccgggcctccaatctcggcggcggcggcggcaacaggggagcctgggtctcgcggcctgcgagtccgtcgcgtgctgagggagacgcaggaggtggagccggccgggtgctcgagggaaggagactggaagctggttccggcgtgaggaggtggaggggccgccgcgggctccggggggcggtgagggtcgggacggaggcgccgcggggtgaggagaggacaggggccgggtgggccgagggcgggcagaggcggcggggcggctgcgcccggggcgggggcgggggccgggctgaagcgtgggcaccagccgctgaggtccaagcaagtggacggcgggcgggcgcggggccgcggtggggcgggtctggagcccacgcctgccgcggggtaggcatgggcggccaggatttgctggtcctccgacgggaggggtgacaacgagagcgaggccgtgctgattctgaagggagtgcggaggaggcaggaccctggtagcctcggcaccttcagcccgggttaggtggcctgggctgggctccccaccccgatcgcgcgcagacggggcgtttcccctagtttccacctgggtggaatgctttgtgggagtctgggtctggattagtttcatcagctgtgggagggaaacctagttgcagcaggattttgattcgctggtctggggtgctaggggtggactgtgatatctgggaatgaaatctgagccttcaaaggagggagagaaccataacttggctgctctggcgaatctaggcgggctggcgagacagtttaaagctctagaagtaaacaaacctggttcccttttacagagtctgaaaaaggggagcgcggagaggaggctggaagaggaagatgcctagcacagaccttctgatgttggtgagccttttgcagacatcctcctggttccaaggcatttgtctccgtttttttagtccaaaggatcccagtgtgtagatttcacctctgatgcttgcttttggtagctgagcgttttgccaccttttattttgttttgttttgttttgtttttttggagacggagtctcactctgttgcccagactggggtgcagtggcatgatctcggctcaccgccacctctgcctcctgggttcaagcgattctcctgcctcagcctcctgagtagctgggattacaggcgcacgccaccacgcccggctaatttttgtatttttagtagagacggggttctccatgttggccaggctggccttgaactcctgacctgtggtgatccacccgccttggcctcccgaagtgctgggattccaggcgtgagccaccgcgcctggccaaccaccttttattttggatgaatgatcaggatgaataaatagctgaattaaatacatcaatacagtatatgtagaacttaaattattgaagaatctttttcaaaattattattattttttttaaatgagacaaggtcttgctatgttcctcagaccggagtgcagtggctatttacaggcataatcatagctcactgtagcctggaactcccacttcaagtgatcctcttgcttcagcctctggagtagctaggactaggagcacaggtcacctctcctggctttctttttcataattcttgcagttttaatccctcccttcccgtactaccagagcagttttgaaacctctattattacgttttatcagggtctgccatatactagtttatctgagtgtttgtcttccagattagagttatggttcctcgacaggcagataatcatgtcttctttgtttagagatgaataaacacctagcatggtgctctgaatatagtatgtgcttaacaaatgcttgttggattgaaccagtatgaatttaagttcttttgttggacagagaggtatgcctgctttagagctgtttcctctcctcctgagatctttctgtgctgttttactgagcagggaagaatagcgttgctaaatgcatgtttaccaaaatgacattttatttttgggacttttatgattccttatggacttcttagtgtgagaattatggagagtttatagctttgaaatggtggtatagaaaaagtgtccgggtttagttttttttgtttcgttttgttttgttttgtttgtttgtttttgagatggagtttagctcttgtctcccaggctggagtgcaatggcacaatctcagctcattgcaacctttgcctcccgggttcaagcgattctcctgcctcagcctcccgggtagctgggattataggtgcacaccaccatgcctgggtaatttttgttttttaatagagatggggtttcgccgtgttagccaggctggtctcaaactcctaacctcaggtgatccacctgccttggtctcccaaagtgctgggattacttacaggcgtgagccgccgtgtccagccaagtttgtttgtttgtttgtttttgtcacttctctgagtgcaaaatcagtgctttaaaaacaattcatttctctctctttatctcactatcccagagggtgggttggcgtcactgggaaactggcaaaaactggtagtgagatttccttatactgggtgctgacatcgtagtggcataacctgtaaggtctgcaggggggctaaagaagagagaaactaagttttgatccattgtgatttgaggcagggatctaggataattttaggttgtatgtgagagacatagatgaatacttaggttatccgcagatcccaatgaaaagttcatctaaaatagtatcttgccccaaatttcatggatttttcagttttaattaatacccttatataacttaaaattcttattcaaagaccattatgttagaaatactggaaactataagtaagcaaaaggaaaggggatttgttaatctcccctatctcctacatccccttcattcgcctctaccccgtgcagtaatttatcacccagaaataaccgctgtgagcatcttggatggttaatgcagagtgacttgtagcaattgacagtttctgtttatcctcttacagaaggatatgtttatgtaaattataggttcttatatgtaagatatttccccatgcacagagatatggttattacttatagggcctatgcatttactttaacagaacaatgactgcttttactcggaatattaactttggaatcagttttcttttgaggtatttctctagctgttgccaccacctttcacctcctcacctgttaatttagaatgtttaggagtgttgctttgcttgttgctgtaaggaattaatccacatagatgcgagtggccctaggcagtcatcactttctgaagacaacatacatgttgcatgaagtgctttcactggaaaagttgtcattcattccttgactgtaatgtataatactatttggaactaactggtaaagaaccaataaccatggctgggttttcagtggcacactaacccatcattctatgaggtgtttctcaagctactttatatgatatgtaaaacatgttcttggccctccacctgggaagaaaggacctaagtgaataaaaaaataacctcagtgcagtgcagcatctcagaattagaaatagtcttagaagtcatgggatgcagctttttttttttttttttttttgagacaaggtctcactctgatgcccaggctggagtgcagtggcatgatctcagcttactgcatcctcaatctctgaggctcagatgatccttccacctcagcctcctgagtagctgggacgacaggcacatgccaccatgcccggctgatttttgtatttattttttgtagagatggtagtttgccatgttacccaggctggtatctaactcctgggctcaagggatccaaccgcctgccttggcctcccaaagtgctggattacaggcatgagccactgtacctggcctgtgatgcagcttatattatacatgaatctgttgaagagtatctctggtaaatggatatccagtctcccgtcttttctgctaatggaataagtgagcaaaagctaggaaacaatacaaggtggattcaggaatagtaatgttaactctgatagctaacatttattgagcatgtattacatgttaagtgtaggaatactgtacttatttaattttcacaaaaaccttttggtatccttcttttacagatgaaaaacgaggcttatagagagtaactacagcagttgagtggtggagccaagtttgacctcagttggtctgacttcagatccctccctcttgcctactttgtgtccttacccctggtaagggtagaggttgctgaccattgtgactgatgggagagggtctgtgtggagcagatgggataggatagctccaccctctagggggcactttggcaatgggggactgggggaggagggagtcttttttcttctagtgtagtctgaaaatacatgttttattattaaattattattaaatcttgtttattgggtcaggcgtggtggctcatgcctgtaattccagcactttgggaggctcaggcgggcagagtacttgaggccaggtgttctagaccagcctggtcaacatggcgaaactctgtctctactaaaaatacaaaaattagctgggcatggtggcgtacacttgtattcccggctatttaggaggctgaggcaagagagttgcttgaacccgggaggtggaggttgcagtgagctgaagctgcaccattacactccagcctgggcgacagagcgagactgtctcaaaaaaaaaaaaatttgtgttttattttcttttacgtcgcatttaatgaattatattgaaattttaaaacttgtatctgcaggcatagtgttataatctttaaatgccatgtcagagtagcaaaagggattacagaatatttgttataaaaagagggcattgggtcatagagttgaagactacttgtgtggacagtatgctgtgagagaaaacctggagatgacctggagtccacatataacaagccttgaatccagactgacaggctcgggctatcagccctcagtgtgttcctgccctcaattttgttatcatttgattaggatagtttgcttgcctttttccatttgctcgtatgtgatgtgtcatagactgcagtactttccacctgtgtctcatagagaataaaatgagtatgttcatctgctgagagttgtgatgatgtcagagggaattcaagtcagacagctttgtagcagcctttctcccccttggcaaccattctttttattcatactctcctccttggtgctagagggtggtatcactttgcaagttgccaaatatttgtagtttttaagaaaaaggtattttataaagccagtctaccccttaggtggcttttttcttttctcatcagaaaatgatgactaaattagctgatattcatagatgaatcaaggttagcgtgtgcaccctggtagtgctaggtggggtttgagtgataattgcttatctagggcagtggttcttgaccaggggcaattttgccctctgggtgacatttgacaatgcctagagacattttgggttgttacacctgaagggttctgctggcatctagtgggtagaggctagggatgcaaccaaacaccttacaacgcacagtttcctgcaaacaagaattatctggcctagaatgtcaatagtggtgaggttgagaaactggtatgaagtttcttaccatagatacctggatatctgtgtagtctatgctttcatatgggtgggggagtgattcccttcttggaggttaacgtgtctgttattgtctcacttggggttattttgcccatgggtcaagccttgctgctcaggaatatatattggagatggtgcagctgatcttttatagcaatgcagaattcttaagaaatgctgtcctttgcaacatttctgcaccactcttttcttgatttgcaaacagcaagcttccctcagttttgttttttgggttcaaaaattgaatctttccaggtccttgagcgtctttatctgtgacccttgactctttttcagggatgctttctttctgaatctcaagtgggatttaagcaataaactgaaagattgaccttaggagctctgttctattatttgagccttgtgtcttgtttgtaggatttgctagaagaaagggaaaattcattgggattgttgataggacattaaaaaatttgttgacatttgagtggccattgcaggatgaacactgtatttggcaatctcccagtgttatagatgaaacagagctgtaataatttccacagcctttggtttaaaggaaaagagggttataaacagatagaatccaaatcccagtatttgacttagcttttcagtctatgtgtcaggaatttttagtaatatttaccttcttaattaggttttacccaatctaatattatatacagtttgtgcacattggtggcagaattgagaatcagcctgggtttaagaatttccatagggaattgatgtgaatcagtctgtatgtgtaaatgtacagaacccaattactgagataaaaaccatgctgtgggggaaggggagataggggccctctgagaagatggaatggtgaaggctgcgagtagtttgtggatatatcagtcatatcttggcataatccaacagcgtactaagggatcaagggactattttcaaggctgagcaggtttaaggaaaacatctaggtgaaacatctaagggctagctagcaataggagagccattatcactcttttttttttttttttgtcatggcaatttcactgaagcttttattgcctctattggtaatatgacagggactgtaagaaacacaattgaacttacagagatatgcagatgatattcactaaagataatcttcatctcaagtattttttatatgtgggcacttctaattttatacatttttctatttaaaaagcattacattttaaaatttgtacctgttttgacatttggcaaaaaggaaactgtacctatggttcagtttaaaacaaagaatcagcatggggagtttaccggaatgaggactgaaacacttaggagttaaagcaattcaaggggcgtgtgtgtgtctctccctttctccgtcaatctctctcactctctctggctctctcacagacacagactcaaacacacacagccatatgtgtaatcattttttagtacaaaatattccctgtagccagacatttatcttcagaataatcacaccacattaaatcagtcttctcttttcagccctagtaaaagttttgtttaattctaagatgccatcatagtgatgaacaaccttaacttttatcctacataattatattcaaagctttatgtatttttgtttataattacacagtaattataaatgtttagtaccaacctgatgacaaacactattttgttgaaaaggttttgcatttaaaaagaaaaatatgtaaaatccaaggcactaggccacgaaccaatatcagacttttaaagaaaacactttatattgaaaaaaaaaaaaaaaaaaagctaatgggatctcatttcaaaacacagcatatgtgaattaatcaatctgaaaccaataaccataactcaaaatcttcaagacaggaaacaaaacagtacatatatatagatatatagatatatatatcttttaaaaatttttcataattgaagttcctctttatatttacaaaaaaatcaggaaatactgaaagcagcaagattcttctttttcctttttcttttaataaccaattccagtagcctgaatagaaattttcagatttttcttttggtaaaactgcattcttgaattaaagttatgattggaatattgatatgtctatagggaaagctttctagtctatttcaaaatcatgtaaataaaaagcagttttgatatgtcattgtttcttaaaataatttccatatttgcataaaatgtactgctattctaagtacattcctttgttaatatcaaccctagaccttagagagtgcctggatatatatcccaagcagaatctgttcctatcaaaagaccataatcatcgaacatttgaagcattacatttctagcctgccttacggaaatgtttaagaaagcaagaaacccttcttcacatgtcagtaagtgaacagggaaatgaccattttcagcataaaagcagctcatgggtaatgaaaaaaatacatacaagatagcattctgctttgatgagaaaactgagctaatctgagtgaaacaaaaacagtaaagagactagaagccagattggtattttgcatcatgtatgcttgtttgaaaatctttgctcctgaagtaaatatttggcaaccaagtgattagcgaccacaatttcaacaaaataataagtcattgaaaatggactatttgtctgaaagagcaatacctatattacaaagattgaacttcatggctcattacaaccattttcaaaatttaactgcaactatcttcttataaattaagagagtttaatttgtgttccatagtgcgatgacaaaaaaaaagtaaaaacaaaacaaaaaaaccctcatgcctaaatttagaatattgtattatgtagcaatccaaaacattcaaaacaaattaaatagtttaacttatgtgacaggcagataagcatttcaaaagcataatgaagtccaattatgtagtgcttaatgtagacaggagaagaatctaacattatgcagacattttctaaataaaagctccctgtaggacagctatatataaacatgggtaaggtaagcgcagactagttctgtggaaccttttgaaatcaagagtctaaaacacaatacatttttcaggtaggcaccaagttatcctaaaaaattttcatgttggttattctgacgttgttttttctcttttttttttttttttgagacaagtcttgctctgtcgcccaggctagagtgcagtggctcgatctcggctcactgcaacctccgcctcctgggttcaagtgattctcctgcctcagcctcccaagtagctgggattacactcttaagcctgtgagagggcaaggaagggagtagtttctggaactttgagagagttgagatgaaggagaaggtaacctgtaggaatgccagccagtgacccagtaggaaaggcatcaaggggaataaatacttcaaactcttttgctaccctctgatctcctgctgtagcctcccattggtctaatacaactggaaaccagaggttaaggagtctggttgatttaattcagagggtggaatccggaggcacatagccgagctggaaaatgctggatggaggatctggaggaggagatcatctggaggggagaacatccagcatgctggagttgagaggtctagtttgtcttaaaaggcacaaatgaggagataattcttgaacagaatcttgaaggtggatagcatatggattatagaaagggaatgttcccactgattttaacaggatagattcagaggcacacagttgccacagctttggcaagcccaaagctgctttgttccagtagtagccttagaatcttaattgcctggagggcctttaaaagtactgcagtccagctttcttgctgcctaggaatccctctacaatgccctgtcaggagtgagtgctacatactttctcagggggttctttccactgttggacagctttaatttttagaaaatttttcatgtgtccagatcactgaatgcatcagctagaattaggtttgagtgtatataacagaaaaacctaaagtaatagagattttttaaaagacataaatatatttctttaagagaaaactggcctggcgcggtggctcacgcctgtaatcccaacactttgggaggccgaaatgggcggatcacttgaagccagaagtcaagatcagcctgggcaatgtggtgaaaccccgtctttactaaaaatacaaaaattagccgggtgtggtggtgggtgcctgtaatcaatcccagctactcaggaggctgaggcatgagaatcgcttgaacgcgggaggtggaggttgcagtgagccaaggtcacactaccgcactccagcctggacgacagagtgagactctctcaaaaaaattacaacacagtacaatacaatacaacacaacacaacaatacaatacaatacagtactacagtacaatacaatacaatgcaatgccagtacaattccattccattccattcattcccattccattccatgccgataaggccattcctgagtctttgaggtgccaggctgcttctgtctgtcattccgctatcagtagtgcatcccctcctgggccagggtagctgcctggggttctacctgtcaggttcatgtttcattcatgaagaggaagaggaaacggaaaaagaagggcttgccctccattttaattaaaaattattttggaatttattatacgtgcagaagagtatagaaagcacatatctacattttaatgaacaataataaaacaacgataccagattaggatataaaccatttatctctaactctacgcttcaccctgttacaaatatttcctttcttcccctctagggataaccccatcctgacttttataattattcccttgcctttttaaaaatagttttaaccacctgtgtatgcatcctaagtttagtttgtttttttttaaacttgatgtaaatggatgcatatgtatttttatttttgtgattttcctgtgttgctcagtattcatgcgatccatgttattgcatgtagtttaagttcattcatttttattgctgtatatatagtattttattgtgtgactaaactgcagttatttatccatttgacttataattcacatttgggttgtttccaatttgaggctttttcaaacattgctgttatgagcgttcttatataacaagtgatcacaagtgcaagagtttttctgggatttgtgcctaggagtggaattgctgattgtaaaggcatacatgcctaacttcactagatattgctaaacttttctgaagaggccaatacaatttataccactatcaacaatatatgagagttatttccacccaacttggcaaacctgatatttataaagcttattttttgacaatctggtaagcagataaatgtaattgtaatttccgtatgcatttcctgataactgatgtggttaagtacccttttcaatgtttaccaaccacttggattttctgttttgtggctgcctcttcaagtcatatgccttatcagttatttctcctttttagttctattattaatagattttgctgtatatttgctgagattttgttactaggtgcattcagatttaaaattgttacatcttgtaagttgagcttttcatataatttgctttttgacataatatagctacatcagctttttgtcatgaaataggaaacttcaaatgtatgataaatgaatgagttgcctgttagtataggcagaaactgcagaacaatcctagcccattattcaggctttatgtatcagcgatttgttctgttatcccataaagtgaatgagtcatttttgagtttaaaaaaatcatagggctttttttttgaggtccaatttgcatacagtaaagggcacaaatcttaattatccaggtcagtaaatatttatgtatgaatatacttccagatcaagatattaaacatttccagcactccagccagcttcttaatgtccctcccagttgatacctaccaaaggttttgcttagttttgctgattttgaactttacataaagtggaaacatacagtatattctcttttgtgagtggcctttttgctcaacattgtgtttgtgagattcagtcatgttcttaggtagcattagtttttctttcttattgctgtgtagtgttacaatgtataactatattataactaatttgttctgtagttgtagaacatttatgtttctagttttttggctattgtgaatgacactgctgccttcttgaacatgtcttggtaaacataaaatgtagagttgctgtgtggtaacgtgtactgccaaacagatttccaaagtggttgtactaatttacgctaccagagttttaatatataacttcttgatttagctttgggcagcaaatgttaaatttctgtcatctgcataccacacatggagaagagcactgagaactctttcctgaagttgtataggcacttttattttattttttatttttatttttttcggagacagggtttcaccctgttgcccaggcaggagtgcggtggtgcgatcatggcttcctgcagccttgaactctgggtctctaaccatcctcattgagaagcctcggcttcctaaagtgctgcgattatgggtgtgagccactgtacccagcctgtacaagcaattctaaaatgtgaaatgcccttccttttctgtaatttccccagagagtaaagcctactgcattcttgtttatctagtctgtaaatgttaatacacaattgatgggaacaaagcaaccttagttctttttgagtatgaaaaggaccctgttaagggcagaatttaaaatatttgtagtagttaattctcaggttaaaatcataatcttctagaatgctttagattctaagtggctattgtagtaacactttatactcaatattgggggaccatgttttttggaggctttcactgaagcatttaattccattcttttgaattcgttttgacagatgggtctaaaaaggaatagatcaattctgtattgaattccagtcttaatggcaccgagtctttgagacaattgaggcaaattggaaattctgttttcacattcttctgaaaggggatgcctttcagaagtgtcctgaagggcgctggggagggcaaatatgaggatgccagggtaagtctgctccctgtctggctgtgttgggccagagtggaagaaagcctaagactctgttacccagccctttctgaaaatgttttcaaatgctttcccaacaatcacgaccacaagagtcaacagtctgtttggatgactgaaaacacacaggtttacgatctgtaaagatagtaggtaagtgatttaatcttgttgtataggtaggccagagggcactcgcagccttctgattgatttaatagattgttgaagattaagagttgacttaacatctctcttagaaaactgagaaatagctcattactaaggtgtgttttattaccaccgtctgtaagaaaatacaacataggcatgggaatcaaactacttaaagcctcttccagctcctttgtgactgggaaggttacttttccttgttgcttattgaagagaaaaggaaaatgtttatcattggataattcaggttcactgaatatttaatgagtgtttattatctgcagtcattttcttattaccttatctcatttaatattcacaacaaccctgtgagtggacgatggtatcttttttttttctcctgaacgttttgttgaattatcccaatggcttctatttttgcagatgagcagagtccagttgcatagaggtttagtgttgtgccacacatcacacagcttctaagtgagagctaaaattagagccgaaggttttgattaccagtccagactttctaggacaccacagctgcctttctgtagaacagattaacatgactctcagagtccgcaagagtagtggtgaggtgtcagttcaggggaatactcaaaggtcactgtccttttcagatatctgggtagttgctacagtatgtgcttaggaattgctggataaaaaaatattctttaaaatctcatcattttagtcgttaataatttattattataactcgtaaaaatatacctttaggcaagttattcttaggtagttatggttgctttcatttggagtccagagctttactctctatttctggagttgcaatttctgctgtccttggcccatttaaaaactttttcagaaggccttttaaattttatttttttattaaaagaaagcctgtgaatccaaagaatcttaggtggtttcttagctgaagggacatttggtgaacacaaatggaactgttaggtcatgatgcttttttaagtgtacaactctggtgttttgtatattcacagttgtgcagccatccccacgatcaattttaggacattttccaaagaaacccagtactcagcagtcacttccttatttccttctcaccggtcctcagcaactaccagtctactttgtgtagatttgcttagtcaggacacttcatataaatacaatcatacagtaaatatgtggtctttcctgattgacttcctgattaaccattcgtttaatggtttcaaggttcatccatgttgtagcatggatcagaactgcactcctttttattgcagttacagggcttttcctacagaattttaagtaatggatatatctaacaatgtctcttgttctcacctacaggagacacaggatcttgggcttactttacttatataggaccttttgtaatatcgaggctatttctatgctttattgtagaacagaagttattaactggggaatatggacctttatgactggcctttaggatgtcctgaattctttgtaattatataagattttatgttcacaagcattttctgggcgtcggaggagtctggaacagcaaagatctctagcttttgttaaaagataattttcgaaagtaatatcctgactcttatacagatataaaatgaacatatgttgaagattttattttactccaaaagaggaaaccaggcagatgttataactggttcaaaggagaggtccaaaaagctgctcatttatggatcaggaatatcaaatgaatgtgcaaatggaggcaaaacaactctctgtcataggggtaggaaagtcaggtgaaacttcacctgacggcagaatttgcatatttagggatctagattactttgcactgctatcagttatctacaactttcagagccgtaaacagcctcctcataatcagaatctggtaacccggaggggcgtcccagataatgcataatttttcattggaagccgtagggaaaaactctctcctctactctcacaccacaacaatcaacaccgaagacttccgtgaccaaacgtgtgggatttttttccccacactccaagaagcagacatcactgggtgtcgcctaattcaattctgacactgtctacctggagatagcatcagatctatgggttgagggctcagtcccaacccatacctgtctcccccaaccccaacctgtcacaagtctggtccttcaaaatgtctgactgactgtcttcaaggtgaggttcccatgacctcctcttggattggattaatttgctggaacagctcacagaactcagggaaacatttacttaggtttacaggtttattttaagggatactgcaaaggttacaaatgaagagatgcatggggcaaggtataggggaaggggtgtggagcttccatgcctccctgggtgcaccaccctccaggaacctccatgtgttcagctatccagaggctctctgaaccctgtccttttgggtttttatggaggcttagttacataggcatgattgacaaccatgtagaaatgtgactggacacaggaggcatgatctcatactaatagactgaccggaaacccagcaaggcctgtctgttcaggttgtcgctggcctttctgtgcagccttccttcctccagaatatggggcacaaccctcccaggaatgagggttttttggcccacagttggactagagtcttgctttgaggcaggtaaaagaggacaggagaaggttgagagagattctgtttcctgaggcccaaagtgccccagcattataatagaagactataacaagggctatgggggttatgaaccaggaaccatggatgcaaaccaatatatacgtataacatcacagaagcacactttcctgctcactttcaatagataccacaaagtttgaaactcttccaagtattaattttaaattaaatttactcagctgcttacttcagcttttaaaagtaggttcttggtaatttcgaagatgcactttccaaagggtgtttatatagttgaaggtcagtcagagacctagggataggtccctgcttattcttttgagcaggcttacgtgttggaaatctctagagaaatagctttagttaggttacacttctcagcaaatattcagtattcctcatctctaatagcagcatgactgttgtagggaaggaatttccacaaatggttatgaaaagtctaagtgtcttaactcccagacaaagatagagaattctgttagtaagataagtatgggactggagaagtcagctaacctctgcccttccccaatcgtgatatgctcagagaagttaagacttctttctgtgtgagaaatacgggatcttttccactagatcttgcttattatccaagaaattatcatttctagttttagagaatgatgaaactcatttgtgctttgaaatataacctgtatacatgtgcacagtaagtcatttagctatttattgtcagactctgggagttcatagcaaacttagcaacattccatgtgcaaatttgcatatttttccccccatatcttacctacttgccttaggctgggagtctattttcctacaaaactggtaattgctcttatctctgtgtccttcagtgtgttcctctgcttattgaattcagttttatgcatttagtcttctctcctagtataagctgctcctgatacttttaaatatgtatttcagaagagaggtgctcagaattgttacttaacagaatcagcatctccctttacttgatgccttgtcctgaccacaagtacattaataaagtgaccatttagcagtgtttcgggttcagcttttaggaacttagaagctgtggttttccatgagtgcacttctgatgacttgggaacatttcatatgtgtgttctttctgtggccaagatggttttgttatttcagggatggaaagatgctttgcctgaatactcccatgctaagtgtatagcagttggtgcttggggaatggtaccaagtgtacatatctggcaaggccaggctagaagggaaaatgtagactcttaagctttttgagacgaacttctcagatactggatctcttgactcacatagtggaattttgggggaagtatgtggtttgctttttgtctcctaagaaatgatgattcagtttcctcaaacgtttctcacagtcactactggttgcttggaatggctgtctggttttgttgctcagttcttacttctttaatgacccaagaggattttccctttggggttgtgatgtgtttttgatgataaactttaatgcttttggaggctataaagacaatagtattttcttacctgtttaccttgcactttgaagttctgtagactgtaatatgaaagaaaatcagattaaattagctttgctttctggcttttctttttttggtgggggggcagaagctgataagaataaatatactaactgagtctcttctgtattttaacttcactccctaggctgaggcttagtccttagagtaacatttgaactgggtagaacagatttttcttttcctcaacagcccattcctgctgtaaagctcagatttatggtccttctggaaaaagtattgagcgttgaatagttcaggaaaacaaataacaaattctgtcttctttgcaggattgtggggtagaagattttgatttttattagtatctggccaaagaataaatattaggcaggaacaatgaattgatatctagtagagtgacgtgactgggccctgacttttaacacttcccaggaaagcttcgtggatgtcttttccctgctgcgtgaataccgggtagccattaagtttggtgattgggtgtcagtaatatgttaagtcagctactgggtcatcttttaataaaagaaaaggatggggaagagaatggattcttaagcagtgttgcctgtcagaatcaccggagggaggtttacaaaatacacattctgtactctgaccctgtgggtggggtattctgacccaagaagatgattcgttccaggaatcatgcttcttggatgatattgatgtacccccactggctttatggaaagaatattgaagaagaagatagattctcttgggggctgtgcctctagtttgaaaccagggaaggcacattttggtattagtctgtggcctcagtttcttcatcactgcaatgagattggactataggtggtctctaaggttccttcagacagtagcattttatgattttgaagacaacttttctgaagtacttttcaaactaatttctttccgtctttcttttgtaagcaaataagtagtatgagtgtaagtctctagctcagagaagaatgaagtttgcagttcgaaaaggccatgcaatagcagttcacttccccaaaatgctcagcccttgtaggatgccgttaggtcatctggaagttctgtatgccttcactgggagcgtagtgaagatgagagcctttcctttggctcttggagtaaactagctgacaggactttgagaactgttggtctcctgatttgtgccactgatagtttggctctggaaaactaggcagtggaaaaaacaatgcattttaaaccagaagatttgagtcctggctccgctatttccgagctttgtgacctgtaggcctcaatgtcttcatctgtgaaggacaggttcagctctgatggcctatgatgtgatgaaccttgtgaacttgtaggcagagtgccacggtgtgcagagtccagttacagataaccagccattctcctctgcagattcaacccactgccactgtgtcttgttaagcttaaataggagagatgtgggagagaggaggcagaaacatcctaggatcttgcaaaacaaaactgtcaaaagtataggcaatatcataattactttatttgaataaacgttgagttcctgctgtgttgaagatgctgttttaggcagtgtaggagatagaagacttatatcctcctcctaatttgtattcttatcagcacctggtaccatagagagttcatatattaaaattatttggttgttctccctaaccagagttgaattctttccttctaggacaaattaactcataatgcaataggctaatgcagtttggccctgagtgactcttgagaaataccctgagttgaggcacactggaaacgtggcacattagaaatgccaagaagaggccgggtgcggtggctcatgcctgtaatcccagctctttgggaggccgaggcgggtggatcacgaggcaggagatcgagaccatcctggctaacacggtgaaaccctgtctctactaaaaatacaaaaaattagctgggagtggtggcgggtgcctgtagtcccagctacttgggaggctgaggcaggagaatggcttgaacccgggaggtggagtttgcagtgaaccaagattgcaccactgcactccagcctgggtgacagagcaagactccgtctcaaaaaaaaaaaaaaaaaagaaatgccaagaagacattgtacaggagaatgaagggaaactttctgtagggaagtagctttcccagaaacttgactctataatgaagctatagagatcagtaaaatcattagggcattactgttttgaacatttccttgagtgaataacagacttacactcagggccctaggtctctgttgtggcccagcaagctgcattcagacaaggaggcagtttgagaggtacgagttgttatggaagcctgagaaaactggtttgtgtgcacttcagttttgaccatacaaccttcactcacttagcactgtgcagtaatccactgagcaaaattgccacattttccttggcagggaatctgtgtgcctgtggcagttcagaaattatttgtagagtgggtcagcctgtcagcaggaatgtttttctttgatcttcagcctgtttttctttaatgtgagcagaacagtaaagagagaatacattggaatatcttgttggttcccctgtttggctttacctacagctctttggttttcttcttttaggtcatactttcccaattagtatgtaggtatttatgatgttttgaagcccagagcgatggttccaatatcttgtggaattcagctctgagtgtgaagtcctgactttgcctctttctatcagtttgactgagcaagtcacttaacctttcttgacttcagttttccccatctatagagtgatactgcacactggtttcttttcttttctttttccccttcctttccttttcctttttcttttccttccctctccctctcctccctttgcctttgcctttccctttccctttcctgagatagagtctcactctgccgcccaagttgtattggagtgcagtagcatgctcatagctcaatgcagcatcaaatgcctgggctcaagtgatcctcctaccttagcctgccaagtagctgggactacaggagtgtgccaccatgcctgctgcttttttgtttgtttgttttttaaatttttttgtagggatgggatcttgttatgttgctcaggctggtcttgaactcctggcctcaggggatcctcctgccttagcctcccaaagtgctgggattacaagtactttataatgtgtaaatggcctgtacattcttaatctaatagcctcatgaggttataaaatacaaataaaataacatgaaagccatttagagttttaaggtgtataataccatgtattctcattaattaaattttaataaatttaaaagataaaattatttttataaaataaatttatttttaaaattttaattacgttaaaaagttaatgctttttttttttgagacagagtcttgctctgtcacccaggctggagtacagtggtacgatcttggctcactgcaacccccgcctcccaggttcaagcgattctcatgcttcagcctcctgggtagctgggactacaggtgtacgccaccatgcctggctaatttttctatttttagtagagacagggtttccccatgttagccaggctggtctcaaactcctgacctcaggtgatctacccacctcggcctcccagagtgctgggattacaggtgtgagccaccatgcctggccaaattaaaaagttaatactttttaagtgcttcactctttcctgtgcatgttgtcttggcctctttttctaaattagttttattccctctgtaatcagagggtcaccaaatctttgagttttagagggaagagaaagtttttagtgaaacaagtgggtgaactctgatccctgtaaaatagtgccttcatacagtaggcactccaaaaataattgttgaatgactgaaactcttaaacagcagtaagcatacgtatagcagagacaacattacagagtagagctctttctaggttggcatggtagatagctctgagggactacctgaatggagatgccattgcttttgaataaaacaaatatacatggtgtcttagtccattttctgctgtgatagcagaataccacagattgggtaattataaacaatagaagtttatttggctcgtggttctagaggctgggaagtccaagagcatggcactgatatctggtgagggccttcttcttgctgaataataacatgtcagaagggcaagtgagcacgcgagctagaggggatgggccaagatgtcatcctttatcaggagcccactcccaagataatggcattaatatactcatgagggcagaaccctcctgatctaaatcacctcttaaagatcccacctctcaacactgttacaatggcaattaaatttcaacgtgagttttaggggggacattcaaatcataacaggtagttagccctgttgagtaatggagaaaggattgtattagttccaaggaaagatgcatcatccagtgtgggtctggaaatatttgccagatggcttttctcttttagtaatattcatttgtggaatgtttctttaggtataaattggtgctgaagtaatttgataaggaaaaaatatcactgcctaattggtatttggtcacgagcagtaccagttcgtaagatttttttggaggtagcaaggggtggatagtgctactattggaagtttgcttatggaatcttttgctctcttgaagtgatttggagattaaaagagtttagtatcattggggatagctgtggtctactgtcagttaggaagtaactcatgactagatatcctgggcttattacttcagctcatattcctgacctcacaaaaatgttaagagaataaatcgtaagtataaaaagcactgagattgtgtagagtggaaaataacattagtgttagctccctcactgtattacacaaccacattctaaatttaaggaagccagaagtaaaatcactctgaagcactgcttttgaaactgcagattatgatccatttagagggacacaaaatcagtttagtatatcaagcgttaaagaaggaagaaatagaaatgtgagtacattacaagtaataaggtgctaagtattattttggaaacttttggttttatatgtttctgtttctacatgtattagattgtgttgtaaaagacatttctttgggactgtattttacaacacagtctcatacacgtagactctaatacacatattgaaacagtttgaaactcagtggtctaacaagtagcataccccaaatttacaatatttgtagccttctgctgttgggtacattcatgaaaaggtcttgcatccttaaagtgaaggctgaaagagttttatgtcattggggcgagtgggctaccaagctcccataaattctaggagctgccttttgtctaacgattaggattattgagtactattttgatgccttttgggtatcatctgaaatgtaatcattgaattggaaatggaataaacaagagaaaggctagtttactcattatttgacaatagctctttaaagtagttaatattatgaatattcctactactaaggtttataagagtttgtttttttctttaatgttatactttaaaaagtattattcattcactgggcaaataatttttttttttctagaggaatacctttccaattttataacagtgaaggaaggaatgttttacttatagaaactgtactgaaactactgttctattaagcaagggttggagataagcacccctgtcccccttccctgcccaggcacacacatatacagatacagcttattttatgactgtattgttcttgtgtttcttcttctagataaagacataaagattgatgaaataatttacctggagttgcacagtaagctagtggcctttgtggatgaccattcatagttcatatatttccagagacacaatacattgataaaattgaaataaacagaagcctaagaattataagtatatattcagagatatatagacaaaaaagtactgttataagtaaaaagacatagtgggaatagtaattataatcacatgaacttctgtgccatctctatctagatcaggggtgtccagtcttttggctgtcctgggccacattggaagaagaataattgtcttgggccacacataaaatatactaatgatagctgatgagcttaaaaaaaaataaaaattgcaaaaaaaaaaagtctcatgatgttttaagaaagtttacaaatttgttttgggctacattcagagctgtcctggactgcatgttggacaaggttgatctagatgtttatctgtagtcatgacctaactatataattttagtatgttatacatggtaccatgtatccagggtagatcctgccaagaacataaattgtgaaaagaaaactcttgggatgctgctggattgtaatgtgttactcctctgcccatgaatactgaaaatcaagatttgaaagggtactgaatactgagtcaaaaggcatgcgttcctagacttcacttaatcacaagcatgtctgtatgagcgtagtcatgtcatttcactttggggtctctgcttgtaaaatgaaaatgttagacttgatcttccaggttcccttcagctcttacattctgtgcttcccaagggctagagtattgcatcaggacccagcctggggtttgtgctgttttcaaggtcctaaggaactgcatcatcctttagtccaaggagataggataccttatgccacagagcccaataattcagtgagctgtgagtgttgtgagttgcatctacattggggactgagcctaggttgtttgtagtaacactaggaggaccttagaatgatgccaggagatgtaatttctgtgatcaactagttgactactcaaaaagcttgtcaggacccatccaactacagtgtcattctgtctttggtgttaaagaatttagatttatctccttttaaaggacctcctttgaatttaagaattgccattatcttcataagaatcaaaacaaatacaaagaaaatatattcttgctgaatgtaatttttaaatgttagtgaggaatgtctttatatcttaattttaaggcttttaaaaattagtttgcatttgctggttctttgctgtcaccctaatactggttatgttacttttttgctcagtgctgtgaattgttcataatatctatagtcatcttttgacattggtaacttctgttttctgggtgaattaggaattagtatcaccagaagaaaagctaatctgaataattgttctttcatcatctcgttcatgcacagtatttaaccatctggtttgaccacaactttcacactagacgagtctttataatgatagaaatcatgacatacttttgatgatagactcctctggtctttcccaggttttggctggtattgccattgctttggattgaggttgttgatgcaacagtgggctctggggaatggccaccaagaactgttggggaattgcagataaactgtctccatgggtagccctccagggaacttagtagttgtctaatgttaattaccttataccacagtctaattactaagagtattgtctgagtccattcaggctgctataacaaaatgccataaacgtggtggcatataaacaaaagtccatttctctcagttctggaggccaggaagcccaagagcaaggcaacagcagatatggtgcctgatgaggcccacttcctggaaggtggccttcataaaagtggttcatagaaaatgtcttctcactgtatcttcacatggtagaaggggcaaatttgctctctgggggtctcttttataaagtcactaatcttattcacgaggcctctgccttcatgatctaatgaccccccaaaggctccctcttcctcctaccatcagcttgagggttagatttcaacatatgaatttttgggggatgtaaacattcagtccattgcaggtataaatgttttcaacaagcatttgttgagtatctgtcctttttctaagctttcatgttcctactagaacactggatgtggatatccaataggaatatatttaagtcagtatcattatctttttctcaaaacatcttctaccttttttaccttcccttcctcttctagtcttaccatagttaatactgatattaactgttaacatcatagttaaccagtctgtcgaacttgaacttgaaaattttgaatgatctatacccacacccgaaaaaattactcacatacttaaaaatccatgccttttgttttgttttattgctgttgtttgtaatttacttatttttacctgatactatgttctggaaatttttctacgtagttcatgtagatctgtcttcttcttaatgtttcatggtatgggtacataaaatgcacgtattatagtttatttaaccattcttctgtgggtggacatttacattattttttcccttttgttagagaatactgaaatgaatatccttgaacatgtttatttgtatacatgtgcaaagtatgcagatgccaaaaagtgagattgctaggtcaaaacgaacatgcgtttaaaatgttgatagataccaacaaattgctttacaaaagttcctatcagtttgtatatcagtttttctaagtcctttttaaacatggactggattagcccgttcttgcattgttgttaagaaatacctgagtctgggtaatttataaagaaaagagggttaattggctcatggttctgcatatttgtacaaacatggcttcaacatctgcttccggtgagacctcaggaagcttacaatcatggcggaaggcaaaacttgagcaggcacgtcacatggcaagagtgagagcaagaaagagagtggggggaggtcctaggcttataaacaaccggatctcacctgaactaactgagcaagaactcattcatgaaagatgcacccccgtgatccagtcatctcccaccagacctcatctccaatgtcgggaatcacatttcaacatgagatttggaggataggcatccaaaccatatcatggacctagcatacttctcccagcctcacgtctctgatttaagtgttcactcatttacttgggcactgttacttgggcactgtcagcccctgtccatgtttgtattcagtataaattgtgtgccgggcactctgccacatgttggggatttagtactggatgagacagaaatggtccctgccatcatgtagcttacactttgccacatagaacttttgccatatgcagactctttttatgcatttgcagctactatcctctctttctggtatgacttttttccttttaacttttctacctagagaattttctttcatccttttaaccagcttaaattttgccctctgtcattatctttatcccttcagagttagatagtccttcctcagtgctccatcttggcactcatatgctttttgtggctattcccctgagaagttttcgtgatttgtttgtatatgtatgtgcctgtgtgtgtgtgtgtgtgtggacacacatctacatcttgcatattagattgtaaactcagtatagacttggaactatgatatgtacctgaacacttccccagcttactgccttcaaccctggagatgcttaatcaatgttgattaagtgaatgaatagtaaactataaaatgaccttagtttgtacagggcattgtaggggattgtagatatgaatagaactggtctgtcttcaagaacttaaccatatagtcagggagataagaaacagatgagtagactgcaaggcaggttgtgataagctctgtataggacttatcaaaaatgagtactggaggagaatttaaagggagagaggaattctcgtgaatgagatactctggtaagtttacagaggacaggttttttcttgctcgtaccaggtgttgtgaggaatacacatgatggtaagatatggttgctgactgagagattatagtcaagtaaggccttagagcaggcattggtaaattgtggcctgcaagccaaatctggctcttgcctgcttttatatggtccttgtgctaagaatgatttttacattttaaaaattgttaaagaatattttatgaacatgaaaattatatgaaattcaagttttggtgtccgtaattacattgtgttggaacacagccatgttcctttgtttacacaataactgactatatttgtactccagcagcagagatgagtagttgtaaaggagaatgtttgctttgcaacacttaaaatataaaataatttagtatcaagctcattacagaaccagtttgctgactactggggtagagaataggaaagattcaaatagagaagagaaatgacattgatattgggggtattagtgtgagttaagagagtgggacagtgattctagcagtcatatagaaattttagggctgaagtgacgatctagcttaaccctcttactgtataaaataggcacaagattgaaaatagtctcaaagtccactagctgttaagtggcagtggagtgctgctggagtgactggtacagaagccttgagggctgtagatgataataagattattgctgaagaagggcaagatccggaatgaccttgcccttgaaaaatgagagttgaagtacaaactaagaacagacttcttttctctctctaaatgtaatgtttttatttttcacttgtatttctagaaggcctttgagccctacttagagattttggaagtatactccacaaaagccaagaattatgtaaatggacattgcaccaagtatgagccctggcagctaattgcatggagtgtcgtgtggaccctgctgatagtctggggatatgagtttgtcttccagccagagagtaagtatgctgtctcctctgtaaaggtatagtggtgtgtcactagcctcaaactaattgctgagagataggactaatttattgccttttggttgtttttttgtttgtttgtttgtttttgagacggagtctccatctgttgctaggctggagtgcactggcctgatcttggctcactgcaacctctgcctcccaggttcaagtgattctcctacctcggcctcccgagtagctgggactacaggcacacgccaccacgcccagctaatttttgtatttttagtggagatggggtttcaccatgttggtcaggatggtcttgatctcttgacctcgtgatccacccacctcggcctcccaaagtgctgggattacaagcgtgagccaccgtgcccggccctggtttggttcttatttttaaaatctgtttaaatgtaaagcagtactttgtcttctgattggtcaagttataacaggactcttgtataactaatactccttacattgattttttttggatttgtagttcacgtaaaaacgcctcagaattagtcattgtaaggatccacagaaatctcagtatggtttaaacctttggtaccagtttcttccctagaacataattatgtcacctggagttcccagagcaggaatttattgctttcattttgtgctatccttttcagtaaagattaggtgaaattggaacagcacttacatggtgaccatttgagtgcttgctatgtgccaggcactgccatcaggctgtggggatatctgcacaagtagtacaggatctctctcctcttggagttgaactggtatcaggggatcgtatactttgagcttcctagaagtgactcagtgccagatcaacatggggaagaagaggccacttctcagggtgcagaagatgagcagtctcagtgatctgcttctgaatcttccacctttgcttaggattaagcccctctcctgcccacccacctttttcccgcctagaaacctggttgtgtgttaccttcttatgagttattttcctctgcagtctgtgcttggtgagtgttgttagtacctaaacacaagtagtggatttggtgctggatgttctataacactcccctgcaccttttccccactcttagtagggtatgggagttaacttccttgggataagaaaacagtaacattgaagataatcattagctgtttctcatttgcttgaaatttccccaccactttgcttccctgataacacctgtttaaaagggctctttaatgtgttttttctgcttttcttctcttgttcaaggaaagtcaatttagaagccagattccatttttatctctttaccctgcaaatagcttcttagccatttatggcgcagtaaacattgcaaaacctgacaaccaagaagcaagttccaactgcttagagtttttaaattaaagtggaaatgagacctgactctcctgtgtaaatctgtagctcactccagctttaaaaaccttgtcctcagttgctgctcctagtccttgcaagattttctgataaactctaagaaattagactggccggcccttccgctgcatctgctcaatggtttggatatggatgtagcttgtgtccttctgctcttgcttattcctttcctaggaagtattcaattcagtgagtaaggggcccatttcagaggattctgaggggtagcaagaaatatactttctttttattttttaacttttcattaaaaaaaaatcagtctctgcttatccttctattataataaaatatatacaacataaaatttaccactttaaccatttttaagtgtacagttagtcctgtggcagtaagtacgttcacattattgtacaggcatcactattaccagaactttttcatcaccccactggaactccattttaataaacatcaaataataactgcccattactctctcccgcatcccctggaaaccaccatttattgtatcgccttgttttacaaatgtactacaattcaaaggtggtacatttatgaaataaggctaagcttagagatctgagatttatattttacttgctatgattaatattaattttaggtattctttttaaaacaaattttaaaattaattggcaaataaacattgtttatatttatcatgtacaacatatgttttgaaatatgtatacattgtgaaatgggtaaattgagctaattaacatgcattacctcccatatttttctttttttgtggttaggtatttacttctgttttcagttctgcagctcactatgccatacattttgcttagctaatagtagagacacagccatcttaggttctgatacttatctgcttttagtggtcaaaaaggaatatgctggcctctgagaggccaattttccatgagaaaattgttagtcgtagtatactgatgagatatgccatctaaatccttgtgggctgaactccaagccatttgaggttttttttttgttttttgttttttgtttttgagacggagtctcactctgtcacccaggctggagttcagtggcatgatcttggctcactgcaacctctgcctcccgggttcaagcaattctccctgcctcagcctcatgagtagctgggattataggtgcccactatcacgcctgcctaatttttgtatttttagtagagatggggtttcgccatgttggccaggctggttttgaactcctgacctcaggtgatccgcccacctcaacctcccaaagtgctgagattacaggcctgagccaccatgcccagctgagttattttgtttctaaagatacaaaacaaaagcagtacatattcactatggaaaagttggacaatatgggtatataataagaacaaaattaaaatcttactactgaaggataccactattgtatttctctgtttctatatctgaatccagtttgaaccatacaaaatgtaattttgtaaaaaaaaaatcgtcaaatgttgacaattttatacaatttagcacatacacacacagcacactttcatttggtaatttccaacttgaattttagacacagataagaatgtcttccctccagagatcagggataattttgatagaatattcattttttttagcacttgctcacttgccatgtgttgctgaacaatcaagttatttttagttacactgcactaaaggagtctgaagtctggactagtgatgaattttgctgatcttccaacactgaatccctcttgagggaagagagtatttctggaacaaaggatggagcctggggtagaggagaagtgggcagcggcatgaactgtgctggggttagcagcctcttccttaattctgcctctgtgattatcagctcacagtttattacttttactttaatgctgattttaactgtgggttgtccataattcatcaacagaaatcagctttatgtcatggaggaaatgataaactctcagtttcttgttgtgtcaccttgggtgacacccttaagctctcttagcccatttccttgcaataaaatggacatcataatagctgctttacctagtcatgggtaatatgaggactgaatggcatcttttgcatgagtggaatttgtaaactgttaagaaccatgcattgttcttacactggcattttctattttgttaaacttaaaattctttttttaaagtaacaaataaaaattgtatgtttatgatgtacaacatgaagttttcaaatgtgtaagttgtggaatggctcaatcaaactaacgtgattacctcacgtacttttttttttttttttttttttttttttgagatggagttttgctctgtcacccaggctggagtgcagtggcacgatctcggctcactgcaacctccgcctcctgggttcaagcgattcacttgcttcagcctcccgagtagctgggattacaggcgcgtgccatcacgcccagctaatttttgtatttttagtagagacagggtttcaccatgttggtcaggctggtcttgaactctgatctcctgatccgcctgccttggcctcccaaagtgctgggataacaggcgtgaaccaccacacctggcctcatgtaccttttttaatggtgagaacacttaaaatctactttcttagcaatcttgacgtatgcaacacatttttatttactatgtcaccatgatctcttgaacttattgcttccgtctaactggaattttctatccttttgaccatctcccagtcttccttcttccccttactctcaatcccactaaaaaattctaattacttttcattctgtaccttctggggacttttgagataatctttttaggtcagggccatgggatctttttatttttagtttcttcatctctgatgctgtattccgttctttttaccctgtaccattttttctcacaacttccacaaaattagtttattcttttatcctccacctagtcacattactatacttctggacagctggtccagtttgctgatttttagacttctttttacctcattaattacttcatcaaataaggaagcatttctgaatctgtacagctttaacagttagaaatagttgaataacaagaagctaaaatatccaatattagattatagtcatttgatgaactattataacattaaaaatatgtttagaaagaattgttaataatgtagaaagtgctatcagtgaggaggatacagttattttacattatacagaatctcaggtatgtattacagtgtgtagaacatagggctagaaggaaatactccaaaatttaaacaaaaagtaaccacaaacaagtggtttcagtctctttgtcttcttattcagtctgtgtcttagttacctggttttgtcccaggtgtttacagaatgtggactctagggagagttagaaagagagggatgcagctgaagcaaaaacagctagcagagatgcaaggcatgatgtgatagatacaaaaagggggtgcagacacatcccgtggttgttgagtgaagagggagctccttctggccaggaaagtgggaatttccagatctcctaggaatgcagtagaagttcatattcagttcacaccttggataaaagccaggcttagattcttatagactcaaacagaaaattcctgtggtgcatttgaagcagtatagaatcctgggaatcctggactgaaaatacaaagacttcagttaaatctttgctctatcactgattttatctgtggccttgagcaagttttgatgctttgatcttgcattgccttttatgtcactcgtagatggtatataatgccttctgtgccagcctcagaatgctgttgtcagagtcagtcgagatacattgattgtgaatgcatcagaaggtctattagtctatttagatgccatgtatttatgattattatgatcgacaggatttgtattccctatttgttctatgtactgcctgacagagtggactctggcatctgtgatttttcaaacttttttttctttttgttgagacagggtctcactgtgttgcccaggctggtctcaccctcctgtgctcaagcagtcctcccacctcggcctcccacagtgctgggattagaggtgtgagccactgtgcctggccagcatccacaattttgagggcatttgtaggtccagaaaatgttagaatctgtgttggatgagaggctggacatagatccaagaaaaacaaaactaaaaacaggctgcccattagtcttgggggaaggaagagaaatgttgaacatctagaaaccttaggaaggtcaagaattctggaacacgtatatcatttgacctagtagttctgcttctgggagtttatcctgtaggtgtacttgtagtttatcctgtaggtgtgcagtatggtgtgtgttacaaggttatttcagcatgatttgtaatagcaaatattagaagcaacctatatatccatcattaaggggcaggttaaataaattttggcacatccataaaatggaatactctgcagctataaaaatgaatgaggatgcactgatctttaagataatactcctaagtggaaaaacaaggtctactacagtgctagagtgtgctactttttgtgcaaaaaaagggagacaaataagaatatagctttactgttgcacgtgtatgcataaggaaactcaggggggtagcatgagggttggggggatacgtttgagagagggaagcttcactgctttactgtgtgtgttatgtgtttgtatttttaaaattttgaaccatgtaaatatagtacttattcacaaacttaaatttaaaagtttttttaaaattttttaaacgaaagaaactctttgcaattggaaggcaagtgaggtggaagacacattgaatggttgctatatgccaggtcatatccatggaaatttatttgaataagagaaccatttgtttcttttaggtttatggtcaaggtttaaaaagaaatgttttaagctcaccaggaagatgcccattattggtcgtaaggtaagtagaatctgtgtatgtcattttttcccctcttgataatcatacctctttctttctatttactaaacctaatattctcaaagtggaggggtgattttgtctcttacctccaggggacacttggcagcatttggagacatttttggtggtcacagcttggatggaggggtgctcttggcatgtaatggatcgtgtccagaaatgctgctaaacactaaacatcctacagtgtacagggcagcccccccccacccaccaaacacagaattatctggctggaaatgtcaaaatggccaaggttgagaaccctgacttaaccctttctccaatgtaactggccaaaggagagatgagaagcctgttaaggaagtaagaatttgagaaaacctgactgtattgttaggtgctttggaacaacatgcagctggctgactttaggtatttatctaggagttgggtgcttacatggtttaggtcaggggtcggcaaatgttttctataaagggctagatatgaaacattttgggctctgtaggccatatcatttctgttgcaactcctcacctctgcccttgcagagggacagcagcaagaggttcaggaatgagcctggctatattccagtgaaactttctttacgaattcaggtaggcctttgttggttcctggctgtagtttgctgatcccaagttgcacagcgctgtctcttgctgtttgcaattttctgtattgtagtatgtcccctttgttatgtcctcttggccctcatccatgttgaggataaggtagtcacctctgtgcgtctcccacaggttatcccagatgaagataaacagggcaggccacttggcaagctctaaggaaggcatatgagtccttggaatcttcatctcctccagtgccctcccctgacccccctttggtctttcccaactttacctgcctttaagttttcttctacttttggctttcagttccctttcctggctataccagggtttgtttgccaacccctgacctaaagttggccagttatctttaacctttggctgaaatccattcagatcgctgtgctaactctcccagagataggtatcttcaggttcatttcctgtaggagagtgggagcaataacaggtggtgaagggaaatgtgagcatataggcttctgtttgctctccaaattatattaatccctaaaagtaaatctagtccttacagagtataaggggtggggacagggaaggtattgtagaagatggactgtagcacaaaggagattaggatttccccttatctcctgaatttttttttcttcttttcgttcagttttcagactttgagacaaataaatgctagggttccagaacccactcttaaacttagaaagtaacagaattggaagatccttagcttgccaaggactatccaatcactctccatttttcagaaacagattctgaggcttagatacaaaaagttacatgtgtgtatgtgtgtgtgtgtgtgtgtgtgcgcgcgcgcgcgtgtgtgtatacctctgtcatttattcacttaacacatgcttattgagccacctgctcagtgtcaagtacttttctgggtgctggggatatggtggtgaacaagaccaaatccttcctctcatggaacttacattttaataggaaagacagaaaataaagaagtaaacaaatatgtggaattttattttgaaataaatgctttgaagaaattaaaattgggtaacgtaatacaggctttgaggcaagaattgggggtaaggaagtacttgtgctttctaatatacctctctgtcactttttgtctgttttatggcaatagcatactctatgtatggaagctcagctttcatagcctgttctgttgcatgagtcgccatttatgtgaattaattttttaatttacaacttaaaaaatgtcttcacatccatagcatgcccaggcattgcccaggagtgtagcctctgctccctgccagtgtgggcctcttagactattgcagacatgctcgaaaggagtggctttccctgtggtttcactgagggccatatctaagaagatcttcttgtattctaattatccttggctagagatgagaaaatcttagtgtggagtgagttctggcgttctttaacaaatatattgctgaaacaatagcactgtgacaaatcgtgacatgtagcttctctccccaaacctactacccaagagccttttgctataagcagcagcccctgcccttctgcctccttactctgctattttttttccctcagcactttttgttacctgtcttactattttctgtctctcctgctgaaaataaacttcatgaggacaggaggttttttttcctgtgtgctccattgcctaagtttgttttgttcactatgtgtccctggcctgcatatttgtgaatatgcagtgaatatgaatgtgaatatgtaagtgaataaaagaaaacagctcagaagctgtggctttgaggatggaaaagaagggaaccatagttgataaactacctagcagaaaggaccttagttccttttaatattttggggtcagacagtgcaagctgtcgacagcagcttaaggagatacattagagtcttcctggcagttcttagaatgccttgtgctagtgttgaatgggacctccaaattcctagtgtgctgcgtgtatgtctgttgaaggagctcatcacttgcacaaggaccagaatcacttttactgcagcatggccagttttctggccactgttcctagttatacctttgattcttttacacacacactgtagctgctgccaaggcaggatcaaagtccaaatactgccctcaaggatgtgctgactttagcaatgccaaccaagtgaagcagcagtgatgtcaatgtggcagagaaaagggttatggggaaattgggtgcaacttttttttttttttttttgagacagagtcttgctctgttgcccaggctgaatggagtacagtggtgtgatcttggctcactgcaacctccacctcctgggttcaagtgattctcatgcctcagcctcccaagtagctgggattacaaatgcctgctaccatgcctggctaatttttgtatttttagtagagatggggtttcaccatgttggccaggctggtctcgaactcctgacctgtaatgatctgcccacctcggcttcctgaagagctgtgataataggtgtaagccaccgcgaccggctgagtgcatcttgacctttagagagaagcttcgcttttcaaatttttaagaggctattgtacatgccagaaagtagctgatcagtcagaatatcaccatatatctttaggaaaaatgttagtttagttacttgtgcggtgcctagcattgagcagttgcttgactgtcataataattctgctgtctctactgtactcttgcatctggataactttgtctttcttacctttggagattcaagacaagttgaacaagaccaaggatgatattagcaagaacatgtcattcctgaaagtggacaaagagtatgtgaaagctttaccctcccagggtctgagctcatctgctgttttggagaaacttaaggagtacagctctatgggtatgatgcttggcatatacatgctctctacttccttaaagagacaggttttgtcattgtttaatgttcacataggttaagaataactcatcattggttaatacatgtttaggagggcctactctctgtttcacaggttgaatttcctatttttaaaattatgtttagattcatccttcatccataaagcaagcaaatctcagagacagtggaacttggcttttatttccttttgtaagcatgaataaaacaaatatatttgtgtttaagaagagagaatataagatatgtaatacaaatgaaatacagatccatgtaaaaatgtgaaatctgcataaaggcacaaaagaaaataagtcactataattccactatcaaagataaacagatggtgtctatctttatgcatgtagctataggtagagctgtctatatagtttacatctatctatatatgtatatctgtctgtttctgagaatgctaatagtgtttgtctgtgtgtatacacatgtatgcatgagcacatatgggatggataaatagaccaaatagcttggtgcttaagagcgtaaccctggaaccagcctggattcatatcttggtttgccacttaaagtatgcctttggcgagttacttctgtatgtcacagttcctgtatctctacaatggggatagtaatagtagtacagtacttacctgaaaagatgattatggggattaaatgagatcatacatgtataaatgttttatagtgcctggcatatagtaaggattcagtaaatgttaaacattattgctattattaactcaaacagatttatgtttgttactgattaagatcatattacaagtactttttaaaaagaagctttttagtttgatatatttacagaaaagtagcaaagatgatagagatttccctatacccagcttctcctgatgttaacatcctctataaccatggtacgtttatcaaaactaaaaaattaacattggtacagtgctattaactacactacaaattctatttctagttcatcagggtttttttttgttttgctatgttttgttttaaactaatgttcttttttctattctaggagccaatccaggagccatgttgcattttgacaaatacccttattttttattttttgagacagagtctcactgtgttgcccaggctggaatgcagtggtgtgatctcagctcactgcaacttccaccttccaggcttaagcaattctcgtgcctcagcctcccaagtagctgagattacaggcgtgcggcaccatacccagctaattttttgtgtttttagtagagataagatttcaccatgttgcccaggttggtctcgaactcctgaactcaggtgatctgcccaccttggcctcccaaagtgctaggattacaggtgtgagccactgtgctcggccttgacaaatacccttacaatttctaagtgacatgtgttgaggtcttgacattgaatagtacaaaatttgatatagtctaggatgtagatgaataaagcagtggttagcactctaaaacctggtgttaaagatttccatgattatgagacctggttgccgccatcatattgccttctctttaatgtttaagtcactgtccattgctgtattctctagcatcagtaaaagaacaggaaatgaaaccagttatcttatttttgaaaggctggtgaccactggtctgaagctgtgtatagtacagagcagtgtcctctaaggaaagagtgaaagtcaaacgggcagcaagccagagcttggcagattgctgtaagaatgagtttgtctgtatatttaccacttagttttctgttctcaagagctgaagatctttgctttggagagcccttggctccatgcagtttttagttggtgtgtttccgtaatagctttctcactacccactttcaatagggcacagctgcattgtagcacaaggacctgagacacccatatcaacaaatttgtgggtaaaatgaagaatgtctcggggagagaggaaagtggaaagtcagatcttatattctactcaggaactttacttttctttccacactgggataaaggaggtttatcccaatgttgactgtgttcctgatcttgaatatgctacagcgtgtgctgctggaagcaggtaactagttttatgtgggtttccaggcttggcttaagggagccggcgtctgagaccggggtgctcatggtttatacctcattgtggtttgtttgctggtttcatctctgatgatagtgtgctgaaatttcacacttttcattttgctttcttctgccaactctgctcataatagttctcaaaattcctaggactggataggaaaggagagaagaaggaagctattgcagaaaaaggccactccaaagccatatagagaacaaaaaataagtatagacaaaggcaaatgttcctgctgttagaaggcagttgaggatgaggacaacattattatcagattgcctttattgtagctaaatgctattaatatctttttcacattgctgataataatgatttttcatctttattttattgtgctaactctattgaacttttttcttgatttgctataagaatgctgttgggtttccactcaacatttttttcttttgtatccagaggagtttcttcctgtttcttctttatcagaacctgtcttcccagagattcttgcttactgaccagtgaccttacctttctctgcagacgccttctggcaagaggggagagcctctggaacagtgtacagtggggaggagaagctcactgagctccttgtgaaggtgagtgtccagttcttgagggaagcctgtgaggtctgtgccagtttacatgacctcctttttttcccttacttttgtaattagaaaaattacttaaggaaagcttattggtacaataaaaccataaaagtttctcttcacccaaacataggcgaatatgtataatattatcaaagacatcttcagtctgtaaaatagtaaaatgttatttatgttttcagtctttgcagatgtcctgtctagaaggcagattactagggaaggtagtcctgtcagatgagatttttgtggtgagacagattttgtttgataagaagagataagatagggaaactctttcataattttctcaaatcatgtgacccaagatgagcagtggtctcatgtatacttcaaataattctcattcttagcttcttccatttctaatcaaatttatttttattttattttattatttttacagacaaagtctcactctgtcacacaggctggagtggagtggtgtaatcatggctcacttcagccttgacctctttggctcaagtgatcctcccacctcagcctcctgagtagttgggactacaggcgtgcatcatgacacccagctaatttttgtatttttttgttggagatggggtctcactctgttgcccaggttggtcttcaactcccagcctcaagtgatcctcctgccttggcctctgaaagtgttgagattacagctgtgaaccactgcactcggccctcatatttatttttgaaactccacttcatcatataaaattggggttgtactgatgatctctaaggtctttgtgtttgattattataaatatgaaactgtcccttactaaataaatatggcaggttttgcataagttggtgtaatgctctgatcttctgtgcttaaaatctttcagtagcttcccattatctacaggatgaaactcaggttcttatgcagcagagaatacaagtttcttcatgagccagctcccacttattttttcttaactacttctctttatttcccacataaacactaatcctgccttttctctttactaaatgtgtcatgcttttacgttgttttccttcccttccatcattcctcttgttccaaatgatgattcctactcatctctcaaagttccactcagcagacacctctagatcactcaggatgttagttgttccctcttcagggtcccttagcactctgtacacacacctgatattgcagtcgataacaacagctgctttgtgccagacactctactaagtgcttcacatgcattatgttatttaattattgctagaacactagaagatagctaccataacaacttctgcgtatgaagaaacaaccttagattatgtgacctacacagctgaaagtaataggcaaagcttagacttcctcctgggtcggtttggtgttatagtctgcgcttttaaccatatttatacttctttcctcatcacattgtaaaattatttatttacatgtctgtctcctctgctatgttttgatcttttggttgaggaatatatcttatctttttttccagtttatattgttgtgcctaatacttagaaactgttgtttagtgcatgattctttgtcctgtatagtgtaatagttttgatttcacatctgcttgcatttttttgcaggcttatggagattttgcatggagtaaccccctgcatccagatatcttcccaggactacgcaagatagaggcagaaattgtgaggatagcttgttccctgttcaatgggggaccagattcgtgtggatgtgtaagtatatgcaaggggcatccaatagccttattttttaggttaaaatagaagagtttttaataaatattaattatattttaaaaaataaaaaatattaaaaatattttactacacaagaaatatttgatcattgtagaaaggtcattttactacacaaggaatatttgatcattgtagaaagatcctaattaactgcagttttaaatgttacttgtaattttgtaacctagacaatgtcaacattttggtatatattcttctagatatttttattttcacctttttattttgaaaaactttgaacctacattgagttgctaggatggcttaaagaacaccttagattcactaaatgtaaatatgttgccatatctgctctctacactctttccctccctacccgcttcttccctcatcccccacctgcatacctaccattcccctatttatctgtgtatacttttgttgttccatccagcagtgtttttagtgtacttctggttttacctgagccaaagtttaatttattattttgctgtaaactgaacctcatttagttgctattaggcataaagaaagggggaggacatcattatatttaaagaaacacatgaggattctttgttttacctgttctttcaagtagatggttgttagttttcgtaaactatgatagataaacttctgtttagatctgttgtctttagaaaaaacgaaatctcaggttatgtaggatagatagatttaactcaatatgctgcaatggtgtcctagaggtgctaatcctatcagatactcatcatatttgcagtcattataaagactgcagatttaattattgaagggcccattcgaagagcacctaatttagtttctttttttttttccaggaagcattgtttttgttttgtttttctaatatgttggcgccatgaaaatcatcatgttcaaatattagtagtaataaaggtgatatgcctggcattcattttcaaagcaaaatactgaaactgttaaaaacagaaccacccataatacagcagcagtttcccttagagtactgaggtgaacagggtgactttcagagggaagatgataatgtacttacagtatattctcctatgccattagactcttgaagaacttgtaagaggccagagtgaatagccacagaacagtttggccttatctggtaaatttgaagatacatatatcttatgacccagaaattctgctactaggacatactctagaaaaattagtacacatatatatcaggatatatggacattaatattcatagcaatgttattcatgatagctaaaaactggaagtaattcaaatgcctatccacaggacacagatgaataaattgtggaatgctgtgtgtgcctcaatccattgtagctcttattcagattgatgtacaaattgcctcatccatctttggccagtggaaacatcatattggctcctaggtccatttacatgacccaagtaatctttgaaagccttttttctctttctttccttttttttttttttttgacgaaatattccaggttcaggttcactttgtccatttcctgctccaggccttcaatcagccatttatccaaggagccctggttcatttaaaactaggtaaaataattacatagttccaaaatcacatttatggaacaagacagattaaaaaaaaaaagttaaccagaatgcagtccagagagacaaagaaatagaaggtatgaaagagaggctaagagatgcaaaggataggatgagaaggctaacacacatctaactggtgtttgagagcagccagagaaaatagattacctacaaaggcataactgttaggacaactgatactcaatagcaacgatggctggggcagttgggggtagatgaaagattggctgtaaattgaaaattgctggagcctggtgataagtagtgagaggtcacagcgtgctggcagtcctcacagccctcgctcgctctcggcgcctcctctgcctgggctcccactttggcggcacttgaggagctcttcagcccaccgctgcactgtaggagcccctttctgggctggccaaggtcggagccggctccctcagcttgcagggaggtgtggagggagaggcgtgagccggaaccagggctgcgcgcagcgcttgcgggccagctagagttcccggtgagcatgggcttggcgggccccgcactcggagcagccggccggccctgccggccccgggcaatgaggggcttagcacccagccagcagctgcggagggggttctaggtcccccagtagtgccggcctaccggcactgcgctcgatttctcgctgggccttagctgccttcccctggggcagggctcgggacctgcagcccgccatgcctgagcctcccaccccctccgtgggctcctgtgtggccccagcctccttgacgagcgccactccctgctccacggcgcccagtcccatcgaccacccaagggctgaggagtgcaggcgcacagcgcaggactggcaggcagctccagtcctgcaggcagctccacccgcagccccggtgcgggatccactgggtgaagccagctgggctcctgagtctggtggagccttggagaacctttatgtgtagctcagggattgtaaatacaccaatcggcactctgtatctagctcaaggtttgtaaacacaccaatcagcaccctgtgtctagctcagggtttctgagtgcaccaatcgacactctgtatctcgctgctctggtgggggcttggagaacctttgtgtggatactctgtatctaactaatctgatggggacgtggagaacctttgtgtctagctcagggattgtaaacgcaccaatcagcgccctgacaaaacagaccacttggctctaccaatcagcaggatgtgggtggggccagataagagaataaaagcaggctgccagagcaagcagtggcaacacgctcgggtccccttccacactgtggaagctttgttctttcgctctttgcaataaatcttgctactgctcactctttgggtccacgctgcttttatgagctgtgacactcaccacgaaggtctgcagcttcactcctgaagccagtgagaccacgagcccaccgggaggaacgaacaactccggacgcgctgccttaagagctgtaacactcactgtgaaggtctgcagcttcactcctgagccagcgagaccacgaacgcaccagaaggaagaaattccggacacatccgaacatcagaaggaacaaactccagacgtgctaccttaagagctgtaacactcaccgcgagggtccgcggcttcattcttgaagtcagtgagaccaagaacccaccaattccggacacagtagaagcccattgggcttttaaattttatttactctaatttcattctaaagaattctgttttgtagttctccttttattttattattattttttgagacagggtgtcactctgttgctcaggccagagtgtagtggtgccatctcagctcactgcagccttgacctctctgggctcaagcgaccctcccacctcagcccccttgagtagctgggactacaggcatgcaccaccatgcctcgctaatttttgtatttttagtagagatggggtttcaccatgttgcccaggctggtcttgaactcccaagctgaagtgatctgcctgccttggcttctcaaagtgctgggattacaggcgtaagccaccacgcttggccgtcttttttttttttttttttttttaatctgcttggttgttttttatagtccttttccttggcttaacttttgtttacttaaatatattacacataaatatgttgtattctgtgtctgataattccaatatccatgagccttacctgattctgctggcttcagtcatggttccttgtttccttatatttgtgattttattttatttatttatttttttatgagccactcatttttctgggaacctagggattctttgaggcctagattgaagttaagtctggaagttctcttcttccagagaagatttgtcatacctttttgagttgctggggattgccaccacactggaaccaaattaagtcaaatccttagcttgtcattttgtaccacagaggtagtgtgaattctgaccacaaactcacataaaggcttccttgttacacattcttgaaagattgctatttttctttacttgaacatcagggttgagaaaaacagtttttcttttctcttttgcagtagtgggatttatttcttgtacactgtagagtgtggtctttttccagccatctcctgttggactccttatcttgggcagtctctaatgtatcttctggtccatcctttgctcatctgtcagtgtaggagtttgaagtctgaagggtctggtgccacctcagggtgaaagctagttttgccactcacttatcttgcaggattcttgattttgctttgtttgggggtttagcaagtttctttatgttaggttagtgataggtttaaattttttttttttgatgttttatcaagttttttagttatttcagttaggaaggttgctcaaggtatataatattgctagaaatagaagttccataattgttttttccatgttacagaccttcgtctatttgaaagcccctttctccctgaatcttctctgccccacatttttctgggttactccgcttttcatatgatttcacagacttccaaccatcgcagtcattctctgtatgacttttggttgcctctggccagattgaacacagttctccacatttggagtggcattgatctttcaatctctgtcttttttaaatctgggttcaataaacttatttcagaccttttccttgaagtcagcatttttattcttggcaatgtttattttattccttgctgttcctaatgtctttgttagttctgtatggatgctactggctttgtttttttaggtctgtagctcattctttttgtttcatggtctaggttttgaactctttgttttcttaaattcatgttcttatgatattttcctatagtgagaaagttataaggggtttccttcatcccttagcttgtttccttctgtgttgggtttttattttgcatgctacatactaccttttcccctgccttttagtttgtttgcatagtttccttgccattttctctcatcttggggtggcattctccagacattgttcttatgcactgtgggtgcttcctgtctgagaccatttggctggggacaaagctcagccaaagctttgttctatctgtattagaataaccaggtctattctgagattctcttcaaagttacctatcagagttcactctcttatttggaagagataatataccctttgagctctgattatttaattcactgaagtcttcactctaaagagccaatcctgatgttctctcttcattttgctcatttctccctagcagccatgtttaccactcactcatgagaagaagaagaaaataaggaaaccccctcagcttgcctctgcagatttgggggtataaaggaaaattctcaggattttgctgactttgcggtacagtttcaagggctgattagaaactagtgttttgcttacttctgctctctgctgtttcactgtttcttttttttttttgattgccaatatttgaagtttattgcctagattatctctctttccttgtttggttgttgttattgtagattttgactcttttctctccctgcactcaccctttttttttttcttcccatcttactcctgaagtccaggcctaggggttttttgcattgctgcaattaaaccatatctctattattttgatcttcagcacgtgtgagggatcagaagaaggatagagtctgattcccaggctcttctaatatttagacttttataaaataactaatcagcactggtattgtctttttccctctcccactctgtctcccccactcctcccttagcttcttacttctctctctggatgagctgcttctagtgaagaaagagttcactgttcagaggtgggaagccagaagataaaaccaaatggctgggcagtctttaggttattcctagctaagagttaagagttgtaagctctctcattctttgttcttcagccttaaactatctttccttctattaactttatttgtctcagttacaatgatagaggtaacttcacatactaaaagaaattaggttaccatgtgaaacattcttcttggcttgtgctaatgttatcagatccaaacagcatctgaaagaaaattttccaagtagatgttgttctcttgttttctgaaatacatatcatatgttaaagtgagagtttttatacatgttgaaagaagttgaatgacataacaaatagttactgaggcctccattttcttacttcacagttaaaattcctgtttctctttgggtataggaggtagaaagaagtgggagagtaatagcattttaaaacacagaatcaaaaatacatattaaaagtagaacttaggcccaggcacagtgactcacgcctgtagtcccagcaccatgggaggctgaggcaagtggatcgctcgagcccaggaattcgagaccagcctgggcaactaggtgaaaccctgtctctacaaaaaatacaaaagttagccaggcatggtggggtgtgcctgtagtcccagctactttgggggatgaggtgggaggatctcttaggcctgggaggtggagattgcagtgagccgagatcacgccatggcactccagtctaggtgaaagattgagaccccatctcaaaaaaaaacaaaaaagaaaaaagtagaatttaggtattcctacttttacagtcaaaagtccactggtgtttgcataacaatgatgttttgactagttattggactaaaagtaggacacatgaagcaggtgactaggaatttggaaatattattgcttaggtcattactggaccttacgaagagattgttgcactggtgacttggactttgctggtccctccccgactcttcacagctggcttgacgactcttgtgacattctgaggttttatgctaaaccacaggacatgctgctgatttgcagagctgacctcagctgtaagcactttgtcttctgcagcgtagaaatgtagtgacctacaagtgtcccatgcccaagttgggtgcattattttgtggtgatggtcacatgtttcataaagacttcctgagtcaaaaaatgacttttctcagttcatcttccatataactcctggccacagggattttgtatccaatggtatttttgttctatgtgtggatattattttagcaaagttcagtggtcactttctctgattccatcttgtattaagctacactaaatatgaaaacgtagaaagttttacttcttatcaacagatgctaatgtatgacattgagtgaaacactttaattcctcaagggctcagttttctcacctgtaaattgaaaaaacctttcaaagattgtatgaatcttcagagatggtaagtctaagaagttgtccaactagtttagtattgtggctttttgtttgttttggaatgattcattctcatatattattttttaaaaaaatagccaggtggctatgacatgcctgtgttggtcaaggtttactgagagtcaagtcaggcattaagaaatgtgaaggccaggtgcagtggctcacacctgtaatcccagctctttgggaggctgaggtgggcagatcacttgaggccaggagcttgagaccagcctggccaacatggtgaaaccccgtctctgctaaaaatacaaaaattaggtgggcatggtggtgggcgcctgtaatccgagctactcgggtaactatggcaggagaatcgcttgaaccaggaggcaaaggctgcagtgagccgagatcatgccatggcactccagcctgggcaacagagtgagactctgtctcaaaaaaaaaaaaaaaatggattgagggtttgttaggtgtcagccactatgtcaggtgctaggaatttgtcatgaacagactggtccctactttcatgaatttatagtccagtgagggaaataagatgaataaaaagacccctacgtctttttgtttgaactctggtaaagaaatgtgtttatcagaggggctaggccaaactttaggaaaacatttcacttcacttaaaaaaaattaggatttttgttttatttcagataaggcaacaaacttccatcaagtagaaacttctgcttttctctgtctttcaaacttgtcaaaatcagcagtttactttgttaaatctgaatgtctctttttagtgtattgcacagtttactagaattgtaatcacaatttcacattctttaacaggtattgaaaatttaaattaaaattctgatatttttgaatggcataaaatgccctatcttatctgaaaattgaaaaattaatacagaaatgtaaatggattgtgaataggtgggatctggccaagtgtgcatttgtctaggcagtgctgagtttctgctcattatttagtagctttcattcttcacctgagccaaaattaggcttagccaataaagccaaattttccttctggaagacatggcagtgtctgccttgcagcatgcatccaagaccttatctgtttctgtatcaaacattgtcaagatcagggcatgaagagccggggcattcctgactcccccaacagatggcatctcttctttattataggtgacttctgggggaacagaaagcatactgatggcctgcaaagcatatcgggatctggcctttgagaaggggatcaaaactccagaaatgtatgtatgtgtggctgttttgtccccttttggatttgtctgtctggagtacagctttatgaaactaaagcagataatccattttcctgctgcttctcttcctctggtaattctggtcccctttccccctgtcctagcccctctgcccttatccttttacattcagtaaaattctaaatggatcagccagttatttttaaagatcattcccatcccgccccacccccagatcatgcatagtatatactacaagcaaaaataagatcctttttccaaaagtgagagtttgaggactacatctttgaatcctgtgatatttgcaaattatttggagcctaaagaaacctctctaggtactttagttctgcttaccttagaaagttacttaatattataggctgcctcagggtactctctgggaaaactttagtgtgagggctgttttctgggaggaagaataaaaatatctttttgagatttacccacattgccttccttggacataaatttgatgtttagttacattattttttcctagactgtccccttgtacagtatgtttatcctacatcttaatatttttactgcaagtattacttgacaatggggatttattgcatatggtctcatgctgtggttcatatgtagcataagagaataaaccaggctgccattctttcttcatatgtcgatctttggtgcttggtacttcctcagtagtagagatttttctccttagagggaacagattcgttgtatgaatggagtagttgaggaaagtctaaagcaaatacccgtgacctcattttctctttcaacactatttgaaatactatttccaaatgtgtaggagaaatggggattttagtttcttcaggtttgttgtctttcagagttggaaggggccactgagctgatgcttggccgctgtgtgaacatttctgcttgaacatgtgttgtgccgggaagccttcttctcattctcactgaggtgcctgtctttggtaggcaaccgttagccagctctgccttgtgttgctctcatccaaagtctctgtcccccagctttccgcctgccagcctagctttatgctttggatccctcactgtgggatcacttctgagtcctcttcctattgccagaatgatttcctaaataggagggaagtttctgcagaaaatcagttggcctctttttgggtgtgcttaaaaagaaaagtagagcagtctaaacacttaaatttttaatttggggaaaaataatcagaacttactcccggtaatttagattagctgctaatggtgttttctattattttggcctgagttacattattctcctcttccctgtcatttagtgtggctccccaaagtgcccatgctgcatttaacaaagcagccagttactttgggatgaagattgtgcgggtcccattgacgaagatgatggaggtggatgtgcgggtgagtccctctggagggcccactgtctgtgctgggccctgacagcagaagggccctcctgttgactagccgtttccagtcagatgggtctgactgcctttgattgtggcagccagaatatgaaaaactgcattgatagtggtgattgactgcagcttcagtcttttcataggttcatgaattctgaaagggaggtgatctagtcactaacttgggacttgagagacactggttttgcggtcagcgccatcactttttctttcttttctctatttgtaaaatgaacatggactcacttcccctaagactcttaccatggcccgggcatggtggctcacatctgtaatcccagcactttgggaagccgaggagggaggattacttgaacccttgagcccaggagtttgcgaccagtctgagcaacatagtgagaccccatctctacacaaaatttaaaaaagtagctggacatggtggcatgcacctgtagtcctagctactcgggaggctggggtgggaggatcacttgagccccaggaggttgatgctgcagtgagctgtgttcacaccactgtactccagcttgggtgacagagcaagaccctgtctcaaaaaaaaaaaaaagactctcactgtggtttagattggcttaaattaataccattgtcattatgatagtgattatttttatgcctcacatttgtgtagaggagttttctagtttcagtgttctgtcagaatcccatttgagctttatgacattccagagaggttgatgaagctgttatattattgtagttcacagataaggaacagactgaagtagcatactcagggtttcactgctggtacgttgtggggctggggctcacatttggctctttggcctcttagctcaatattattttcgcccccacagcgattctgttcttattttgtgctctcagactattctccaaatggacttacctggagtcacctgtgtcctgtcaccgtggtgggatgcagtcttctcccagttggagtggtgaaggagggggtactggtggaactggaactctaagctagcagcccaaattgctcttggcagcagaagagaagagtaattgtgacatagattctcattttcctttaaactttaaatccctaggcaatgagaagagctatctccaggaacactgccatgctcgtctgttctaccccacagtttcctcatggtgtaatagatcctgtccctgaagtggccaaggtatatgagagaaatgggctgctaaggcaggcaaatggatattttaaaacaaagcctaatggggcagtacttggcaaatagaagcgattttttttttgtttttgaccacagtagtgataagtagctctcatcagccctaggggaagccctgcagctcagttgcaagcctttaaaagttgctagtctctgctgtgggggaagatagtacaaggctgaggccttttaaactggaaattctgaaataggattgccttctagattgagatctggaaataatctgcatgtaggaatgtgcccaccaaaagggtgatattccacatgctgcccctcagcacctccctttccctcacgcctcatcctgcagtgactgaggcaggacctttcccttgtgcgagaggcagcctaaatcagagctctactcatttcctgcttgataccgcagagcgtttgaggtcatgcatatttaaatataaaattgataccatatttcagatgaattattttgaagggaaaatacatttgaaagataaattttgttgggaatgttaaaaatagccattttttaaaaacatgggaggcataatacaaaatagccttgtgtttatagcccatctttccacccatgtcttgcagtttttattatagggctataaaggaaattctcttatgttctttgttttttggaacaagctggctgtcaaatacaaaataccccttcatgtcgacgcttgtctgggaggcttcctcatcgtctttatggagaaagcaggatacccactggagcacccatttgatttccgggtgaaaggtgtaaccagcatttcagctgacacccataaggtgagctaaggaggagatcaagtgttaccagttgattattttgactattattgataaaataaattggtagcttccccgcaaagtataaaattaactatagaattctcatcagatgcttgttttaaactctctctttgccgtcaccagatcagctggttcaggtgatggggtatagtggtagaggtgacaagcagtagtgaaaatgaacctgttacctttatctcaaattggctaagagaatttctgtatccactgactgtgtgtaactagaacatgctagtgtagtggcccttgttaaaaaagctccctgaagccttgagctgatttgaggtggagggtagaggagtgtgagggttggtagtggagttcccatgctggtagataacattagagctgctgtgcaactgggctcctgagcgtacatgacgggaaaatgttgacggaagagtcctttggaaaatgggaagaacctgtgtgctcaggaacattcagcatttgagatggccacgcctgccacccttggtggactgagacaaagtctagatcagttgataacgctattgaatatacatccagatgtggaagaagtattagcagcctcaggaatgtgtaccttgttttgattgcattttcagagcttgttttaaactcaagtatattaaagacttgtttttcaaaatcggtgtgatctgcagccgattttcagtcagcatctgttttttccttaccatccagatagctcctgtgtccttttcccataaccatccatttctggatggttcaggtaatgaaattagttccacgttagttttaataagagttaattagggggtcagatgttctataaggaaaccagttacatagttaattttaaagctggattaagtagcttttagtttctgagcaccattatgttctcataagcataatattcttagtaatactaagcaaaaaaagatgggaagggggtcagatggtgattttaacttgaagtgacaaattccatcctttcctggcttccattgcaaacttacccttgctttcatcctgacatatggtctccagagaaatattttaaataaggtaaaccacatgctgggcaagagagggagtaaaccgattaactgggcgctgttcttccctgggtctcagattcctcattcctaacagagagaatttaaactccatcccttaagttcctactatcctttagcattttaagtttgaatccttaatgtgagtgggaaacataacagagaaactgagaaataaataggatttcctttgcatgatgagagttctgggacaaggtctgccagacagaactatactctcacttttcttgtctgctacttcttccacagtatggctatgccccaaaaggctcatcattggtgttgtatagtgacaagaagtacaggaactatcagttcttcgtcgatacagattggcagggtggcatctatgcttccccaaccatcgcaggctcacggcctggtggcattagcgcagcctgttgggctgccttgatgcacttcggtgagaacggctatgttgaagctaccaaacagatcatcaaaactgctcgcttcctcaagtcagagtatgtgtggaagactggggttctgccttgtctattgcttttttgtcctagtaggctcaaggcacctgcctggctaagtatccatagccctagcccacctgttgtctcctgcgatatagagggcttagggcagcagcttagggcttaggccagaccagctggcctgggagaagaagctccctttctctgccctgacttttggagggtctttgagacgggggcctcatttgtagtttatctcatctctatggatgtcttaataactggcagctcttaccctaaggctaatgtacaatttaatggttaggacagtgattcccaaacttgagcatgcattctaatcacctgaaggacttgttaaaacacaggtagctgggcccacccctagagtttctgattcagtggaactgggatgggctctaaaaatttccatttctggagatactgatgctactgctccaggaatcatacttgaagaatcattggaataagaaaataattggaaatgggccagaaggaatgaggaaaggagggcaatgaaatcttgggttaagccaaggccagaacaggctgcatgctttgtctaatgtatctgttaacatcttatctgcccatctctctatgtgtcacttggattggggaggctctttaagtatattgagggggaaggaaagctgcctgcaggcatttctcatttgagaaagatccttggccaggcacggtggctccggcctgtaatcccagcactttgggaggccaaggcaaaaggatcgcttcagctcaggaattaaagaccaaccggagcaacatagtgagacattatctctacaacaaatttaaaaattagccatgaggccgggcgcggtgactcatccctgtaatcccagcactttgggaggctgaggcgggtggatcacctgaggtccagagttcaagaccagcctgaccaacagggagaaccccgtttctactaaaaatacaaaattagccgggtgtggtggcgcatgcctgtaatcccagctactcaggaggctgaggcaggagaattgcttgaacccgggaggcagaggttgcggtgagttgagatggcaccattgcactcaagcctgggcaacaagaacgaaactccatctcaaaaataaaaaataaataaaaataaaaattagccacatgtggtggtgtgcacctttggtcccagctacacaggaggcttaaggcaagaggactgcttgaacagcccaggaatttgaggttacagtgagctatgatcacaccactgcactctagcctgggtgacagagcaagaccctgtctcaaataaataagcaaacaaataaataaaaattagatatatataaaaggtcctcctatagctctgatagggccatttattaagacctgctataccatttcttgctttagggattacatatgactttttagaactgtggagatgggcagattacttttccagaaatttttttagtacatctttcatgcctcagaagcatctaggggaatataattgggagttgggtagacaggttcgaagtcagtgattgagtcattagatctagatggggtttgggccttggaattccatttttattgttccatctatgattctgatctcagtaagaaccactgatccagtgtagccctcttcttttttgaagatgagaagactaaagcccaaagggttagattgcattcattataaggaagactttgaatgattaaagagatagtgaccaggggattgtatgtgactgaatttactttttcttccttcatttatttttttgttttaagactggaaaatatcaaaggcatctttgtttttgggaatccccaattgtcagtcattgctctgggatcccgtgattttgacatctaccgactatcaaacctgatgactgctaaggggtggaacttgaaccagttgcagttcccacccaggtaagcttgaagaagcctctttcccttattttgctccatgattttggaagaacttgggtggtacagtaacctgaagtatagagtttgactgctagaggctagcacgttagtagcaactgtagtatataaaggatttctctcttgccacctggaattattagatacaaagaacaagaccattagctttaaactctggcagaattaggtgacagcctcctagaccagtggttggtcatgaggtttttctctcagtctctagcctttctactctccaatccatcttgtacacagccatcaaattgctcttataaaatacttgttacctggctaatatttagttcaagaccttcctgggggtctctaatcattcaggcctgctactgccttctttattagacttttctaacctaatcttccatgatgcctttgagtaaatgcaccactccaactgagtacaggtctgttcatgtcctctgtgtacagcttagccttccacacgttggtgcattgccagtcccatctggactatctttttccctcttcacaattccagtaaaccccactaaattcctccagggcgaggtagaatttcttctgtgccctgaagtcctttaagaccccagccatgtggccctgtccccatgagagcacatgggggctgattatctaagataaaagtgtctcattgatggtgacgtggttgaaggaatggtggtggaatttgtgaggggatgggtgggacaaagcagccaacactgttcatcctcttagcatggttctcagtcatgccgagaagctctgaggccagcccatgcctgacaccccaagcatgagagagccgagattcccaggactaggaacaacttggatgactacacttgtcagaaatattgtgaaagggcaaccaggaaattcccgtatttggggctgcatcattttagaacattttttctttcttcaaggttcatctctctctgtctcttctttcctagtattcatttctgcatcacattactacacgcccggaaacgagtagctatacaattcctaaaggacattcgagaatctgtcactcaaatcatgaagaatcctaaagcgaagaccacaggaatggtagggacacttggagttttttttcttctcttggaaatttaggtgttggtggagagtttgaaggaatcatatgacccggagtctgttcctgcctctgcccctttgccacagacatcttttatttgttgactggagctgatgatctctgcatcacccaccccttagggttgctgaagtctcaaatgagatacactataaagtaccttgtaagttagagacttctgtataaaagcagctggtggtagtgtccatttgaaaagaaaattttgtcacaggaaagatagtaaacatgttttttctggaattttcttaggctagtccctttatgcagaaaggcagactggaaagtccctgtgaaaaattgactatgccagctgtttttctgatagaatgatgggatgccttaggtggaaatggggtagggcagtgcacatgcgaagctaggactcggggagaaggggctcattgctgcagttttattcttgcttttggacctggcctcactaataatgtctctttctttggatttgtagggtgccatctatggcatggcccagacaactgttgacaggaatatggttgcagaattgtcctcagtcttcttggacagcttgtacagcaccgacactgtcacccagggcagccagatgaatggttctccaaaaccccactgaacttggaccctttctagtctcaaggggattccagccttcagaaggttcttgggatatggaacaggccgtgcacaactttgacatctggtcttgctccatagagcacaactcaagatagaccatgagacagcttgagcctcaggattcttgttcttcctcttatcttccttttgtggtttttaatttgaagaccccagagaattccattacataatgattttgcccttgttataaatgttaccctaggaattgttttaaccatttccttttctaaactctctagctttcaactttacttaaacattgtgtggtagctctgacctgtcctgattctttagagaagctggggtacagtttatgagatagctagagcttctttgttatctcaggcaggaggcgtttacataacagatgtttcctcagctgggtgtgaggtatactctaagcaggaggctttttcagccttctctctcttttttttttttttttttttttttgagatggaattttgctcttttgcccagtctggagtgcagtggcatgatctcagctcactgcaacctccacccactgggttcaagcgattcttctgcctcagcctcccgagtagctgggattaccggcacccaccaccacgcctggctaatttttcaattttctttttcagtagagacgggttcaccgtgttggccaggctggtcttgaactcctgacctcaggtgatacccgcccccccgcctcagcctcccaaagtgctgggattacaggcgtgagccaccgtgcctggccctgtctctcttaagagtaggttcattgtctgtcttagagtcacttctattgcaactcattttctttttccagggcacagatcgaccaagctgccgttccctattctgcaggacaggactattctagcatacctgcttcgtccacccaggcagggtttggggtggtctcttctgtgcctgcagtccccatttgacacttggttgccaccatctttggagattattgtttggaatgatgcttccattggctttttcttgttaccatggactaggaagaaaacatggtttccaaataatctgggagcttttggccatggtgccgccttcctgaattggcagtggtcagagcacacctgaaccctatcctgggctggtgatgagcagaaatcagacctttttctatgcttttttgaatatcagagtaggatgaacacccagattcaaatatgtcaccaaagttggtggtggtccttccctgcacccttgcgttaagccattatgtaatgaaaatgtgtttgcttgaaggaacagctcaaagcaccttcacaagttgccttgacttaccctaggtgggtgtgaaagagcacccgtagcaaggaaaattttctctattagtgtgttcttctgcctcttcccccttgattcagctttcagaggtactatggcagttttgcctcaggtgctgaacatttctcagccctggctaaaagggagcagcacagggagagaaacaggataggaaagcagaatggcgagcagcctatggcccagggcctgtaatcccttcccaagactagctgctcagggtggtgcagggacaggaccagaccctgcgcctatttcctgccttctttcccctatagggaactctgtaggctgagccactgtcctgctcttatgacattatatcttgtgcctttctcctcagcagtgagcagtgagctactcctggcccaggccctaggggaaatggatcagtctttgaggtttctatttggggaggggagtacttaagatgagtcaaaagacactttcctctgttccattccccatctcagggactcctgaatattcagcctctccaggctggtgtcttctagtttcccccactgggaatgctggctgggagagccatgactaccagacttttcctcaggctccttggcatgttagtctgaattgttcttgagcactgtactactgacccaacaactgtgactagctggccacgccattcagggctggtgtggcatttatgtgtgtgtgtgtgtgtgtgtgtttttcctgtttgcccagcagtgcattgtgggttccaagagtgggtagtgtgtgtatgtgtgtgtgtcagagggagacctggcaggcacctctttgagagtagctgtggtcagagctgtttggtcagtgcattatgttgaatgaggtccaggaacccagagccacccagcagacaccactg

SEQ ID NO: 13758 - DNA, 24005 bp, Human
tgcccggccttgaatgcactttttcaaactatatatgcccagcagaaaattctaatgcaatctcctgatacgtagtcatagagtaatttcgtccaagtctcacatttcatggccaccacctcaggtgtcctgataggtccgtatgactaaatcatggagaccggaaacagaaaaaacagataggtaagtaaaaaaccacaaggcatcttgtgtgtcagactaacaagtttagactcttttaaggcttactgttttgctatcagagtaccaataagatatttagtataataacatttattacttagagaattactactggccaggcagggtggctcatgcctctaatcctaccactttgggaggctgaggcaggcggatcacctgaagtcaggagttcgagaccagcctggccaatattgtgaaaccctgtctttactaaaacacaaaaattagccgggtgtggtggtgcaggcctgtagtcccagctacttgggaggctgaggcatgagaatcacttgaacccaggagatggaggttgcagtgagctgagatcacaccactgcactccagcctgggcgacagagcaagattgtctaaaatatatatatacacacacacacacacacacacacacacacacacacatacatatacatatatataaacataaaacaataaagttactactataacagagtggaagaaaatctgggaaaaataaaggagcaaaacaagtagtctacagtaaattaatcctgtatactttagtgttataaaatttggttacctctatttattctcgttcaaaactctggacttaatctcaccttctgactcgtattcacttgctttctgcttcaagtcctctattaccaggtagacatccctgtcccggaccctgttgcgttctgaaaggtgatgtaaaatctctgtggtccgtgggttcacctcatactgtggaataggatgatctccaaatattttttttaaccacgcagcaacctaaccattaaaagaaagacaaatattataagccttgtttactgtaatggctcgatgagaatatgacaaagaagtgatcaaaagcaaactaaatgctttctgtgactattttggagtcctacttcacaacctcacttgtctttagggagatactagatatcaggaaataaaaagtgagcaagtacacaaagaaacgtacaatactgaaaattaccagagaacaatccgttcttttccaaatctgcaaaagcggtacaggctaacaatttgcctcgcttgaaaaaccttaaagcttaatagaccataataatgcgaacgcattattagaccgtgcatggtctgaaaaaagcaattgtccctcgatcaccagaagccccgccgcgccgggaggctcccagtgttgggatgcagggcgcggaagcagttcagatgtggaagccgccgggctgagcagcgaaccggaaggcgggtttggcttcataagtcccactccagagtctgtggacacgggctgctcaacgcctctcccgggccagatccaaacaaggggaggcccgggcaggaagggaaaggccttcaggagagtctaagcacggggggcttgcagatagtgacggcggcactaaaagacggatgtgtggaataggggagagaaaagtagacgtggcgcgcacaggagacccgctgtcggcgcgggggtgtcaaaaacgcgttttccaggaggccaacgatccccattcccgccccatcacctgcgtttctctctcctcctgcggctccatagctgcggctcccgccactttactaggaactcctagcgggagatgcgccccgctcactccctaggccccgcccacacgccgttggcacccgcccctcgccgggcccgggatttctgggagttgtggttttacctgagactcctggccgttgagcccctgtgcaaggctggtcgaaggctctggcattgcaagcctcgcttcgttgccacttcccagctcttcccgccttccgcggtataatcaacactacgagagatagagccgcctagaaccaggttgttttttctttcttttatttttatttcttgtttgaatcacttgtcgttaaaaaaaagtacttgaaacgtttggttcttgcttagcaagatgtttgtgtttcttccacattgattgcatccactcagaatttatattctaccctggcaatatgagctgaggcaatcttaacttgatccgttagttcccccaacctaaaaactagggacattttttttttttgagacagagtctcgctttgtcgcccaggctggagtgcagtggcatgatctcggctcactgcaacctctgcctcctgggttcaagcgattcttctgtctcagcctcccaagtagctgggactacgggcaagcgccaccacgcctggctaatttttgtgtttttagtagagacggggtttcaccatattggccaggctggtctcgaactcctaacctcatgatccgcccacctcggcctcccaaagtgctgggattacaggcgtgagccagcgcgcccagcttttttttttttttttttttttttgagatggagtctctgttgttcaggctggagggcagtggcacgatctcggctctcggctctcagctcactgccacctctgcttcccgggttcaagcgattctcctgcctcagccttccgagtagctgggattacaggtgtgcatcaccacgcccagctaattttttgtatcttagtaaagatgggatctcatcaggttggccagcttggtctcgaactcctgacttcaggtgatccgcccgccttggcctcccaaagtgctgggattacaggcactgcgcccgaccttttcttttctttttgagatggagtgtttctctgtcgcttaggctggagtgcagagtgacatgatcttggctcactgcgacctccaacccccgtccccaggctcaagcaattctcctgtctcatcctctctagtagctgggattacaggcttgtgctagcatgcagggataatttttttatttttagtagaacggggggtttcaccacgttgatcaggctggtctcaaactcctgacctcaagtgatctgcctgcctcggcctctcaaagagctaggattacaggtgtgagccaacacacccagcctaaaatgattttcttttcaaaggaaacttactagcaagccaagcttatttattatttattttattttatttttagagacagggtcttgctctttcgtccaagctggagtatagtggtgatcacagttcactgcaaccttgaactcctgggctcaagcaatcctcccgcttcagcctccttagtagctgggactataggcgtgcaccaccacacccagctaactttttgtattttttgtagaaagagggtctcactatgttgcccaggctgtttttgaactcctggccccaagtgatgctcccacttgggcctctcaaagtgctgggattacaagcatgaggcaccacacccagcctgtcttgcttattctttttgcttcaaacatatctctgctctggctggatgcggtgcctcacacctatattctcagcactttgggaggccgaggcaggtggatcacctgaggtccggagttcaagaccagcctgaccaacatggcaaaaccccatctctactaaaaatacaaaaattagccaggcatggtggcacgtgcctgtaatcccagccacttgggaggctgaggcaagagaatcacttgaaccctggaggcagagtttgcagtgagctgagattgagacactgcactccagcctgggcgacagagtgagaatccaccacaaaaaacaaaaaaaaacaaaaactaaatatatctctgctctgtaaccaaatttcagataaactggtgcagcccttcagtatggggcaaaaaaagttatctttatgtcttttgtccacttttatcactacaaattttacaaaatatccctgcaatttttttttttttttgagagggagtcttgtgctgttgcctaggctggagtgcagttgagcaatctcggcttactgcaagctccgcctcccgggttcacgccattctcctgcctcagcctcccgagtagctgggactacaggtgcccgccaccacacccggctaattttttgtacttttagtagagacagggtttcaccatgttagccaggatggtctcgatctcctgacctcgtgatccgcccacctcagcctcccaacgtgctgggattacaggcatgagccaccatgcccggcctttttttttttttcagacagaatctcactgtgttgcccaagctggagtgcagtggtcactgcaacctccatctcccaggtttaagtgattctcgtgcctcagcctcctaaatagctgggattacaggcatgtgccaccatgcccagctaaagatggggcagggggtgcagggatctcgatatgttggccagactcatcttgaactcctgacttcaagtgatcaacctgcttcagcctcccaaagtgctgggattacaggtgtgagccaccatgccggctaattttgttgttattgttgttgttgttttgagatagtctcactcctgtcgcgcatactgaagtgcagaggcgcaatcttggctcactgcaacctccacctggctcactgcaaccttcacctcctggattcaagcgattctccttcctcagcctcctgagtagctggggttacaggtgtgcaccaccacccccagctaatttttgattttttagtagagacggggttttgccatgttggccaggctggtcttgaactcctgacctcaggcgatctgcctgccttggcctcccaatgtgctaggattacatgcgtgagccaccatgcccggccttgttgtttttagaaacgatattttttcctgttagcttgtgaaagttgattgggtcattcttgtcatccccaactaaaacagtgtcaagaggtaaagggaaaaaaaagcactcagggcacataacattgctccaaaaatgtaattatctgtaagcctggctgctgaaactgcccgctataacctaaaccagtttttttgtttgtttgttttgagatggagtctcactctgtcgcccaggctggaatgcaatggcatgattttggctcactgcaacctctgcctccaggttcatgtgattctcctgcctcagcctcccaagtagctgggattacaggcacccgccaacatacccagccaatttttgtatttttagcagagacggggtttcatcatgttggtcaggctggtcttgaactcctgacctcaggtgatccacccgcctcggcctcccaaagcgctgggattacaggcgtgagccaccgtgcccggctgacctaaaccagttttatctaattagctgctaaaaacaacctgcagtgactctaaggatcgttttacctagttgccattacttgccaatcaaaacttgccagctccccaaaaccttactagtgacaatgaactttcttaaagaacaatatacaacagttctctttttttgttgtttgttttgatatagggtcttgctttgttgcccaggctggagtgttccggtgtgatcacagctcactgcactcccaaactcctgggctcaagtgaacctctcatcttggcttcccaacgtgttgggattacaggcatgagccactgttcctggctatatttctcttttacaaaaataaaacctctaaccatctgtttgttcttctgacgtaccaaagaccaccctgtttgtgtgtatgccctgaatggcaattattgcttcccaaatgttttaaatttatagatttgtctctgtattttattttacttggacagcctttttctttttcttttctttttttctttctttttttttttttttttttagatggagtttcacttttattgcccaggctggaggacagtggtgcaatctggggctcactgcaacttctgcctcccgggttaaagcaattctcctgcctcagcctccccagtagctgggattacaggtgcccgcccccatgccgggctaatttttgtatttttagtagagatggggttttgccatgttggccaagctggtctcgaactcctgacctcaggtgatccacccgcctcagcctcccaaagtgctgggattacaggcgtgagccactgcgcctggcttggacagcctttttgtacccctgattcccaggagaactgctgctctattttcccatggcttaccttgaaaagagtaggatactagagaaaaggatggctaatcacgtgtttacaagccatgtttcaggagatgacccttgtagcccggatatttatttgcctcaccaaaattcaggttctaggtgtaagccaggatttgggggatggaactgaaaatgcttctccaaacggtgaaaagcgggcccagcgcagaggctgaggaggaaggatcacttgaagccaggagttcgagaccagcctgggcaacatagagagacctccccccacgccctgcccaccaccgccgtctttacaaaaaaattagccaggcatggtggtgggaccacaggggcacaggctgaggtcagaggattgctccagcccaggagttccaggctgcaatgaatggtgataaacccactgcactctttcctgggcaacagagtgagaccctgtcttaaataaaataaaataaataaataaaaaaaaaagaaaagtgaaggcaacgttaataagtgtccactatgacataataataaccagcatcacacacacacacgaatcttgcatatatcacaaaaatctcagtatggtaattctgtggagaaaaaaaaaaagcccatccaggtaagcatagaaagtgttttttcatcatctccctttgactccaaatgaagaagcagagttcccaatagcatgaactagatgttggcagaggaaaaagcgagtcctcgtcctatcctggtgtaaacttctgattctggacaattctcagtaggattggcaatgactcttctaggcctccttgtgattgttgatatattttttttaatttaaagttccggaatacatgtccaggacgtgcaggtttgttacacaggtaaatgtgtgccatggtggtttgctgtaactatcatcccatcacctaggtattaagctccgcatgtattagctatttatcttgatgctcccctcccccggttatcaggatttttaaacagtttgctctaattcactgacaggattcttttagaatgaatctaaaaaagctgggaatctttaacctgagcgcagatcggatcacgtggaacggtgctggtgtttgttaaaaattcagattgccccgaattttcgactcagagggtctgaagtggggctaagatctgcagattaacgggctccgtgggaggctccctgctggtggccagtcccggggtttagctgttcactgttgctactcgtgctaaaccacggtctaacactaccgacactattaatcgccctggtcctcaagacagccgcgaccccagacgggtgaggccctcatcctctagcaccagatggggcctgggaactgctgcttagcagattcagctacccacgtggtcacccggggcaaccacaaggtcgactcaaaagaccaaaataaatgtataacgaatgccaggaccaaagccggaatatatctaatcattcattttgaggtttaaacttaaaaatgttacataaaaaaataagtaacctgccaaaaaatgcagagtggcggcgggggcggggggagaggtggtgaacgcgaggggcagtacttccgggtcaggtgggccggctgtcttgaccttctttgcggctcggccattttgtcccagtcagtccggaggctgcggctgcagaagtaccgcctgcggagtaactgcaaagatgctgtccgtgcgcgttgctgcggccgtggtccgcgcccttcctcggcgggccggactggtgagcaccgaaggccggcatgatgcaggcggccgggtggggctgcagggtggtggtgcgccggctcgggcgctctctgcaggagggcgaggggctgtggcgatgccgccatcttgcacccgtggcttctccggctggacagagcaggcgacacaggtgcccttttgctcgtcacctgcgcagaggcagaatggtacagggcagacagttaactcgatggtgtccagagacagggcctcaagattcctgccttcggctgacagcggccctagaagggggatcttgggtgaaggtcagggcttgggcgctagctctccgaggcctgttctgaatcggtgaggttcctctctttcgattcttagggtcgcgtcccgctgaaggtcagaaaactgctgtcagctcttgttgaagctagtcagtggagtctgacattgtgtgaaggtcagcaggcccagcatttcacctctgcctggagctcagtttagaggaaaggaataaatgaaggtggtttttggaatacttacgtaggctttctcttagtgctgaatacgaaacgaccgtgaaaacgtcctgcaggtgcaaagaaccatttcatgtggccagcactgtgacaacagtgaagctggtttctaaattgtctctccggcagagtgtgtgctttgtggcacttggacgtgtttaaagaatttgtccttgagttttccacctggttttgagtaatttttagtgatggagaattcaagtaaaagagaacaaggttggaaaatggctgtaaggattaatacccttcgttatttgtttcccttgaaattaacatgatttcagtgtaaacgcattgacactgacactttttttttgttctaaaagtaatctcaatttgaaaggtgaaataaacatgttggctgttttgctgccttaacaaccgctggtagcatcttgggtttctgttaacaaaaaagcatttttaacggttttcatctagctcctatggaaggtagaggcttcagaattgacagtgaccagtcgcagtattacaacttgaaggagaaactgaaggaagttccaggtggctgcaggatttgttgagagagtaaaataagtccacatgccacaactcttggtttctaatctaactctagcatttattcagtttttgtttgcttgttttttttttttttttttttttgagatggtgtctcgctcagtcgcccaggctggattgcaatggcgtgatctccgcccactgcaaccaccgcctcccaggatcaagtgattctcccacctcagcctcccgagtagctgggattacaggcacccgccgtcatgccctgctactttttgtagtttttcgtagagacggggtttcaccatgttggctaggctggtcttgaactcctgacgtcaggtgatccgcccgcctcggccttctgaagtgctgggattacaagcatgagccgtcgtgcccggccgcttgttgtcgttgttgttgttgttgtttttaagtaaaattggaactactttgagttttgccccttgtaggaagctgtttatcttagaattcctgcaactccattaaaatacatctaaagtcaaaataataaaaattgggtacctttaaagggaaagacacttacattttgttaacagttgctttttttttttttttttgagacggagttttgcttttgtcgcccaggctggagtgcagtggcgcgatcttggctcaccacaacctctgcctcccaggttcaagcgattctcctgcctcagcttcccgagtagctgggattacaggcatgtgccaccacgcccagctaattttgtatttctagtagagacggggtttctccatgttggtcaggctggtctccaactcccgaccttaggtaatccgcccgccttggcctcccaaagtgctgggattacaggcatgagccaccgtgccctgccaatagttgctttttaaaatactgactgccaggccgggtgcagtggctgacgtctgtaattccagcactttgggaggccaaggtgggtgcatcacctgaagtcaggagttcgagatcaacctggccaacatggcgaaaccctgtctctactaaaaataaaaaaattagccgggcatggtggtggtcgcctgtagtcccagctactcaggaggccgaggcatgagaatcgcttgaacctgggaggtgaaggttgcaatgagccaagatcgtgcccctgcactccagcttgggtgacagaatgagactccgtctcagaaggaaaaaaaaaatgtgtgtgtatatatatatttactgcccagtctgggcaatatgatgaaatcctgtctctataaaaaaaataagtacaaaaattagcctggccaggtggcgcactcctgtgatcccacctactggggaggctgaggtgggaggatcacctgagcccaggaagtcgaggctgtagtgagccgtgattgagccactgcactccgacctgggtgacaagagtgagaccctgtcccaaaaaagaaaaaaaaataagccgggtgcggtgctcacgcctatagttctagcactttgggaggccaaggcgggtggatcacttgaggtcaggagttcgagaccagcctggccagcatggtgaaaccccgtctctactaaaaatataaaaaattaacctggtggaggtggcgcacccctgtagtcccagctactcgggaggctgagaatcgcttgagactaggaggtggaggatgcagtgagccgtctcaaaaaaacaataataataaagtacagactgcattttaaaaatatgcgagtgtttactgtgtactaggagctgtataaaaggttttcacatatatcaaaagctactttcccatttgacattttaaacaaaatgctttatatgtaattagcattttcaccagtactttgatcacactaagctggcatttgtttaagcttgtaagttttataaaggctttgttaaaaatcaaatttttaagaatacttttgcactaggtctccagaaatgctttgggttcatctttcattgctgcaaggaacttccatgcctctaacactcatcttcaaaagactggtaagttattatttctcagtctacgccgcacttactagatgaagatataaattacatacatcgtataactgtggtgagttgtttttcatttgttagttttttctctagtttgtatagactctcaggttcttaaaccatattgttaccatttagccctgtcatggttctcttgttatagtcaaatgaactactgttacatatttttcttttgatattagtatggcttctttgttctggtaatggcccttgggtagaaacagaaagaacatacactaggtaatggaatctttgtgacctctggaagacttcctttttccttttctaaaaggcattagaaaaaatgtaagttcttattgataggttttcttattctttttctttttttttgagacagaatcttgctctgtcgccaggctggagtgcagtggcaagatctcggctcactgcaacctctgtctcctgagttcaagcaattctactgcctcagtctcctgactagctgggattacaggcatgcaccaccatgcccggctaattttttgtattttagtagagacaaggtttcaccatgttggccaggatggtctcgatctcctgaccttgtgatatgcctgcctcggcctcccaaagtgctgggattaaaggcgtgagccactgcaccggtccactgataggttttattttttcaaaggcagtagctactagatatttggcaatctgtgaacttgcacattacagatgcagtagagaagtggggaggcaagcataggaagacactataagttggggaatttctttggagatgagtatttggacttttaaaataaaggttaaatatatatgtgtgtgagagtgtgtgtgtatatatgtgtgtgtgtgtgtgtgtgtgtgtgtgtgtgtatgtgtacacacacccccacgttcagcatatatgtttttcttttttcttttttttttgagatggagttttgctcttgttgcccaggctggagtgcagtggcatgatctgggctcactgcagcctctgcctcacgggttcaagtgattctcctgcctcagcctcccgagtagctgggattacaggtgcccaccaccacacccagctaatttttgtattttttgtagagacaaggtttcaccatgttagccaggctggtctcgaactcctgacctcaggtgatccacctgccttggcctcccaaagtggtgggattacagacatgaggcactgtgcgtggcctccttttttttgagactctgttgcccaagctggagtgcagttgcgccatctcagctcactgcaacctccacctcccaggttcaagtgattctcctgagtcagcttccctagtggctaggattacaggcacgcaccaccacacctggctaatttttgtatttttagtagagatagagtttcgccatgttggcctggctgatctcaaagccctgaccccaggggatccgtctaccttggcctcccaaagtgctgggatgtttttttattttgttttgttttgttttttgagacagagtttcgctctgttgcccaagctggggtgcagtagcgtagtcttggctcactggaccctccacctcctgggtttgagtgattctctcctgcctcagcctcccgagtagctggtattacaagcatgcaccaccacagctggctaattttttttttttttttccttagtagagatgggattttgctgtgttggccaggctggtccaaactcttggcctcaagtggtccgcccgcctcccaaagtgctggtattactggcgtgagccactgcacccaacccctgtatgctaagatgaagaataccacctatactaccctgtgtgccttgaaagagaaagacacactttgttaacaggtgatttttattttttattttttatttttttgagatagagtcttgctctgtctccaggctggagtgcagtggggctatctcagctcactgcaacctccttctcccaggttcaagtgattctcgtgcctcagccacccaagtagctgggattacaggcatgcaccaccatgcccggcaaacttttgtgtttttagtagagatgggggtttcaccatgttgcccaggctggtctcgaactcctggcctcaagtgatccaccccctttggcatcccaaagtgctggttttacaggcatgatctaccgtgcctggccaacagttggtttttaaaatatgtttttattgaatttagccaaaaaattcaggttttaacatagttacagatttcttagaaattaaaggagaacatttattttaagggttttacttaatttgattagcttcttgtctggtttacatttgttttgtgtggacttttttttccttaatcacttggttttattttcatagcttttaaaaatagaatctcgtgttacagtgtagaatatatatatataatttttgtgtgtgtgatagtctcactttgtcacctatgctggagtgcagtgacacaatcttggcttactgtgacttccacctcccaggttcaagcagttcttctgtctcagcctcctgagtagctgggactacaggcatgcccgtgcccagctaattttttttttatttttagtggagacggggtttcacaatgttggccaggctggtctcgaactccttacctcaagtgatctgcctgcctcagcctcctaaagtgctagcattaccactgtggctagcgtgagccactgtgctgggtctgtagaatatatttggattattatgatcacaaaactagttttttgttgttgagaaatgggctttgaaaagatccgaggaccagatttttattattattattattattattattattattattattattattattattttgagatggagtttttgcccttgttacccaggcttgagtgcaatggtgtgatttcagctcaccgcaacctccgcctcctgggttcaagcgattcttctgcctcagcctccgcctcccgagtagctgggattacaggcatgtgccaccatgcccagctaattttgtatttttagtagagacagggttctccatgttggtcaggctggtctcaaactcctgcccttaggtgatctgcctgcctcagcctccaaaagtgctgggattacagctgtgagccactgtgcctggcccagattatttttttaattgaattgaattgtcttccatagggactgctgagatgtcctctattcttgaagagcgtattcttggagctgatacctctgttgatcttgaagaaactgggcgtgtcttaagtattggtgatggtattgcccgcgtacatgggctgaggaatgttcaagcagaagaaatggtagagttttcttcaggcttaaaggtaaattataaaataagattttggtgttttaggatctaagtcttctcagttattcatttagcgattcaaagattgtatcagatttttaaaaaactttgtcttaatttgcctcagatttttttcttgttattatcatagattgtaaagagaataaacttaagggtttgaattagccaagtttttttactctagggactgatttatacataacttgtagccactggctccaaaatataaaattgaataaactttcaccccaaatccaagaagtttaagtctgttctgtcttgctgttaagattattttatacaaaagcaaagcatttgataacttcaacaaaatttttctggtggaaattggaagtccgtgactttgtatttctagtgagtagacatattgttcaaaggcgagttttggtgtagctatcagaagctctctaatgtaagtctactttgtattgggttgagcctcatctgtcagggtatgagaaataagttgtaggagttagggaaagcagaggatgacatctggataaactagagagagtggaactgtctagtaggcatgcagatatgggaaaagatagtcttgatactcttggtaatgtctactacggaaaaagagccacttgatgtggaagaataattacagagcccaaagttatcattagctgtaagacattggccaatttagcatcttcagtgtacagtatttatctttgaaaggtgaggtcgaaacagattaattctgagttccccttttagcttttgaaatccaagtgtctagaacagtactgtccagtagtattggaaatatgtagtattctgcagtgatgagaatacatctgtgctgtttaatatggtacctactatactatcactattaatcatgtaaaatgtggctagtgtgacaggaactgaatttttaatcttttaaatttgacaaatttaaatagccacatgtggttagtggatgctgtattgaacatcagagatgtaggttaaagtttttggatgtgtaatgatattccatgatactccaagtacttctccagagttttcattattgaccagactattcctggaatagcctttttgcttcagacatgatttaaagatctaaaatatagttttaatgatgagagatgatttggtgctgttatgttatgaaaatttgtatttgattggttacagttaggtagcttttaatttcactttctactaactcgaagagtacaggttttgattaatttttgaaactgtttatggagcttctcacacataaataagatgataatcaaatttgtcttaagatttccatttggccttcatcactttatttcatactgatcacccagcccaagaatcattgccaaagaaaatacagtggaaaaaagcttattaacctgtccaatttctttgcttctgtaatagttatttgaggatatgatagtgagcatattaggcttatcaatgtgctgtcctaagattattcaaaatagcaattttaaaagtcttaatcagagagggttgtttgttagttggaaaagtactcaagaataaaccaggtgaaaaggacaatactgcttccccccccaccccccgactattttcttatgtagtattggtgtatggggaggagtgcccattcagcttcattgatgttcaattgtgtcttttgtgcagggtatgtccttgaacttggaacctgacaatgttggtgttgtcgtgtttggaaatgataaactaattaaggaaggagatatagtgaagaggacaggagccattgtggacgttccagttggtgaggagctgttgggtcgtgtagttgatgcccttggtaatgctattgatggaaaggtaggtttaatgttcgttagatatagttgcagcttctaacaaacatcaaaactgattatgcttagggtttttctttttattttttaacagggtccaattggttccaagacgcgtaggcgagttggtctgaaagcccccggtatcattcctcgaatttcagtgcgggaaccaatgcagactggcattaaggctgtggatagcttggtgccaattggtcgtggtcagcgtgaactgattattggtgaccgacagactgggtaaagactcaaaagcatattaaaagttctaactaaaatttgctcaatggaaggattatattttagtcttggaatggtaaatggtaatggggacattagaatctaatacgaggattaatagtaaaatttcagctgggaagtgaagggggccagcccctccacacctgtgggtatttctcatcaggtgggacgagctagctcagtcggtagagcatgggactcttaatcccagggtcgtgggtttgagccccatgttgggcaccagatgaagggggccagcccctccacacctgtgagtatttctcgtcaggtgggttgagagactgagaaaataaataagacacagagacaaagtatagagaaagaacagtgggcccaggggaacggcgctcagcatatggaggacccatgccgccactggtctctgagttccctcagtatttattgatcactatctctactatctcggtgtgggggatgtggcaggactgtagggttaatggtggggagagggtcagcaggaaaacgtgagcaaaggtctctgtgtcataaataagtttaaggaaaggtgctgtgccttgatgtgcatgtaggccagatttatgtttgactttacacaaacatctcagtgcagtaaagagcagtattgctgccagcatatctcacctccagccatagggtggttttctcctatctcagtaaatagaatgtacgattgggttttacaccaagacattccattccccgggacaagcaggagacagatgccttcatcttatctcaactgcaaagaggctttcctctttcactaatcctcctcagcacagaccctttacgagtatcgggctgggggatggtcaggtctttcccttcccacgaggccatatctcaggctgtctcagtggggagaaaccttgcacaatacccaggctttattgggcagagggccctgcagccttccacagtgcattgtgtccctgggtactcgagactggagaatggcgatgacttttacgaagtatactgcctgcaaacacatttttaccaaagcacatcctgcacagccctaaatccgttaaaccttaagtcaacacagcacatgtttctgcgagcacagggttggggctatggttacagactaacagcatctcaaggcagaagaatttttcttagtacagaacaaaatggagtttcttatgtcttcttctttctgcatagacacagtaacagtctgatctctctttctttcccccacagggaagtccttttaagtttaggaagatttatatttactttctctttttaaaggaaaacctcaattgctattgacacaatcattaaccagaaacgtttcaatgatggatctgatgaaaagaagaagctgtactgtatttatgttgctattggtcaaaagagatccactgttgcccagttggtgaagagacttacagatgcaggtattaaaagaaatttagtcccattgctattatcttaagtcccattgctgctgattgtagaatagcttctacttaatgaaggcatattttaattacttcctaatgggctgaactttttaatacaaatcagtaggtaagacaatgtaaaacagtagtacatttaaaggttttgttggtttctttaaagtggaagctgtttgattctgattaactctttttttgttgtttgagacggagtttcactcttgttgcccaggctggagtgcgatggcacgatctcagctcactgcaacctctgcctcctgggttcaagcgattctcctgtctcagcctcccgagtagctgggattacaggtgcatgccaccacgtccggctaatttttgtatttttagtagagacggagtttcctcatattggtcaggctggtctcgaactcctgacctcaggtgatcacccgcctagggcctcccaaagtgctgggattacaggcatgagccactgcgcctggcctgattaactcttaatggtaaatatttttagcacttaggtaatttttatagtagcctccaatttaaaaccacaatattgataaaattgtaaaatatattttctcagatgccatgaagtacaccattgtggtgtcggctacggcctcggatgctgccccacttcagtacctggctccttactctggctgttccatgggagagtattttagagacaatggcaaacatgctttgatcatctatgacgacttatccaaacaggtcaaaggaaataaatttttagaatccatttatttgtactgaagtaaaagttcacatatgcaacttctatttaataggttaacttcacaaacctattctgtaccataggctgttgcttaccgtcagatgtctctgttgctccgccgaccccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacaggtattattttaatgattaaaagaaatgttaaaaaagatttggataattctaaggcattggttgagactaatggtatattgactgatttgctaaatgcattttactttttattatggaaaatttcaaatacatagaaaagttaggagaatggcatagtgaaaccccatgtatctgtcacccagttattgcatagagtagcatgtttcgttctagtttcatttttaaccactactgttctcccttctagataattttgaatcaaatagaaattatatcacttcatttgtatgtatttcagtataaatatgttgcctattatgtttttttctcatctcatgcacatctcctaattgcagcaataaaatatacaggtcaggtcgtgaaagatttggggtactgatgctttgcattgttaggttttgagtttcagctttttggcataatgacttaaatttgaagatagttgatttcttactttaagcttgctagcgtgcgtatttccttacattatagatcttcttggaaacagaattgttctacaaaggtatccgccctgcaattaacgttggtctgtctgtatctcgtgtcggatccgctgcccaaaccagggctatgaagcaggtaattttgcatcactttggcagtaagggggctatcattagattagcaatatttgtatagtgctctgtgtcactgagttacagtacagtaatttctgtattgcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattgtaagttgttcttttcttcatttggtcaggttcctattgtgtatcagggtcttcccaggcctacagagctgcatcacatatcacggcctgtactacatgttgttatctgttatctttcatcaaaggcacttttacttaaactacatttgttttttgatttttgattttttttttttttttgagacgaagtttcattcttacggcctaggctgaagtgcaatggcgcaaccttggctcattgcaacctccacctcctggattcacgcgattctcctgcctcagcctccttagtagctcggattacaggtgtgagccaccacgcccgactaatttttgtatttttagtagagacagggtttcaccatgttggccaggctggtctcgaactcctgacctcaggtaatccaccctgcctcagcctcccaaagtgctgggattacaggtgtgagcccccatgcccggccctgtattctgttttttaaagagagacagtgtcttgcagtgtcacccaggctggagtgcagtggtgccatcatagctcactgcaggcttgaactcctgggctcaagcagtcctgcagccttagcttcctgagtagctaagactacgggcatgcaataacaagcctgggtaaattttttgtaatttgtaaagaaacacgggtctcactaagttgcccacggctggttttgaaactcctggccttaagccatttttccaccttttaaaatgctggcataaaaggggtgagcccaccaagcccggcctcaaaatattttttttttttttttttttttttttttttttttttttaatacagagtctccttctgtcacccaggctggagtatatttttagtagaaatggtaaaacctctaccattttggccaggctgatcttgaacccctgaccttaagtggtccacccgcctcagagtcctaaagtgctgggattacaggtgtgagttaccatgcccggcccaaactacatttcttattatcatttgagtgtaaatgataggggcttcacaaccaggaaaacttaagtatatttaatgtcttcctttcaggaattaaggcctgttagagtcccctcccccacttggctatatgaatatgtaatttggcagatttaaaagaaagttaatacgtttttattttgtcaagtcatttcagcaaaatatttatactcaaaacagtattaacactgtcagattataaacagtgcttatggactatactgaaagattatgcctcaagccttgaaaatataagaaataactgttttctgtcaggggtgggaggaaggattattaagtggagttctaggtcattgatattgtgaagaatagataatttacagggacatgttaggaattggagaaaaagtaagttttcctgaccttggtaacatggcattcatttctttgagcaactcacttggcattcttcttgtatcttttcagctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcaggtatgaatgcaattgttggcatctttttttaaagttatgtttaagatatgaagttaaaattattttcaaatctgtagttaggctagtcattaaaactttttccaggtcagaacttacgacctgcttttatttccaaatagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtacagaaatcacatgaaaaataaaggttccataatgcatagttgttttctgtcatttgtgttattctttaaaaccaagatcaaattgagaaattggtaagcaaatgcttcttgatctattttacttgaatattggtacagtcaactgggctagataattcaaggctgagctctttgtaagttttttttttgtttttttttttgagactgattctcactctgtcactgaggctggagtgcagtggcaccctgtcggcccactgcaacctccgtctccgggttcaagcaattctcttgcctcagcctcccacgtagctgggattacaggtgcccaccaccacgcctggctagttttttagtatttttagtagagacggggtttcaccatgttggccaggccggtcacgaactcctgacctcaggtgatccacctgccttggcctacctaccacagtgctgggattacaggtgtgagccaccgcacccggctgctctttgtaagtttctagagtactttgtgtttaagagaaattcctaaactggatatatgtggcaggctgacaatactgaagagcatagctggcttctctgcccagaggatgtacctgcataaagaggtactgtaggcaggaaaataataggacagttaaaattctcagggaaatgaaaaaattgctggaacaaaagctgagaagatagaatgcataggattatgaaaacttgtcaatatctcttttgtttgttttgtgacagggtctccatctctctcacccaggctggagtacagtggtgtgatctcagctcactgcagcttctgccacctgggttcaattgattcttccacctcagcctcctgagtagctggggttacaggcacataccaccacgcccagccaatttttctactttttgtagagggagggtcttgccatgttgtccaggctgatgatgaactccttggctcaagtgatcctcctgccttggtctcccaaagtgctgggattacaggtgtgaactaccatgcccggccatcttttaatattttcacagctactttatttcctctgttactagcttttcatagcctttgctcattcttactgcattaaattttttttactgatttatttatttttttgagacagagtcttgctctgtcacctaggctggagagcagtggcgtaatctcagctcactgcacctttcacctcctgggttcaagcgattctcctgccttagcctcccaattagctgggaccacaggcccatgccaccacacccggctaacattttgtatttttagtagagacaaggtttcaccatgttggccatgctgctcttgagctcctgacctcgtggtctgcccgcctcagcttcccaaagtgctgggattacaggtgtgagccaccacgcccagcctactgatttatttatttacttttaatttttcatagcctttgctcattcttaatgtgttacctttttttttacttagttatttatttatttgagatggagtctccgtcgtccaggctggagtgcagtgacctgatcttggctcactgcaacctctgcctccaggttcaagcaattctcctgcctcagcctcccgagaagctggaactacaggcacccaccaccatgccctgctaatttttgtatttttagtagaggcggggtttcaccatattggccaggctggtctcgaactcctgaccttgtgatctgcctgccttggcctcccacagtgctgggattacaggtgtgagccaccacacctggccttttttttttttttttgagacggagtctcactgtctcccaggctggagtgcagtggtgcgatgtcggctcactgcaagctctgccccctgggtttgcgccgttctcctgcctcagcctcccgattagctggtactacaggcgcctgccatcacgcccagctaatttttttttttttgtatttttagtagagacggggtttcaccatgttcgccaggatggtctcgatctcctgacctcatgatccacctacctc

SEQ ID NO: 13759 - DNA, 6140 bp, Human
ccagcctggctgggagggggctgggggtgggcccaacctgttctggaggggaactagcacaatggtgcggctggccgggcgtttatggcctggctgaggccccattcaggactcagggaaggtggcaaagcggtcctttcccccttgaagtgccccctcacccccctgggagggggggccagcaggccggaccacagccatgcttgaggggctgtctgacaagcagctgtctgcagtggtggaaggggaggtcctcccgcagcgggaacatgaaagggacaggctaggtcccgcggggagagggacttgtgggttgtgggctgtgggggggcgtggggctgcttttgtgaaaagcttgaagggggacgaggaaaggagggggcttcgggggggcgcttttctgctcctgacctggaacagactgccagaggaggccgtcggccaagaggggcggagggcctgaacctgggccaggaggcggggctgggataggcaggaccccaccccctggaagggaggccagcgtggggcaggctgggcaggtcccccaccccaaatgctccagggtggggcgaggggcaggtcttgcagaggctaggcagaggctgctctatggggaggtgcaattggaaatgagcaacggtgcacagtaagtgttaaccccgcgcaggttaaatgtccagctctgagagctgctccctcactccccctgcctcaaaggtgatatttcccaccccctccctaggagagagtagcccctaacagatgctaatctgggtctagctctgtccagatggctgaggttgggcctgggataaaggtggaattagggatttggggcaggggctgagaaaagctgtcccagcacaggcagcggcatccaggtggagacaaaaccagcaaaaaaggtacattctcatgctagagctgaggctgttgccagcagccaggaaacctagcccgggtcgcaccttgcaggatggaggggaagaagtactcagtctctcccactcagccttacagatgggtaacgagagacctagctgggaggcggtactcctcctggctttgcacagtgcgtggggggaaatggttcctctcccccaacccaaaggggaagcaggtgggcgggcgcatcccaccaactggccaggagcctctgttacattgtggctaaggagctgcctgccaggggcagccattgggccaccgctgatagtgcctgtcctcttggtactgcctctgcctccctccgctaaggaggcaccttgcctgcctgctgtcccatagtgcccagccccagccccagccccagctccagcccatagaggagggaggaacactggaagggccctgagcaccagggggcaaggccgggaagaagatgggtatgagctcaggattccacagttagtgcttcaaagaaatgctcatgggaccctgcaggagctttcagagtcccccacatgctctctggtgaccctaactcgcagcaccatctgctctgtgcccgtgtgctgggcaaggggtctttcaaggccagtggggaggatgaggaaggaatctggttgtcctggctaatggagcatgtccttggagttctgggggagatgacaggctctggtctaagaggtagggacaggggttctgtccctaatgagctgtgtgccccgtgcacctccttcatagaatacgaggacgggatagaaccctgagggctccttccagctcccagagtcctgattccagggctgtgctctgtcaataagtgtcccccagcctgggcagaccccagtcccttctgtaaggtagacgcaaagcaaagaggttatgaccggctcacccaggggcctgggaaggctatggccatatgcccacttcactctgcaggacaagtggcctgtccccactatattcacctcctcacccctctcccttggatggaccagtggtggtgtcacccaaagcaaattgacactatttttcccttggtaaccgcaaagggggagaatcacccgtctcctaattttaaccagtacgtgagggaccagggcgccatgaccgaccagctgagcaggcggcagatccgcgagtaccaactctacagcaggaccagtggcaagcacgtgcaggtcaccgggcgtcgcatctccgccaccgccgaggacggcaacaagtttggtgagagttggccctccccccagggcacccacacctccactctgcctcacttccaccctgcctcacctcctggtccatccccagatcctgtgtcagggctgagggccccaagggcctgagtgtccccaaccccttcgcctgagtctggaggtcagtgtggctgggtggtcccctgctgtagccataggccggcagccccgatggacggaggtctttctcccctcccccaccacagccaagctcatagtggagacggacacgtttggcagccgggttcgcatcaaaggggctgagagtgagaagtacatctgtatgaacaagaggggcaagctcatcgggaaggtgaggctgggagactgggaagtaacagagaatcagccctactggggtggggacatatagggcatcatgctcccctctctcctctgagccacacaccctcctgtgtaaagacttcccatcctactctcagcccacccactgggccactctctggtttttattttagagtccgggtcttgctctgctacctaggctggagtgcagtggcacaatcatagcccactgcagctttgtactcctgggctcaagcaatcctctcgcctcagcctctgaagtagtagctggcactataggtgcatgccaccatgcccagctaatttttttttttttttttgtagagatagggcctcactatgttgccctggctggtctcaaactcacgggctaaagcgatcctcccacctcagcctcccaaagtgctgggattacaggcgtgagccacggagcccggcctggtttctctatttaaatgagtccccgggactctattagccctctgaggggactggcaagccactgggatctgtggggctgatgtcaggagtatttctccagcaggcatcagtaagagcttagcatctacctgacactgcagcctctgggtggaggactaagagctgttgagggtggaaagtggggcacagatgtaagacaggaactcccccaagttcagtggggccagtgggctccagctagcaagatagacactaagcagctgcccctgtgaccaaagcacacggtaggccgggccctgctgggtgggagaattccacttcgtttgaaaccaggcaatcccagcttcccattcggctgtcgctgaccaaataacctttggtttgcttatctttgtcaagcctcaggcttcttgtctgtagaaatgggcacagacccctgattgcagacagagtgggatgggtggctgcactggcacccttctttcttctcattggaggctgctgcctcctctcccatgcccagcagcacccctcacctaggctgcatgagcatttcagtgctaagggcccgtgcatgctgggaaatgccgcaggtccttgatcttcacctacatctcaggaagctgaggcccagcctggttcaggaccgctaaacgacaagcctgcaactcagatccacaaagcgtgttcttgttggccactgttgcctctctaaataggatgccatctcaccaggcagagttccctgggctcacggccccgttgttcccgttgtccctcctcagtcgtccaaaataggccgtaagggcgacaccccagaccagggtaggtggacaaatgcccttcctgtccttgcttctcccgcagcccagcgggaagagcaaagactgcgtgttcacggagatcgtgctggagaacaactatacggccttccagaacgcccggcacgagggctggttcatggccttcacgcggcaggggcggccccgccaggcttcccgcagccgccagaaccagcgcgaggcccacttcatcaagcgcctctaccaaggccagctgcccttccccaaccacgccgagaagcagaagcagttcgagtttgtgggctccgcccccacccgccggaccaagcgcacacggcggccccagcccctcacgtagtctgggaggcacggggcagcagcccctgggccgcctccccacccctttcccttcttaatccaaggactgggctggggtggcgggaggggagccagatccccgagggaggaccctgagggccgcgaagcatccgagcccccagctgggaaggggcaggccggtgccccaggggcggctggcacagtgcccccttcccggacgggtggcaggccctggagaggaactgagtgtcaccctgatctcaggccaccagcctctgccggcctcccagccgggctcctgaagcccgctgaaaggtcagcgactgaaggccttgcagacaaccgtctggaggtggctgtcctcaaaatctgcttctcggatctccctcagtctgcccccagcccccaaactcctcctggctagactgtaggaagggacttttgtttgtttgtttgtttcaggaaaaaagaaagggagagagaggaaaatagagggttgtccactcctcacattccacgacccaggcctgcaccccacccccaactcccagccccggaataaaaccattttcctgcaaatgggttatctgaagcggggcgggggatccgaccaccgaacacccctggaaacgagcctgcccgtccccggccgggcgtggccacggcaggtgcaggcgcggcccgcagcgctggggcccccaggaggccgcgggctcggccccgcgggaggcgggcgcgtccaggccgggcggcccctccctggcgcgggctcgggtttcctgggctcgcgcggcgcggcccgtgctacctgttggggaagaaaacccgagcccccggaggggccggggccggggccgggacgtgcatccagccgggccccgggccccaggccccaggcccgaggcgcaggcgagggccctgcggagcccggcggagcccgggcggcccgcggacgccaggagcctcctcgggcagcgagattgctttttttccggtgaggagggcgggggcgggaagcggggttgggcggccggaaggggggagggggcgagaaggcgtcccctgtcctcccgggtccccgcggggccggggcgggggccacacctgagggcaaatctcaattagaggcagcggcccggcccggatggcccggggggtagggggcgagaggggcggggaggaaggggcggccttgcccccaccccagcttctccggtgggctttcccagggtcctccaggtgtgcgtgtggggagtggaactcgggggccataaaacccgcctcttcagtgcgctggcttttaatcttgtcgagggggaggtcttcctcgcagggacaaccccccccccccgccaccccaccaggtcagctcttcagggggaacaccctcagtgagcgctctcttctgggggtggggccccagcctcagtttcccctaccctcacggagccctctcttctgaggatgtcccccagcctcagtttccccttccctcactgagtcctctcttctgaggatgtaccccttccagcctgtttctcctcctctccctcttctttctgagactaccttgaggagggggattatggagagagaaggatgaaacacatcccttctcctctctgctccctagaatggcctaaaaatgagagaggaagtggggaagggccctcgtccagtgaaaatgggaggtgggtgcagctacagtctcagttgatggcgagcgccggcgcagagtctgacacccccaccacggggcaatttagaaggtggggacagcggcagccaagagggaggtccccggccctgggacagacattctccctactgctcgtcataattgcttttcaccaggttacttttttctctcccccatcacaaagagccttaatcccagtgaagaccgcgccgtgttgggggtagttttctgggatgtgtgtcgggagggtggtctggagccacagctgataactggcgagttcaatgggacttaacgggggcaacacccagcaattacttg

SEQ ID NO: 13760 - DNA, 6517 bp, Human
  misc_feature (1)...(6517): n = A,T,C or G
aagagcagaggctttttcaaagaaagagatccctctcccagcacccagcgatggcggcaaaccccacccacagtgcctgctaagaacaagtcccacgtgagaacaacatggccccccgagatgcccacagggaccccgagatgcctgcagtgcttggctctcccgctggccagctgcccacctggctcaggcccagtactcgtgagtcagccgatcaatcccaatgttgccaggatgatgggggcgggagtaagggccctgggggagggcaggggtgggcactgcaggcgagctgtctcccacatctggcacctgcacacagctgaggccgagctgagaggatgcttctgtgggctccccctcctcccggcacccctcccctcctttcactgtcctaggacactctctggctgctggagtcttaggcaaatatttaaaggggcagcaagggggtgaggagggtggtgggagcaaacacttccctccctttcttcctccctgcgcttctcaggggctctcagttcagatgccatgctgttatgcaaccttggggctgaaggccctccagatggagagggggacaggggaacctgccagctcatgaccgaagggcagggcccaggtgggagggggctggggcaggggacaggaactggggtggcatgttaaaggacaggaggctggttgggcatggtggctcacacctgtaatcctagcactttaggaggccgagatcacttgagcccaggagttcgagaccagcctgggcaacatggtgaaaactcatctctataaaacaagcaaaaattagctgggcacaatggcatgcactggtagtcccagctacttgggatgctgaggtgtgaggatcaccggagtccaggaggtcaacgctgcagtgagcagtgatctcgctactgcatgccagcctgggtgataaagtgagaccctgtctcacaacaaaacaaaacaaaacaaaacaaaaggataggaggttaagggagcgagcccaggcctggactctgccacagtcacctgagtttagaggtgaagggactttagagaccacctggcccaaggagtgaaagggaacctgagagaaagggtgagccagcccaaagtcattggcagatttgacctcgtaaatacatagagatggctttgggaaggcactaggaaagacagagaaaagagaaggagacagtcctcaaagctgatcgtatttgggtgagtattattctcagggcaaatttaggatcagaggatgcagaaaggggagtctagaggggtagagtgtagaccacagggtgagtgagctgattcgaggatggggagactgggagcccaccagtgaccagagccagccctgttcagggctgtccgggcagaagaaagcagtgtcagacctggaatctgccatcagcacagcctgcaattgacagacaagcccagagcaaagaaggaagcactgcacatgagtaagagcttgccaccagtggggacagagtttccagaattaggaaaataatcactgggggcaagtttgaggttggtaccagatatgtgggaggaggcaaggtaagggaaagagtacttgaagttggaactggtccttgcagggaaatgcacatttatgaaaccccgaaaactgatgtcaaagcacctcctgccttgggcagagtcctctcagagtctacaggtgctgcctccagaaccctcttcctggagcgcatccctatgtatctagaaattctgctgggaaatatgatggtcagacccttggccacctgaaaggttcagggtggtagaagaaaaaggaaagccacagggcagcaggggcaggtgccagcaaggaaggcaggcacgccaggaagacacccatggtgagaagtgcagatggcccgagggcaagtttgctcaactcacccaggtttgctcttgctggggccaagaggactcatgtgccagggccaagggcccttgggggctctcacagggggcttatctgggcttcggttctggagggccaggaacaaacaggcttcaaagccaagggcttggctggcacacagggggcttggtccttcacctctgtcccctctccctacggacacatataagaccctggtcacacctgggagaggaggagaggagagcatagcacctgcagcaagatggatgtgggcagcaaagaggtcctgatggagagcccgccggtgagtgtggttgcgtgtgtgtatgtatgtgtgcgcgcgcacatgtgtgtgatgggccctgcctcctctatcctccctggcctgtttccttatccagatccattcactcaactaacctaggactgtgataagtcaggatggggacaccaagaccactaagccagggacccttggggagctgtttgtgggccaagagccactataggggtccgtagaaagggctgtccgtagacagccctgagtcagaagccatgagaaacttcagaagtcaggggacacttctcagagaaaaaccacatacgagctggagccagaataaggaggagctcgcccggtggagaaggaggaaggcattccaggaaggagggagactctgtatcaccgcatggaggtgatcacttggggagagagaggggctgaccatggctaggggaagcagcagggagagacaggtgaagcaggctctcttgggtccctcaaaactagaccctgcttctaagcttctatgtgtctatgggtttgttagaatccaggccacctcctccaagaagccttctctgatctcctcagcccttccctgtccatccatcgcatcggctgtccagccctaggcagccgtgggagggtgttcagcttgtatagggagaagaggggacagcctcatgacctcatgcctgtctccctgcctgccccaccgtgtcaggactactccgcagctccccggggccgatttggcattccctgctgcccagtgcacctgaaacgccttcttatcgtggtggtggtggtggtcctcatcgtcgtggtgattgtgggagccctgctcatgggtctccacatgagccagaaacacacggagatggtgagaggtgtgggatgcacagcagtgggcacaggacatgccagacagaggggctaggtgggatgggcgataggaaactgtccaaggggagtggaggggaggaggcaaggggcacagctagaaggaaagaggcacgaaccaggcagcaacccagctcaggcttttccacaaggcccctgccccgcagcaggacagccagctccctccagcacctggttccactcagcctccctgaactcttgggaaagagggaagcgcatttgagtacagaggcctgagtatggggatgggtaccactggctgagtaggaaaggggaagaccaggtggctccatgccctttccccaggttctggagatgagcattggggcgccggaagcccagcaacgcctggccctgagtgagcacctggttaccactgccaccttctccatcggctccactggcctcgtggtgtatgactaccagcaggtgggtatgcccagacctcctgaccctgggaccaatgacaaggctctgctagagccacccagctgggccacttcatccacatccatctctccctctcctccagaccttttttgcctgagccccagattctagtatgactcccgtgcccaacctagagggaggtggctaaggacctgggtcagggagagagcagggcagggacccccgaatgatctccagcattctgtgcctagctgctgatcgcctacaagccagcccctggcacctgctgctacatcatgaagatagctccagagagcatccccagtcttgaggctctcactagaaaagtccacaacttccaggtgtgtgtgtgtgggtgaaaagagtgggctgtctccctcccagggctgctgggaggagtgtccgaatggtggctatttgtcacctgtaaagcactgttcctcattggctgccagctgactgcccctctcctattcccctgcacgactcctttccttcccaccccactgccaagctgctgggctcagctgagtccactcactacctggtggcttctgactctagcacagcccctctttactgatgagaaaactgaggctcagagagattgcctgatatacctgaagtcccacaataagggctgcacatgggatagaaactcacttcctacattccagatggaatgctctctgcaggccaagcccgcagtgcctacgtctaagctgggccaggcagaggggcgagatgcaggctcagcaccctccggaggggacccggccttcctgggcatggccgtgagcaccctgtgtggcgaggtgccgctctactacatctaggacgcctccggtgagcaggtgtgatcccagggcccctgatcagcagcggaggagcgctcgggccacctgcccgggctgtggaggagcgctcgcgctgaccaggcgctggggcgtccactgaagcggggtcatccaggcaactcgggggaggggaagctcacagaccggtacttcccactcccctgattctctctgtccatcctcaacattcctttgcttcacagggtcagtggaagccccaacgggaaaggaaacgccccgggcaaagggtcttttgcagcttttgcagacgggcaagaagctgcttctgcccacaccgcagggacaagccctggagaaatgggagcttggggagaggatgggagtgggcagaggtggcgcccaggggcccgggaactcctgccacaacagaataaagcagcctgattgaaaagcaaagggtctgcttctgtcttcctgcagggcgcagtcctgccctggcgggggccggccaagaagggaagggccttgggagagcaaagtggggtttgccattcgccctctgtcccagggcgctggggcactgggtccacctcggcgggggagaggggctcgcagggagccatccacgggctttcggcgccctccagcggcgtctccggaggagggagagacaccaagcacagcgagagagacagagcgcagagagcgagacgcgagagagcgagggtccaagaaggggagatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13761 - DNA, 25021 bp, Human
  misc_feature (1)...(25021): n = A,T,C or G
attgtcatgtgaacaactttgttgtaataaacataaacaagagttgcagtgggggaaccacaggaactgattgatcagactttaaggagagccattataccataagcatcaggactgttcagggagtgtctgttcaggatgttggaaagctcaaagtgtgtgatggctgtggaggttctgaggctgctgctgctccccaatacctgatgccaggttttatagcagcttacgttttagttaaacagtgtctttctcttgatgtctttcttgttacctattttcctaaataatttttttctttttttttttttaagggaatcattttgtaggaggggggaaatagatttcaatgttgaaacaaaaccttgtgaaggagatttaatgccttgtttaggaatgtgagtggttataattaaactgattcaattctcaataaggtcttgagcagtactggcaagcataaaaatggcttttgcatgtattttatggaatgtatgtaattagccttattttctacttgtgttcataagccatgtgaataaactcaggtactacttatagaactttattgcttgagatctgactttgcaattgcgattttctctgtgcttttgaattgaagaagagattaagtgggacccctggaagtcagaaacaagttaaacataaacctaatcaaagtcccaagatgttgtgaaagatggtttgtttcgttttaagggcaaggttgttgttttgttcttttgggggctgtctgaagtaggactgatgatcttagggcgtcagtattcatcgttcttgtttcctttcagttagtgttggaaatttgttaatcaggttgagtaaaataggaatcctgccccaaaggctttcctacttagtggaaaagctgtgatttataaagacacagtgtaatgaaataaagtgataatgaaaagccttgggcagactggctgtgtaatatattttaggcaatttacacaggttggtttaattattattatttttgttcttgtcagaattgtcctttctaatagtaggatccctcaaactatccttgctgctggtgaaaataggctccaattttttcttaaagtccaaaccattcctttaaaggctaacagatgtttactctccacttcagtcagtgaaaggtgatattgaagtatagtcttaattagttactttcctctttgcctttaaacaccacattaagtgcaagtatatatgcctccctatgggtttttgaccaaagcacacacccataccccttcctgcctccctggaactggttcaagatttggagagaagagtttgcttgtgggtgtttcccttgtcttatctgtgagtgagcatatgctagggttgaatttattttgacgctttcattttaaatttggaaccaaagtaagagtttaaagtgcaacagaagagagtctgctgaactttagacatgagggatccagggaggaaggtgcgtaaatacatcttgaagctttctctagaggttttctcgtacaggtgaccatctttacgcatatacattattgtaagctaataactactactcaaaggaatatttaaagctatatgaaaatgtgtgtggtacttatatcatgtttatgtgcttaattttagtagccgtgcctctggtatttcacactttttacattaatagcagaataagtaaattttgaatttttatttcaaagccttttaggaaagcttaggaggctgggtatttgcaagcggaaaaatgtatcatgtatgattgatcctcaagggaatgatgaaaaagttatataggtattctaagcatcttaccattttgtcttctatagcatcaaataaagagacctataaatggttattaggtgaatgttacccaggttctcctcagttcagaagcaattctttctttactgattattatttatctttgtttattaattttaagcacagttgcttacatttgtagtaggctgaactgttttctttcctgactgatcttttccagagcctggcccaactagagaatctgtgcaaacagctgtatgaaaccacagacacaaccactcgactccaggcagagaaagccttggttgaatttaccaacagccctgattgcctgagcaagtgccagctactcctcgaaagaggaagtgtgcgtaagatctgaaaatcctaaaggataacgggcgcttcggaaacgttattctggttctctgtgtaggaatggcatgggatggcttctgttccctgatttttctaggtgtccctgacttattttcacttttaagaagtaccatacctaccaggttggcaaaacagccatacagtctcatcaagaaaatctctttgaacatgcatttctgttctgtaatttttcatcctaaatttccagaacttgttttctgcttttacatttaagtgccacatcctgtcctttccagaataagataggactgtagataaatgacctttgtgtttgtttatttatttatttttgagacggagtttcgctcttgttgcccaggctggagtgcaatggcgtgatcttggctcactgcaacctccacctcccgggttcaagtgattctcctgcctcagcctcccgagtagctgggatcacaggcatgcaccaccaagcttggctaattttgtattttttttagtagagacggggtttctccgtgttggtcaggctggtctcgatctcctgacctcaggtgatccacccgcctcggcctcccaaagtgatgggattacagacgtgagccaccacacccggccaataaatgacctttttaatccaaagtcctagtacaagatcctcagtcttctctgtgttttgtgtcctctctgccacagctgctgtttattgccttacaaatccaggaacagtgaccttgacaatgaaattacaggagattgtaggattttaaatggaattagaacctcctccagcttaaaaatggcattgcagtgatcaaaataatgttcctgagatacaatttgaaaaaatcactatctttggcaagatggaagtcttgggaagggtgggatccccccagggtcccatgaaagggcatcatgagaggcatatcccagctagacttcagcagcaagcactggccttcttttgataaagtggcaacataaagtgcagtcctcatatttttcctaatcctcaaacagcttcccagtcgtgcttacctatattacgctctttcacagatgaaagagaaaacaccaagaaaaggcacatatattagccatcattcttgtgtgtgtggaaaaaggtgaaaatagaaatgataatgccatgtggtattctgaacaacagtaatccctaaagaattgcttaatcaaaatttgctttccaaaaagtatccttaagactggaatgaaatgtgaaaaaatgaaagttaattggttgagaggatagaattctagttgactttatttttgactttttattagtattataatattgtttatacagtaaatagaacaaattataattggttgaaattatccgttagtagctgaggggtataacttttcccccaaatatctgaatgatacaaagtcatggtcaaagactgtgtggtggtctgttctgttttacgcacatagtgttttatatattgctcttaaatcacttggtgtttggattgatgcacttgtatttgtcctgtgggagatgcccagctagctctgccagctaactcctgctggagtgacagtacagtctctctcaccactagtcttaaatttttatacctggtggtattatgtaatattaacataaatggatagtctgagggactaccatcttaaggactttctgtgtcatagaaaattgtccttgacccttgattaaaatactttaatgcttctgagcctgttcctgttttatggcattgtatataatatagccacatggaggaattcttccttaggcattttgatcacatggaatgctttgagtctccgtaaggttaaaacttgttaaacccacatttgagaatgtgataaagctattccattgcttaaggcataattctcctttctcacaaataaccttaagtttacttttaaactatcatatacattccccagcccaatagctgattgatagctgcgctgatggaaagatacaatttggagacaactatacagcatagtgtgatggtttcctctaatacttcttttcttttttccccaatatcatgccatagaaatattttgaggtgaaactgtttgaaatatcattataacagatactaaggggagatttcttggtttaaatgaggggagagattttttctaatctctatttttctgaaaagatgccctctagtgtctgtccctcagagtgaagcagatacctgtattagattcagcttgatcagacggttcactttatcttccccgttgttcattgttgaagtcagctaataaacttatgctatgtggttcatttttcctcagagcagtagaccctctaaaatccagaggatcaaatctgccaaaactgattgccttttcttgaatctgagcagagatctccaagttaaaaaccttgtgactggcttactcaatacaattttaagtcctttttccctctcttttcacagtcctcttactcccagttactggcagctacatgccttaccaagcttgtatcacgcacaaacaaccccctaccattggaacagcgaatagatattcgtaagtggagaattttctgttctgtcttgaagaaaatagtttgtttagtgatgtgctagtaatagtcaaatgtatgtgtttgttcaatgatatgctgagattgctaaccatacaaaatgtctagaatccagttcgtttccagaatttggggcttatgaaagtgaagggcccgacgcaataacttctggataaagcctaagtcctcccttttgttatcgggagatttcttcattcatcttttctttactgccactaataactaagaaaaacattgttaatgattttgaattctgtgtagaccacgttctttagctacctagggatagagtcaaagcagctatactgcaaattcttcatgagacaaaataaaattctgaattagaacacctactaatcttaaatttaaagtcccatttggaacagtagcataaataattaagacagtttgggttaaatagtctaaatttataatttcttggccatttagcatgtctaaagatatacacccttctctggcagagctttctattatgtggattggttttgtttcttgtttttttttaatagggaactatgtgctcaactaccttgccactcggccgaagttggctactttcgtgacacaagcacttattcagttatatgccagaatcacaaaactgggctggtttgactgtcagaaggatgactatgtcttcagaaatgcaatcacagacgtcacaaggtttttacaggtacagtgtatatatttgatgtaatgggaatgggagaaccagcatatacatatatataaacacacacacacacacacacacacaacttaacacgcttatctactttttaaacatgacacaaaatagaattatatgatatattctcttctgcatgttttttacccttaataggtcttggtagtgtttgcatgttggcaaaaacaaaccatgtctcagtctttcaaattcctacatatggtcccaagcaaaaatatgtttaattaattagttaatattttatagatgggcatttctttcgagtgttaaattaatacttcagtgaatagcccagtacatatattttgaataagtgcgtttgtagggtcaattcctagccttggaaagatatttccaagttatcctcaaaaaagttatacagcttgcacttcatgatgatgttttcgtcaacagtagaccacatatacaacagcagtcccgtaaaattataatggaactggaaaaaaaatggagcctagtgatgtcgaactgtcttaatgttgtagcacaatttattttttaagtaaatttagtgtggcctaagtgtacatatttataaagtctgtagtggtgtacagcaatgtcctcggctttcacatccactcaccactcactcactgactcacccagaacaactttcaatcctgtaaactccattcatggtaagcgccctatacaggtgtagctttttaaaaaaaaaatcttttatgctgaatttttactttatctttgctatgtttagatacacaaacacttaccattgttatagttgcccacagtatagtcacgtggtgtacaagtttgtgcctaggaacaatagcctgtaccatacagcctaggtgtgtagtagactgtaccatctaggtttatgtaagtacactctatgatgttagcacaacagtgaaatcctctaataacacatttcgtagaacgtgtcgccatcattcagtgactcatgactgtatctacttccacaaacagttgataagaggacctgcttacctcagccctggaagctaaacttaatttttctaatttaataggttaaaaaaattggtatcttattgtttgggttatgagtgagactggataaattttgatatgtttatttattgcttatatttgtttttctgtgaacttctatttatatcttaaccacacttcctcagattctttgcttattgttttatgcattctctttataaaatgtgttgtttacttgtcatttactttagtgatgtgttttgcaatttaccttttaaaaatgtatatgctataatgcttatgggaattttttttaatgtaaaagttttaaattttgatgaagtcagatttgacagtcttcctttgtggtgacagttaggttttaagtccagcaaaacaacagttttaaactatgattccttgctgccttgtctaggcagttttactaatgacacaggaacccgtcattcgaaagtatgagtgcattccaaatgccaaaaccaagcacacatgacaactctttctaccttatactttttttaaccaggatagtgttgaatactgcatcattggtgtcacaattttatctcagctaaccaatgaaattaatcaagtaagtgctacagccttcctcattgaagtaagtgccatattttttcttagtattggtgttttctgctgtgtgtgggatgatcttttttggcagttgtgtgcttttgcggtaagtgattaatgcccttttgaaacaaaatagttccattgggttttcctctgtaattgcaactcacctcactttttgtcctgttccctttctgtctccaggttgttttccccttttccatcttagcttttttttttttattggtactaattatcattttagagataaaagcgatcgcagcactttgggaggccgaggcaggcggatcacctgaggtcaggagatcaagaccagcctggctaacatgttgaaaccctgtttctactaaaaatacaaaaaattagccgggcgtggtggcatgtgcctgtagtcccagcgacttgggagacaggcaggagaatcgcttgaacccgggaggtggaggttgcagcgagccaagatcgcgctgttgcactccagcttgggcaacaagagcgaaactccatctcaaaaaaagcaaaatactactgccttgcccatgaaggagaatgacttcaaaaaagagaccataaaggtcgaccttttgtgtgccccttctgctcctatatactttaaattttttaaatggtcattgatgccacagaatactacagaggaaacaccagtggctttcttttgtcctggctatattttagtcatttacttttttatccagctaaaaatttgtgattatagaacaggcccttatcaatattagctataacatctcacccttaagttggaagcatattaatgatatcagcattactgttgctattgctcataattctgcagacatttttattaaccctgagaaatcttaactgtgagttggtcctatttcaaatgtgttagcttagagcctgtgaaaattgggagtccatgttgtgttttcttgccacatgcaatccccgttgtgatcagtaattaccaaaataataacagcttacacttttgagtgattactgttaccaccattctaagcactttatagtaactaattttattctcagaacagtcatatgaggtaggtactgtgtttatcccattttctggatcaggaaactgaggcccataaagatgaaatcatttgcctaaggtttcacaagcaacagatgtgattcaaacccaaatagtcttattctagggcctgtgttcttaacaactaatgtactatttaaccactcttatctttgcagcagaagagcagatgcattaactaaggatagagattgtggacttaatgttttcccctttgaagcttggccccacagagtacataaattttgatatatgtataataaaaaacttcaagattttacttttctaagaaagtgatgaaattttgtgtagcatttagtgtgtaatcattctctgtgttatgatcaatataacagattgtatgatacataatctagcaagacctttattatctaagacacatgataacacaatgacagaagcaagaattggagaatattttgagcctctaaataatttgaattttccattgttttgtgattgtcagattcaaaaaagaaagtatatttctgtcactattcttacttagaacctagaaataaaattaagaagacttgattgtcagtaatcttgctgccttacactttaatgtggaaaaaacaaaatgagtctcctcttggatgaattgatcagtaaacagaagagatttaagctttcagtacatggttagactgaaaatactcctgacaactttgaagttattttattccacatattgaatgcctactgtgtgttaggactgggagcatactaaagaagtaaaagatttagttcttaaccacaaaaacataaatttagctgaaaagacaagaacagggaaagtcaaagaccaatacaactacttaaattaagttttcacttctggggtatagagaatatgttgaaataggttagaaaaggaggtgaatattatgggctgttgtcatttgtaaattctgcagtaacttcagcgttgagggttttttttgtttttgtttttgttttgagttttgcttactgaaatcaaagagttgttactctgtctgtgggtgtttaagagactctgctgcccaggctggagtgcagtgcagccacgaatgcctgggctccaggccctcctgagtagctaggacttacaggcatgcaccaccacaccgatttttttatttttttatttttattttttttagtttttagaggtggtggggggtctcactgtgtctgcttctgggctcaaatgatcctcctgcctcaacctcccaaagttctagaattacagaggtgagtcaccacgcctggcccattaagccacagtacaacatgaaagtaattatcagtaacgtctgccaacaatttaagttttacctccctgaatacagaggaaaataagaatttgcagcagagattatccatccttttgttttccctctgtaagctagagagaaaggataccctggctattagcagtttactatcctccatcctttcactagatagcgtttcacaataatttaaatgttaaaaatgtattttatgtttatgttgctcttactggaaatccttctagcttataggaagtctacatgaaaaattctttttttgcaattaattctttgcattggtttcttctttttctgcacaggcagacaccacccatcctttaaccaagcacagaaaaatagcctcttcttttcgcgattcatcattatttgatatcttcacactttcctgcaatttactaaaacaggtgagcatgtagtttgggtcatatttcccagtttcttttgaaagaatgagaatggatgggaacttgttaaatgtcagcttttaactgatcccacgagagtttatgcatctgtttaatcatcatctcttatataagactcatagaggcgttgaagaaactggtcagagtgaccactgaggttggagaaatgattgtcacttccctgtttaagctcaattcccctaggtaaagagcagtaagtgagcatttatcccatactcctatcttaaagggatctagtttacctaactcagagtttgaagttgtgttgttattgtttttataaccacataaaatctttctatatggtgcgaaagcatgttagttttatggtgtttggattcttagtgctctgaaagtaggttcagactatgttgttagcatacagaaaccaggctggttcccctgtcccccgctgagttaaaagcagcacataaacaagtaacatctgtaaggaaaagtagattttgaatttttaacatccatttagatttaataacctggaggagtagacagtatcacataaggaaattacctgtgttaaaatcgaaagttggtgttttcaattcatttattgatagagctgaactaagaaagaagtgttaagctgggagttccacacagttgtaacacagctcggatgctttatccctaagaaagctaaatagggttagcctctggttttttgttcatttttgtggttttgttcttattttccaacatttcccaattttagttttggaagccagtttgtattctttctgttattccagttaacgatattcatctttttcctcaattacttagttttaccttagaattcccaaataatcctcaggttaagcaaagctgcctagcaaaagctgttgcacccgctggaggggaaaagcttttgagaaaactaaggattgaatcctccttactgataccatcaggaacaaataattagccagccagtcacggaggctcagctggtataaccttggaatgggacaggcacagtagctatggccagtactcacctgtagtctgcaggtacattgcaatgagtaaataaaattcactgatgattttaattctggtttgagagatttttggtgatggtggttgtaaaaacgaggaaagaaagtagggcagggtgttaagcatcctcagagctccctccagagtttaatcccagccctgtctagaaataactaagatctcacatgccaataaaatgaccacaggagccatattgcttcagaattctctgtgaccattatgtctacattgtgtgaggagtatagtaagtgttaaaacagggctttctttaaataccaacttcatgtttttatagtaaatatgttttaatagtatataaggagctaggtattttcatagtcacaggtgatagaagtaccacatctttggagagaaggggacattttactgtgctaacatatagccctccttttctgacttaacagctttgttgagtctgggagcaagctgggaagagaggagtgattttggggactcattatgtggtaatttttacaggcttcaggaaagaatctaaacttgaatgatgaaagtcagcatggcttgctcatgcaactgctcaagctcactcataactgcctcaactttgacttcatcggcacttccactgatgagtcctcagacgacctgtgtacagtgcagattcccaccagctggagatcaggtaacagaacttcctccacctcaaaggctgtctgtcactcccctacagagtgtctgtagaatgatctaaagaactcctggcaactcctgtgtattctgagggagaattgagaaaaaattctaacgtctttttttgtttgtttgttttttaaagacagggtctcactctgtcacccaggctggagtgcagtggcacgatcacagctcagtgcatcctcaacctcctggactcaagcagtcttcccatctcagcctcccaagtatctggaactacaggcacatgccaccacacccggctaattttgtttgtttatgttttgtagaagtggggtctaacaatgttgcccaagctagtcttgaactcctgggttcaagtgattctcctatcttggcctcccagagtgctgggactacaggtgtgagccactgtgcccagccagtaacatctattttataatgttggggaggttgttggagtaatctcatagatcccccagtgtcaaagaacttttaaaattgccgattaataatagatatgtatttcacctttttgcattaattgcctagagacttctgtaatctatttagggtaataactatctttaaaaacaaaatcaaacacaacaacttgttcttatgtttgcctttgtattccagaaggataaaagttttaaattctttttatggacagaggtgttcaggttaagttctcagagaattgaaagaagaaatctgtttcttagagaagctaaaatagtactttcaaaaaaagaaaagaggccgggcgtggtggctcacgcctgtaatcccagcactttgggaggccgaggcaggcagatcactatgtcaggagttcaagaccagcctggcgaacatggtgaaaccccgtctctactaaaaatacaaaaattagctgggcatggtggcacgtgcctgtaatcccagctactctggaggctgaggcaggagaatcctttaaaccgggacctgggaggcaaaggttgcagtgagccgagatctcgccattgcactccagcctgggctacagagggagactccgtctcaaaaaaaagagaaaagaaaaagggaaaccaaaaagcccctatttgcttatcacttccaaaggaaataaatactctgtaagataagtaggcagaaggatgtgctccctgatgtatagtgctggaagtatgccagcggcaatgttcatacttaataaagtgatgtcttttgtctttttcttccccagccttcttagattcttcaaccttgcagctgttttttgacctgtatcattccatccctccttcattttcacctctggtgagtcaggactaccgtttcttaaagcaaacctattcatagaagatagcaatggtgaatgaaccttatattcgttttgttttataaaattatacaagtaaagcatagaaatactaggctagttatctagtcttttgagattaagcttgtagcctaaaggttccagccataaagtcttaattatttttaaattattcctgtctaaaggccaattcctgcagatggtcaagctcttttgggtctcatcgtgtatctgactttatgctgttcctcaaacggccacaggctagcacctggggattcacctaatactgtctagttgaactattaagattgtcctgactcagaaaaccccttaggtgtacattagattgtcataaatggaaactgtgatgagaaggctaatttgcatacttaccctgaataacatttgaaagctattgggaatggtgtatttctcttttaaagccataattaacctaaaacctcaaaattcattcacgttctaaaatactattggtctggtatttcagattgttggtgtaaattaccggttggtgttatacacaaaatatataaagaagacacagtgaagtaatgagtggtgtgcatagtgtttgttcagtagaggacttttctggccattgtagcacttctccaaattaatgtagacctttgtgttcgctgaaacatgatttcagtgttgtcgggtgtatcgttaaggttactgcaagaaaaggtagcacagtcaagagggatgattaagagagtactacttgcaaaggtatgggtaaaattaagggacaccagcacggggtggtggtgcatgcccctggggctggcagtagtggggagcctcaaagggcaagtgaaggaaacctggagagagttgaagctgtgtcttagaggagggctggacaacaagaactacagccatcactagagaaactctgccactgcatagccagctggatggtcggaagaggggtaccctgttccctctgccctctaatctcctgctggtactttccattggttgaagccaactagaagccagagggcaagggagcttggctgctctcctcaacagaggtcagcctcctagggaatagggcagggtggaaaagggtcgaaagcagatctagagggggcaaacagagaatgtaaatatctaacacagtgggaacagagggaaatgtcttcagggataaagctgggttgtgtttttttgtttgtttgtttgaggcagagttttgatcttgttgcccatgctagagtggaatggcactacccatgggttcaagcgattctcctgcctcagcctcctgagtagctggaattacaggcatgagccaccacgcccggctaattttgtattttcagtagagacagggtttctccatgttggtcaggctggtctcaaactcccgacctcaggtgatctgcctgtttcagcctcccaaagtgctgggattacgggcgtgagccaccacacctggccaaagctggcttttttagggcccagatgtgatatgcttatttcttttttttttctttttttttttcgtttttttttgtttttgagacggagtctctcactgttgcccgggctggagtgcagtggcgcgatctcggctcactgcagcctccgcctcccagcttcaagcgattctcctccctcagcctcccaagtacctgggattacacgtgcctgccaccacgcccagctaattttttgtatttttggtagagatgaggtttcactatgtttgccaggctggtctcaaattcctgacctcgtgatctgcctgcctcagcctcccagagtgctgggattacaggcgtgagccaccacacccggccgatacgcttatttctttatagcatgtaatgacataagcacataacatctacatgtcaaactcagattagccaagaaaactaaatctaaaactttaaagtataaattgctcgatatttttaagggtgaaataacgtatctcagcaagaacaaagatgccattggagtggtcaaaggaatttgtacctaagggaatttccaaactgaatttaatgggctgccgtggtctgcttggatctatgttcttttcttttctctttttaaaataatgttgcttcagatatcctaaagaaggatattgtaggaggtggaacgtttctggtgaaagtaactgtacagtctttttaatcgttgtgtttgggttctgccctgcatttaggtattatcctgcttggtacagatcgcttcagtcagaagatccctgtttaacaatgcagagagggccaagtttctctctcatcttgttgatggtgttaaacgaatactggaaaacccacaggtaagtttatctgagaatttacatatgtataggattagtgtatggccagctgttatgagtcagaaggaaatccatcccaaggcccagtaaacaattcagtctgttcttcagggaagactgaagtgaatctctatttgtaggccaattctgagattatttgcccaaaagaggagcttatatcctcccgcttcagaaatgtaggagttacaggaaagaatcacttcgctataaggaaataaggaagaagctagtcatttttccccccaagaagttaagactctaacatctccgggcacagaggctcacgcctgtaatcccaacagtttgggaggccaaggtgggcagatcacttgaggtcaggagctcaagaccagcctggccaacatagtgaaaccctgtctctactaaaactacaaaaaaaattagccggccatggtggcacgtgcctgtaatcccagctactcgggaggctgaggcaggagaatcgcttgaacccgggaggcagaagttgcagtgagccgagatcatgccattgcactccagcttgggcgacagagtaagactccgtctcaaaaaaaaaaaaaaaactaacatttggtttttgattttgtttaccatttttaaaaaatgtttatcggtaacctaagtatatagggctgcttttaggtgggaaggaagatacttctttcaaacgttaatttcataactcgattgccctttttgtcttttgaagtcccagtgattcagtatttttttgaaagtatcacttctctatactagaagaaaattaaaaagcagtttatttcaaaatatactcagttttgtccctctttttaaaattcatttattcattcaacaaattacattgaatacctactctgtgccagggatacacgggtgaacaaaacaaagtcttagcccacatatgctaacagaagaagacatatcaggaaacttacaattaaatatactggtagaatagattttaaaatagctgtaatatttgctatatcatataaatactactatatgaataaattacagtaagtgatataaatatatgaaacatttgtataactttgctaactatcggttagttgtgctgaatgatcagtttgacagacgtggaaatgaaaatttcattagatttcctttgattggtaacaataagaaaacaagtcagtcacgtcttaggtcgtgcccacttctgctataatgagctttacagcctcagtgtgatcctcctgggcttctgtttcaaactctgtccattgaggctaataatgtcatctcatgtgattattattgtgaacatatgagataataaatgtgactgtcccttttcaaagtgactttaaaaaattgtttctgaacattatgcagacgtatcattctgaatcatgacctgcagcccagaagttaaaaagtagattctaccccttcccccatgccatctcaagtatacatcattcttgaagtatgttaaggcacattttacattttatttttctcctctgctactgccagagtttatcagacccaaacaattaccatgagttttgcagactactggcccgattgaagagtaactatcaactgggagaattggtaaaggtggaaaactaccctgaggtcatccgattgatagccaacttcacagtgaccagcctacaggtttgtctttgattacttgtgtcttccttcctaaatactggaatctcttgcttgttggttttaaccatgtaagaatatatttttttttcttggcaaaggtaaccataagtccagtatagccctacagagtagttactattgtggcctgtgatttacatttacacaagtgcaagtagtgtggggagaggaacatgtgggaattactaggataatatttagattcatcccagagagaattagctcatagtcaccccaaaaaagccaaggtcggaacagggagctagacagaagagtaaaaagagagttgatgccctctctttcttagtcatgtaatatagaacaatgggtctcaaattttatggcttgtatcacagtcatctaggggactgatgaaaaaatatagattcttgagtcttatccccataatttctggttcagtaggtccagggtagagccttggtgtttctaacaagttcttcaggtgattgtcatgcatactaatggttgagacccacttacatatggctttccttatggtaaggcttacacagccagcatagagtagcccttctcattagatgcttaatcttgaaaatactaataaacacattaaactagatgccatacacagaacaaagcccacaaaagtctatcctctttttttaaaaaaaagaaaaaagtctttatcttctgtgtcagtggcatgggactaacacgtacagaaatgaaaaatatgccttctgcttttctacttttctttagcactgggaatttgctccaaatagtgtgcactatcttctgagcctgtggcagcggctggcagcctctgtgccgtatgtcaaagccacagagccccacatgctggaaacttacactcctgaggtcaccaaagcctacatcacatcccggttggaatctgtgcacatcatactgaggtaaggaaacttagcctcattcattcccgcaccagtggcctgttgtcacacttcctagagatcagacaccccattggcaaagaggtactcgaagcgtgtctcattggagccactactgttcatggttcttcttccttgtcagcagagtagcatgagagcataaagcctgatagaatagtcttgtctcttgaacatttatattctattcatgttcccccttttcactgtccatagcaatatctttgaatagagtatatccatataatgtttgtccttgccgctgtttttctttcaatgtgagaaacatttataagatatagatgataagaattatgtgtaacttataggtgcttaatgtgaactcctaaagaaataagtggataaagattacacaatctagttatcaattctaattccagagctagaacacataagaattctaagccactgatcactgattgctttacattcatacatggtttctgtctacattgacttaactgaaccaaaatcccgtagctaaagaaatgtcaagccctttcaaaaattacctatattaaatgaagttatagccctgtttaggtagctttcttgttttcactggctgtttgtcaagagaatttacttggagtctaagggtctggggcctttttaagttggattcttaatttgcttagccccaagtgcattgaatagtcatgagttatagtcttaactgttgatgacttgaatcagttcaaaatctgagtattcatgaagttcaccagcaagccttcttctgtcacctccatagcttccactcctgaggattcggctggcttcagtgaggcattgttggggagtggttacatgtttgtaggctctggggccggatagccagttagtagctctgtactcttgggcaagttgctccatttctgtatttgtaaaattcaaataataataggcctgcctcataaggttcttacaaggattaaattaatatgacctggcacagtgtgtagcacatggtaagcacacagctagttttagtgctgctgctcctgctgctgctgctgctgccattatcatattgcagtgtaacaacagaagagctcctcattggacaagatgttaaaatctaggagctggcagataaggcaagacctagtacagggccacaatgccttgtctgcaattccaaagtcaaagatgtgacaaaagaaatttcctcatcagtttggcattagaattcacttgttacaaaaccggacgggagttggtatgagaccatttgtagtttttttaaaatcctacttagtatgaccatttataatattcataagttttgctacaggaacgttgagtttgatgtgccacaaagcccatcaagggttttatatgatatggtagaagcatcatactgccttcctccaatttgaacagttctgaattccaagacacacctggccacaatggcctcccacacaggactgtgtacttatcctacagtttactatagtcaagaacaagcgaaagactaagagtcaagaggtcagacagttgagaagggcaggactttgaggtttaaggcagaaaaacattaagagttgagaattcagattgtaagatttgacaccaacaagcagaatatacctaagggagactgatgctagggcgaagacattggccttctgcctcattaaacattcttccttgggaaaaagtaatgtcgggatgtagacctctacagtcagaaatggtggctaagtgaagaagtcagagagctgctatattgggcaaatcagtagtcatattttaagagagctgccttccttcttcccttgggaatagagatggcctggaagatcccctggaggatacggggctggtccagcagcagttggaccagctgtccaccattgggcgttgtgaatatgagaagacgtgtgcactcctcgtgcagttgtttgaccagtcggcccagtcgtaccaggagctgctacagagcgccagcgcaagcccaatggacattgcagtgcaggagggtgagtgtgcagcgtgctgggaactctagacctgtgaggagatgttgtctagtaccccttcgctcattgccacctctttcctacctccctgcaaaaggattctttcatcatctgttgtctccatatgcacaagaatctttatgaatgaataaatccctcaagggactagggaagaagaactgaaatcacatctgcagtgggattttgttttaagagatgaggtctcgctatgttgccacgtgggccttgtacttcttggctcaagtgatcctcctgcctcagcctcccgaagtagctgggactacaggcatgtgccaccacacctggctcctgtctgctttttaatgccccacagcacagctgggaccaggccaagaggtttatgactgctaaatcaagggccaggggaaacagggagataagtacagatagtaacctgggcttcctctttttaccgggcctggctggtgtttgtaacatggcactgtgcccagcttgggtgtttttaactctaaggaaatactacactaaaaataatggccttgtctgatacaggaacattggttacctaacgaatttccctcttagcattgcccttaccaaagcagagaagtagccattctctgtaagaaaagtaagacttcatggtttcaccacagtgttcttaagattaaggaagttcagagtgaggaatgtcttcaagaaactatcactggaggtgacactgggtctgtctcctgctgcaggaaggctgacatggctggtttacattattggagcagtgatcggtggccgggtttcttttgccagcactgatgagcaagacgccatggatggtgagcttgtctgtcggtaagtgctccccacagaagctctccactctgccttgctggcacttctccactccccgatagggtcctctccacttacagaacgtaatctgaacatgctaactgcccatgagacacagctttcaaggcttttgtaagtgccatgataactctgcctatgatctttactttaaaataaaaaaccagcaataattcagaaaggaaataatggatacggaattaggaaaactaaagcagagattctctgttaggtctttttacgaatagtatctcagagttagtaaaatatggactgcttttgccatcccaaaataagtctaaaaggaaactgcagttctttaaagttcaccagagatggaattacagagttcctacagcctttcaaatctcttggccatacatttcaagttatttttcatctgtgcaattctcattttatcaaaactttttttttttttttttttggagatggagtctcgctctgtcacccaggccagagtgcagtggcgctatcttagctcactgcaacctctgcctccctgttccaggttctcccgggttcaagcgattctcctgcctcagcctcccaagtagctatgattacaggcatgcgtcaccacatctggctaatttttgtatttttagtgagacggggtttcaccatgttggccaggctggtctcgaactcctgacctcaggtgatccacctgccttggcctcccaaagtgctgggattacaggcatgagccaccgcgccccgccttcaatatatatatcttctgaaaatcctcatttgtctctttccacccccattttgtttatcagatgcccatttgcccagaggtcccttaatcctgacaaaagtctccgtagcattttcccactggcattttttgaagagttgagcagagctttaataagaatgaaatctaatgcctttctgattctgcagccgagttcaatactgtgtgtgtcataatataaatttagttcaaacaatgtcttgcagattggttctgagcttgagtgtagcaacacaatgatggagtctcattcactcatgatgtgtcacaaatagttaactattcccacactcaaatatcaaatgactcacttattatgacatctgtattcgcattcactcacttgcattccagtatcctttcttttggggagaaggtacagagaaaagagatgaagtcacaggtaatatttctgctagtaatccctggaagtgttacctacctgtgaacatcatccttcatgtgtctccaaaaagattgaaaactcctggtctagtcctgcctccctcatttatgtagatgaatttggttgcaggaggttgctgtacccaagtacaggcatatacgaccatgtcaagatagcttgggttgtctagagtaaacaggatgtcctgctgttgagagaatcattgctcctcttcctccagggtgctccagctgatgaacctaacagattctcgtttggcccaggcgggtaatgagaagctagagttggccatgctgagcttttttgaacagtttcgtaagatctacattggggaccaagtgcagaaatcctctaaggtaacagcctctcaattggctccccttagttctcacttctcacttgtgggattgctgatggagggaaacagttgctgatagttcacataacctccagatttcacgtaataggacagtccaaatgttttctcttagtctttaaattctgggagagtcatcaaagaattgggcccatttctttagtgctccatatgcttaacaaatggccagtccaaacatctgttgttctcccacaaatgggcaattcttagtctccatgcatgaattaatattcagaacagaagatttgggctgtctttttgcaatttcaggattgaaagggaccagtaagattgctcagcatctgtccagtaatacttggaaactagcttatcccttcagtaaagtcctctctgggattcttgtccattttcttccacatcttacccatgagtgtggacaaaaatagtaccaggatgtgattgttgtaattcatgtgttctggttactttctcttcttaacaccagctgtaccgccgactctcagaagttctgggcttgaatgatgagaccatggtcctaagcgtcttcataggaaaaatgtaagtgtttcagcttgccaccagcaagagtcctttgcactcctgttgcaactgtaaaacgtgatcttggcattgtgctgccagtgcctggtattccagcattgatcgtttgcgtcagaaaattgtgcatttgagtgtgtgacaagctgtgcttagagatatggcccggccccagagcattccaggcttgtacaggcaaggatttaattttgttcttgcagaatctcctctttagcctctggaatcacaggtgaaactctgtcatgtcattagcaaaacagacctccaccccagtaattgctgctcagcccctcacccagttgctgtgctccagggatgcccagcataggcattcactttctgttgctgatttcctctcgttatcccccgaaggggaaagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttgatgatacatgtgtggaatcctcatcagattgttacagttttgtcttttcttctattttaacacatttttgccttctactacagcgaactctagttggcctagtaagagacctgagagggatcgctttcgctttcaatgccaagaccagcttca

SEQ ID NO: 13762 - DNA, 15742 bp, Human
  misc_feature (1)...(15742): n = A,T,C or G
gctcattctccccgtgcgcagccggtggcatcgccggggcgttggcggaagcccccggggcccgggagggggcaggcccaggcgcggccgccgaatcacgggctcctgtttcccgcagggtgctggaggaggaaaccggcggagcagcttccccactctcagttgcgcttctggcgatggcgatcagaggtcctgctgcgctctccgccgcgctctacctccattagccgcgctgcgcggtgctgcgccctcgccggtgcctctctcctgggtcccaggatcggcccccaccatccaggcacgacccccttccccggcccctcggcctttcccccaactcggccatctccgacccggggcgcgtgttccccccggcccggcgccttctctccctccgggggcacccgctccctagccccggcccggccctccccgcggcgcagcacggagtctcggcgtcccatggcgcaacctacggcctcggcccagaagctggtgcggccgatccgcgccgtgtgccgcatcctgcagatcccggagtccgacccctccaacctgcggccctagagcgcccccgccgccccgggggaaggagagcgcgagcgcgctgagcagacagagcgggagaacgagtcctcgcccgccggccgggaggccccggagctggcccatggggagcaggcgcccggtgccggccacgacgaccgccaccgcccgcgccgcgaccggccggtgaagcccaggtaagcgccaggagcgcgccgtctggggacactcgtggcgggggatttctgagccgagcctgcggtgcccgtacggagcgtgttccccgtgcccctgtgggctgggccacacattctgacacctgaaagttaggaagcccgacgcggccagaccacggcggagcggtggctccagaaaacctgggcgccctctgccactgcgccgtcacctcccgcctggggcttcgtcgctctggccgaagggaccgcgccaaggcagcgctgccgctctagtgccacctgtcatcctggtcccttgcacgcacgttcaattttccctcccttgcctctctctggggcccagcccgctttccccgcctccttccctctcccctccccgccaggctgaagtttccagcggcggtggcggctgccctggcactgctggctgggctagggcagcttgacccatccagctgaggcttcttaatccccctcccctgtgccggcgcgctcttcccgctgggggccagggcggggttcctagccccctgcagttgtcctgggactctgcttgagaagccgagaaactgcagggctctgggaagaggctgactcagggccgcccaggtgtagagagagacacagccagcggccctggctggcagcgttccccagcgactccagcctgccaggcctgcacttcccacggctacaagcctggctggggctgtaggctagggttgggctagcagcacccccaaaaccacggattgcaggatgggaagaatcctctgagccgacccaagcctcaagggcacactgaggcccagaggagtgacatgatttgcccaaggccatacagcataggacagagtcaggctcaggatccagcctttttcttcattcagtgccttccactttctgtcctccctcatgggtcgtgagcagattcctagcttggtgaggccaggacatgccctactagcaatggcagcctccgctgaggggcactggcccaggtggaatttggggaaggggtaacatccccacactggaggagcaagatgtgtctggctgcatgtggagaggcagcatggtgcccagttgtgggctggcacttgccttactggtttgagctgcctcagtgttgccagggcggtgcccactctgtgccaggctgtaaggtgcttgggacatgtgccccagaagctcatgctttgatggttatgctccagggacccccctctgggagagccccatgagggcaggagagtgatggagagtacgcccagcttcctgaagggcaccccaacctgggagaagacggccccagagaacggcatcgtgagacaggagcccggcagcccgcctcgagatggactgcaccatgggccgctgtgcctgggagagcctgctcccttttggaggggcgtcctgagcaccccagactcctggcttccccctggcttcccccagggccccaaggacatgctcccacttgtggagggcgagggcccccagaatggggagaggaaggtcaactggctgggcagcaaagagggactgcgctggaaggaggccatgcttacccatccgctggcattctgcgggccagcgtgcccacctcgctgtggccccctgatgcctgagcatagtggtggccatctcaagagtgaccctgtggccttccggccctggcactgccctttccttctggagaccaagatcctggagcgagctcccttctgggtgcccacctgcttgccaccctacctagtgtctggcctgcccccagagcatccatgtgactggcccctgaccccgcacccctgggtatactccgggggccagcccaaagtgccctctgccttcagcttaggcagcaaggtgagtgcaggggcagagagggtacctgtggctctggcctagcaaagttgctcggtggtccccaagatgcccttccactgtgatgaaaagagaaggcagcaccgaggtagaggggtctatcagcttggagctgtcccaggccccacagtcaaccccaagcaagccctaccctgagcagctccatctctctaggcctcccctgccctcgggtcattgcagccactgactcacccattgtctgcctaggataaggtcctgggaactgtggccttggaatgtgtggcttgtcctgggaggagatgggtgggcagacaagggccctctatctgagactgggatgtgcaggggaccccatggcccatgtctagggtacctcctccatagatgactcccactcccagggatgagatgttaaaacacttaaaactcagtatggcacaggacaccaaatggcccaaacagaccccagatgccctttggctgtgccaggcattcactctttagttcttagacttccttgtggggacgtctgagaaatcctgggggaggaggtgggggttgccaggacagtgtcagaggcactccagagacctagggcagtgctgtttattaatcagaatgtgagggcttcagtattctccccttccttcttgcttgtcagttctgcccatccatttaggcatggggagcccaagtcagctgaagcgtaacactttctcccctctttagggcttttactacaaggatccgagcattcccaggttggcaaaggagcccttggcagctgcggaacctgggttgtttggcttaaactctggtgggcacctgcagagagccggggaggccgaacgcccttcactgcaccagagggatggagagatgggagctggccggcagcagaatccttgcccgctcttcctggggcagccagacactgtgccctggacctcctggcccgcttgtcccccaggccttgttcatactcttggcaacgtctgggctgggccaggcgatgggaaccttgggtaccagctggggccaccagcaacaccaaggtgcccctctcctgagccgcctgtcacccagcggggctgctgttcatcctacccacccactaaaggtgggggtcttggcccttgtgggaagtgccaggagggcctggaggggggtgccagtggagccagcgaacccagcgaggaagtgaacaaggcctctggccccagggcctgtccccccagccaccacaccaagctgaagaagacatggctcacacggcactcggagcagtttgaatgtccacgcggctgccctgaggtcgaggagaggccggttgctcggctccgggccctcaaaagggcaggcagccccgaggtccagggagcaatgggcagtccagcccccaagcggccaccggaccctttcccaggcactgcagaacagggggctgggggttggcaggaggtgcgggacacatcgatagggaacaaggatgtggactcgggacagcatgatgagcagaaaggtaagggggccaggaggggctgcaggccctgcgtgggagggggcagccggggctggggcttcgcatggggcggggtctgtaggctttatgagtggaccacaaccagtggtcaggctcccacctggatcacgagggctctctgggagttcctcagcatctccaggccagagccttccagcaagtatcttctacctctgtctcctcccaagccctggtgtgttggtggcagtataatgacatagttcagagcatggctctggagccagagtgcctcgtccctgactttgctgattggtagctgtgtgacctcggatgagttgcttcgcctctctgggcctcagttacttcatctataaaatggggaagaagacggcacctacctcaggaagactgctgcaaaagttaaatgctagaatgattcatagcaagggcttggaagaattcctggcacccagtgaacactcagtaaatgttcaccgtgatgactgcgtgtgccacaaatccctgtttggggattgcttgtcctgaaggatcccttgtcctgccccaggaatggctgctctcttggccaggtggagctggagactcagtttggactctgccagtgttagggctctgggcgcaccctggagtcacttgctacactgtgccctccacggaggaccctggcactgccggctccagccttagttctttgggatcacttcggttttttcagcttcctggacggctgggtgtggatgagctctctccgtggccttgcccaaatgccctgcacctggcatgggcctgtctgtgccctctgcccaggcctctgccctggctgggaatttgttggccccttcgccttcttgggttactgcacctgtggcctgtgtcgaaactctctggcccttctcaccttccggcgccctccgtccacgttgggattgtctcctcatgtcacgcagccagtggtatcactaagccctcagtggagctatccaaagtctacactggctggatcctgcacttgtgtcaggacgatcgccccagctgcccaaagccttgggctcaacacaccagacaacctcttcgctcggctgccggtccatgtcacggcatcctcagactccctgctcagcctggcgtgcgagccttccagctgcctggtccactcttgctggttctgaattaggcttcagagacctggggcgaggaactgggctggctctgagtgtggatggggtgggcgctaaggtgaggaatggggttctcagcagcccaagaaacccagattcctgacctctgcattgtcccctcaggaccccaagatggccaggccagtctccaggacccgggacttcaggacataccatgcctggctctcccctgcaaaactggctcaatgccaaagttgtgcccaggcagctggagagggaggagggcacgcctgccacttctcagcaagtgcggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactcctggctgggcgcggtggctcatgcctgtaatcccagcactttgggaggccgaggtgggaggatcacttgagtccaggagatggaggctgcagtgagctgtaatcacaccactgtactccagcctagatgacagagtgagaccctatctcaaaacaacgacaacaaagtctcctggaggaaatggcacctgagcatggttaccacttctggtagcacctagggcttggagggaaggaggtggaggaaagaatgtgctagaagtggtgtggattaataattcagggccagtggggaagtccctgggggcagagctgggtgtggggcaggaatggtggagctgaggcctccaatgtccctggaaggctttgctggagaggatagtttctacaaggaggctctcgacagggctgtggagtaagcagggggtagctgtcgaggggcctgtctcccttccctgggggggccctctccatggaagctgctccttgcttctcctgcccctccttggatccttcccacgtgaagccttccattggggcctgttgccttcaccctctgaccctgttctctccgtggtcagcaggccaagggccagccgtgacagaggacagcccaggcattccacgctgctgcagccgttgccaccatggactcttcaacacccactggcgatgtccccgctgcagccaccggctgtgtgtggcctgtggtcgtgtggcaggcactgggcgggccagggagaaagcaggtaggagaggggctgggggtgggagggcgggatggagccctcagggggactgctgcaagcctgtggtcattcgttggctgcctctccccaaaaagccccctacccactgcacagccccagcctcagccaccatggctcaatgcccttagagcagacttcccctctctgcagatcagaggaccatgcctgcgtccttgaccacccttaaacaaaggcgagtgtgcccactcggtgtctcccactctgttcagctggcaccttttaaaacctgctgtaacactgtgaagtgggtattactgcttttgttttccagataagaaaaactcagaggataagcgactcgtccaaggtcacacagttagtaacgtgttgcagccaggacttagactcaggtcttctgatttcatcctgttcttttcatagttctcagctttctttcccttggctcaagttggccacgggagagcttgaaatttccctgtgttccagtagggatgaccagaaagagctccagggtcagacacgttttagaacattgtcttccacatggttagcctaaggacctgcaaagcctctcagcacgttaaagtctgtagcattctacaagcaaagaatgctgtgtctctatgtgacccaggtttcccagaaagcacgagttttgtggactattgagtcccctggtttaggtatcatgtcctgaccttctctgaccttaacctgtgattaccttgatttctggacctgcagcttttcccttcctgccccacaggctttcaggagcagtccgcggaggagtgcacgcaggaggccgggcacgctgcctgttccctgatgctgacccagtttgtctccagccagggtgagccatcttggaggggtggggcgtgcagaggttgggtcctgagggagaccagcttcccgtctgattgtccctccccccagtgccatgcccttctgcttggcaaggccaagctgcccgggactgcctgttggtctacactcaccaccaacctccctctcctgcccacccccacccccagctttggcagagctgagcactgcaatgcaccaggtctgggtcaagtttgatatccgggggcactgcccctgccaagctgatgcccgggtatgggcccccggggatgcaggccagcaggtaagacccagggcatgtcaccggttgggtatcgtgcctgcaaatggctgacctttgcaggggtttggcccccccttttcttggtggggatgaagagagagaagcctgtgggatcaggctaattcccaccttggggatcaggagccatgcatgatctccagcgctggcccctcccacctccatgccctggaggtcctcaccccctgccttcctggagcatatccaccctactctgtgcatattcttgttcagcgcttgccacatcatgctagaggtgcttgttggtatggccaggtccccaggccatggttccttcaggtggagcgttggcccgccttctcagtatcccggcacctaacacctagcaggcgctcaatgtgcattctgcaaagttttttgaagttcatgttcttattataaaagtcatccattcaaaataaatagttcattgaatgcattttgggttccagacactgtgttatatacccattgtggaaaatttggaaaatacagacaagtataaggaagaaaatgacgatgaccttaatgctaccattagttttgacatatttatttccagccatttgtctattttagtagactatagaccctatcataggtagaagtccatgagcaacttttttccacctaatgttatatcctatggcattttgctcctataaacacgattttaggactgacaagagtccattgttcattcttgtgggttctgttgaattgtgtctgccattttaaaatctctggttggattgggggggtggtggatgggtttaacagaaggaatcaacacagaaaacgcccccaactccacaaccttcctgcaatggcgacacccacaggaccaagagcatcaaagagggtgagcggctcctcttgcccctcggcctgtgcaagagggaggctgggccagagtttgaggcaggaggggacagtcgcggaagtctccggggactttagcaactccccccccacccccaataatctccactactcccctcaggacatgcctccaaacaccttctttggccagacccccctctgaacccctctttttagagactctggagctgcctgcaggaaaagcagtagagcggggagacccagagcagagctgaggtgggggatgctggctggggagagtgggctcagccaggaagagagggaagagcagcatgggcaagagggcctcgaggggaagaggagggaccaaacgcgaagccccccaccatcttcctccctgacagagacccccgattccgctgagaccccagcagaggaccgtgctggccgagggcccctgccttgtccttctctctgcgaactgctggcttctaccgcggtcaaactctgcttgggccatgagcgaatacacatggccttcgcccccgtcactccggccctgcccagtgtgagtgagggcacggagggagggctaggagccaggggaccagaggctgggcctgccctccctgtggggcccagtgggtcctaagcccctgtgcccctctctgcaggatgaccgcatcaccaacatcctggacagcattatcgcacaggtggtggaacggaagatccaggagaaagccctggggccggggcttcgagctggcccgggtctgcgcaagggcctgggcctgcccctctctccagtgcggccccggctgcctcccccaggggctttgctgtggctgcaggagccccagccttgccctcggcgtggcttccacctcttccaggagcactggaggcagggccaggtgaggcacccctcccctcccctcccggccctggccaccccacctgcccctcggggccttggtccctaggcccagacagacccagtggctcagggggagcaggagggctgtccccgagctgttctactgcccttacaacacgcccttgcctggccacggcgggcaccctggccattctcctcatggcctccttcctttcccaccacagcctgtgttggtgtcagggatccaaaggacattgcagggcaacctgtgggggacagaagctcttggggcacttggaggccaggtgcaggcgctgagccccctcggacctccccagcccagcagcctgggcagcacaacattctgggagggcttctcctggcctgagcgtaagtgtccccaacacaggggagagggagctgggagcccaagccctagggatcgggtggcagaggagtcccagggtgaccccgaggggctggaagcaggtgttgctgccgccggggcaggggcttcagggctgaggaggccaatggccgttctgtctcctcctgtagttcgcccaaagtcagacgagggctctgtcctcctgctgcaccgagctttgggggatgaggacaccagcaggtgtgtatgtcaccaagggccagccctacctccccgccaccgcaggccccgcctggttcagccctcccctcctcctctgcccccaacccccaccccgtggtccctggtactctcatgtttgccctctgggagttaccccggtggtggtggggctttgatggggtctctggtgcccaggttgggcctgctgggcatgaccccctaccctgacagggtggagaacctagctgccagtctgccacttccggagtactgcgccctccatggaaaactcaacctggcttcctacctcccaccgggccttgccctgcgtccactggagccccagctctgggcagcctatggtgagtgtccctccactcctgcccagtctctactcccatgcctgtctgcctgtcatctcggggcacacgagcgtctgtgccaaggccctggggcctgaagcgcttctctgattccatttctttctttctttttttttttttttgttgttgttgagacggagttttgctcttgttgcccaggctggagtgcaatggcactatctcggctcaccgcaacctccgcctcccaggttcaagcaattctcctgcctcagcctcccgagtagctgggattacaggcatgcaccaccacgcccggctaattttttctatttttagtagagagggggtttctccatgttgaggctggtctcaaactcctgacctcaggtgatctgcccgcctgggcctcccaaagtgctaggattacaggcgtgagcaaccgcgcctggctctctgattccatttctaactgttctttctctattgccatgcaggtgtgagcccgcaccggggacacctggggaccaagaacctctgtgtggaggtggccgacctggtcagcatcctggtgcatgccgacacaccactgcctgcctggcaccgggcacagaaaggtaggtcctcggccagaggcaggagcggggacaagctacagaggtgagtgtttgtcgccaccagccctgggcctgcctgagcgctctttcctcctcagacttcctttcaggcctggacggggaggggctctggtctccgggcagccaggtcagcactgtgtggcacgtgttccgggcacaggacgcccagcgcatccgccgctttctccagatggtgaggaggcagccgggagccctccccttccccccgcccagccctagaagctcgtccagtcccaccccagtgtgcggtcccatgtgctcgctccccgccccacgccctcaggtgagctgcacagacccaactcgcacagacaggtgcagagaaggcagaggggacccggagttctgccgtggggctcagagaaggggcaggggctgcggcaggagagcctggacccgatgatgaaatgagagcaccagctgcccgaggctggacgtggtgctagggccttaggcacaattatctgttacccgtctcagccccccgccccatgaggcaggcactgctcctttcccattggcagatgagaacaccgaagctcagtggcagggctgggatctgagcttctgtctgtcatggccccaggtcactactctatgctcttcctggaggcaggcagcctcctctgccttctgagactccgtccggctgcccaccttttggtatttgcatcttgttaggggagactgcctggaggagatgctcccggaggggctagcaaggaagggggctgagggaagtggagggagagatgggtcaggtgaggagccagggaaggggaaggtgatggggtgggctggaggcaagaagcttgaggcgcaggggaggagagagtccaggggtaaggcgagggcagccccgtggttcccaagtccagctgagccctcattatcctggggaaaagacttccacctagtgtcacccctcgccaaggcacacacacacacggagacgtgcagaggccagcatggtgtgcacccctcctgcccacaggtacacacatgtgtagatacacacacagatgctgggacacgcagaggggagcagacaagcacacctccacacacagatggcctcttctgggctgggtgtggctggccgtgggcagtcaccacggcccaacccagtgactcacggggcagggctgaggggcacagtctccctgggtggcctgggaaacactgctcagctccaggatggagctgaatctccaagggcaaaggaatcttggcacccagctgggactcccctagggtccaatttgcttcaccagccttcccttcccccacgccccatcttgcagccctaagcccaggggcaatggctgaggtccttgccaaagggggtggattgggctggtggtgggttggagcacgatgctggcgtcccctttgcacatgttccctgggcacctctgtcctctgcgagtccctgcctgcccagagagctccctgctctggttaggcttgtgaggtccccgtagctgtggctgctgcagaggcctcagcctggccggaaagcctgttcacctgctggcactcagagcctcgcagtggtccttcccttttctgcatccggaatcttagggagaccctgatgaacactttgagttgtctccccagggacacacagctctctcctcatccaccacttagcacacaattctggccattccaaagacttcagatgaagaagtcctggtagacagtttatgaactgggattatgcaggacgtctccctcggatttgcagaaaggggtaccattgagagagggaggagaggggccgaggtcacagaggctgttaaaggcctccagccccagaaaagcagggattcagtctgcccaactgtagggccttgaatcccttccttctaagctccttccagccaaatgtgtgttctgccaacctgagctgccccagccccaaacaaactcagccatgccctccctgcctgcccttcaagacttgacccttcggctcttttctccacccctggcctctggaaagtccatgccccatcctcctgcagccctgcccttccctccccatctcgctcattcccccttctcttctttgaggtgtgcccggccggggcaggcgccctggagcctggcgccccaggcagctgctacctgggatgcagggctgcggcggcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13763 - DNA, 137226 bp, Human
  misc_feature (1)...(137226): n = A,T,C or G
agccactacagtgcgccccttcagcaagcagcatgcagactctgagcacaagctgcagaccacccacacgtcagaggtgcctggggcacccaccagcatgccctgatccttggggaatttgcattctttgcacgtgctccaggtcgttctgatgcacctggagatttgtgcaaggcaggaatgtgggctgcagcccattccctagctgtaggggtgttctacattcaactcagctggcttaaactcaactcagtgaagaggactcactgtcgtataactgataagtcccaaggggagtggggttaaggggtggcttcattcaggggttcaacaagatcctccattctgtcatccagtgtccacctcatctcaaggccagatcctccttccctaccctgaccctgtcaacttctgagcctacaaagttccttgtcccaggctgggagaggaggcaggagtgggagaggtgaggagagagagttagttcatttgtttgtttgttctaggggctcttttagaaaggcaagaaagcttgcttcccaaaaaaactttttcttttgtcatattgccctttctgaaacgatgggctgggaagggcaacatactgattcatttcagcctgaaccgcatgcctccttacacacacacacacacacacacacacacacacacacaccagggacggaatcaccttccccgagtctgtggctgaatgggtgaggtgaagatgaagtaaaacccagatagccaaccgaaagatagtgaggttgggagacgagcacaagcccacttcacttatgtgaacctgggtcttctcaaactccagctcatcttcaggggccctgactgaacatcacctcctctgggaagcccttccaatacctcccagatagaaaactctatcctttgtgcacccacacaccacctgtactcacccatccatccacccgcccacctactttgttcctgggtgttaggggctgagtactccattgtgaaccagagatttctaccctgatggtgttttcagtctgcacaggagagaaaagttaaatgatcacaccaattgatgccttgcttctctactaagcacaatgaagagaaatgagggagagcgggctggggaatatcagcatgtgtctgggactcaacctggtggggacgggaagagggggtgaaggaagcctttcctgagaaagtgggggaagggcgctctgctgtggctttccctgcatcttggccttcctaccctctgcctcggcttcctccattgctggaaaagcctccacaagcgcggtggaggtccggggcctggatttaaagctcttgagataaatgtgcattgaatttaactaccagtgattagaagagggaaagaaggtggcagggttacaaagaagagcttcacgttaggttaagagggggtgcacggtgtccctgggtgctttggaatgcctcaggtgtggaggctcagggagtggcagtggaggcgaatctgcatgtattccagggtcagaagaaacactagcctctacaattcaagccgcagggtgcagggagacacggggatgtcttagaatggacctttgagggacatccactcacttggccaagggagacctgcgttccagcaggtgttcctgagccagcttgggtaccctctgagttttgtgaatctcttttcactgggaaatgggaataaaaaccacttttcctgaacagaatctgactgaggcggtgcggtgctacactggtgagggggttcccaggagcggttctctggagttttctccagaggctgacgtggggttggcggagaaggagcgctgcacaggcgcgtcgaggcagcgcgccgcctgcccaggtggcagagcggccgagactggcccagagcccgagccggagtggtgtccggcgcccctcccctccgctcgagccctcccacttcctctgaatgagccgcagctgtcagggagcccggcgccccgcgcagtgcaggctgcaggcgccgcgccgaggaggctgccgctctggcttgccgccccccgccgccgctgcacaccggacccagccgccgtgccgcgggccatggacctgcccaggggcctggtggtggcctgggcgctcagcctgtggccaggtaggtgcccaccctctgcctccccttgcctctcggagtccctccctgggccctcggggcttggatccagcggccaggatcgggacgcgacgctcctcccagggtcagacctcagctgctcttggggacgtgggtcccccagggactggccccagtctagcggttcagtcaagtttcgctaaagagggaggtgcgaaggctattgaaagccgggactctttggtgtgtttgggaagagttgaagaggcttgagttgaaaagctcccagatctggtggccctcctgggcgccttaggtgcctccaaggcccatgccggggttcccgcacggctgccaggggcactcgggtgtcccgggagcgccgagggcgcacggccccggctggggaagggaatcagcgccaagagagtgtgccctggctgccctcctgcctggctccggggaagcatctcaaagtttggagagccgggcgcggcggccccggagggctgaagggtgggggtgagggctgcgcagagtgcctccggccaaagacagagcaaagccccggggcgatggccggtaggcgggggctagctctcgtctgcccggccagcagcggcgggacacagtcgcgcagcgcaggacccccgaaacgttacctgacacccggggtagggacccggcattgcctcccaacccgcgctcggaattatgcaattattcaataatctggggaaagccgccgtcgcctagacgcgcgccgccgcctaatgcactccaggtgtcggggcgcggcaggaacctccggcccgaggggcgcgcggctgggagcgggaagccagccctgagctctccgccctagggtaccctggccccggccgtcccacaccgggctccccggctccaccctccacgcggggcggccgccagtgatgctgttctgcggaagacggccaagtgctccggcaagggccagcgcctcggttactggccgggtgtgggcgctcaaccttgcctccccttctgcgtgggctccaggcccgagctggggccagtagtgggggtcagatgcggtggtagtgggagaggtgccctcagggagctcaggtggagacccccatcccgcagccgcttgccctagtccccgggtaccacgcgaagcaagtccaccctcctgtcggcctacagaggagcttctcagagggcccatggttgaaagggcctctggctagtggaatcctagagtcacagtttaaaacaatcattgatacattgagttgtgggggcttggaagggagagcaggggaagaactgccaccaggccaatatgcaactagaagccagctgcgggaggaggccaagcccatttaggtgtgtttagacaggaggggagaatcttctccaggaactgtcctcatatcactaggagatccagccacaagaaaagagacgcactcctgtgtgactccagataggtggctgcatcagaaccttgggaaggagtggctgccttaggggctagggacagcctggacctcaggaagctaagagcaatggctttggaatcagacctggcttccacttctggctctgcaccctgctagctgttcaatcttggactggttatgcgacctttccaacaggtttccttatgtgaagaatggagacacaaattccgtgtcctgtaaagttgtcaggatgcactaaggcactgtaagaaaggcccttaacacagggctgggtgcacagtaggctttaatcaatggttgttaatgttgttgctactcaaggaggagggggcagagaatgacattaaaggacctctgaagacacaggatttgtgactcagagctccgcttatatggcgaaaaccactcctgagttatgtctggtcagttgcattcttgaaatatgggattcattaaacatatcaatcaatgttggaacaatgacatctgcttgcaaggagctgggggtggggccctagcgtgtgtgcagtctgggtcctgcctgtaactgagaataagccaaggccagggaaagctaaacagaggcaccagggagtgaatggcttggggaaaccaagggctgggtgttcaaacaagagaagttcaatttcagccagataagcaaggaaggcttcctggaggaggagatatcatttgaactggccctggaaaagtgtgtagagtgtgcatgggcctgaaagtgggaatgttcatattttggagtattattttctgagactagttaaagaagatgatgaatattttaaaaccactctggtcagtgtggactttgaagactagaagggtctcagggatcattgggttcactcctcaggctccaggacaggactgatgttgatacctcatccatgcatcacatgaattcaatgtgaggattaccaggaagcttgtctactggtgatggcagtttggctgggcagggaacctgtnnnnnnnnnnnnnnnnnnnnnnnnnnnnnnnnnnnnnnnnnnnnnnnnnnnnnnnnnnnnnnnnnnnnnnnnnnnnnnntgcaggttggacagcgtgatggggtagacaaaactaacaggaaagcctaaaaaaaaagtaatcaagtccaaagagagagatccattgaccagagctttacagtcataacctatctgtaggaagggtgatgattcttagaagcataatctttgctgagcacctgttatctgccaggccccataaagacacaaagtgagatcagacacagcgtaagggtggaggccctggagtttcactgcctgggattggcctagcccctgccggttagggctctgtgctcttggcaagttactccatggctctgtgcctcagtttcctcacctacaaagtgggggtaataatagaacttagagttatcacaaagattaatgcttagaaagtgccaggcatgtattaagcactcaaggaggttgtcttctccaacatcatcagcagcagcagtagcactcaagatattgactattcaggatctaaggacacagagatataactttcaaactcaagttctcaagagaagtttagaggaagtacattgaagaatcagaggagacatacatgccagggccccaaatgagtgaagactttcctagtccctcccgcaaagccctggcccaaactcttgatcataataagaactcagggttgttgttttgtttgtttgtttaccatcggggctgtcttgaagtcagtatgctcttgatgtgggtgtattgtggtgtggaaaaggagaaggcccataccatgcaacatggcccttgtgggtaggggtcctacccaacagaaagcaacctgtggaaaagcacagtgctagacaccacaggtgtacaaaggctccagaggtccaagacttgctcccagcctctccttcccagtggagagcagggaagaagggaaagtttgtcactttgccaccccattgcccactttgacagccaagcccctcagctgccattagctgaggagcttctggatctttccatatcacaagcagaccctggagtctcactctttttctgcttactcaccatgaccccatctctaccccacagtggacccccagagaggggatgtctatctccatgctcttcccaccattcccagcccatccacacagggctgtgagccctggaagaactcagacagtatcttacctctcaaccttgccctctctgaacctctttttccaccctcctgtagtggggagctcttccttcttctaacagcagggaccttcccttgcattctccctcccttccaccaacacccccagctcctatcacttaggataaaaatatgttctaagctgagctggctttgctcttgctatgcagaagggaatttggggaattttaaaagcccctgtttcttctccacaatgcctgactttgggtgttattgtctcaccatgggcttccagagcttactttgggggtcaaagtcgaacattgttcttaggatccatcataaccctccccaggcagtgatgggctctggctgactcagggaaggtcagctacaaaatgagccttaaaaatcctctaatatggttcaaaaatggtatctctgctgatcctcatcactgaagtccccttccaggcccacccactccccaccaactgtatgtaggctaccaccaaggattcatagccatttggaacttttccctaagcagctgtgagctccaaagacacccacacatcttcagcatggcagtgctttctataggagctgtggtccaagggcgaccctccacaaccccatcatgcagatcctaactgtgtgaattctttgtcaaatgcccattaagtttgttaccactgacaggagaaggagaggaggagactggtgctggtcatcttgtaaatctaaaataagtgagctgcaaaaaaattccatggagagttttcatactatatacttaagatctgagtcacacgacgtgtgaaatcccacctggaggaaaaagtcagtgaggccaaaccccctccctgctgcctctcacttcctccttcactgaagcactcaccaagcagcagaaataatcggcatgtgcatgggcttaggacctagactgcccggatgcaaatcctttctacctgggtgactctgggataagcccccaggcctcagttttctcaactgtaaaatgggcaaaataacaacttcataggacaacaatcaggttaaatgtccatatgtaattcatttgtgtcaagtgctgagaacagtgtctggcacccaataagccctcagctaacagaagcattattactcttcccatcatttaatatttgattgatgtcaggcactgtgtcaagcactttctcacatctcaataaggccttgctacagttgcacaaagtcactgctacaattctgccatttccaggttacacataggaagttaaaaggctcatccaaggtcatgtcgatagagtaagaggcattgttgggatttgtctgacccccaggccactgcctttttttttttttttttttttttttttgagacagtcttgctctgtcgcccaggctggagtgcagtggcatgatctcggctcattgcaacctccacctcccaggttcaagtgattcttctgcctcagcttcctgagtagctgggattacaggcctgtgctaccatacccagctaatttttgtatttttaggagagatgggttttcgccatgttgaccaggctggtcttgaactcccaacctcaggtgatctgcctgccttggcctcccaaagtgctgggattagaagggccactgcttttaatccatgcaccatactctcttcaggaaatggaacttgagggcacagaaagacagtaagttgtccttgttaaaggaggtgtcttcaacagctgagaaatggaggaattggggaattgttggggaattgagatcagtatgcaaacagctacccccacaggggcaccagcttctaggcccagctagacagtgactcctccaacaagatgctgactcggtagaagtggtcctcctatgatgcttcattatgtgagaacgtctctccctctcccctctccccacccagctcagggcccaccaggctctgccacctgcccccaggtgcccagtgctctggaacactgacttcccaggggctgtcattccagcccattctcagggtcaaggtttggcgatcttctcctgtctgccccgcctgctcccattccgctaatcagaacctgctctgagcttcaggcctaatgagttaactcatgctgaaccgcactaataagtgatgacaacgtgatgtgttctacccaaagggatttccatttcaactggctgtgccttgagcccaaggaataaagggctaatggtgggatgtcaggcaccagggccagccagcagatgaaataggtgaggctggaagacctacctggtgtagtccaaccacttagccccctgccccatcactggtcagataccccctaccccagcccttgttgctgatgggcagcctcgttctataacatagaagaacccagcttgtggcttgggtgatgcagctctaaagcgggcagaggtttttccacgtggcatgtggggtgaattaggcaagttgctatagcaatgcactccgggcttccaaacaggatgacacagagaaggggttcctgcctgcgcagctggggctgacagctttcttcccccagcagcatcactcagctgggccagacaaccagaaatcctgaccctgcggattttcagggcctgtttcttccctgaagatcagaggactgggcctcaggaaggccatggaaaaattgtgaaatgggcaagtgggcgtagctctagatagtctgcaaagagcactcccaatgttccttctgtcagtcaggccgggccaggtgaggccagagttcctgctgagacaggtgtgtccattagatggatggagaaactgaagcccttgccccacctcctccaggcagaagggtacaaagcagtctccattccctctccatctcctggaattgctctctccctggcactatgcatagcccctgcgttcagagattggtggccataataaagtcccatcaatagtttgtagacagggttctctgagtttattcaaaccacatatgacacatgcaggaccagttacttaatctgaaggacccagtgcaaaatgaaaatgtgagaccccttgttttaaaattactaagaatttctagatggccacagcagggcattcaccaagtgcagggcctttctgaacatgaggccctcagccactgtacaggccaagcgctcatcaaaccggccctgctcacatggctctccccgtgggcctgttgtttggcaaggaagacaccatgatcccactttacagatgataaaaaaccaagtggcctgtccatttcaccagcatgtgctgagcgcccactaagccccaggcacctccaagttctgggaattccaaattagataaagcgcggtctctgcctcaagaaacatggagaaggcaccccacagatcccacagactgcagggctcattccaaacactgatgtacacagagggcaggggtgtctgtggagcagttctaaaggcacacgccagagctgtgaggtcatttttaagccatggaattaagatacttctgtctccagttattgcctcaagactgctttgggaacctttttaggggatctctgcatcttcaacattgggctctggagcttccaccttggcagacttgagaagctgggacttaaaattcctggcctttcggcagcccctagtatttgtattggcatagtcctccagggtcagcacttctaaataaggggtgactcctgttcacctgcccacatgggcttcgcatctcattctggcatggaattgtagagggtcagcactaggagggaaggcagggaccagcagatccagtggtcctccatcctgggtgagggtgagaatgatgatgtagaagaaaactgtcatgcagaccccaccccagaacacatcatcactctccacattggggcccagcagggacattttttgaagctgtccaataattctaacgggcatccaaaatggaggatcactggtataatgtaaacccagccccagtcaagcaaaaaaaaccaaacactctccagggaaggaaaatgacttgcctagggtcacacaacaccagtggtaaagccaagatttaaccagttctcctgactctcagtccttctggaactgcccagcctgcagtgccacaggattcacagctgggttgggctggagacacagtttgagagtttgagaagctgagtgcaaggtggactttgcagattggagctggtaggtgtggagtgattcattggtgatactctctatgtcccctacaaggcataagctacttgatccctgtgtggccccaagggggagaccagaaaaaccaaagaggagctatagataaattgatttggctgaggatgccagtcagagctgtccacagacagatgcaccggcactggggcggggggttctctgagtttctcagagatgttggcaggggttagtcgaagtccattagggtcattccaaccctgtgatcttgggccctgctgaaattgaagtgagggttcaggtgaaggaagcacctgactcaggatgggacaccgacaacgccaagcccaggctgggtgaggaaggaatactccatcaacaagaaggaggaggccggcctgcggggtgggacaagcagggggacacctaggacctccctgaggtccccagctcaggtttcattgtccctcttgcccccattcatccagagctttctccacagccgtcaaagtgaggctcaaaaacaaacagagttgtcttactttcctccttaaatccttagtagctctctactaccattgggttgagtccagactctttgacagagccaaccagaccaggtaggaatggccagccctggcctgcattcaggactcacctctaacagagccatacgtttgggcacctgcacacgccaacagcagccccaatgagactgagcttcttagtttcttaaacacactgagctgtccctggccttcactcctgttgttgcctatgtctgattctaccctctgcctcatttctcctggctgcccccaacttattcttcaggtctctgcttgccacttcctcctgaaaacctcccctgacctcctcaatcagtcaggtggggccccacttgtgtgattccaaggtgtcctgtacttcccccgccatacagcattccagttgcctggacatctcccctactgaaaagggagcaccaggagaacagggaccatatctgtaattagccactgtatcccagggtcttgcacagtgccagacatagcaggtgctcagttaaaatgtgttgaatgaaccaaagaactctctgtccaggtaaatggaaagctatttaagggcagggtagatgtcttcaatttctttgcacatgcactccaggaggtaatagcacaatagcctttggaatcaggccctgggagatgctctgggggataaaagatgagaagagataactcctgcctttcaaggagcttgtggtttagcaggagagagatttttggataaataactacaatgcaagggaggaagtaatgactgtgagccagctacagataaaggactctgggatttgagaggtgggagagagattatttgtaaatgcaagaaggactgggtctggcagcaagagggttagggagagagttcacctgggtaaactgcctgaggtttggtgggcaggatgccggagtgtgtgctgtgaggaatggcaagaacagaacagtgggctgaggcctctgagaggaaaccgaaagccaactaaggcacttggatttagcagatgggagccatggaaggtttttgagggagagcagggacatgttctatctgtgcttggaggagcttcctcaggtgggagggggaggctggatacagcagggctacgatggggagcaggtagaatgataagatggctactgcagcgacccagcaaggggacaccagagtgaaatgaggtggtgagatgcaaaaggagtgaacccagggggatagaatttaacaaggcctggtcaccagagaaggaaaggtgtctgggagaccaaggacggtgtcaccaacctgaagagaggcatgagaggatgagaggtttgacaggggaagttgagtcaggcctgaacgttgactttgcagtgctcgtgggcaggtggaggtggccctctggcagtggagaatgttgctagggagcgtgcaagtgagtagtcggacttggagtggtttgactgggagctttcacacagacgtgcctcagtggtgcgggcctgagtgagagggagcgccccacggcacagagcctctatccctccaccccttttcaggcccagaagcagtgattcatgccccaaacttaaagagaattcaaattcggactttaaaagccttttagaacagaagaaaccaaccagagggccaggccagaccacaagccaaacatcagctgtggaatgtgcttgctgctgatggtgaagccagccaggggcaaaggcaccggcaggcttgccagcagcccctaccatcgtcctgaacatgtcccggttgccactgagagtatcaccgctcttaactctcttctaaaaaaattttaataaacacgtaataataattgtacatatttctgggctacataatgtcctctcttttcagcgtagatctgtctgcattctagcccatctgaaacccagcccctcacccccaccccccacccaggctggccccacatcacctttgtgtgaaggctctgatctcccatctatcttccccactctgctcagcccaaaagaggaagaccagaaggcaggttacacgaggggtcaggggacagaaaagctcccatggcctgtggccacagccccctcactggcctccttgcatccgcccttgtaccttgaggctctcccacccagcagccagaggactgccaccagaatgtaggtcacatcatgtcatgtccctgctccgctccaaaccctccagggctccccgcttactctgagtaagaggtcccgtgtgatctggctctcctgcatttctgacttcctcctctgtgccttccccactggctcactccgctccacccctggggcctccgggctgttcttcaaacacatcaggcaccttggactttgcatttgctgtttcttctgcttcgaatgctcttccccaagaacctctctcacttcctgcaggtctttactccaacatgcttctcccattgaggccttgcctcgggctcctacctaaaattcaacccccctgcatgcattcacatgcataaactcccctcctatcccccttccctgctttagtctctccgaggcttttaatattatctcacattattacctgttttatttattcatgttgtatattgcctgctccgatggaatgtaatcctgagagcaaagatttttgtctgttgagtttacttacgcatcccagggcccagaacagtgcttggccagagtacacaagtgataaatagttcaagaatgaatcaatcaatcagttaaaatctccccacccgcctgccaccgttgctagaaatcccatttactaatcaatcactccttttagataagccaatcctcctccttacgaccccaggctactaggtaggtatacattcagtcctgacttttccctgtccacttgttatcaaaggctttctttccagacaagaagaggttggtggccattgagcatcgcttacaaatgggcagagcgaggaaggttgctgaagggaggaagggctctggaagggaggggaaccttagaaaggagtaaattggctcacagcaggcagtccaggtcagcccagctggccccatgctattcatcactatttactatgactctgagatgacacaaggagacaggggaatggccttgtttttacacagtgaaaacctagttatataatgggacttcctaggaaacaagggggcagggagcatgcagcagaaattttaaatgcctcatttcccacaaaagggtagtgattcagacatcatctatatgccacagaatgtggccatgttgtttagcacccaagaaggagctgggagtgtccagaaaagatggtgggagctgaacatagaccccagattacagtccaatccctgggaaccaccaagccagaatctgtcctggtggcttgggagatgacatgaaacccattgcacaggtggagagactgagtctgagcctaacaaagtccatattaggagcctgttccactgacataaggtttcaacactggtctcgacacttaatggcaacagtaatactagctaacatagaagttaagtaacttagccaagatcacccggatgataaagtcacagcctggcatttgaagccaggcagtctgactcgagagactgcaattctgagaggtcaagtgtcttgcccaaggtcatacatctgctgctaaacaagagagccagaatccaaacctctcaagacttccattcgatctcttctaaaataaatgtttggccttcatgtttctaaaagccctttaggggctatgcttccatgctgccatgaacatttcctgagccagaacctcaatcctgattgtaaacccagatgtaacaggagaaagaagttgacaacagggactctatttccaaacaatgggtacactcagtacggggttggcccttcctcatccacaggttcatgaggggtcctgggcctcaggggttctctgagaggcctcagcaccaagggtctgcctgggagggcccttaacagagcctgaacatcccaaacaaatggccaccctaggcttgcatccctccagtgatgggggctcaccactttgcatggtagtccttcattttctagcaaaggcagatggagtcatgagccctcgactcctttaaggacctaaaagtagcagtagacatttgagatcgttttgcaaccatgaaaaattggcctgtactgaaaaccaaaaagacctctgcataaccctcagagaacaaaaacacttccactccccgaagtccgccatccccaccaagcctagacaatggcatctggtggatctatgttaaattccatgcagccagagaacttttcagatgggtgtgggtatatccactggagggcgggccctgcaggcttagaagggaagggcccccacaattcctttttttagtttgcattcaaagagcagggcagactggcccagtagttctctgagtcctcttcaccctacttcctctcgtctgagggaaagccctgccacaaattgcatatcctgagccttgtcttgctcttattttgcccaaacactctctgggctggggctcatcccacatgcacagggctcttgatccacacacccatgacaagcaggagacaagcttaggagttggaaaaccaaaaccaaactgtctgagctctttgagatggtcagtatgccaggaaagggagggactcactgtccaattcagctccagttgaaatggcctgaagccagaatcagtgtgggcagggccgccacgtacagctgtaccggctgtgcgctacatgatttacatcaactacaatgtaaacagcatcctctgcagttgtgtagtaaagtgacctcaggaagggggtgggggggtgggtaaagaaagtgataaaggtgtacataaatgggcttttaaaaatcctacacagggacttaaagcatcgagtcctgtgtgtgcctttcacagataaggcaactgagggccatgtgaagtaagaaactggtccaaagttgcaaagcaatttagaaaccatactggcaatagaaccaggatttctgaagccaaatccagtactctaagttccttccctccctgaggctctatcactttcccctttaaccccttattggaaggttagtgtcttagaagcctgaatacttctattcattttttccgtctcatttaacaaatgtatatagatcacctattgtgagctaggcattgttctagatgctaaggataaagtggggagacagacacactgattctggctcttgggatgggatagaaagaattcctatcattcttatttgtagtatttgccaattaccatgatgtaaatcctcccaccatggtcgttttcaagctgccaacatgacatcactgaatgggaagagtgcacacaatcagctcttgtatgcagactccagcacacattagtcccttcctttgtggaacttaaactccagtgggagaggagacagtgtccaagtaggcaaacagctcttataaccacctgtaattatttttaattgtaaaatacataaagaagatgttgtgagggagaagaacagattctccatagcaatggattctcctttctcagaggccatggcgttaaaactggaggttgagaaggagccagctgagaaaagttcttggggaagaatgttccagacaaaggggactgcaaatgcaaagatctcaaagtgggaaacagcttggtgtatctgaggaacagagaggaagacggtgaagctggaaggtagtaagtgagaaagcaaatccgcagggcctggtgggccctgggaagggtctagaatctattctaaatgcaatggaggaactctcgggggctttaagcagagccaggatctagttcacaccgttgaaagatcactgtggctgctgcaaagagcatagcttgaagctgagcaaaattggaatgagggaccagttggaaaactctagtgcaagtctaaatacaaaatgaagaggatggcttagtccaagtatggcagaagagacagagaggagtgggcacattggagaggaatggagggctagaacttgcaggatttgctgatgggaagtaaaggaaaatcataaggaatgacttccaagcttctggcttgagccatctggtgggtggtaatgccatttcctgcaatggggacaaaaccatttaagaagcgaaaacctgggttccttttccagcatgtgaaatgtgagatgttatgagacatccaagtgaaatgtcctataagcagccaggaaattgattgtggggctcaaagggcaggcctgggctgggtggggtgaaatatggggtcctcaggagctcgggccatgttgaggccaaggtcccacacactcgctcagacagagcaagactctgtctcaaaaaaaaagaggaggtccattttgatcacttttcctacacagagaaaatgataaatgatgtaagatggaaaaatacactagttttcataaaaaactgtgacccttgtttttgttttttacggagatggggtctccatatgtcacccggtttggagtgcagtggtgcgatcttggcttactgcaacctctgcctcccgggttcaagcaattctcctacctcagcctcccgagtaggtgggattacagatgcctgccactaggcccagctaattttttgtattttagtagagacggggtttcaccatgttgcccaggctggtctcgaactcctgagctcaggcaatccgcctcccaaagtgctaggattataggtgtgagccaccgcacccagccatgacccttgttcttgaagaagatgatccatatattctctgaaggcatgagatggctgtccagggctcggaggaaaaataatgttaattacagtcagtctcaatgtgctgtttgctgctttaaagttttaggcctgttttccttgagcttgacatctgcttaaccagcccattggcaaactcctgagttctcagaaaaagatacaaaggactgccgaggctctcaccagcccttgctcgttctctgtctccctgtctccggatgcttctgtgagtctctgtttcagcctacatgccacctgccctagccgacatttgttctcctctgcaaccccagggaagggaccctcactcttccacaggctgcccagccccagattgattgtttttttctgatttggagaattcttcctcatatagagctgcaaatgcttttgatggctgaggggaggctgttgtgataagtcacttgttaacaagcattagtttatctaccatacaacaggacattgaggggatgggacagataacaggcaaggcttttgatgagatgacaagactgaagtagaagagagggaggcaggccagggtcagggtgctccaaggttgcaggcacccagtgtgtgtgatgaggatgtgccagggcctggctgaaaggggaggtggaattgacagaggacagtgggtgaatggcaggctgctctgcatccctctacttaggcccttcttggatgaatatcaagttcatctgataagctcacccctggtggcaggcagcacctgcttcactctttctgagcatccacatcaaggccagctgaatcttcaagactctcagctgacgcagaccctggaactcacctagtgatggctcccagcccctcatgacacacatgagctctctgcttcctggtgtgttctttttcacatgcttaacattcgagagggcatgtgagcacatccctatctagggctcctcctcccggggaaggtggacactgtggctgcagctccatgacacaggccttgcctcaaaccactggcgtgctcagagccactccctgccggaagcagcagtgggtgtggactggggacgtgctgtttcccaaatgagataatctcccccagagattctgctaagaaatgaggggtgtgctcataccatggggacagatgatgcttttccacagaagccccccgtgctgctgaaatccttctcctttcccttctgtggccagtctctctatccagccttcaaatggacagcaccctccatcccttgaacccctcccctttctctagactccatcagaagacacaatttcttcgtcccattattcctccccttcttctccagtgagctgcgttctgacctgcacaaaggctggggaagccaagagacacatccagagatgaggaaggccagtggctggcggtgatattatagttggaggaataaggaataggagagactccatagcgcttccttcagaagaaaggcagggggataaggccaagttagcagagagacaagcagtccacccaggggtagtcatttggtagagaagtaagatgctgacgagttgatcagagaagctagaaaacaggggggtcttttgcaagagtaaagaggagggatgcatccctctcctggaaagacccaagtttggttaagttttctctagagcacaggagggtatcagggtggtaagaactggcttggcatcaccaggccagccctagtggcagcctgcaactgtagcagcagggcaggcccggctgggcgctaagccgtggggagaggggttacagctcactttcatgggggggcttgaggctgagggacacttgtttggacccaagtgctagaggggaaggagggaatgacctcagtcccaaaagccaatctgatagatacttgcggaggccctggccgttggcctgcccacgggagtgcccccggtgccagtctgcctgctcctcccctctgaggggagatggatttggaaataagtccagaggaggcggaacacacagactcagaacctcagtactggaaatgtttgtagaccacctggccctacttcctcattttctagaagaggagacagaggtccagagagggaaggtatttgtttcaggtcacatagccagtcgagaaaccaggtcttctgatgtccaaactagttctcaccacagtggtctcagcactcaggaggggctgttatactcccatgtcccctttgctgagtcctggaaccagctgtcctaaagtcagaagttcatcctgtggcctttgaccttagcattctgccctccagccccgtccccccagggaccattcctagaagacctcagggagactgagaagcctctgtcattccaaggccacagtcatgcctcaaaggagctggtgctccctgcctggtgtccgcaagttttgaattaagagggggtctgatggcagccatgttgccctcctgcccacttgccctaagtctcctcatcgaggtttcagcagcatagtccagctctggggctaggctgggctttctgtggaaaggtgaccacatcgcctggacccccaccaaggcctctgtctttctgacatctgggtgtgtccagaagccccagccagggcaggagggcccagccaagtctccatggtacaggcaaagggagagagagagctgggccctagacaatgccaaacgtttgatggtgattttctttcgttctttccttggcttgggaatgcaaaatattatcgtttttgcctggagatttcccttcctaaatgcgcatggctccggccaacattaagatgagtttgcattcctccacactgcctggtttccaattctaaattgtttgctgagactcaagacagatgctcgagtgccgacaactggaagtcagctggcgtctgcccaagggaacctcactgacatgtgccgtggtgggtcttcgatgttacaaagcaggagcctctcattttacagatggggaagctgaggcccagagaggcatcggggctctcaatggacatccagccaagttaatgacaaagctgagattagaactcagatcaccccaccctagtccaaacttctcctggcttcacttcaggctctgttgacttataaacatgtctgttgcctgcccagtggggctgtaagctctgaacaccgtaagtcgtgtctcagccagcttggtgtcctcacttcctaccatggaacctggagctccatagaccccaaatagaggtttattgaactgaagggccgtagaggggactaacacagaaggagtggtggtgaacatagataagtatgaagagaggctggtgaccttggacacatttctaccccgctctgggccttagtcttctcacttatagcaacaagctttttaaactcgacagagcagttctcaaactgtgttccaggaaaccctaaggtttcagtgaggcatcttatgtctgctactgagggtgggaaattcctccctaccccctagtcctaaccccaacatccacttcttgtgtctacttttcatgtatatattttgttcaaaaaatgtgagattcgctgtagaaaaacaaagtttggaggctaatagattatttgatctggaaaattcctgcttgttcttaaagataaagtcctggctgggtgccagtggctcacgcctgtaatcccagcactttgggaggccgaggcaggtagatcacttgaggtcaggagttcaagactagcctggccaatatgatgaaaccctgtctctactaaaagtacaaaaattagccaggcatggtagcacatgcctgtagtcccagctacttggaagactgaggcaggagaattgcttgaacctgggaggcggaggttgcagtgagctgagattacaccattgtactccagtctgggtgacagaacgagactctgtctcaaaaaaaaaaaaaaaaaaaaaaaagcgaataagttccccctccctaataacatatttgctacacaccacctttgacccaatggtagcttgtctaacggggagttcgtgtcatgccccctagcaactggaaagagagaaaatgaggtgaaggaggcctcatgctctggaggctccgttctgcacagagctgctccagagcccagaatccatgttgggtgcctggctggctgtgggtctgcgtctgtcattccctgagtgattcaggacaacccagccatcaggcccggtgtatggctgaggcaggaggaggccatgatttgctcgttaggccacacttctccctgacagggtaggcccgggcccagctctgcctaatgttgggtcttcctgatgagatcttgagtaggaaatgattggggtactaccccagcaaccacgagtccccagagatccccagctcctcttctccttgtctttgtccaatcactctgtgaaattgttcctcctccctgatggtccatcacttaagagctaagctgcatcaattatcaattgctataataatgtcctgtaaccaataatccccccaaatctcagtggcacacaataataattgtttagttcacatatctggggtcagctgagggtgggggagtgaactggtccaagctaagctcaactgagtggctctgctgggctcactgggcttgcttgtgagtttgggggtgctgacctcagctaggttgggctggggcaactcagctggggcagctctgctccgaatatctctcactcttttcctggggtcagtggactagccgtctcatgttgctgccagaagtgccagcaagcagaaatagacaaggcatcctaaggcccaagctgggaatgggcacacattatttctgctcagatggcctagcccaaagttaaggttgggggaaatatactctcctcttttagaggcaggaattacaaagtcccatggtaaagggtgtgcatatagagaagtgaagaattgagactgatgatgcaagctggagcaggaccacttgtttttgtatcccagctctgccacccactagatgtgtgacttgggacaagttacgggatcgctgtgcctccagttcctctcttctgccatagagcggcttcctctggccatcggctcccatctgctgcttcatccagacttttaagcccttgggactctggctctgtccttctggcatacctggtctcctgtgctctgcctgttgtgatcagggagccaccaatcagttctgtagtgagcagagggcatgggcccaggatgggtgagtcttgaagaaggagtgtgtgggagggggataagcctgggtgaggcctctccagggttgtcgttgttgataatttgttgtggttgtcagagctgaaatttctactttaactcaacacatttttctgagcaccaggccttatggtgggataaagggataagtagaatccagttctcctcacattgctcagtcttagatggggagaagattgtgtggaatcagctctgctcagtgtacatgtctaatcctattacttaaatattcactccacaccctccatgtggcaatgcaggcagagttgctgctcatgggatgctcacagtccactgtgagttccctgttggccacgcagctgcccatgggggcggaaccgcacactccccaccagcctgggggcttcccagggtgagggcagagttactaggtctcctatgagagcagcagttccccaagggcagtatccctgcttctccccagagtcagagggctccccaagctcttctgtaatgaaggccttcttccctcaactagctagaagcttctctgatgtagggaccacgtcccctcacccctcccttgctctatcgcactagtgcctactacaggagcctagactagggtccttgggcctccagcaatgctcccaaatctagcattgccttcctagatgcctctttgaaatgatggccttgggcagaagggaaggctggctggcagcagagcaagaaccctcacatgttccctgctcgccagggcaaaaggggcagcaatgcagaggatacgaaacagccagccatctgaagctcattacttcttcacttttgaatgggttgttttttttcccccatagcagcaagaggttcactttgccatatctttttgcctaggccagcttatggtcttttctccctcctcctctccctctctgtgatttgcttttagacgtgaagattcttggggcccaagtaaaactgggaagagtgagataataccagagattcttagtgataaaccccacctccctcaccccatcccagcgccctccctccaaggaaaatgaaagctcttgcttacacaggtgcatctgcaacatggagcagagcccaaagaaccagtggaggcctggggcagggctgcggagaggcttctgggaggtgttcacgcttaggttccacagatcggcttcctctggccgtcagctccaacctggtgcttcatccagactttcaagacccttgggactctggccccatccttctggtataccaggtctgctgtgttccacttgttgtgatcaaggagtcaacagtcagttctgtattgagcaggatcttagagcatgtgactgggatagatgagtctgaagaagaagaggtgtaggaggggacaagcctggctgaggccactccagggaggattcaagtgactgacgacggtcggtggtgtctgaaagggcagaggaagacttgatggtgatgggctggatggcacgggacccgtgaggcctcaaagtcatcctggccgcttcctagctgtatgaccttggccagttgctgactttctttgtgcctcagttttctcatctttaaaatgagaatgataatatacttactgcaaaacatggttataagcattaaatacattcagaatagtgcttggtacatagtaagagctttgttcatgtacacaattatttttattattgttatctaagtggtaggggactatcagtacctacctaatcaggtagtactgataggtagagtatcagtactacctatcagtacctacctaatcaggtagtactgataggtagagtatcagtactacctatcagtacctacctaatcaggtagtactgataggtagagtatcagtactacctatcagtacctactatcagtacctaagtcagggagctaggaggtaaactaaggcaggaggagccaacaggtactgattctgagaacagattctcagaaggtgagaaatccggtaggcaagtctatctgcaacttttgggcactgggcaaagataaaagccattcatggatgtggccttgaatagcatataacctaagagcaaggcagaagggaaggcagctgttatgcaaggcagggagtgacagagctatgagcagcccacgctgaaggccccagaggaaggaccactttgcagcagaggtgtcatcagaggtgggacttgaaagcgtaggacgaagggaagaaaggccttccaggcatggtgaacagcatgggcaaaagcgctgaggccagctcaaggaaccagggcatcttgatccagttcaattcaaccaagatgtattgagtacctttcctgcaccaggcagtgccagaggtttgctactccctttagtcttgccaaccacttttccagatagatatttttattcctgttttatagatgagtaaactgaaaaccagaaagggagagtaactccccagggtcacccacttatgaatgagtgctagagccaggcttctaaccaagtcctcccagaactgaaagcccatcctctcttcatgtctggcctgactctcaaggagcctggcaggatggcaggaggagccaggcaattcctgacacctccacccaggtaggctgttctcttcttttccccggctccacatttgcaccaggaaagcctgcctagcacctttgggccacttcacctattcctccacatggcccttcaaggccagaatcacacctccagaagcttcctgagcacccagcccacagggtccttctctctaacaaccatggcatctgcttgcagggcacacttgcactccacgtgcttcccgtgagccactctcccaagctgataggacccatctctcttcttgtcttgccctccactcatcccctgtgctaagtgctagacccaacaatgagtagcaaacagaccccatcctgccctcatggagcctgcgtcctgatgcgggagacaggagtaatcagacagtcacatccatggagtagaattactaactgtgagaagaaaaggagaggtcaccagtcacccattagtaaggcacaggggtgatgagatcattaagcaagatctgatgtaatcaaggtatcagggaagcttcccaggggaggccaggggaggatttgcatttatgctggggtttaaaggtgatgggaagctcatcagagaggctcaggcagaggaaatggcacatgcagaggccctgaggcagaggaagcaacgtgcatctggaggagcagaaaagggacctagaggaaaactcacacaagacaaggctaggcagaggctgaggggccatggggccacatggaacattttggactttctcccaagatccctgggaagctatatgggaggaggaggagaggcagggaaatggaacagcacagcagacgctccttaagctggagcgaactctccccgctgagctgttgaatggccttagccatacactggccagcagccctcagcacctgggaccaggactgccctacctggccttcaccttaacctgtagggagtggagtggctttgagaactgtgagccccaagtgatgctctggcttgatgctgtggtttccgtcccttcttgagactgactgatgctttttttgaaagacacacaagattctgagaaagggagcaacagttgacgtaactttggccacggcccacaggagagcagcccaggaattgtggtttttttccccctctgtcatcaatatcaagggcagaacagtggcaagctgcccaaccaggctcccaacatctctgcaatcagcctgttcattcccatcaaaacaactttattttatcatgttggtatttggaagtcatcaatctctgagaaaagtacttctcccaaacatgaaacccatctaccataaaaggaggcggccagagatcttgtcaggagccgaggtcagagagatggacttgactgacatcatttttaggaaatccactctctggttggttcggtttggtcagaagcaaacgccaactggtctctggagacgaaaccagcactttgtaatttaatgcctcttccttgtggccagatttcactaatcctgtccccagtgaggttggggctctgtctaggactagtcccaccttcccctgggcccccaccaccccctcactgggcacctcactttggctgcaggatggaatgcaggcagctggctttccctcccattgcgtctccctgctggaacccaaaggcagaggcaatgggacctagggcaggaagcggagaccctcttctctaaaaggaatcttcccttctccccagtgagtccttcttatgaaaaactgatctagggagggaagagaacacatcaccccggcaccccaagctatgtggtcatgtgtccagctaatgtgtccccagctgagtgatttggggaaactatttaatctcccagaggtgtgattgtatctgtctcatggggttggtgtgagatttaattgattaatgtaaaactcacggttagatgcctaggatcgtgcctggaatatatcagcgctcatcattatttcctttctccttttcctcactgaggggagagactgtcccagacaaatgaagatcctggtctctaactgttcagtcaaccagtatctacgagctggacctccattcaaggcactgaggatagagcagtgaggacacagcagagtcccgtggcacttagagactataggaatattctaaatatcagccatgtgacaataaacaaatgtcatatgtttgtgataaacgctatgaggaaaaatggagcacaggaagggatccctggggtgtttggtggcctggtgatggacaagatggcattgaaacagagattctaagactggagggagagagccttgcaggtatgggaagaagagcattccaggaagagggaacagccacggcaaagatgctgagcagagaacgagtctgaagttggaaggacagcgagagggtcagtatggctggaggagaggaggaggagagggtagaaattaatggggcagagtgaatgcggtgagattatggagggccttgcaatgaggagtttggccttggctttgatggggtggaaaactcattgatacaggggatggagctgaggggtgacgggatctcacaggtcttggaagggtccctctggccatggttgcacaacaagcactgatagagggcttggggtggacaaggccccaaagacacaatctgtggcttcaccttcactggccctcacccctctgcaggcctggaagtggcaggtggtctggatttcctgacagctagaacatactttccttttcctgctgggtcagatgcaggaaggggaagtcctagtctctagtgggcaccaggaagccaggcaaagtgccgtccacaatcagggtgtatgtggcctgtgcatgtgtgtgtctgtgtgtgtgtgcacgtgcatgcatacatgtatatctgtgtgcgtgtgcatgtgtgcatacgtgtgtgttcgttcctgggacagatttggagagagggtaagtttctctctgccactgcaacactccttcagtaacccccctatgcccaccaagctccgagctctgcacaggtgacactggtgtctctctctctctcctctgtgacattgcacatgtgacactgctgtctctctctctctcctctgtgacatgccttcactggccagggacctgtgttcttcaggaccctgtgctcaccggaacagagtcctcttctccaaggctgcccgctgctagccaggctgataagttcatttatggcatgggatttgtaaacaaagcactaacgggttcatatactcttcttccccaacccccactccagggccatgacactaaattcatgtgggagattaggaatcgtgaagatagagtgggcagctacatagtcacgtgctgccactgtcctcccctgtacccatagcaggtagtgctatcagtcacactcctcttgcctactgagcccagacttgacctcaaaatctttcctaactcagtgctccagaagtgctaatgatccattggcatgttcaataagataacacgtatctaatatccctacttgaaggtccctcagttttactctggggactttaattctatgactctaatgatggaaattttggctactgttatgtgtttgctgagcaaaaaaaaaaaaaaaaaaaagggagacagtgggaaaaataacttgtttctgtatgataggccttattaaagtaggtgccccagggcttcacagttgaatactgagcagggggtcagtgcccaggggaaggagagtggcgcactcgtgtgcgggtccaagcctcaaattcagaggccctacccagcgggcttgggtccttgggaaggtcagctaacctctctgaccctctgttttccctttgctgcttgtcatggagatcgaatgataacatacatgtgaatggtctttgaaactaaataagtatcccacatgtgaaaggggcaacaatgataaaaggtctattctgccaattcatttttacttatccaaaagttttggctcgtggcaagatcccacccctcaaatttaatgcgtcccaagtgtggatgggtatcaaggccagatgtatcctgaaaatgccttctggtggggaggcgtcacagagtaggtgtctgaggtcctagttctgatgctaccactgacctgctgtgcagccctggacaatcctcttaacctctctggtactgcaccaagtgcatctgccaagtgaggacgatgctcactcattctccaaggtcctgtgacagcaaatgatggcagatgtgaggaggcccagaaaccaaaagtactatacagatgtgaggtgctattttgttgtttcttgtgatttgcccaaaggggtaaagcatttggcttaacacaggcttcctgccaggaagaattagttaactgacaggtgacttaaacaaacaggggcgacccttggggccagggcgaaagggtcatagggctttttctgtgctcgcttcagctgccccggccaagcagaagcccctgccgaagccagacggagctttgtcaactggttcagagggaagtggggagcccagtgccggcgcccatggccactgggacctcaggcttgcagaggaaggtggatgtcagttgcctgactcttcagcagataggggaggcggtaatgaagggaggaggagggaagagaagggagagcaggagagaggaggaaaatgagagggaaaaaaaagaggagaccaacaaaagctggaagcagcagatgggaggaaggagtgatggagaaggagggcaactgtctctccctggtagaatcgggagttccctgggggaaggacaggtcttccattcagactgggtctctttgagagcaggttttatgtcccccctatccatgtacagggtctgtattaggcctttctttgtggggctaatacaggaatacctgagactgagtaatttataaagaaaacaggaacccggccaacatggtgaaaccctgtctctactaaaaaataaataaaaatcgaccaggcacagtggtatgtccctgcagtctcagctccttgggaggctgaggcacaagaatctcttgaacctgaaaggaggaagttgcagtgagccaagactgagccactgtgctccagcctgggccacagagtgagactctgtgtcagggaaacagaaaaaaaaaagaaagaaagaaagaaaagaggtttattttggctcacagttctgcagactgtacagaaatcatggtgccagcatctgcttctaatgagggcctcagggagcttccaatcatggtggaaggtgaaggcgagccagcgtgtcacatgcaagagtgggagcaagaaagagaggggggaggccccacactcttaaacacccaggcctgtgagaacttagagtgagaactcactcatcaccaaggggatggcaccaagcaattcatgagggatccgcccccatgacccaaacatctcccaccatgccctacctccaacattgggaatcctgtttcaacgtcagatttggaagggatacacattgaaaccatatcaggctcccccaggacgggggtggaatctctcccatcagactgtgggccctaccaggcaaggactacatcagccacctcatacagggactccccaagatggggaaacatgcttgtcccacagccaagaccctccaaggttcatgacctgccaatgggtcctgacacagcccagggcctacacctctgcctgtctgactcccctgcttctcctctcctctccccctgcctcagggttcacggacaccttcaacatggacaccaggaagccccgggtcatccctggctccaggaccgccttctttggctacacagtgcagcagcacgacatcagtggcaataagtggtgagtgagagcggccgcccacacccagccctgtaccattccacacccagccccctccatcctgcccctgtgccctgtggctgccccactggccctcacatggagactgacgtttccagtgacttgactctgtcccagcaggtcagagactgcacaggctctgctcctgactatgaaagcttgaatgttcaatttctcaagccctgtatcttctcatctgtgaaatgggaatgaacgagccctccttctctgggttatgtgacagtgggggtagcaggcacctggggaccaattgttagcccctggtcatgtctacctggagagctgctgggggtgtctctgagagggtgggtgtgagtgtgctctctagctgaaacccaggcagcgatggggcaaaggggagggagagccagaccaagtggagggagagggctggaaagatccccaagagccctccagagcaggggcaatcaggaggaagaaaggattcacctccaattttaaaaataactttatttcaacatattttatcatctaactcactcatttcaagtatccaagtcaatgatttttttttaaatgtaccatgttgtgaggccatcaccacaaatcagttttagaatatttttatcaccccagtaagatctctcgccacatttacggttagtcatcctcctccccacttggtttttagctggcagaaggctatccttcctgggatggaaagggccaggactctgcatggcccttttagaagcccttgcatagtcaagagaccacatgaacactcgtgatcaatgttctacgctgccctcttcccactctggcccctgtctaccctccccaacctctcccccttcttgtgctccccccacccccttacttgtgttcaatgctccagccacatggcacaatcgcagcattgctgtttccccagatcttcttcaaacatgctcttcccttctgtgacaccctctcctgacttctctgctcaccccaccaccatctggctaattctctcgtattctttttgatttttgtaaagaaatatcttacttattatctttctaccgaggtataacatacatacaacaaagtataggcattttgaatgtgcaacttaacgaacttccatgatatacacctatgtaatcacctcccagagatatatccaccatttccagcttcccagaaggtggtgcccactcacccccgccccagccagtgcccctccagggacccactatgctgactcctatctccataggttagttttgaacttcatagaggagaaatcatgcaataggtgctcatttgtatctgacctctcactcaacattacgcctgtgaggtttaacctgttgttaagtgaaccatacttcatgcttccattgatgagcagtattccattgtattaatctacaacaatgtatttcagtttagtgtttattttactgtatttggattgtttccattttgggctatttcaaataacgctgctattggcattcatgtacgtgtcttttgatgggcatatgtattcacttgtattgggtttttactccgggatagaattgctgagttaaagggtagttatgtttaactttttagtaggacctgccaggcatttgtttcaaagtggtttaccaatttaaactctctctagtaaaacaagagccttctggttgtgacatgtcttcactaattcatgacattatcagtcattttaattttagtcattctagttgtgtgtggtggtatctcatggtgggtttaatttgcatttctctatttactaatgatgttgaccaacttttcataaatttaatggccatttttgtatccccttttgtgaaatgctgtatcaggtcttttgcccattgtaaagattgtgttgtgtgtctttttcttactgattaaaggccttttatatatataaaatatataaataaatatatataatattataatatttattatataatatataatattataatatttattatataatatataatattataatatttattatataatatataatattataatatttattatataatatataatataatatttattatataatatataatatatttattatataatatataatattataatatttattatataatatatattatatattataatatataatatataaaatatatatattctgtatatattatatatattatatatatatattctgtatacacttcctttgtgacatagaagcattgcaaatatctgttcccagtctatggcttgccttttcattctctaaatggtatcttttgataaacagaagtccttaactttaataaagtctaatttatcaatattttttatggttagtgctttttgtgtgtcccatttaagaaatcttcacctctccccatatcatgaagatattcttctctgttttcttctagaagtttgatgtttttgctttgtcatttaggtcaatgattcatcccaagttaatgtttgtgtaaggtgtgagataaaggtcagaggtttttgttttctttttctcatatggatggccagttgatctggcacaatttgttaaagactattttccccattgaattctagtgacatctttgttgaaaatcgggtgaccatagatatatgggcctatttcttgactctattttattccatttgtctatttatctaaacttgagcaaacaaaaagctgctttggttactgcagctttaaaataagtctcgaagtcaggtagtgtgaattctctatatttggttttctcttcttttttatttcaacttttattttagattcagggagtacatgtgcagatttgttacatgggtatattgcattgtgtggaggtttggggtacaagtgatcccgtcacccaggtagtgagctacccaataggtagtttttcaactcttgttctctccttccctccctccccactctagtggtcctcaatgtctatagttcccatctttatgtccatgtgtacccagtgtttcgctcccacttataatagtgagaacacaccatattaggttttatgtttctgtgttaatttgcttagaataatggcatccatgttgctgcaaaggacatgatttctttctttttcatggttgtgtagtattccgtggtgtatatgaaccacagtttctttatccaatccaccattaatgggcacctaggttgattccatgtctttgctattgtgaatagtgctgtgataaaacatacaagtgcatgtgtttgtggtaaatgatttatcttcctttgggtaatatacccagtaattgggattgctgggtcaaatagtaattctatttttagttctctgagaaatctccaaactctgaactaattaccattcccaccaacagtgtataagcatttccttttctctacagccttgccaacaactgttactctggagtattttaataatagccattctgactggtgtgagatgatagctcactgtggctttcatttgcatttctctgatggttagtgatgtggagtatttttccatgtttcttggcggcttgtatgtcttcttttaagaagtgtctgttcatgtcctttgccctctttttaatggggttgtttttctttggcaagattgttttagctatgatagatcctttatgtttccatataaatttttaagtcagcttgtcaattttcctccaacaaaatttgctgagatttttattggagttatactgaatttatacgttcaattttatggataaatttaggggaaaatgaaatcttaataacattttttctaatccactaacatgtatatcctaccatttattcagtttttaaaaatttctctcaataatgctttgaaatattcagtgtaagttttacatctcttattgcattaataaaatataaaatatatttatattttatactattaaaaataaactattcttatttcattttatactattcatttcattttatactatgaatatagttatatttacagttaatataaattatatcataataaatatatatttaatgtaaatatattttcatatttgcatttatgctattagaaataaaatatttttatttcattttatactattcattttataccataaaaatatttatacttatatttatattatatttaatataaatcatattataataaatatgttaaagtctcccattattaatgtgtgggagtctaagtctctttgtaggtcactcaggacttcctttatgaatctgggtgctcctgtattgggtgcatatatatttaggatagttagctcttcttgttgaattgatccctttaccatcatgtaatggccttctttgtctcttttgatctttgttggtttaaagtctgttttatcagagactaggattgcaacccctgcctttttctgttttccatttgcttggtagatcttcctccatccttttattttgagcctatgtgtgtctctgcacgtgagatgggtttcctgaatacagcacactgatgggtcttgactctatccaatttgccagtctgtgtcttttaattggagcatttagtccatttacatttaaagttaatattgttatgtgtgaatttgatcctgtcattatgatgttagctggttcttttgctggttagttgatgcagtttcttcctagtcttgatggtctttacattttggcatgattttgcagcggctggtaccggttgttcctttccatgtttagtgcttccttcaggagctcttttagggcaggcctggtggtgacaaaatctctcagcatttgcttgtctgtaaagtattttatttctccttcgcttatgaagcttagtttggctggatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgatctgtctaatattgacagtggggtgttaaagtctcccattattattgtgtgggagtctaagtctctttgtaggtctctatggacttgctttatgaatctgggtgctcctgtattgggtgcatatatgtttaggatagttagctcttcttgttgaattgacccctttaccattatgtaatggccttctttgtctcttttgatctttgttggtttaaagtctgttttatcagagaggaggatttcaacccctgctttttgttgttgttgttgttttttgctttccgtttacttggtagatcttcctccatccctttattttgagcctatgtgcgtttttgcatgggaaatgggtctcctgaatagagcacactgatgggtcttgactctttatccaatttgccagtttgtgtcttttaattggggaatttagcccatttacatttaaagttaaaactgttatgtgtgaatttgatcctgtcattatgatgttagctggttatgatgttagctggttaattgatgcagtttcttcatagcatcaatagtctttacaatttggcatgtttttgcagtggctggtaccagttgtttctttccacatttagtgcttccttcaggagctcttgtaaggcaggcctggtggtgacaaaatctctcagcgtttgcttgtctgtaaaggattttgtttctccttcacttatgaagcttagtttggctggacatgaaattctgggttgaaaattcttttctttaagaatgttgaatattggcccccacactcttctggcttttaaggtttctgccgagagatccgctgttagtctgatgggcttccctttgtgggtaactcgacctttctctctggctgccttaacattttttccttcatttcaaccttagtgaatctgacaactatgtgtcttggggttgcccttctcaaggagtatctttgtggtgttctctgtatttcctgaatttgaatgttggcctgccttgctagattggggaagttctcctggataatatcctgaaaactgttttccaacttggttccattatccccattactttcaggtacaccagtcaaacgtagatttggtcttttcacatagtcccatatttcttggaggctttgtttgtctttactctttcttctctaaccttgtcttctcactttatttcatgaatttaatcttcaatcactgatacacttgatcgaatcagctactgaagctgcacatgcatcactaagttcttgtgccatggttttcagctccatcaggtcatttaaagtcttctctacactgtttattctagttagcctctcatctaaccttttttcaaggcttttagcttccttatgatgggtttgaacatgctcctttagctcggagaagcttgttattgccaaccttctgaagcctacttctgtcaactcgtcaaagtcattctccatccagctttgttccattgctggtgaggatctgcgatcctttggaggacaaaagtgctctgacttttagagttttcagcttttctgctctggtttctccccatctttgaggttttatctacctttggtctttgatgttggtgacctacagatggggttttggtgtagatgtcctttttgttgatgtggatgctattcctttctgtttgttagttttccttctaatagttgggtccctcagctgcaggtctgttggagtttgcaggaggtccactccagaccctgtttgcctggatatcaccagtggaggctcagttggatatgcagaaatcacccgtcttctgcatcgatcatgctgggagctgcagactggagctgttcctattcggccatcttggaatggatctcaacttcttaaagataatggattattcagatttgctactccttcttgtgttaattttagtaacttgggtttttcaagtaatttgtacatttcattcaaattttatccacaaatattcatattagcctcctattatcttttcaatgtctataagatctatatatcctctttttcatttctctttttggtaatttgtgttgtccctcttattttttatcagtcttgctatgggcatattaattttattaatgtgttctaggatcaactatgggctttactgattttctctattgaatccctgatttctcattcattggtttctattctcattttaattatttcttccatttttttatttaatttatctttttctagcttcttacttaaattgttgatttcctgaccctttttcttttctaaaatatacatataaggctatatatttcctctaacattgctttagctgcatcctacaaattttgatgttttcattatcattcaggttaaaataatttctaattctcatcatgatttcttccttggaccatgggttatttagaaatgtgttttttaatttccaaatatttggagattttctagttgtctttctattatatttctaattcaattccatggtggtcaagagagctgctgtataatttaaaatcttagttgtttgttggcaatattttaaattactgattcaatctcactgcttgttattggtctgttcaaaattactgtttcttactgattcaagctaggatggttgtatgcttccaagaatttatgtgtttcctctagattttctagtttgtttgcatagatgttcatagtagtcttgaatggtctcttataccactgtggtgtcagtcgtaatatctccattttcatttctaacacagctttacaatctacttgcaattagtattttaccactttctaagtaacacaataactttacgacagtttgattccagtcccctgtcctgtcctttgtgttatttttgtcatatattttacctttgcacatgttataaattccacaagacattattgttattgttgctttaagttgttaatatttatgtctacttatccacatagctaccctttctggtgttcttcgtctcttttatataattctgtgctctcatttgagataattttcttacagccaaagaactctacttagtatttcttgtggtataagtctgctaacaagagttctttcagccttgggagttgggttttctgtttgtttttgttcgtttgtctgaaaagatcttaatctcaccttaatttttgaagtatttcttatctagtttttcttttagcactttaaaatgtcattccattgtctattggctttacagtttctgttgagatgtcaaccatcagttttatcattcttttgaatgtaatatgtcattttcttgtggttgctttcttatttgcctttaatgtcagcagtttgactatgatgtatctaaatgtagttttgttgtatttgttctgcatagggtttccaaagcttcttgaatctgcattgatacttttaattagatttggaaaattctctaccttcatttttaaaaatatagcttttgtcccatttcttctctccttttctttctaaacttgaattgtgtgtatgttaggccttctcgccatatttctcatatttctgttcagttttttattccatttttctcttgctgtgctacaatttagatatcctctattcatctgtcttcagggtcactaatccagctttctgctgtatccattgtgcagctaaacccattcgatatactctttattacagatattttattttgctcctgaatgtccactggattctttttttatagattctaattctgtcacaataatctgtcttgatcccatttgtccatcttttgttctattttctttaacacattaattataattattttgaagtcctggctggttaactccaatatctggatcatctctggtctgcttctggtgactattttatctcatggttatccattttttcctgattatttactcattttgtaaatattgtgaatattgtggatgttacagttttgcccttattcctaggatgtggtctttactcttagagcatagattttctggggtctcaaatgaaatcccagagtattcattaaggtctctcctttctgactgggtatgaaccccaacaccttcctcccagaataggaggcaacctctaaaatctctgctcccattggctgttttctgatatattttccagtgtatcatactatgcatacacagcttaggagtcagccaagaacctgagggaaactttcaacagagcttttgagactcttttcctgttgttctctcctttctggtatgctgcccttcccaaatcctagtcatctttgcagccccaactccaatccctatttcctccatccagcaagacttctactctctgcatccatttccctgtgcttcagcaaagaaaatgccctcagaggaaaagctggggtgaacagggtttcagcttctgtatttcccttcttacaagtattgagctctgccttgattgctgtccagtgcctgaaaatagttgttttagatattttgtgctgtttacatagttgtttatggctagaattgaaagccctctttcatattctttttatcaacttagatatcacttcctctgagaaactttctctgactatcccttcccatcactacataagctgcccccatagaattctgtgtttctcttttcatagcacttatcaaattgaatagtaattgcctgtatcattatcttacttcctgaaatcagcggtataattcctggtgtttagtaggtgctcaaagaacttactttgacagactgaattaaggatttgagcctctttcaaccagcccagacataagatgcatgacatccatattgtttacatggtatgaaaggttaaaaattaagttgaactgacttttccaagacagaatttattttgaccaatatttgtttattaggcatctgttaatgaattttactagactcggcaaaatattggtatgagtaaaacgtggtttcactctcaaataagtcacagaccagttagggaggcaacattaatacccttgaaataatttaaaaccaatgcaagtcaaatatgacctggtattaattacatgcatctttgaggctactttctccatgaaggctttctgaatccttttcctagcctaaaatgaccttaccctccccaagccttttctgtgataacacatatcacttcccactttttgttggagtcactgaggcccatggcccatctcccctgttggacaccagcttcatctccctgcagcccaagagcagccaacacagcatcatcttcacagcagaaacccagccagactctgaaaggagaaatcactgtgcctggggtctctggaaatgctccatggaagagggcagttgaacatgatcttggaggttgggcatagaagagcagaaagatatgacagaaccaactcctggtagcttttgcttatctgagtgcagcctggagcattgtgggagagaaatggtgccccaggtgggcagggtcccacccattgcagccactggacctgagcatgttactgccacagccgagctgagagaaacagagagggtggccttggggaccccgagagctgagccccctccagaatggacaggagcacactgggcctttctagaatctctgttcccacttgtgtggatcccaccacaaatcctacttggctttcccctccctgcttcctcttctggccccatcttctctgtcgtatgggcagcattccaagaatttgattcagacctaggaccctatgggtgttgatcctagaaaggagaggttgatgccagtgtcatttaggagacattggctgactattaagcatgaccccagtgggatgtattgattcagctctgtgccagggtgaacctcaaaggaaggacaggagcaaaggtttgaagtgcgaagcctctgccacgtggaagaagaaccttgggagaacctctgccaaccttcccgaacctctatttgcccatgtgtaaaataggaatgagcatacctgtcccagggagctaggcaggatcaaagaatacccaaaacacgattatattttgtaatcagtaaaacaggaaacgaggattgagtcactgcaggccactgctgacttgattgagaggctccctctgacccaggctcttcctgcctctgtggtatggacctggcttccgacacctcaggcagagcttgcgtgccttggtctgcatctcctggggctgtgggggaggccaggaagctgcatgtttgaaagagtttcccaggggactctagcagggagactgtaaccccccaaggatccgctgtttccactgagcatgtaagacagattccagtgagaaagaacatcactccccagccccggcccccaaatccaggtcccagcattgcccccagggaagaatccaccgctgactcccacctcaggcaccagtgagatatgccccgtttaccagccgtaagcctccttgaacgtcaagggcccgcagtaaacagttggaggataagaggacagacctggtggggcagtcactttattttcttaacatttctccttcttcccacctcactcacaactcagagctcaaactcagcaaagctgaccatacaccaacgcttcagacatcctgaacagttttccacatcccctggttctagcaacaataacaacactcgcagacacacaaaaaggaaagagaaaacaaattcctcttgggctgagtgttctctgcccctgctttttaagcccttgtgtattttcagagaaatttaatccacatgactatcgcatttacattgaaattattaattcagtgggttttaagaccatttgatgtcccagcagctccaatgcagggcttgcagagggcctctctgagcctttggtcccctgaagcaggaagcctcctgatgctgagaaaaaacagagctgggcctcacaagtatcccatttttcactgaagctctcacccctggagaggagagaagagaagcctcagctctcagcaaggcagaacgtttctcctcctctccatgagggcgccagggagcagaagactgccagtccccagtgagctccaaaaggggactctctagggacatggtgagctttaagatcaagagaccatggtgaattccctgggtacaggtgtacagacaggagcaacttgtaggggaagtagatttgtccccattttacaggcaaagcaactgagactccaaatgatgacataattaataagtgtcagaggtagaggcaagactggagcccagatctctctagtccctctgcctcagggcaggagcctggtgagccccaaggggacacagaacagaagcagcctctgccccagggctgccatgctcctccccagacacgctgctggccccatgagagcgaggctgtggtgtccacagggcccagcactaagtgtatttgcataagtgggttggtgggagatcaagtgctgcccaacctggaacagaaggcgtatgttcacagaaccccgatctcagatgaatcccaaaggagggacacacaaaaaggatctcaggtgttcatgggagagagagttaatttccaacagcatgaggctgtgggggtggagggaattgagagcggattgtgaaggaggaggcttccaggtggataggattccaatgttcagagtacacatgggtgagaggagtacagcagatggaggggacagcatgggaaagagtacagagatggaggggacagcatgggaaagagtacagagatggaaaagaagaaactgtgtttagagaaaggacgccatcccatgtggctggaggagaaggtacaaaaagcagagaagtaaggccaaaagctgggagagtgatgatcctaccatggagttcctaaatagcagagtgaagagactgtacttgggaggcaatagggagccactggaggttttagagcaggagagtggctcaccagagttataattttggtgatcaatttggctaccatgtggaggatggaatcgagggaggagaccctggaggtgaggagtcaagtgggaaggctgtagaagtctaggtgagcaaagaggatgctcaagctaaggggtgggggcttgagaaaggggcatgctttatgagcagcagtaattcattcattcattccattaatacttcttgagtacctgtaatgggttctggaaactcaatggtgaatagaattgcaaggtctctgctctgatggagtttttcttctggaggggcaaaaagtatgattagtttgtccatcatctgtcagatagttatctgtgccatggaaaaacattaagcagggtaagtgggcttgggaacagtggttgaattgagggctcaactttatacaggctgtctaggatgccgccatgacaggatgatagtcattagagacatgagggaaaggaagaatctgagagaatcatggttatctgagaaggaattccaggcagaaggaatgacaagtgcaaatggcaagtgaagtaggagcatgcttgagatgttcaaggaacagcaagtgtggctggagtagagtgagctagggcaagagcagaaggaggcaagttcagagatgcaagaggctgcaggatgattgaggacatatcttgctgactaggaagattgtggtatcctttacacaaaagcaaaatccagcaacagggtgcaggctttggaagttcaggtgagctgagctttggactcattggtttggaggatccaagggccatccaggtgcaggggagggggccttcagtttggcagggaaattagggctgagacccacatgtgcatcaggagagctccattcagcagggagaaggaagcggggcttgggatgaacgatagactgcagaacgtccataggtatgaggaggaaggagaaagagaaggcggagagagaagggtcagaggaggtgctgtgtccgggggcagaagaggagaggattgtgaggaagacgaaggtgggtgcagcatcgtaaggacttccagctctaggagggaaagcagcagccaggagtgcctctcctagaagcagctgaaggggccgggctgggcagctcacagcactgggcagcctctaccaggattggagcccagcgaatgtaagggaatgtttataatatacattaacacacacagaaaatctccagtctctgcaaggctttactgtcatgtgtgtcatgtgtaaagagtctggaatgaactactgtccagcaatgactctcaaaccttagcgtgcatccctggaacgcttgctaaatcggattgctggaacccacctccagagtttctgattcagtaggtctgagtgaggcctgggaatgtgcttttctagaacttcccaggtggtgctggtgctgctggtctgggaagcacactctgagaaccacacacttagcggttgccattcccagtgtcttaagctggttacagcaggcagaggcagaatcaccgtgtagatgcctccatctgtggggccagggagagcccagagacagcggagatggggctggaggtgaagtggggaggacagaaggtgctatttttgaggcgatctgctcacacttcattcttgtaatgcacccagaggccccttccctctctccctcttatcctttcccctaccttcttctacttttccatccctgttccttcactttgccagatttctcaccttactttctcatcttttctcctcattctcctccctttccccctcatcccctcctcccccatcccttctcgttcttccttcccctctttactccctcgcctgagtctctgatagacatgggtgagatagggggtgagggggcggccaaggcgaagggaggctgccctgtcccacctctccctgcttctctcagcagctgccagtgtctttagtctcatcagcctgtcttgtacccacgagaggagagaaggataaagagccccatccaggctcccagcacccacctgcagcagtgggcctgcagactcccaaggctgggcaaggagagtgtgcacagagaagggtacaagagcagccagagggagggtccctggaccaggagaaaaaggagaaaggggatcctggtggagcaggagagaaaggaagttgggagatgggctgccccctgcagaactgaccggagcctcggtttcctgaatcctggggtgtcctaatgggaaatagaagcttctcttgggaaaaagggagcattttaagcctcactctcatcgccctcagccatggagggacagacatggtggcctgactccccagagtcacaaagggtcctgggcagccttcccgcctctttgaaggatcctctgggattattttgcagcaacttaactctgcactgtgtggccagacatggaaagggctgtggaattgggtgtcctgaggatggactgcgaggcagtagggagggagacccagcagcttgcctggcttagaagcaaatcatccaccatggccaagtgcagatcctgccaacacccaccatcaccactaccactaccacccccaaagcttggcatgacacagcagatgggcagccatggcccctgaagtggaccagggctggaatggacctacctggcataggttgatcaggttaatacccatctctccttggggacctctctatagatacagtgtcttctacttgtggagactccaggcagaggggagagccccataacctgaagacagggccaccattcccatgatcttcagaagaccccaattctcagagatgatggtgggctggggagggacagaatggctggagacaggcccaggaggcgcaggtggaccactcaggcctgtgggtggggttggcctttagggctgctccgtcagctgcagctcctccccaggcctgggaggggtctgagaaatcatttgccccagcctcatgattttacagatgggggcactgaggcccagaggtagaaagagaccagaccaaggtcacacagcaagtcagtttgagggccgggactgaaacctagtctcccagcccccagcccagagttgcttccatttctgcagcatttccaccgggaataacaagcacttaggcgaaaactacccaagggtcagttcacccaccatcgcagatctcatgtctcaagactttgtagatgatatttacccaaactaaattctagttgggctaaggcatccatccttttacagtgggtttaggtactgaccttcccagataacaaatttgcattttcactagggtcttccatgtctaaaaccagaggccaactatggtggaatttgggttgactgcaaaggcaatccctgaagagtaaatccacaaaaccagccgtggagcctaggcccaagagtgttgccctctggcactgccacttcctcctctcccaacccagaggtttcccagctcccattgcagtcctttcccacaggcatagagtgctgtctcggggcacacacaggccttctgcctcagcagaggcagcaaaggcatgtccgagtagctcctcactacagggagaatataggcttcgaaatcacagaactgagctcccttcccagcttggctactttccaagcaatgaaaactcaagcacatcacatccactttctggatcacagtttcttcatctgtaaaatgggtatggtgatgtgaatcccaaagggttcttatgaggaagaaataggagatggtgtttaagtgtctaccatggggcagaggctgaatgagtgagttccctacactggcctatgccctggagaaagggtatggtgtccagggacaggttttgaggaaagggcctctggggcttgttgtttgagcagaaagatgcatcttacacaagtctgccctttttcatcagtgacagtgcaggctgccaggcctggggcagccttggttgttgctgtggaagcctttctgagcaacatcctttgctcttttcctggcctgggcccccagaacaggctcccaacaccacagcacataaacgctctccgctattttctcttggaacaaataaaatccggcatcatgactcattctggttaaaggataagtcactacagaagcgaagcccaggataggatgaaccacccagtgcacgagagatagagggagagatagagagggagagaggaaaaactgtattcgtggggaaacgttggcccagggccccaggccaagccacccagcagaccttggcaggcacacacagacaagaagaaaatgagctgcagagggctgggagagtggaaatccagacattcgtcctcactggcaggagctggggcatcttcaggccctcaaatgcacaaagcagcagtgagaatgaccaaggagagcacagcagccccagaaccaagagcgaagcctggggcactgtggatttaggatgtggcctgcagacagctcctaaggttccttgcatctcttgggtgattttttttcctcttctctccttgctttttcattctgtctccttttttttttttttttaatgccaaaccacacaagaaagtcccagaaattgaagagatgtcagtgagggtccaggaaacttctgacacacacacagactggtcaaccagagatggagctaatctcagctccaccctctaaggcctctaaggccagtcctcagggccatagaacgtccttagtgctgaactcggaaaggcaggagttcagccattgcatgcttttagaggtaagacgcacaatctcggtagtgaaaatattgaaaagaaagtctccttgttactaacttccaagaaagaaaataaatttaacgtgggcagttcaggaaagccagaggggtttgccaactcagcatctttgccacccgtctcttcccactcccccaccagcctccccctacagcagcctgtgggctccccacaacctcctttccatttctgcagccaacaccatttgttctgcgatgccaacatccttcctaagtccagtgaaggagaggaaatgggagctctccacatgaggtggagaataaacaaatgttgaaattccctgtatcttgagagtggctttctataacttcataggtttgaattttcaaggctggtactgtttttaattgctccttggcactttatgtgcaatgatcataactgacactagggggtgcaagatagccctccaatggctcctctagtcaaccattgaggcttcctgtagatatcactcagggtagcatgtgcttccattcagttaggctataaaatgtgaaaaacagaatttcttattgaaaaccacaaggtgcaatgtgcatgttttaaggttatatacaattagaaaaacaaatgaaggtgccataaatgccttttctcactaattttaactataattaatcactatctaacccttgttttctgcaggcttggataaaatacctctttctaactttctctgactccttcatgaggaatcaagggctccttgggatttctctttttttttttttcttttttttgaggcagagcctcgctctgtcgaccaggctggagtgcggtggcatgatctcggctcactgtaagctctgcctcccgagttcacgccattctcctccctcagcctcccgactagctgggactacaggtgcccgccaccacgcccggctaatcttttgtatttttagtagaggtggagtttcactgtgttagccaggatggtctcaatctcctgaccttgtgatccgcctgcctcggcctccaaaagtgctgagattacaggcgtgagccaccacgcctggctgctccttgggatttcaaactctttcaaatagcttttctttttcagtgccttctcttccaagcagccacaaaactcagacacataaccaatagcaagatgcttgttatcaacctgaggccatcttgacaaggtttctgtcatcttctgttgaattcctgctttccctcttgaatcttttcttcctggtttatctgtgatgagtcaccttgagacaataatgtagacagacatggaaagagagttgtagaaaaagccaatcaagaaaaatggaaactggaatgggaaaaggaaagaagaaagatgagatggaaaataaaatgccaacaagagagaagagagggaagggaggctgtgaacccccaagggtagggcttgcctttattcatcttggcctcttcaggggttggcataggcccacagatggtgaagaagaaagggagggagagaatggttccagacgtctggatgtgacccaaggtaaatcttggggaagcccaaagctggatgtccttgtgttaaagggtctggagaccatggcccctggatgggagaagttgagatttcttattttttttaattttccttgcaaagtttggaagggccccgctaaagtgaactcaggcaggagaccaggtgagtggtggctggtggcccggcccagctccgggatggctcaccctgtgacagcagatcctctctgcaatttctcttctgccactttccaactgccgagccaatgattttataacccaggaggaggacatttccaaaaatgtaatgacacacttcaccctccaatgaagctagcccacagcctttttgtttctttatggcttcttgaaataagaataagtctataagaatgactatttgtcacaacacaaagggagaggagaaaagtaaatctgagctttgaaccagacagaaaagacttcgaagcagtccatgtaaacaatgattccctgatgcaacccaaggctggcttctgtgtcctctgcgctcctgcactccatccacctcccagaggtggggcgaggcctgggtaggagagtgaggccgaagagctgccccttaactagctgggtgacttcgcctctctgtgctgtagtttcctcagcttcaaaattggaatgtagctgggtgcggtggctcacgtctataatcccagcactttgggaggccaaggtgggcaaatcacctgaggtcagaagttcaagaccagcctggccaacatggcaaaaccccatctctactaaaaatacaaaatttagttgggcatggcagtgagcgcctataatcccagctactcgggaggctgaggcaggagaatcgcttgagcccgggaggtggaggttgcagtgagccaagatgatgccactgcacttcagcctgggcaacagagcaagactctgtctcaaaaaaaaaaaaattggaatgctgtctctgcctcaggattgagaagattaggtcaaagtcagggatacctgtagcgcaatccctggtacctaataaactccccccagaatattcattcatgcatccatttatttgtttattcatataaagtgctttgaatggagaggcacacatgtcccactgtttatttcttggttgggcatcctgtcctctattcccgtattatctgttttccatcatcttaaagcctggtgatcacctgataaaataatccaggggttcccaaagctggccacaaaacagaatcacctgtgaaaggtcaaaaagaatacagatatctcagtcaagtccaagaattacaaagacagaccctctagaggtggtgcctggtaatccctattttcaaaatccccaggtgagtctaatgcccagccaggtgctggaatcactgacttaattttttctaagaggtctgtgagttcccatggatccataggttaactccgttccaggcttacactgagagtggccctcagtgcctgaatccaaagagggatgaccaatggcaagaagttaagaaccccagaaagcaggtaggggcaacctgactgggtgacaatgctgtgcttgtcagtcatgtaggcatccaaccgtctgtctgtacttaggaccactttaagtagagttctctggacaagtgaggcaagaagggagaggacttggaaagtcagaagggaggaacagggatgaacctgttgaggatgactctgccacaagctccatgaaggcagggaattgtctgtccctccagatcccacctcaggcccagccttcatcatggaaggcagcatagaaataatgcacatgagcgccggcaccatgcgggaccctccctgtgagccccagccctttttcacctgagtgacacctattcattatgcaagcctctgtccaggagttgccccctccaggaaggctccccagacagcagagcaagaacccttcctctgtgccctgccacacctggagacccctcttgcggcatgttctccacactaaattcatcgggtataagtctccctgccctcactgggctaggggttaggctgtgcttcattcatctttatgttcacagagcccagcacatagcaagtgctcattaattatttctttgaacagaatgtgtccaagtccctcattttacagatggggaaactgaggctcagagatggcaggtgactcaccgtgggtcacttagcccatctggggataggttagagatagccatgaacatgtcaacaggcccacgaacaagaaaagagtatctgtcctttcacctccaggccatctcctttttctgcgttacccaaatccctgtggctggtagacacagctggaagaatgagggtaccagttgtgcctcagcctctacctgaccacgtgatttggggccaatcctgacattctctgggccttgctttcttccccagtctaatgggaatatcttccttgctggaccacctgcctggccatggtttgctggagacagttgggtgtgtacacctcactggccacatttaaagagtcaccatcctatttatgagccaaagcaagcacaccagcccagatcagagagcaggaaatgcttaggcccctttccttcctaccatgcaatggctgagaagctgtcagacctacacataccagaaattaaagctgtacattctgctgagaaacatctgtccaaactattgctgtgtttatgtttcatttttggaggagaaagctgctataaagtggaaagaaaaaaacctctgagcatgacttggaaaaataagcaagggtttgtcaggcatcttgcaaagagatgggagaggggttacattgcatgtccagcctctctgcggggagaacagaccacagccaccttcctgagagagctgggccaagggctcaccaaggctggttgtccacctgcagacgggacccagaagagttcggcccagctgtgctgccagttacaccccaagaagcaaagtgaagatgcagcttgtctttgcaaaatgagcagcttcctctatctgtctattcatgtgttcactcaacaaacagtgattgagccttgactgtgtgcaaggtatttgaccagcgctggggggagatttgaagatggatcagggtctctctctctctgctatctacaggcaaattatctagaggagataaaagacacaaacaataaaggtatagacaaagcttcataggaattgaaggagctttcagctaagagatcaaggaaggcttcctggaggaagaggcactgaagggtggatggaatggggatagactgagagtttgggatgaggagactgctcatgcagaggtgggaaggagagagtgcaggcaatgttgagaaacggatagacgagcagccgcgtgtgactggcactggggtgtgagatggggaggggtgctgaagattgacactcgaatgtcagacactgtaaatggcacaagttggctacttttattccgcatagtcagtggctgaggttctcattttccctccagatgggttgagaacttcctttgcagtcaccttccctcactcttccctcttctcttctaagaacttctgcaacttaggaaggaagcactgtttggatgtcagctgaggtggacctaaaagttgtcaagtgcaaaccagagacccaaatgttgattatgaagttgacgtttgtgatgatacttgtcaacaggtgtgtgcccaagctgaaaggggccgcctctatgtccagccatcagggtagcctgtaggctttgtatctaccgacttcatgactacccatagctacttatgtgtggaggccttttatttattagtattgataaaagatatgcaatagaaatttatttatttatttattttggagacaggatctctctctgtcacccaggctacagtgcagtggcatgatcatagcttactgcagccttgacctggactcaagtgaccctcttgcctcagcctcttgagtagctgggactacaggcacatgccaccatacccggataattttttatttttttatagatggggtcttgctatgttgcccaggctgctcttgaactcctggtctcaattgatgctcctgcctcaccttccctagtagctgggattatagacatgtgccaccatgcccagcttcaagaaaaattgttcaaagcacctgaacgtctatcagtagaaaaagggatgaaactatttatttcagtatccctgaacaggagaacggttaaaaagtataacactgtgaagccactataaagaatgaggcagaactatattatctatctataccaggcccacctctaacatctgaggggcctgaggcaagaaagtaaacagaggctctggcccacggcctgccatcttttcttcccaccgctggttctctctcaataattgggggacattacacatgtagacactccagcctgcacacccaagctctctctacagccctgcaaatggccactccttggctactaccatcagaagtatgcttctctatcagaaaggcaggtctagaggagaggcctgcacaggccctggactcaggcctaggctatttgggcaggagattccagcatcccagccacccagagtgggaggacagtggctccaggtgtcctgtccccttgacccctaggactcctcaccccataggaaggggcacagctagagaagggttggagtggaaccaagagcaggagccctagtcacacagtccaacgggggcattgatagatattaacacagaaatatgtccacatacaaaataattaaatggaaaaagcatgttacacaaccacatatgtagagtgattccagtttttaaattctggatgtcctctagattgtctgcatccctgctgctatagtagtttcctatagaaggctggattgagaaggggaaggagaaggctttcaagttttacttcgggccaggcgcagtggctcacgcctgtaatcccagcaccttgggaggctgaggagggcagatcacctgaggtcaggagtttgagaccagcctggccaaaatggtgaaaccctgtctctactaataatacaaaaattagccaggcattgtggcgcatgcctgtaatcccagctactcgggaggctgaggcaggagaattgcttgaacccagcggggtggaggttgcagtgagctgagatcccgccactgcactccagcctgggcaacagagcgatactctgtctcaaaaaaacaaaacaaaagtattagtttgcacagttctgcaacatgaacactagataacaaatgtgtattttacctttaatacacaaagaatcacagtttttaaataagtgaattttttgaaccaattaaaggattatttattacatattttcttatgaccgaaagaagtaaaacaaatttttcaaaaataaatagataaaatcaatctgggtgcgctagatggtcagagatggctgtggtcatgatccccagatacagtgaaagttcccagggtagaagtgctgctttacttggccagagggcctcctacctgcttccttagcagatccttcaaacagggcttcccatcctgcctgtacaccccagaggatctgcagattcctgggtcgtgtcccacactggctgagtcagaaccttctggaggtggggttcaggaacctgcatttgtacctcccctggtgatcctgatgaccagcaagtgtggaaaccactgcccctcaaaaccctgaagggtgagcagaccaggtataatattcagtccctttgggtagatgagaacactgaggcccaaggcagttaatgaccttgccttcccctgccagagcttgctctattcatccagttgggtcaacccatgttggaagacaaaagcaagcagctggcagtcagtggtcccaagctgcagcctactgggtcacaggcatcccactaagccaggtgattcaccagctcatacaaaaactgcatttcaggatctactctgtgccagatgctgttctgggtgctgggatatttgtggctgcccacctgaacagcaagatcctagctcccttggggcttaaatcctatagggaaataaggacaatgaaaagttattcaaagaagccaacatcagacactacaaagtacttgaggaatacaaggcaagttggtgagagagggagtgacaggtcttcaggaaaggccgctttggggagctggccttgaagatgagccctaaatgatggctgagaagacccagctgtgcacacagtttatagcagcccaggtaaaaaaaaaaaagagaggagaacaatgaggtgatctagagcctcagaaggcgtggtgaagagggtggattttgttggcatggatctggggctttgagcccagtgagagtcgccatgcctctgtttcccccatataaacactcctcatgcttctcaaacttaagcatgcatcagtgtctcctagagggcttgtgaaaacacagacgctgggccccacccccagtttcagcctctgttgatggtctggggtagggtccagggagaattctctttctcaagggaaggtcagtcattttgttctgttctgcccttcgactgattggatgaggcccacccacattaggaagggtgatttgctttccttagcctacagatctaagtgttaatctcatgcaaaaaacaccctcacagaaacacccagaatgacgtttggccatatatctaggcaccccgtggcccagtcaagttgacacataaaattaatcatcatgtatatgtccctgtttaaaatgcacacaaaggtttccagtgtctgataggactttatggagggagagtaagggatgtgcaaacagaggggctctcgtttccctagcccccacgaggccaggcctcaccagatgtgtgagccaaggtgaaccacaagcccctgcagtcagtccaggaagacctgcaggtgccaacttctccccttgggcaggtcctgggccagattctccatctacacccaacccccaggcagggcagccccggggtccccactgggcaggcatttggacttgctgctctcagcgcttccccagacccatcttgaacccattagccaccaaactcacaggggctggaggagattccattttccatggagagagagggagagaaaggcctcactaaaggaataatctctcctttgttccctcgagctctcggctcctccagtgaaacccctccctgatgcccctatctgatttcagaaaaggaaaatggagccaggagaaaaaagagacaaagggaccatgtgggtttaagggagcgggggctgtgttgagagaaaggaacaggtgaggaagggaatggggtgagagaggagagaggtgagaggctcctgtggggacaggccctgctggccctagagaggacaggcctcactcctctctgagcactgagccttccacttcttcacaatgaaaaaaagagcacaggacgaggagtcctggctgtgaaactgatcagtgtctctctgcaggctcatcatacctacattctgagcctcagacacaaactgctctgccagccccaaagctgtcctggagatcaaaatcaagtgcaattaaattgcattgaaagtgattcattcaaatgaaaaggataaccaatgataattggatttcccgggatgtgaggttgaggccttgcagagggaggctgggaggcccatcagggaggggattgaacccacattcttcccttcctgggcagtccatgccagcctctggtctcaggatctcctgcagaggcaagctcatccttggaggttccttcttccttcccctagcatccagtgagctcaattcatggccttggctcatttcatctgctggggagctaagctgctcctgcctgcctcaacagacacagcctgtaaaagcctgactgggcctagagccccagcccttgcctctaggctttctgccctccatggcttgggggaagcaccaccctaggagtcaggacaccgtgtactagtccagctctgccactgcctgtctgaggcctcagacacagcacttctctcgctggccttggatcccacatttgaggctggcccaaggaacctgcatgtttcctcccagctctgatggtctcgaggcctgttcccaggtaaccagaaacatctggaatgcagggttccctgtctaagcagctgttatatgtggaatgcacacaggacaaaagggtttctgttgccacaaggctaggccaggggaaagttttatgcattcagttaaacaacaagagagaaataatatacatggtgctggtgattccacccaccacttactcagtaagtccaggccccaggtggagcatgagctaggggatatgaatctgcttctccctcattggtcttggttgccatgtttctcttatagcataataacatatggaatttctaagagtaattttaactatgtgcacttttttgccttgtacactctaaacattaggatgttttaagttataagtacctaaaaactcacagacttactatgcagtaaaaggtagtcattgagcctatgtctgaaaagcccagtggtagttaggctgcaggtacagtttgatccaggggttcaaagcatcagcaggacttcagctccttctcttcatgcttctctcagctctcccactgtcaatgcatcagctcataaccctcatcatcacaaggtggctgccaacagttccaggccttgcattcactcactacagcatccagagaaaagagaccaccctgctacctgcatcccaagcacaagtcttgagattcacttgattggggagatttaagtctttgtcccaccctgactcaatcactgcagctgggggataaactctcctaacctgagctatgtgctccatccctgcaactgggaatagagtcagaatccctggatcctcaaacagaaatgagtactgttgggaaggaggaaatggaaaccagggaagcagtcaacattgactttagcatggaagctgggtcactccattgaactcctatgcatggaaagtactcgatttctcaacaaccctctttccaaggattgaattcaggggcttctcttaggcctgaggcaaagccaaaagcccccacagttgctcctgctgcagactgtcacacagaaggttaggttggtcactggggacctctttgccgagtgccttcaggaccaccctactctggtgcagtagggcagtccaggacatctcagacctcaaggaatcatgacactacgacattggccacaccaggcagcagggattacaagccagtttatgtgagaaaggccagggtaatcaccgagggcttcctggagcaggtgggaatttatgctggattttaaagggatgatctccagggtggggtacacacaccacagggactatgctggactgtatactggagtacagaaataaaataaatgtgagttctatttaggtttatattttatctgaaaaaaatagaattactaacatttaatatacagtttattaaaattggacagtttatgctggtataatttacatatacacttacacataattaggggtacatatcatcttttttcttacaggagattgaattttaaaagtttagagaccaaaactgcctggaagaatggagctgaggataagcagaattcaggatgagtccccaaagagccttgttggagagggtgtgaggtagagtcaggtgggagggcactggagccaggggccctttgtcttagtctgggtcctgcagggagccaaggagcccagcagagggcttccagagtgccatgtccggccttccagagtgcagtctccacagggaccatcctctcttggcaaggcccttcttagaggttggtcaacagggaaagggtcctacagggctgtggctggaatgcctgttgcccattttcccatccaccgaagccctgctccctgcgcctccgcaggaagaatgccgggagcccgcagccagtgactcacagcacacagccaatggaaagggccggatgctcgccacgacctttggggtttgctgtgccgtctggtgcccacgccaggaggtatagggtatcaagcccccgagaggcgtagcaggccctgaggctgcagaaggctgtataagcctgaggctgcagggggtggcaggggctgccagaccccaggcaatttggctggtctcagtggtgacgtgaacattttccctgcgcttcggcagttatcctctcaaactgggactgaatcatgtcctccaaacctcaagcccaacaggcacacgtaatgcccagactcaagaatggagagaagggctgacccaggccctctcttcatggcaaagaaacatttggggcaatgcagaggaagctgtcccaggagaactccagtcccagccccgcagcaaaccaactgtggggctgggtcagctcccctcttggggcctcagtttctgcagctatattatggcgacagtaagccctgccctcctacctcatgaagtactatggactcccagagaaatgaggtctgggagagtggagatgggacccagggagtggcccttgttctttgaaaaggacaaaaccggtctcattgcaaatttgaggtcacagtgacttagtgaatttactaccagattgtcccatctcagccactgccaggacacgtgacttttcggaagccaccagtctttgcgcatagcttgcctagatatggccccttctgtttctcggtgcctttctttctttttcttttccccgagatagagtctcgctctgtcacccaggccggagtacagtggcatgatctcggctcactgcaacctcctcctcccagattcaagtaattctcctgcctcagcctcccaagtaactgggattacagatgcccaccaccacgcccggctacttttttttgtattttttagtacagacgggggtttcaccatgttggccaggctggtcttgaactcctgacttcaggtgatccacctacctcagcctcccaaagtactgggattacaggcatgagccactgcacccagctggccgtggcttttctaatctagaacatgctgcgcctgattctcccagaggcaccctgagaggtgctcctccatctggcaacagtgcccgggaggaacgtgtccctcaggaagacttggtcacgtgtcaggttaaccttgaaaactggagcagccccagagaagtaagcttagagcccagggttctcttactgacctttttctttctttctctcactttctctctctctctcaagaatggagcagccttgaccacacaatcacttgcagaattaagtagccaaaaatcacctcgtctagacaaacagatgttatgggtccaattaatttctgccggtcaaaaataggcgggcttaataaggggatatatatagaatctgccatcatctggctccccaggggagaaacctcagctcttatttcatagacgcttaatttcaaacagagttctgtaactcccacttcagacctggctttccttcctgacggcgccaaggtggaccggggcagggagagcaatggaccacaagaagccacttaagtcccatgcagcccgagcctcccggccacctcctcccaaccatctaactccgctggtatgtggtggcttcttctttgggccatgtcaccaggcagtgggaagctgctggaagagcaaggtctaaagagctccagaaagtccaacctgtccctgtgccccagatcccaccatcatctgttctccatccctcgggatcgaaagcctttcggggctcttgtgggctgtggtgtcccctcccacacacagtaccgctgtccctgggaagggttaccgttcttagccactgttagtatgtggcctgagcagagagccagaccggcacccaaggcctagagggccccaggtgtgccagagtcacgtgccacagacccagtgggcaggtcagaatcctgggacactctgggcccccgtgatggggctgctctctggtgggtgagagatgaggcgtagagggccctggagagcactaaggacaggacctggggaccctccagtctgaggtagaactctccccagcatcggtgggggtgagtccacagccgcacctccagggtcgcaggcttttcctccagggcacggccaccggggcttggccgggccaggaaggagtggctgctcacttttccctagatacatgtaagtaagtaagccaggtgtgttagttccttacggccgccataacagatgatcacaacctgcgtggcttaaaacaacagaaacgcattccctcagagtcctgaaggacacgagcctgaaaggaagcagcaccaggtccgcactccctccgcaggctctgggggagaatccttccttggttcttccagcttctggtggtcccgggcgctccttggcttggggcagcatctcctaactctgcctctgtcttctcgtgtctctcttctccccatgtctctcctctgtgtttcctcttcaggacacttgccattgaatttagggtccacccagataatccaggatgatctcaacccaagaaccttaacttagttacatctgcaaagacactttttccaaagaaggttgcaaaggcattggctcaaggcaggagccccagctgcatggcagcttccgcccactggctgccttgtccaccctgacccactctggggcaccagctttaaggcttccctataagatgaagaatgagggccctttcaggtaatgacagatggtcaagactctgtggctccagaaacatcattcctttgtcagaatgacttccattaccactctctcgtcatttgacaaactcatattcatcccttaagacccagctcaaacatcgccccctcctctaccagggatttgcctccatcccatttgttgcagagcccatgtggtcttcatctctgtacctaggcaagggcctagaatgggccacaggtcccatgactttatgctgaaagcccagcatccctccctcagggagacagtggtcccagcctgagggtctgcatgtggtcacacctccagggttccctcccaccctccccacccaacttcacctccacactgcccaccaggctccatcctctgccaggaaagagtacctcccccaatgtctttgctcatcttctcttccttcccaggctggtcgtgggcgccccactggaaaccaatggctaccagaagacgggagacgtgtacaagtgtccagtgatccacgggaactgcaccaaactcaacctgggtaacgtgggctggtggtctcttcacaatgaggccagcggttgtctaacacaaggcaggctctgatgcacgcccatgtccatggtcacactgactccttcctgctactccatgagatgacccagctgatatcactgcccccactttacacatgaggaagctgaggccagggagaggaggcaacttttccacagtcacacagcttgccaggggctcaccaggaatcaacccaggccctagctgtcccagaccattcctctttctgactcagccactgcccttcaactcaaagttttctctcccaggagaaaaaaaaaaaaaaaaaaggacttcctgtctttttcctgattttgaaataataacaacaatagctaacattcagatatcttcgataatgttcaccatgtgtgaggcacatttggactcatttaatcctcacaacacccatatgggatttaaccatttaacagataggaaatgacagcatacagaggtgaggggacctgcccggggtcactcagctcacaaggagcagggcttggcgtccagttcatgcaggctatggcctccctttaaccaccatgcagcactgcccttcggaaatgcaagcttttcctcgccaaagagctttcaggcatattctggaacagggagatgctgtgaacagcccccagcctccgaagccctcctaaaatctactcgtgtgtgtttgcatgcatgtgtgtatctgcttatgtgtgtgcaaatgtgtatccactaagcgcacacaccagtccactaaagtgctcccacttgtcctaaaggtcagacagcagctgggtcattgcttgctctgctctcagaagggagaaaaagttccattttggctgacaagctgcaattctaggctttgccctggaggactggacttccctagggccaggaccctgggcctccctccttcgaggagcggggtctccaccccagagcagtggggtgggtctccctgggagatgggggatgggaagggcagcagggtctcactgggcgggaatggcagaggttcaagagataagctgatggatgaaaaggtcagcatccaaaagaaagcccaaagaactccccagggcagccagccgtctgtcacatggtcccggaggctcccactgtccacatctgtatcagcaccatgggtgggaagttcaaaacccagcatagctggggcccaaacttcagtgaggaaatcgtctaagggaagagggtgcctggttggtggcatatggttccaggtcatcagcaccctgagaacacaggcttctgaaactggccaacctggagtccccttccagctgtacaaattctttgctgtgtgtccatgcggagttcacatcctctctctgagcctcagtttactcgtgtgtaaagcaaggaggctggactcaacaacccttaggatccattccaggtctaatctgtttccgaacctttaatgggcacctagcgtgtaccaaacactgtactatttattggggatatggtggggagcaagaggccaaggaaggggacagtaatcgggtaggcaaattaggaagcaggataattttaggcagggatcaatgctgtgcaataaaccaggtgctgtaataagagtggctagggggtgatggaagtggagagggatttctaccatagaaggtgatcagggaaggcttctctgagcaggtagtttttgagaaggttacaggtgggggcggagcactccagacaaaggaggagcaagtgcaaacgccctaaggtaggaacaagtctgccctgttggagaagataaagaaaggccatgtggttgggacagaggcaatgaggttggggtgtggtggaagagtgggcagtcttctcagggcttcagccaccaagagaagctcctggtccaggcagggacgtggattcgtgaaccaatctttttttttctctgttgcaatgtggaccccatttctctccagagggaggaggagacataaagccatgagaccctggaaagcatttctgagctggggcacaagcctaggaggcagtgggtagcaaagtgagttgggacagaggaaaattactcttcatttgaggtgtggttctctctctcccactgagaagaaaatgcatggcagaaagaacatctgtcagttttgccccacagtggaaaatgcaaggctgggaaacctgagtcctgggttttcctacggccgttccaggcactgggcagcacgatgccaggaatgttctttcctttttctccagggaaggctaagtgggtgtcagccattcacacctctgtgggaaagactctaccactggcactgtccttccaacacctggataaagtcagggttttcaatgaggggcaggggctgggggaggtgatgtgattctcaaagccagggcctgtgtagggagatatctgggcccgggaccctcacccagacctgctgaggaaggcgtgagtctctcccgctcacagaggggttgggcaaagacttgaacctgagtctgtctaactccaacacagggatttttcctcccctgcccctctgtctcagccagctgcacagtttcactacaaacatcagtcccaggggagagggaggaaggagaggggcagggtggtgaggtctgcgttccttaaataaacggagggcagaattctagccagaagggggcgagggttacccagcccagtggagcatggagccgcccctctagttcccactgccaccgtgatgccatcagatgggagaaaacacagaactcgggatgaaacgtcacacggtctgggctaaagatcttgctctttaatttcccagcaggtaaccttgtggcagtcactaaccctctctacacctcaatgttctcatctgtaaaatggaaatgatgacccctgggtctcccaggaccgtgaggggtcctgaaagggcaggtgtgcgcggtgctttgtagatgataaggcatctcagaaacaccggggctttactgttattttctctccagcttgtttgggcagacaaaagagaaatcgagcccagtcattcttagcacagccaagaagggcagatttcaaaaggagccttgcttcaaactgaggaaaaccaaaaaggaaaaaacaacaaacacagctgcccctaccctccagtccacaaaacagtctgtgtctgacaagctgggctctgccagcggctcacccccagactcctgcaccagctggccttcctgacctgtgtgccctgggagccaggccgactcttcacacttccagtcaccgacacagtgcaatgcaacccattcttgctcaaggcctccttagaaattattcctcccattgctcgaacctgggagttggagattgcagtgagccacgatggtgccactccactctagcctgggtgacacagtgagaccctgcctcaaaaaaaagaaaagaaaagggaggggagggaagggaaaattaaaaaaagagaaaagaaaagaaattactccttccccaggcagggaagccacccagagctgtccacactgcatattagggctggcacactctagctccccagcctctcccactccctcttcctgtacacgtgcacacacacacacacacacacaccccaacacacttctggggaattcagactcacttcctttccttcggtggcctccaggatgatctggtaaaaccttaagcgatgcaatttttttatgattctaatctgccgcagagctgaccctctccctattcccagcaggctgataacccagctcctaagcacctctcttggcagcctccttcagaatggcattcctgggcaaggcctggcagctctggaaggctctcgttgagttggctctgttacccatgagaggaaactctcagctgtcacatgttgattgttcagatgagcagagaagtggacacagaaagagttgggcacaggactggttaagtgtggatgggggtcaacttggaagaaagcgtagcggggatactgcacaaaggaagccagcccaggtgggatgccatggcatgcttgggggcacacggggaagtggggctccagtcggatggctggaggaggaaaagctgtgggctaggagatagaaggctcggtgagtgctcactgtgtgaccttgggcaggttgtttgcctctctgagactcggttttctcatctcacaggcagttgtgaggaagtcctgagagtacgtctggggaaggcctttgtaaaccctgagagccagaggtccccagggtcagggagaatcggggaggcacctcgggtgaccagaccagcagcaggctctgggcagagggcgggcaggagggggctgcaagctgaacttctcccccaaccccaggaagggtcaccctgtccaacgtgtccgagcggaaagacaacatgcgcctcggccttagtctcgccaccaaccccaaggacaacagcttcctggtaagagccacctgccactgcttggggtcaggagaggcaggggtgggggtggggaggggtggagcgtctccttacacaccctcacgtccatcctgtacacccactctcccccactccaaccaccaagctgcctggccctgtgcattccaggaagcagctcccccgccagctccctgcttacgccattccgggtggcagggccctgggtgttttggcagggacagtccaggcagaagaaacaattgagtccttttgtgtgcatatcccgaaggagggaggaacagccagaaaggggacaagaataaatgtagatagccaacaagtctggtgggggactgtccctttccttggggagctagttgtctgggctggaggtcaaatctctgctctaggcttgaaaaaagaagcaggctgcaccacacacccaaagaagacttggaagggatgccataaatgagtaaacacagactaccacagccgagggaagggctacagagtgacaagccgtctcaactatccaggattagatgaagaaggctggaggaggtttctgttttgtttttaaagaagagacaggccttcgcaaggaagaaaagggcatgtctgggttgaggtggtagaaacattcattcatttaaacaatgatgtttctgagcacttaccatagtatgtgctaagcccagtgctgggcaccgggattcagcaatgaatagagaccctgtcctgctggagcttacactgtggtggaaagagaggcgacaagcaaacgagtaatgtctaataggactttgggggacagacagcagcaggctctgcttacaggtctctgttctgtgcccaggtgagcacatatggactctgcacatggtagtgagtgtgggcagcacaatggattggcactgcctgctccttgccaccaccttggagtgagctgcgttgagtatgggcgatgcttggggttcaaacaggatccttctgagactgatggttcctagaaacagttgcaggataggacttcagagaaaatttaccccagaaagcccagtacaaattactgcccatttttagatggggtgcttgtgtcagtctttgttctggtctatttctgctgacaaatgagacatctggggcatgaatcacaagacaaattagataagacaaataagacataaagataagacgatgactgggatgcaaggggacttgagtgcatagtggccctgccagggaaagtcatgaggtgccttgatgtatattcagcccacagccctttattagccataaccagaggcaaagcaggacccctggccctatccacacacatatccgtcaggggctttgtctctactcccttttccctctcaggctccttatcacatttcttcttcacaaggtggtatgaaggtctgagaggaatggtgtgatatattctctggggcctctgtgagtaggttaatccttggtttatagatagtcacctgttcattgattcactcatctgtccattcccctctcaacaattcattcctccattcatctatccaaccacccatgcattcatctacccatctgtctatacatcgatccaccatcaatctcccatgtaatcatccatctttccatttattccttcctgcatccatccatcaacctccatcatctatcattcatccacccatcaattcatcatccatccatccatcaaccatccatcatccatctgtcattcatccacttattcatccatcatccattcatccatcatccattcatccatcatccatccacccattcatccatcaaccatctatcatccatccattatcattcatccacccattcatacatggatcatctatccatccatcatccatccactaattcatccatcatctatccagccatcattcattcacccattcattcatcatccattcatccatcatctgtccactatccatcatccatccattatccattcatctatctgtccatccattcacatctatccatcatccttccatccatcttccatccatttatccatccatccattcatcatccatctatacatcattcatccatccatctatacatcattcatccatccatctaccacccacttatccatccatctatcatctgtctatccatccacttatccatccatccatctatccattctttattcccctctgtcccctgccacttccaaacattatgtacagcagcttcaacaaagtacacagataaaacataacctttaagatctgagcttaaaaagaaagtaattaaagaaagggatcggaagtagaataattactcccctaaaccaaaggaaattacagcacaaaatttagctctgggtttcctgatagcaggataacaatggaagcatggagctgagctttcatttttaatgacaatgactctgagaagaacccttcactcagtccttcaatggggactgacatcagtgtttttggtagaacatttcacagaaagaatacagacattcttatcttcccctgccccagtatgagccatggcatgtttttgggacccagtcctagaagtttgcccagtaaggcccttcaggcgacctctcagacagaggagttattctagtgacccttgaagtgttcacacccgtgggtgaaaaggcttccccagatcccgtatggtgggtgggtgagtggggtgggcaggtagggtgaagaagtatcatattcctaaatgatgagatggagaacagggccttgaaaaaacaatgaaagagactccaagatcagtttttctccattagacctgaaaccaaaggaactagtacacattgcagcaagagagagttcagttagacccaaagaagatccctcaccccctcacccctcagatagaagtctgtcttgggtcgtggaggatgggagtgggcctcaggccattggacctcgatcctctctgaggtcccctcactgactggggatctgcactgccctccccaggcctgcagccccctctggtctcatgagtgtgggagctcctactacaccacagggatgtgttcaagagtcaactccaacttcaggttctccaagaccgtggccccagctctccaaagtaagtggcttcaaatctgcaacctcaagctgagcagtggacagtccagagagacttgggccctgagcacaacaacctgtggctagaaagcagtatttggactctagcactgtcctgccccagctctccggatgacctggaatgtatcactccactctctgggcctctgtgggagtcataatcctggcctccctctcccaagtgtgatggtggagagcaaatgagctaaggtttcaaagacaatcccagcctcaagggaggctcactgcagaaaccctgggtatataggaggttacctggcaagcacatgcagcagacaagctgtgcactgcacaattctgggggaattgttcacttagacatatgaatgacgccccctgatgttgtgcaatgcagtagccttgtagatgaaggaacagggagaacagaaatctccttggtagtagttccaccaaatcagtgctcctggacagcagggagttctgtccagctcgtccagagcctcatggaacgtaaaacctcttgctcattgcccacctgcgaagaaaacctggggaattactgctcagaccctgcctcccacaagcccagacttcttggctctgagcctcactatttcctctgcactaaataccatcacccaagcagctgctgcccgttttatggagggttcgggaattggcacctctggcttgcctgcagccgccctccagacaacaaggccgagtcagatggggctggggaagggaggaggaggaagcatcagtccagcaggggcagaaaggtcgtctttctgggggataatgagacatggattctattcacacaaaatgacagaggaaatggcagagccagggcacaggaggaggcctgaggtcagggtacgtgaggggcccaccggggaatgtcaccacccctagagctagtccctccaggcctagatgtgaccatcctatggtccctgaacctcatgtggtggaggcctcctcacctggctgaccagcagcattgctctgaagcttaccaaatgcagattccagggcaccccatgtgggtcctaattcagtaggagtatgtgcaagtgtgtgtgtgtgcatgcgtgcgtgtgagtgtgtgtgtttttaagctccccaagggagtgttcagccatgtttaggaaccgtagccctcaaaccagtttgttcccaaggtatcttagaaagaaaaatgtgaaattgtaagaaagaaatcaacaataataaatgcattataataataaagctggcttaaaaataaaaataaaaataacctgttaaaagattatgaactcctccaaatcaaggaatttctgtcttggtcacccccactgctgcctgcaccatgcagagctccagcacatagcaggtgctcagtccacatgtgtggagccgaactaaaccagaaaaggacaaatgtatgaggctctgccaggccaggagtgtcaggtcatcacatgctgtacacagtatgcaggtgggacaagaagtggcggagcactcaagttgcccaaatgcttctaaaatgctctactaaacacaaagcctgcaacaggcgtcccaactcaaagccacccccaccttcctctgtctgctcagcactgacttcaacatagtgcctcttcgaaatgcaagaattactggaacagttaacacacaaaaggttcatgcagcattgttataaagtagattttataacagcataaaaagtcaccaataaaaatgagcaatgcccagacgcagagtgtatgcattatttcaaagtaactccaactgttgacaaacagaaataaattacttagattttaaaagaggagggtttttttaatatttgttatggccaatattttcttaattttctttgttgattttcattattccttttaatttagttttttttttatttgtttgttttgttttgtttgtttttgaggcagagtctcactctgtcacccaggctggagtgtagtggcccgatcttggctcactgcaacctctgcctcctgggttcaagcaattctcatgcttcagcctcccgagtagctgggattacaggtgtgcatcacgactcctggctaatttttgtatttttagtagagacggggtttcgccatgttggcaaggctggtctcgaactcctgatctcaggtgatctacccacttcggactcccaaagtgctgggattatgggtgtgagccatgactcccagcctaatttagtattaatattacaaaagcataaagaaacctttatattcagaggcagagataatggcacgagagcttgacctgatgatatcagtaccatattaactcagtggtttccttaaaaaataaataaataaataaaaagtgaaaccatgatcagttcagatttattgagcatttgctttgtgctcagccctttagaagcatcttctcattaattactctaggcaactctttactattgttgtgcctcttttacagaagagaaaactgaggctgagaggttttgtgactgaccctaggtcacatagctagggagtgccaaagccaggagtcagtgtgatgccacatcccacatttctagccacgacatcatatctccctcctaaaaacagaaatccattcatttgggctgaaagtggtaaatgccagcctgctcattacagcaaaacaaacaataccaaggtactgatttgagcagtgctggctgcctcggaagcgttggccgattggtagtggtcagtctctgattaggaatagaagtgatcaggcttaatttaagctttgttcaaacagccagcagagtggtagaacacagccaggaattcctgggctcactcacattgcccaaataaatgtccaacccaaggacagtttcccagcccagggaattacacatatggagcagagtcattcatttgtcctttgaacaattgtccagagaatcagagactcgcagacactgctccttgggtagccataactgtgtccccactttccagggtgccagacctacatggacatcgtcattgtcctggatggctccaacagcatctacccctgggtggaggttcagcacttcctcatcaacatcctgaaaaagttttacattggcccagggcagatccaggtgagcatctcttgggctctttccacttctgaacagggccacccaaacccatggcaggtgctgccttaggtctaagagagatctttgcatgcacgaaggaggtgtaggtaagagggcagaggtagtagggccagccagcactggggcactgcagctcaggacactcctctctggtgtagcacatcaaatgacattttgggggaagcctcacttcacgggtcagacacaagacaccacctgtgaagacttagacaagctaaaaagtgacaaggaaggtgggaatggttgagtggaatctagagccctgtcgagtggggcacaggggagaattagacatacaggtcatggagggaagatggtaggagaggtaagggctgctaggctcatatatctgaaacgctgcctggctaacgcggaggtagattcattcccttttattctgcctgagtgaggactaatgactagaagttattagatggcagatttcaagtcaatctaagaaattatttgtaacgattagggctgttaaaaagggagtggactttctcatgaagtaatgagttccccatcaccagaagatcatcttttagggtatcatgggtgaaagtccagcattagaagggcacgtgtgccaaataaaccctgtgggctcctccaacaggaacgtttcatggttctattcctactataggtcttgaagctttttgtttattttgatgctattaatattgtcattattttatcatccatggggataaaagaacctcttacaagttttaaggaacctcagttttggagtttggtaaacactgtgaccttccacccacactattcataattttttggacttagactgattctctgctctgcttttgttttcctaagaaagaagcataattgttgggcctttctttcaatcacgaagtctccattctctatatgcaccccttcttgtgccaccaagctgtccattcattcctagaactttgcagaactcacttccctttggctgtggttactttcttggaaaggtcctcagccctcctccctcctgtattatcacacagagacaactcccggggatcctcactctcaaattctaaggttcatgggttcatggggtcaaaatgttctgttgccctctcctctcccttgcaggttggagttgtgcagtatggcgaagatgtggtgcatgagtttcacctcaatgactacaggtctgtaaaagatgtggtggaagctgccagccacattgagcagagaggaggaacagagacccggacggcatttggcattgaatttgcacggtaaaaaaaaagtagaacaaaaaaaatttttttagatctcagatgctattgtagttatctattgccttgtaacacactaccacaaaatttagtaccttgagacaataatttcttaattcctcaaaattctggagtttgactgggctcagctggtcggttttctcttgggtcctctcaggtagttgcagtctggtgtcaccttgggctgttgtcatctgaaggttctcacgtggctgtcagttgttgttggctgttggctgagagctcaggtgggactggtgacctgagcacccacacgtagccatgtggcttgatttccttgtggcatggcaacaggagttttagagacagcgtcccaagagtgagcatcccaagaggcccaggcaggacctgggagactgcctataacctagtctcgaagtcccagaatatgacttctgccacattctattggttgggcaagtgactgagcccaggccagattcaaggggaagggaatttggttctgcccttgatggatgaacagcgaggtcattttgcagaagagcatttagaatggggaatattgttgcagccaactttgaaaaatagcttctgccacagacactctataagaagtaggttctgtgaggatggggtcttcttatggagtgttagtcatcaatggagtggaaagaatgcagtcaaatctgacacctgagactgtatagtagtgaggctgattccttaaaaatcacaccagaactcggccaggagtggtggctctcacctgtaatcctagcactttgggaggccaaggtgggcagattgcctgagctcaggagttcgagaccagcctgggcaacacggtgaaaccccgtctctactaaaatacaaaaaaaaaaaaaattagccgggcatggcggcatgcgcttgtagtcccagctacttgggaggctgaggcaggagaattgcttgaatccaggatgcagaggttgcaatgagccaagatggtgccactgcactccagcctggtgaacagagcaagactccgtctcaaaaaaataaaataaaataaaatcacaccagaactcactcatccagataaatgttatccctagatgttgtctatgcagaaggctacatgcttattccagtaatgttgttgctcaaaacattgtgctcaccccccactgaaattagccagttttaaaggcaatccccagatctcttgagccgaggcctaaactcataagatgactgtgtcaaaggcatttagattttaaatgtctaagtgttacacctataaatatgaattctgctgcatttgttgagaccacagacctggtaccttataatcccaccttaggtagggttagttgacgtgttttttaaaaaaaaaaatccacaaagtaagagctatttaggccaggtgcagtggctcagacctgtaatcccagcagtttgggaggctgaggtgggaggattgcttgagcccataagtttgagaccagcctgggcagaagcatgagacctcatctctacaaaaaatacaaaaattagccaggcatggtggtacatgcttgtagtcccaactattcaggaggatgaggtgggaggatcacttgagcccaggaggcagaggctgcggtgagccaagatcacaccactgcactccacctaggcaacagagccagaccctgtctcaaaaaaaaaagaaaaaaagaaaaaaagaactatttagtagtattgtgaattcgtaggctcaaaagattaagacttttccaacctcataactctttataattaagtcattgctcaactagcgtgtttctgtttgctgataaaacttgctcaagcttttcctaaatgagcatttctccatgtgaaggtggctgtcttactcatcctcataaggaatgggccatttttctgtttttgttttgccttcttcggggtgagacccgagactcccagcaggcccttgtgaaatggcttgggtaagggaggcagcccataaccaccagctctcactttctcagtgtgaagctaactgactcatacagggataaagcccactgtttggacctcactttacaacccaccaacccctggtcagttatccgtgtgtgactcaccaggtagtttgaaccatcagtgactcatgagcaccgctgaggttgcaatcttcacctcaaattctgatcttcccaaacttccaaattcaagtcccaaactacagctggtgccttttaaggtgaaaggttttctgtcctcactcagtttattcttaatgcatgttttttcctatgcacctatgaaagggcaaagatccaggccatgaacatgagggcttataaagatgtcggtaatctgtgggtcctggccactgatgggagggctgtgacaagtgttcaccctaaccctaactcggtgaggatgagagagggaggggcccccatggagtggccaaggagaactgccaggaggaggcggcactggacctgtcctgggaagaccctgggattccaacaaaaagaggtgaacagaagacgtgccacacaagacattccaccctgagaacagcagaggagagggaaagtcaaggaacatttgcattcagagatgtgctccttttgaccacagcaaggggttcatgttggtgggaagtgagccatgtaaagatggtgggagtgatgatgttgtagttaaaaccagcatgggtggccactgcagattcttgagtacaggagtgtaatcatcagatatgcacgttaaaaaaaatgagcctggcagctatgtacagcagggaagtggagagggcccctgaacaatgtggtgtgattctacctttgtccacataacactttattgagcctctactatgtgcctcacactattttaggcaccaaggctagatcagtgaacaaaataggtacaaataccgtgccatcgtgagctgacattctagagagaggggcagacaataaataaataaataaataacagcatactagaaagagatgaaagctatggggagaatggagtgtggtagcgggagtggagcaggtgcagagggcaggtacggaatcagcatgcacagggtggtggggaaaggcttccctgacggatgacctttgattggagatttgaaaggaggtgagggagttgttggcaagcagatggctgggagggaacagctcagagaaaggcttggtgtgcctgaggccttccagaccattgaagagtccagtgtgggtgggggtgagtgagcaggaccagaggctaagagaggaaacgggccagatttcagagggcctagtgagctgttgtcagaatctgggctttccctgagagaaataggaacctgtgcaggttttgagcagaaaggagctgtgacggggcctaaatctccatgggccactctggtttctaggcccatggagcctgttatgagtataaagctcttgctgctctcaaggaatgtataatctaatttacaaaggaacaaatccaagtccctttacccagtgcagaatccgaatttaaaatctgatgattcatgctgatattcgcacgattacagattcatatgacattcacactattccactctatggaaatatgatcctgacatttttcttgggtccatatataataaaacctgttttgctcctgccatgcttttttgcagggtgttttattcctgggcctggcccttccatgcagtcatggaagcatctagaatccccttggaaagaatagcagagttctcctgctactgggttgcgcttgagctcgaaacctgctctcgtcatgtggcacgtgcctctgcaggtttcagtccacagcacatactaaaattagtgggttttttaaggcaacatatccagcatatcggagaattgctaagagaatggtggatgttttttctctttgctggtagtttgaagatgttctaaactaatgtattccagcttttgtaaattcctcaactcctaaattgtatgcatcagttcctcagcgtgctgcgtaagaagagatacctctgataccaaagccgtgtggctctttaacctgtcactacagagcttaaatctgtggcctgtcctgccttgctgtgggtcagacccatgaggaataacctcagagtctaagactaacatttatttttagatccttattggcagactataacttctgggccagactcctcggtgagaccatgtctatacccctcagaacctcatggtctaaaggagggccggccacagggacaccaaaagccagtggtgatttgggagccagtttttcatgctttgtagcccaatggcctgttacaagagcctctctgccaattgacggtcgaggtgccagccctgctgtctcctgggctggattgcctgataggtgggctgagctcatgctctgggcactgaaaacaaaataaaaagtgagaaagagaaatatttgtcatggaatttgatatttaatgtttcccaaaatagaatcaaagtagtccttgtgaggaagtcagagctctgtcaggcctcatcgcacgcattttatgggttagtgttgtctggatgctgagtcaccctggcacatcctgttttcagtactaaagaaagtgagtctcaactctggatgctcaccagaaccttataaaatactgatgccagcccggcacggtggctcacagctgtaatcccagcactttgggaggcagaggcgggcagatcacttgaggccaggagttcgagaccagactggccaacatggcaaaaccccgtctctattaaaaatacaaaaattaaccaagcgtggtggcagagctctctaatcccagctacttaggagactgaggcacgagaatcgcttgaacccgggaggaagaggttgcagtgagctgagattgtgccaccgcactccagcctgggcaacagagggagactctgtctcaattaaaaaaaaaaaaaaaactaatatccaggccaccaccccagagattccaatttcaggggtctggctgaggcctggacatcaatggtgtttgtttgtttgtttgtttgtttgtttgtttgtttgttttgagacagtctcactctgtcgcccaggctggagtgcaatggtgcgatcttggctcactgcaacctccgcctcccgggttcaagcaattctcctgcctcagcctcccgagtagttgggattacaggcgcatgccaacacacccggctaatttttgtatttttagtagaggcagggtttcgacatgttagtcaggctagtctcgaactcccaacctcagttgatctgcccgccttcggctcccacagtgctaggactacaggcgtgagccaccgtgccaggccaacagtttttaaagcctccctccgagagatgtcagtgagcagctggggttgtgaaccactgacttaatgcctctaaaggttgccacttgcccctgaactcccctcccaggtccacctcatccctttggcctgtccaaaacagcaaggtcaggactccaaaggggcttttcaacatttcatttaaaaacaacagatctaagaaccctctgagcagctggtgaaagagtagctctggccatctcaatccagctacttctttggtttgaggtcctggcacctgttgggttgcccaaggaggacttggtcctggtttctgtggctgcccctctgcaggagcgtcaggggctgccccaatcccacttacctttcatgaccctgcccctgtgcttggcttccagctcagaggctttccagaagggtggaaggaaaggagccaagaaggtgatgattgtcatcacagatggggagtcccacgacagcccagacctggagaaggtgatccagcaaagcgaaagagacaacgtaacaagatatgcggtggccgtaagtcctggcccgcccaagggctgctgatggcctctgagaggctttaccatcaaatccctggggactccaagggactagttccaggcagtatcacaagtgtccaggccctcaaaaaagcctcccatttcatcttctgaacaacaagttgaggatttttctgcactgctctggcctatccacaaaagctacgggttgtgtttccccccatccattgccagggagggtctggaacctcagaaaactagaatacacctccaaacctcccagctcccagaccctaacttagcacaagggctttatcttgcccctaaaagagagtccattccaaatgcaaatggcattgcgaggaactctcatggctaccggccctggctccagcccaccctggggtccccagggtctaggccgtgtggtgtatgggaaagtctgtgctatgttctggtttgtggttcctgcccctgttccctggcaggtcctgggctactacaaccgcagggggatcaatccagaaacttttctaaatgaaatcaaatacatcgccagtgaccctgatgacaagcacttcttcaatgtcactgatgaggctgccttgaaggacattgtcgatgccctgggggacagaatcttcagcctggaaggtaagcaatgcatgctaagaggggatccactctctcctgggcttatgtcaggtaaaccccgtagagcacaaaccaatcccacaaaacgaaatggcttaacaagagtcttccgtaataataaatgccaggccaggcatggtgactcacgcctgtaaccccagcactttgggaggccaaggtgagcgaattgcttcagttcaggagttcaagaccagtttggtcagcaaggcaaaacctcgtctctttaaaaaaaaaattacaaaaattagctaggtgtggtggtacatgcctgtagtcctagctacttaggaagctgaggtgggaggatcgcttgagcctgggaggttgaggttgcagtgagctgatatcatgccactgcactccagccggggcaacagagccagaccctgtccccaaaaataaataaatcataaatgccaacaattgagtattactccgtgccggacgtgaggctgtgcgttttatgaacaatgctgaaaggttgctttgctaatgttctcatttttatcgctgggaaaactgaaactcaacggagttgagtgacctgccaaagttctcacagcttgggagcatggtgggctttgaactagggttgccaaatttcgcaaaaataagatacagtgggtgtggcaggcttaggttaaaacttatttgttctctgaaattcagttttaattgggcatcctatattgcatcaggcaaccctagcttgtgcctagcagagtctgactccgtattctgaaacccttaatccctatatgccaactgcttccactccaccaaaagcattttttattttgggcagagtccttcagattgcctctctccttgtgatttaagctccatttctgatttgcataaatttcatttccaccataaattgctacagtgggcccttccaatatcgggctttgggcatatgggaggattataaaaggaaatagaaggcagtataaagcctgagaagtctgcagtgcattggaaatgacaagccacagacacacgaagagactaaaatggccctcgtaaacaagggcagatgaatataaagtctgaacgtgagctttgacacccactccagaactcaaatatccaaatctgtatttctcctcaaaacggtcgccttgagtgatgagaacattcgatccaatgatgtgttcagggagtccctctgtggggagaggctttcagcactcatgggatttcttacgcaaatctgcagtggtgacagacctccctctgagggtggatttgatgtttgagttccatccaaagacatctggaaccaaagctagtgaataaaaggaatgaacaaagtgggaaattccatttctggccaaaaacgtacactatttctgtgcacttttgcttactttccctccagttttagcagtctcatagtatacatgccctgtaatataagttgtcccgagcccttttcagaagtaagtgggctaccagtaacaacccacatgggcacctggaaggtgtgtggtgccccccactgcacagggtgctggggagggctgaggaggctggcacactactggcctcagcttcagagcccccctcgaaagagagccccacctcctgacgatgcccccaggaagcaggagctgtgggttgggcagcagatctgtctggcgctaagggattgggcatggagctgacatctctctgtcactctgttgcaggcaccaacaagaacgagacctcctttgggctggagatgtcacagacgggcttttcctcgcacgtggtggaggtatgtggtggaggtacgggcacagagcccagcctctgtctctcgagggcatgctcttcccctttctagctctctggatctgtcatccaccttcacagatgggttggctcttctcctcactttctctctttcttggggtctctctgcctcccatcttctgtgggctggaagaggggagtcgaggtcttccacctatttatgttgtcttaagccaccagacaatgagtaaacacccaggtgatccttcccacaaataacgtacaatctgtaggacagcagagaaatagccacagttcatttgctctttagaagcgaatggactacagacaataatcccataatttcacctgtgaggcgcggggtgtgccttcccattcagtccacagagccttgtgcaaaatctagggcaggtggcaaagccaatggcacgtgctttggatagctccagtgcccaaggcggcctgcacatgccaggccccatgtcaatgttgggagggtatccagatgttccagctgtgctctggcaggtgactcataggccccccccactgtgtgggtgctgcatcagattgcagaggtcctggggtggggctggcccacagagggaggggtgtggtgtcacaagcaacatgtgacatctggggctctgcatcactcccccgctgtgtgcttcacctggtgctggttcataaggaggggctggagcctcccaggattgcaagggggacagaagagtcgatgtctgtgaatatgcttaatgtactgtaaagtcctgcccaggattgtcatgtgggaaaacgtaccgactgcatctgtcagtatcgatacgtgctcctgtgggtgtgctttgcacagacaggtgtcccaggtgcatgtgtgtgcaagtgtgtgtgtgtgtgtgtgtatgtgtgttctgcctgggctggcaccatgagagtgtacttattcctcctaatttaccagagaaggcccattagtgcatcctagttatatgtcactgtcatcctgttgccctctcctaactcctctgtgaggtggatagggcaggactccttgttcctagtttacacataaagaattcaaggcatgagaaggttaagtgacctgctggagtaaaattcttcagaaaaaatattagtctcgtgctctttcctctacaccaagcagctgctccgtgagagggaatctccgggggtctgagtcagaacttccaaactggaggggagggggacatgtgcgtgacatgcagccggcagatggacggaaatgccactcacactcagacttttctgagctgcatctggacagtttcatgcccactgtcttgaataacagcaagatgtaaatatagctgccctatcctaataacagccctgttacatgtgcacagcggtttaaacttctccaggaaattcctgcacctcatttcacaccagaacagccctacaaggttggcaggtgatgatagttatcccattttaggtggttggatcagccactcttttcagtgccttctctgtgctgggtcctgagcctgatgccaggagaatcagaggcgggagccctgccctcaaggagctcagagtctgagggtaaagagcccagcacagcgaggtgagagcatccattcacgtgggggccagcagagtcatgtgctctggcaggaccagccctggtctccagactctgacgtcagagctgattagaaaacgcaacaaggaaatgcaatttaattaaatctacatgcatttgtcaagtgccactaaagtgctgaaaggacccggaaatgattcttgccaccaggagtcaacttgtaaacaatcctgaacggcagttcttagctttgagagtaggatgaaagaaactatagatgccttctaggtaaaagtgtacaatacctggaggcccccctcatccgaagatcccctgtgaagaccccctgctcaatgcaggggatagggggagacatgcacatgtctaatgttaaccaaagcaacgtgatcaaggtagtatagaaggaagggcctccactaaaagaaggggtggtcagggaaagatccggagagggcttggcactcgagctgcccctaaaggacacggatttcagcagtcctgggtggcagtaagcaggagaacagagagcattatggacacacactgggtgacatcctggcacagctcagaggtcagccctggtgttggggacagaagagaaaatgaatgtcccaatgtttcctttgtccattcacagccattttttgagtatcttcatgtgtgtcagactctgtaccaggtacattaaagaaacatttcagctgacagccattcatagcctagctggggagaaagactcttaaataatcagctcactgtcctgcttctaaaatcatgatctgtgtctgcctaggaatcggggaatctaaaaagaggaggacattaaaatgggcttcagggactcagggaagcttgagctgagccttgaaaatggctccagcagttcagtgttgagcaaggtgagtccttgcaggatcaacaggttccccagcttccagagtgaggagacccaggagctcacagcctcagcacaagacttcggtcacgtcaaggtcatgactgccatgtgcagccccttccacatatgctcaacttctctgttccccaggcagagggatgcagcttgcctctcccatataccctagttcttccatcacccctgacacagggacctagcttgactcttcctcataccctagttcttccatcacccctgatattttcatctaatttgactttaagagagacaacgatcgcatttgaatctgagactctttagtattaaaaacaaaaacaaaaacaaaaacctttcaaatgcacaggaatggtgcaagcatgatgggctggctggctctgtgaccgggcactgggggctattttagagcacagacgtctttcagtgccaggccgctgatgccatcatgaatggccacagccatcctgtccccaggagtccaactcctcagctctcagggtcagttaggcctctctggggatcagggctattgggtccagcctttccactttgccctgagcatgtctgtctcccaggcaagcccccaggcttcctccctgccagaagcgccacagatggtctcaaacagctgctgcctgaagagatactgaaggagcctgaggggcttccccgggcctgtttagttctggtagaaggagagatccctagtagaatgttctcagatggcagaagaaaggcccggctcctccttgcttggtttgctgccgtcttaatgagcaaggaaatcagtctttgaattagcaagggtaaaaacaacaggagagagaagggaccagagcccagggtagaggggagaccccaagacatcacctggacacccacagagtccagggccccaaaacattacattccaggctgaaggcaaaacgtctgagccattgggaaaacccgggtagctggaaaccctagtcttgatttgcagaaaggggaaagaaaatattccaaaaattatcatcaggaaggctagctgtggatccctggtcagactttagaatacatttttaagctaatgcttccattagcatttggaaatgaacgcaaaggtcactaagagccagagtggcttccattagtgctggctgtctgctgaggtagtgaactacctgtcaagctgggtaatcaagcaggagctgcaacaatctgccagaaagttgggagaagggattcacacctccagagggggactagactctaagactctgtaatcccatgggccttgaggggaagatgcagagggagaaagaggactacaaagaattgatgggcatgggtgacggtgtgcagagggctcagctggagggatttcgcatccgccttcctacactggaatcctaaatctgccctaactccaaaagtttacagaaggaagcagttttatcagggtagatcttgtctacgcagaaaccttggtgactcacccaaggtgggaagagatcctttttctcttgtacctaaaggtgaggtcacttaccctgcacgtgatgacctaacaggaccagtgctcagttctgttatgaagcaggtcaagttcagctgagccctgtgtgggagggtcctctgcagcaccatcacccatgcgcatcaattatttgtagtcctctttctccctccgcttcttcccctcaaggcccatgggattacagagtcttcgagtctagtccccctctggaggtataaacatcccagatgagctaccccagccaccctcctgcctcttcagcctgtgcccatcccacaggccctcctgggattgaggtctagacaatgaagggtattggctattcgctaaggttcttagtggctgaagctttagaggtgtaatcttccctaagggtttcgcatttgaactggttttgcgtatctgattcaacaaaaaatgagagaagctgatggataatggtgaattgaggagttgacctgtggaagctgtaaacccctcctgtgcccccctagacctaaacaatagactccttcacctgccaggctgggcgggcagtcaagatggtctcctggccctctccccaggggtccaggacacagcagctgaggtcctctgccacgctggtcccaagggtttgcgagttgtctcctggtggcaggaatcatttctggttcattcgggtcctcctaagcctggccccatatcctcaggctgtgccctagtgcccactcctgggcctctttcccagggcctctgacaggaggcaaccaactctgatggggaatgagcagtcagtgtagcacgcccaggtccccgcggctccttctgctcaccccagctgccggattccagcaccgcacatggtgagggcccctcctccacagaaaggcagaggggctgtttctgggcctttcctgcccacaccccatttaagcctcctggccattcatcccttcctcaggtccacttcaagcttgttgaaacaagccttctaagactccaagccattagtgaaaaagcataatccaccctctaaatggtgtatgtgccttagaaggggctcctgggaacagagcctcacccctctacagccactctgacgtggactctcgggagtttggcgggggaggacagcctcggtgtcctctaggggtctcccatcacaccagcccacagcaccaccagcgactacctccacctggctccaccgtcttgcctcacaaaagccaaaaagagctagaaggaagaattactggcacctggtatcctaattccgtgactgctgggcaagagggaagcactgtctggcatgtgggctcagaaaaatcatttgacctgtctgagcttgtcttagtagatgtctgaagaatatttgtgaaatcgaatcaaggcttggaactggaagtgttcgttttgagacttactaataaatcaagtaagattttcttaaaagcctttcctaaccctactatgtactcaccccctcttctcagttgttcacctgctcctgggactgccaaaataaccggtccctgactccatcagagcacttctcacatgctaccgcaatgacgaacgtgactgtgacacctgattcttcgactcccgaccactggggagatgcttacagatggattcatgaacgagaagagctaccatgtaccaagtactcactggctgccaagtgccctgctaagaattaaaaatgctgattttcacaacagaactattttacagctgaggaactcaaggttcagagagagagagagagagagagagagagagagagagagagagaagaacttgcccagggtcacacagctagaagctctgagctggaagtggaactcagaagcctctgactccagaactccttcctgctctcaccaccacaccagggatcctccacctctgtcctagtgacatcttgggctggataactctgccgtaagggaccatctggtgcattgtaggatggttagcagcatctctggcctcgactcactagacaccagtagcacccccaccactacccccagctgtaacaagcaaatatcacctagggcacaaacctgccccggctgagcagcactgccctagaccatgctgccttcactgccggggctgtggtccaaccctggcttgggacatggactggccggaacacagggctttgagagatatggtcacacaccctgggagcacgcagctcagctgggaaggcaagactgcctcagaggccaggtcagagggcagctgagagctgagttggcagggtctggtggagggagctacacacactgcaggtgctagggctacaacgtcctttgggaaggcacagcgtggcctcagaccttctgacagctgccaagcctgagacctcatgtctacacagaacgccaggaaaatcagcttgtggggaaggtcccctcgtgcaaggccacccaggcacaccctggtaatatctggtgggagcccaggtggccccacataggaaaggaggctataaaacaggaagccagtgcgaggcctgcagagcgggggacacagctcttcccgggaatgcccactgtttgtttgccagctgggcccacgtgcctgacttcccctattaaggatttggtcccttctctttttttgccccacccttctagatttttctaaactcaaaatgtctgggcttccccagctgggaagagattgtgacatactaaggcttgcttcagtggccttaacctgtctactcctcacagtgtccccatcctcagaagactctccctggccacaacaaattcactctcaggaaagggcctcccactgcaggcccaagactgcagctgctgtcagggttaaaatgggatgaggtgggagactgtaagcgatcgcctggccaagtgttgccaaatccagaagtcatgacggaattccccaagctcccatagggagaatcagtgtgaggggtctccccggctgaatcccacgcccctgggccaagccagcccttctcagtacatcacaggggctccctgtcatctgcagagccagaaattcatcttcaaaggcctgtccatgaagcacagaagccaggtctgcagttacaaacttggactcaacaggcagagagagggaggaaagcaaggaagaaagtcagaccccaaatactgcgcccctccctcaggagggttcaggtggaaaatggaaagctggacccacagcaggctttggggaaacagatagatgttttcttctctgccctacttacctctctggtcaaagccccagccctgcctctgacttgctgtgtgaccttgggcaagtcccttccccctctgaacctcaacggctcatttgtcaagtgcaaataatgaacatctgtccttctgatttcacagggcctctgggcccaaatgggcagccagatgagaaagtactccacaaagaatagagcacaccccacgtgcaggaatgttggtggtgactttgtggacagcgaatatatgagttcctggctcctgtcgtggcccgaacaaactgtcagagcctcctaggctgaggctcgagcacagagtagcaggaagaaggctaattagaaagtacaatgtgaaacataaccaagcacattgactctcccaagaccagcttatttatagctgtaaaaacattctgtctgaacagtcagttctacctctggagggttaggatttgttaaccctttgataagatcagcttgactctgtaaagcggtgggaatctcaagctcacccaggcagccaggcagccgggctcagggaaggctccgtgggagagagtggtgatttaccagcctgtgttttgaaagcccaaagctgggatccagacagtctgcccccacccctgtaatcaccaaggtaacccagaaggcagcccttccctgtttccaccaccttccttgggcccgtcatcgtccctggtcattttccttcctcttccaagtgctggctgtttgtctgcctgtacccagtaggtatgtcgattgctgaagcaggggatcggggatacaggagagagagggtgagtggacccagtcttcaagaaagggccatggggtcagtaacctggaaactttccctcaaggagccagagtttcctgtcttcctgcccaagcattgcagcttccgcttgtcctgcaactggtgggtagaacaagaccttccaagccctgagaaacaagcagaagcaccagtgccttgggtgctggctgtcatggaggtggccctggcttatctgtccagcctcatgtcaaggctctctgcccctcttgcttggtgctccagccccatcaaacagcgttcagttccttatgaacaaaggttccgtgctctctccagcctcagagcctttgcacaaactgttcctggcccttttctccagctcttctttctctctggctctacccatctttcaggtacacgggtaaacatgacatcctcgaagacttttcctaacccccatctcaatctagattcagcctcactgtggttttccctgattgcgttgatcacagtttgcaactgcatgtttgttgagtatttttttttttttttgtatcttcaagctctgttgctggtggttgggggcggggatacgggggacaatatccctggcaccaaacaaatgcctggcacaaaggagacctcagtgaatgtttgctgaagaaaccaaggagtaggatttacgtgcagggaagcaactcagacactgcaaagaaatattaaagaagggcaagtgcaaggggccctttccctccttcaatacatgtcagaaggagtggacagtggcgagacggtccctaaagggttttgaagcccaaggagggatggaggtttggccctggatttagagtttgtttctagaacattcctttttccctaaattcctgtccttgggatcaatttgacccattttgtgccaaggatggaatggggcaagaaagtctccttggcttattcaaaagccaagagccccagccagaagttaggttgctaaataatgcacccaggagaaggtgcccgaggtggctggtggaggcgtcactggtcataggacctgatgtggctcctggcaactggcccatgaggacaggtgctgatgtgtgtcccctccccaatgccaggatggggttctgctgggagccgtcggtgcctatgactggaatggagctgtgctaaaggagacgagtgccgggaaggtcattcctctccgcgagtcctacctgaaagagttccccgaggagctcaagaaccatggtgcatacctgggtaagagcgcagagtgaggggaggctggcgggtcgtgggccgggagggcacccaggggctgcacaacccccagcccacacacgagtgaggggcctgccgtgtatattctgggctgattcaagcacccaactctgaagagcatccccgggggcatttcctctccaccctggtatccaccgcgcccagcaccatgcccagcgtataacaggctctccataaataggtagaataaaggacaagcagttccccactcccttcaatgtgtttcatttggtgcttctagactctgggtcagctgttgttgtgccttaaagcttttggggctgcctagggctccagtacactgagcctgcctcccaaaggcaaaacgcaagtcgagtggaacctgcattcatttttatttcttaatgttcataatcaaggcagaagtcgctgcccatgaagcactttggaagtggatatctagatagaagcacaaatcattgatggtgaaggtcccagcagcgaggccttagcctgctggccaaagtcaccttccagctctgcaggagcagtcacctggccatccccaggcatgtcccattcgccatggcttgttcctttctaaaggaagggccagaggggagggcggcaaggggggtgatgttcagggtccccactgtctctgggtctttcagaatttctgaaccaaatccactgtctgtgaagttactcctcattgaggcctcctcggaccccactcctccatggacttggggccacccagagtggacagcgaatctgtccatgcgtccatctttctgatgcttcatcccatcccgacctttgttcctcagctcgttagccaataccctgcctatgactctgcccacgctgtggttaccctgttttctatccccaaccatgggaccctcagctgacaaaagggcaaaatgctggaatcaggactgtgctagaaaattcagaagtgtagatccctagaagtttcccaacagcacctggccctagggcctgcgttccatttaattcgcaaggtgttaaacctgaattgcatagcacctgcagttgatgccatcagagtgccatgttaagtgccgtggtaagcaggacacagcgcctgccctcaagctgcttctgggccagtgggagacacagacatgtgcgcagataattataacacaattgaggtaggagctcagataaaagcacaaataaaggagagaaagattggagtccttgccttggcaaatgctcaaacactgggaaagatgctggaagaacaaaggctagcaaccctttaactagaaactagaatgactcgtgttttattgtgtttcctcccaagtgtacagccctgtgctggaagtgaggaaaccaaagaaggggtgcaaggtgcaggtgcctcgaggcattaaacagcaaggcagatcacatcagggtgtcccagggcccatgaggttaattccaagtgagtcagagaaacgaagtggttggccatggtccagcgagctggtacactcgggacctactgtgtaggagctggagcctacaccaggtctccaccgcaggggccatttcaaataagccaagaagggccaagaaaaggaggaacatgtgggaaataccaggttatttcaggacccaagaagtagatgagtgtggctggagcagggggcagaagtgggaacatggaggagagggaaggttgggatagactgtagcaggaggcctcgaatgccagattaagacgtttgagtttttcatgttggcaacagggagctgaacatatctgagtgagagctcagcaggatgaatatccccctggcccagcaaagccaccctgcttcccctcccagaagaccctgatagggtagagcttggctgatggacactcatgaggcccagctgtcatgccttagccacagtcactgccttgggtgggggtcttgagggagtgccttttctcctcctcctcctccgtctaggagtcatccagtgagagcagtgtctgggttctctgctggggcagagatgcctgctggaagattcctcctgtgtttcaagggagaggagtcctacaggggaaggagaccaggaggccagctcccagcctccactgggggtgcagtataaatttcgggccatggtcctaccctttcatcaggccttcagggaggctggcccagcctcagaatggcccttcctgctggccagagagttgcctgggtaccaaaggtgctgcccacagacagctggaaggcaggaagctctgtgaactttgaatgctgacccatgcctgcccagaggacacttggacctcaaactgcatctcagtgcccctccttccaagcaggcccagaagcccaagaccaactgagaacatttacagtagtgccactgagggctcagctcagaagaaacctttgccctacaccacaaggctaagcccacccacccatatatttatgattgctctaaatacatggccatgttagccaccccttgtgaggtcttggtattatggacctgtcaagcctcatttcccaaagtacagcctcaagagtgaaaactgttgtgtctggaaccagagcagttcacccccaggcactgagtcagctcatctgtacaccctatagccactctagaagcagccaatgagacccaagtgacagtgttacacacacagatacgcagatgcacacgcatatatgtgcacacacacactcacacacgtgcattgcaggggacatctgttccccagaaacagcccaggaactgtcaacaaagtccaacactcatctaaaatctgggatccaagattatctggcagaaagtgggattctaggatgccatcggctttccacacctgctggagcccactttcaggagagttgcctgaagttgctgcacatttgcttcctgggtactgggtgggcgacttgagattcacagtgatcaggcacagccataccgggagcggggattggcagcctttccaaaagagcccctggggttccttttctttctctttggcatgctgtatgtatggggctgacaagagcctaggagcttccacctttgagtctgcaaagctttggggctgcaagaatccctgagaccccatgtaaatatctgaagcagaccaactccttccacatttacggctcacactctagtcctcagtgagccacttagcaggcgtttgtggtaataaagagaaccctggttagtctccaagagtgaagattggtggggaaccaaaacaaagtctccccagtattaactgaagtgaggctagagtctgccctactccccattgccctctgctgtgctcatgagcaggtgaaggagggatgtgtgcatttcaagttagtcttttagcagtcccacctggcttcctttattttctccagcaggggctggggtgcagtgagttctccctaccctccaaacccccttcctgggtcctgcctcttccaggcctccccagctgcccctaggaattatggccctgcgtgattgaatctgctcagctagccctgaacctaccccatcactggcccatcctctggcactgccaagccatgcaccgggccaagcaacgcctgctgaggacacggtgccaaagatcagcctgtttcctcctgtggcagggtacacagtcacatcggtcgtgtcctccaggcaggggcgagtgtacgtggccggagccccccggttcaaccacacgggcaaggtcatcctgttcaccatgcacaacaaccggagcctcaccatccaccaggctatgcggggccagcaggtaatggagggggagcctggggccgggatggagggaagagggggcagatcagacaaatgggagggcagtaaatacaggcatgcctggaccactgggtgccccaaagggcagtcatgttcctccagccaccttcatgctgccaggagtggcaggagtgcgcatccacctacagaaggccccatgggccctccaggatgccagctgcttcccttttcctggaatggaagcaatgaggaatgggaaggctgccaatgccattgccccacagggaggtggttggcaaccagactgtgctgccaagagtcctgtggtggacaatgatgaatgcaaattggaaagctataagagtcattggtggtgaaaacagggctccaatcccaagtcacttccagcacaggggaaaactgggctcctgggaagcaaggtggctttcccagggttctatggcaaattcatgactgggtcaagccaagaaccctcttggtggggctgcctgcatcatgccacctcctgaccccaaataaccccaaaatcaggcctgggctcctcctaaccagcagcatctgtgccctctctaggccagagctgagtgctgtccaggcccttccatgttgtccccagctccctgccggctctcctgagcctgggaacagtcctgtctcctgagtctctgactgcccttggctggtcactgtgagaatccgctcctcaccgagtctaacctaaatccctctcactgcagagcgccaccctcctgccattcctcctcctgtctcttgggtgcaggccatcccaggcagctcagctctcaccctccaccctgcctgcccacactcacccagggccagctcttttgggaatcgagggctagaccttgagagctggagggaatttgctgatgaatttatgacatttttcctgcccagttccgcctccaacatccgaaggagaaaccacagtgctgaaggcagctaaattaagtgaattccaaatcgcggtgacccacatagctgaggccacatatttagacaaatttctcccgccccctccctcacttgctgtctgtccgcttcttagttactttatgtaggcacatctcttccctctcccacccatgtgtattatttccctttcctctcttctaaattttttatccttctcctcagttaaaagcttttcatccttgagaatagatttctcctgaaaacacgctaagccagagatggacggggtaggcagaatcatgagccagggtgtcagacagaccccagttccaaccagcttggcagtgaccaggtgaccggccttctgaccttgggcaagcaattctctgagttttggttccttcccttgaaaatgaggatgactctctctcctagcagcatggggctcacatgagctaacccaaggctataaaccatcccacacagggcttgtccacgaacagggcgccttcccctttcctaagctacccagtgatccaataagcattgattaggtaccttctgtgtgccaggcaaagtaccctggccaagagggaacacagcaggctcaatgcctgccctcatgaggctcccagcagagggagtgggggctggtgggaggagtatggagctgaaggcacatggaaaaggggcagggagcagagtggagaaggtcaaggatagcttctaacaggaagtgacacatcagctgagacttgagggatggcaggggatggtctggggaggacgcaggggcggggagtgcatgcaagagaaaagcttgtgcagagggaagcctggaagccagccaaggcctggggcctttggagaagagaaataactcagtttggcaggacccgggagcactgcagtgggagcaggagcttgtggggacagaggctggggagggaggctggtccagcacggtcctgctagagagtttagatactatcccaaaagcaagaggtggagtggtgttagaggccacgccagctgccatgggggtgggctgaaggggccagcctgaggctggaaggccctttagaaggcgcctcacctagggacgaagcaggggggagcagttggtgaattggcacccaccacgtagcacttgctggcaggtttacgggtgggagaggtggagggtggagtcagggtttctgggtttctgatgagggggtggatgttgccctcactgaagtggggagcactgtaccccaaacagaaggggaacacagcaagtgctcagacactgaaagaaatcataattcaccatccacgatgctaatgccagaatgatttataacatcaaaaattaaaaacagtggcttacacctgtaatcccagcactttgagaggctgaggtgggaggatcactgaagcgtaggagttccagaccagcctgggcaacatagtgagaccccatctctacaaataattttttaaaacagccaggagcggtggtaagtgcctgtggtcccagctactcaggaggctgagatgggaggatcacttgaacccaggagtttgaggctacagtgagccaagattgcaccattgcactccagtctgggtgatggagcaaaaccttgcctcaaaaaaaaaaaaagctaaccgtccagcaataactgattaaacacattatgatacatgcataatttggagcactgtggaatcaccagtgattatgttgtagatgaaaatataatacatcatagaaaaatgttcatgatgtattgttttatttaaaaatcagtatataaactatatttgccttattaccccaatttgtaaaaataaaagcatatatacacacacctacaaataggcaacatgcctcaggggaaaaaaactagaataaaatccactaaaacgttcatggtagttatgtttggatgtcttcttcatacttttaaatagtctcctgattttttgccattatatcactttacacacaagataaatggccaccaacaaaattaacagaaagaaagaagagtggcgaggggataatgacagaaggaaaagagggaaggggagaagggcaaactgaaaacagacaagtccactctgagggacaggagagagaggtagcgcgtgagaagggaggatccatttgttcaccaaaaattctgagtcaaaggatgaccttggcttccctctgcccgcgaggcgagggctctgggttgtgcgagctgggcagccagcccactcctctctcccatcacgtgccgcagataggctcttactttgggagtgaaatcacctcggtggacatcgacggcgacggcgtgactgatgtcctgctggtgggcgcacccatgtacttcaacgagggccgtgagcgaggcaaggtgtacgtctatgagctgagacaggtacagctgggcaggggctgggcagcttctcaggggcccccaacctctgctttgacttgggtagccacgacggaaatgcgttactagcgaggccagtgctggagccaggcctggggagaatcagagcctcctctgtggctgggttcatatagccagagacggggttctggggaatggagtggtgagaggatgccggagcagcctgcagagggaattatgagcctgaggacttttgccaaaccctccccagcctttttctgcccctggttttgcagaaccggtttgtttataacggaacgctaaaggattcacacagttaccagaatgcccgatttgggtcctccattgcctcagttcgagacctcaaccaggattcctacaatgacgtggtggtgggagcccccctggaggacaaccacgcaggagccatctacatcttccacggcttccgaggcagcatcctgaagacacctaagcaggtcaggcttccctggggaagcagatggagcaaatggggctgcaggagtcccaggagtcccaggagcttctgtgcctcatctggttcaggattttcttccaggccctctcacagaaacggatgccaatctgtcctggccatgcttccccaagtggaaattttgaaaagggcacattttaccttcaggaccctcccatcaccccctttggcactctctccctgcttaccctcatcctcccccaacaacaaacaacaagaagtccctggcacctgaccctcactccccccgagacgcgcacacatgcagttgcctaccagtagagcatcccttctgggctcactcttctctggaaatgcttcatgctagaaaccatgcccacctcaaaaccaacccgtctcgggtcccgtcccctgaggatcattcttttgcccacacggtttatcagtaaaatagcctaaaaaatagaccagcgtgagagatggggatgggtcgcctccaagtaacatgtatttacacttaatggggaactcttttaagacacgatattttaatccaaaagaatgacttgaatggtaggaatttcaggtgccatgataggccaagagaggagattgctttgggttggggaagcttcttggtggtttcacacaggctccctattgttcctgattgttcctgctgctcggggacgcccgcccccacactcacagtgtgcatgccctccccctctcttcccgcgccctgcagagaatcacagcctcagagctggctaccggcctccagtattttggctgcagcatccacgggcaattggacctcaatgaggatgggctcatcgacctggcagtgggagcccttggcaacgctgtgattctgtggttggttcccccgctgttcccacctcctgggctctcctgaaagtcacaatgaatccaggggttttaaagataggcttcaggatctttgtctcttgtctttaactgccctcagctagacccaccctgttcttatcccatcttgcttacacatttccttttggtggaatcagtgtaaattcaatataaattgaagtcctgtccaaaagcccccgctcttagaatttgtcctaaaagttatggctactcaagcatgtcttccacttcagcttttcaagctataacactcgcaggggcaagttgagcgtgtttttaccatctggaaggacctttccttctcccctggcgtggaggaatgtttatctagtacagagatttctttcctccaaagcgctctgacttcttgcttcctttcttcagggcctcattttcatgcttcctaaacacccatttattttaccatatgtttgctgctttttgagccaaaaaaaaaaaaagaccttgagtattttttcatatatgttgatgagatatttttcatcataaatataataacataaagaacatttataaaacaaggaaaaaaaaatcactcagcctgccatcaccttaacaatgccactattaatgctgtggtatatctcctcccagtctttttcccttgcctgtaattttatataaatgcaatcatatttgcctacaactttaaaaaggcattgaacagaaatatataacttcacagggagaataaaggaaaggacaggctcctgttcacaagaatactacaacccaagggggaaatgtcttcctccaggttccctagaaaacagcctgaggcaaaagcctctgtgaatgctttgggagtgggagcaatcctagaagcagaagtgaagccggaagagagcaccgatgccgagcgagccagcctgtcctcaccacgcgtgctgctctttgctcagtgtctcagcatttcccgtgtggcgtaaaacagcccattgtaggggaagaaggggcagcagcagacttgtggctccctcagatccctcatttgtcatggccagagcatctgctgcccaacagtcccggtggtgccccagccctctaggcagcactgggaagccagggcctgtgcgtgtgcagcccagctagtgtacaggagcagggtctgtctcttcgaaggtctgtgctgcatgtgggggctcttaggtccttgttggtggtggtggtggtggcagcaacagcagcctgggcttgcaaggtgtgtaaaggtgtccactgtgttggttccagccaagaaagcatggcagatgaccaaggcccggggaggaggtacacagaacctagcaggtctttaaagtaacatataaacttctctacaggaagcaagatacacatgtgcacacacacccctcaagagaatcggtctcacagaaatgattggatcaagctctagcttttgaagtctacacctatgtgctacctaaatactgatgaaattgcgggcgagagccctctgggaagactatggtcaagccccatagttctcaaacatgactgcccattaggatcaccaggggagcttttaaaatgtcattgcccaggctttacccacacccattaagcagaattctgtggagggacctgggcagcagtaattttttttaaactccccaagtgattccaatgggaagtcaagtttgagaacttcagatgtaacccactatgttgacacagcactctacactgtcaaaggacattctcacctcctctgatcctcacaatcccccattgcaaagatcatgtgacctgccaaggtccaatgaggagcccgtggagccaagactcaaatccactctttcacgctacagtgcaggggtgctgttcacctttatgctaagaagaacagagtattggcacagatcatcatgttgaagctatgaaacctctaagccactctacttctatttctttttatatacattcatggttgggagaggcaataggtttccgttcctaattacatttgacttaggccggtataagggtaaatttgtatttccttggttacctggatggggtagtgtgggggttagatggatgctggctgcacgttggaatcacctggggtgctttaacgcctcgctcttcgaagtgtggtccatggaacgttcacatcacctgggatcttgttagaaatgcaaaatcagtgccaagctattggatcaaaatctgcattttaacatgatccccagggggcgtgcacacatatgaaaatttcagaggcactgctttaaaacctgctaaggtctgattctgatgtggttttgcctagggtgtagctgaggcaccaggatttttttaagctcttcagatgactcacatgtgcatccagggtggggaaccactgctataaaagatgatgagggagcaaagggaagtcagcatgatccacagcgagcacagcccctcggggaaagtgctgaggggctgcatggaggggccatgaggtggctgagcccctttcgccccgtgctcgctcttgccagtcctttgacatccgaagccccctccatcctccacctcgccccctccatcctccacctcaccccctccagtggctttgcagatcccactcgcatctggttcttgtctttccccatggtcacagcagggcagcctgagcccctgccccaccccagctcactggcccttctcctccaggtcccgcccagtggttcagatcaatgccagcctccactttgagccatccaagatcaacatcttccacagagactgcaagcgcagtggcagggatgccacctgcctggccgccttcctctgcttcacgcccatcttcctggcaccccatttccaaacaacaactgttggtaaagcaggcccctcctttctccccacccccagactccagtctccccctgcaccttgctctatttcaaagcctgggcttttcccaaaatgggtgctaagtgccaggtcgcccaagagccaccttggatgactactggatcccatttgatgctctcattccaaagggcaaagaggggatgtcatgccagggtgagagtggcagtgagcaggggtgatcatgacagggaggacaggagaagaaggaaacagtctgggcgtagagtttggatcagagcacaggactgatgccagtggagcaaagtggggtgtggaagcccagaagtctgcctggatgcagaggaagaggcagacccaggagtcctacagggagggtgctggaaaccaggaggccaggtcagtgagaccccagcagcagggagccccgctcagaagtgggtgtgagtccacagcagggcagtttccttctgagggtccatcacttccagctaagtctggagtcagacacctactcatgacagccctggccccaggtggtctcaggaagtgagctgcgggttccaggactgtctgtgctggcacaggaaacagggactcagggagtctctcagccaaggagcaggaccagacaaagaagagaccaaagggaagatgaggacaaaggtgggcctgggggctgtgcccctctctttcaacttctgtccctgagaggagacagatatgagagccagcagcaacctgcgggcgtgctggagaacaggagaagggactgagcctttccgggaattggcaaaacctaactgaaggggaggaggctgcagggtttatgccccagaatagagtcagagatttgaggatccggcaggaaggggctggccagccctccttggtgtgagaggaagtacccagcaaaggctctgaccagccctgagggggatcccagagcccagggaaagacagggaaggtggagggagaggcggagggggttgttgactgcagcaagggctcaacatgacaccaccctggccccacatcctgtctcccctcctcatctgcggtgttcactttccctccacttcttccttctgctctttctccaccctcttcctcccccttttctttggttccttcctttaccttcctcatgcaatcacttgctctccatgtgggagtttctcacccacactggggctcgtgagaggaaaggaacagctctcccctggccagcctggggggcttcctggaggaggcagacagtcttggatgggcatgtggctccacctttgtggtcttgccctctcccctcctgcaggcatcagatacaacgccaccatggatgagaggcggtatacaccgagggcccacctggacgagggcggggaccgattcaccaacagagccgtactgctctcctccggccaggagctctgtgagcggatcaacttccatgtcctggtaagctggcagccccaccagcagagcccaggctcctataggaaggagcatctgccgtgggagaggcagagagtctgcctggctggttctaagcccccagcagacctcaggaagccagccagggacagtgtaccctgaccttggccactccacattcccacctcatgccccagagacacgctacataccacctcactagacatccttccaaaacctcttctcctgccactctcagatgccgaagggaggaaggtgggctcagtaggtccagcagagagaactaggagcagctggtggggggcacagccccaaagggagggataagcaggcagcagctaacaattaaaggccaggtccaggagacagtggcatgtacaaaacaggaggtgagacagagaggggcgccagtgatgtcacaagtagggtagtggcctggtgccccattttatagctaaggaagagaatgagaggtttacttccatccagagataccaaatacccagctcacagctccagccccagagatgcaagcagggtcactcagagccctcctggtcccagtagttcaatggccagagttcagagatgtgagcaggtctgagaaggtgcatccctgttaaggggccccctgagacgcatccacaccagcagcatcttcatcctccccacaaacttggaaattcacttgttctgactcagaaactctggggctggggctggggctggcgccagcaccctgtgttttaacaagctcccaggggactctggtgccagctcaggtttgagagccactgcctttatataatcagggattgcaggttccaaggggaaatttttaggctgctctaagcaacccctttacttaccatctatgctcagaaccaacctgagcgcccctgtcttgctcacgagtttgttcattcaccaattccacatgctgaagcccttatcacagtgctagggccatgctgggaggctccaggcctattccttgcttgggaaggaagagtgacacacagtcatatggttcaaatgctacatgagcagcaggcgtaactggtctgaagagagtggtgggtggggtgggatacaggcgggcactgccaggcttcccagaggccgaggtacccgggcaatgggagtctggccccgaaggatgtgcaggagcttggcaaaacagccaggcagctaggttggcatgagctgagcttggagctcctttcacagaagcacactcttcccaccaacagacccgctagaaacctccatccacctgcagactcaccctgagggcacagggcagctgccctgccatctaaggaaggtggaagttctatctcagcatccacggtcctggctcataaaatgacgttctctcctccctcaccgctgccctcatctccaccccccaggacactgctgactacgtgaagccagtgaccttctcagtcgagtattccctggaggaccctgaccatggccccatgctggacgacggctggcccaccactctcagagtctcggtacatctcggtacagggcacgcacctcgggcatgaaccccacccccacctccacctcaaccccaaagcccagagcctgagtgtgccgggtacagaggacaccatccctcatctcaccttcccacctcctgtcctggcaaacccacagtgtggctccttcctgcctctctcggggcctgtgctgagtgttagcagatcaattccttaagggcaaggcccaggccttctcctgttcaagtttccccgtatccccagcacaggggagcacagggtgagcaccggagaaatacaaagaaccactggatgagaagggatcggagatcttaatcacccacctccctcctttacagatgaggacaatggagaccagagagtgactcttagagcctggggttctgcttgttaggtgactaactgattcacagagctcctaagtattgcaaaaagaagtgttttaactgactgacagcggtcctaagcattccaaaaagaagcggccccatccctcagccacattttctaatccctggctctggggcatccaaaatgtttgacatctaacattcaaatgctccctgcagccgcaactccatgtaaatcccactcaaggaaaatgtcaggcagtgatcaattctgctgctgtgctgcaagagcaggcaaaagttataaaatggaatagctaatgcctgaaccttgaggatttgggaaacaacttttaagcacaccacggtgctcttaagccattctgtgaggtccagtctctgagcaacgtctgtgtgagtgacagagtccagccaggaagcagtttcagaattattcaagttcttacctgcatttcttcaacaccaggaaaggaccgtacagtccacagcaatgcccctgaaaacctccccttctctcattcacacccatcatcccccacagcccctccacacccctctccccaggcctcccacagtcccctgccaaacccccgtcctcacacctcccctctttctcctaagtctgagctcctgggctggcaaagctggattcatcgttagtgagccgggagaaggggaaagctgggcgcactaagtcatttttgtcctctcgcagtaattacaaagtcactatggcaaatgaatgagtacgtggcactcaccccacaagcatgctgaagcccacagtgcagattaacacacagggtaatccctgctctgacaccgacgatctccgtgcaaggtggtaatgagcagcacaggtcaggtgggaggcagtatgcacttggaggacgtacaatcaagcaatcagatgataggtcagagggccttcctggaggagggagcctttggccagactttaaaggctaggcaggattcagacatgcagagacagggaggatgggcttttattccgggagagctgacagcatcaccaaggcagggaaataggaaaggcaggatgcagcttcaggtaaacccctttctcaccttataaagaaaaggtgagaaacagagctgaaaactttgtagagcagctaagtttctaaaactctgatttatctggatttctagcccccagcaagtgagacacattcttcccatcattctacagagtcttactttgcctctactaaatgcccagcgctgttctaataccataatatctggcctgttggggaagtgagccatcccatattattgagtgtaacagttgcttattacattaaattatttattttaatcagccagatagaaattcttctgaaggtcattatatagttctcaaacttcttaaacagtatgctgagtgggagctggctgttttttctttgagacttgaactcaccaggatgaactttggtgctagaatgccgtaaagcccctatcctgaactaagttcctttcccaaacggctccacggtgacccctggatatggcttcgctggctaccattgcagtcggcagatccaccttgcggtggggagctgaggggcgagatgggtagatccatgcctaaagcaagagcgtgtggatctgactgagggccagagagctctccttcaagaaaagttaatgaatttaagatacacatgactttgtgacacctgtttcctctcccctggtttgggctgtgttgtcggtagtgacagttactgcccctcagctccaggcttgaatatccatctgcctgctgaggtcctcgccctgggtgggccacaggcacttcaaactcaacatgccccacactgaacttctcacttaacccctactttcttttttttttttttgaaatggtatctccctctgtcacccaggttggagtgtagtggcacgatcttggcccactgcagcctctgcctgagttcaagcaattctcctgcctcagcctcccgagtagctgggactgcagccactgcgcccagctaatttttgtattttttagcagagacaaagtttcaccatgttggcctggttgttcttgaactcctgacctcagttgatccacctgtctcagcctcccagagtgctaggattacaggtgtgagccaccacgcccagccaacccctgcttttattaccaaatgccatgattatccttctagacacctaaaaaagaaactcagctgacaccctggacccctttctccctcagccccgacaacctccaggttcctattgatcccgcctctggggtcactaacctatttcctcctctcatgcccactaccacaccgacaccagcgtcatctcttgcccgaatgttgtggcagcctcctcaatggtctccctgcctcgagcctccatcttctcactccattctcccacagcagccagggcagccttcagcatgcaggtctgtcaggacattccctgcctgaggcattcggcgactcctaccagttgcaaggaatgaccccaaggccctgtaaacacaggcccctgaccatctcttcctctctcccacccctgtgtctcttaccacagcaacactgacccacctatcatttcccagactcaccgtcccgctcctgccccagggcccctgcatcaggccgtccttcctcctggacttcaccacctccatcccggtccacacagctaccttgaccgtccttcagaactctgatcccctgtcacttcctcgaaggcttccctgacttcctacaggccaaaacagctgtttctcctctctgcctcttctattcctcatgcacatttcttttcggtttttttgcacattttacactagtgatttgttcatacaccaatcttccccttgagctgagggcagaagctgcatctttcttgttttgtatccccagtaccaaagcccttgcccacacacagtagatgatcaataaatgttgaccagaaccgctctgctgggtgagtgggggtgggggttctgtgccatcagctcagttatgaactggaggggagccaggaggagctgagctttgagcatcgttttaaagagggaagcatctatggaaaagcacaagacagagcagtgtggtgtctggggacagtgcaggaaagccagcccatgtctagtgtggtggagacagagctggtgtacattgagggcgaggggctgcgggtccctacccagctgcccacacctggctctccctggcccaggtgcccttctggaacggctgcaatgaggatgagcactgtgtccctgaccttgtgttggatgcccggagtgacctgcccacggccatgtgagttggctccttccacccccaccctcgccccttccccttcactgccagaggctctggggctcctggggccctggattatttcctggacatcctcctcacaggcagcatggatcaaacattgcacttggagcctgcgttctagcccaggctctgccaccaactcctgcataacctcaggaaagtctcttctgtaatatgaaactactagtctaatctaatttcaaattttgttaaaaaaaaaaaaaaaaagaaaccctttcttcggagcccacattacaaaatagatgaaaggtagagacaggagtctctggagttctgggtgcttgtccttcagcccccagatgaggtgacctctaggcccgctggctgaacaccttgggctttccaatccttctgatggaaagatgccagggacaccagccgagggtgagcaggggacctacaatcccctggaagagacaaacgaacatacaagggaaaataatgaacaatatcatattcttaatttatgtaacatattttccaataatttatgctcaactttgatccaactatgagatgatttagatagaaaacatatataccatgacatagataataaagagaaatagcacattcaaaacttgtagaaggataatggagcacatattctaaccagctaggctaaaataaggattatctctacattagtgctgagcttcctagcagccaaggccaaaagggaaacatgatgtgcggagtggtgatgcgtgagtggtgaggtcaaataagagctctgggttcagcggagggtatgatctctatggtggggacaccaagggcctttgaaataggaagtggtcttgaagggtgagctctttccagccctgccatccatttccactctcctcccagtggctattcccatgagcagaggccagtcaagtgcccagacccacctttttgccccaaccctggggctcctctctacccctgctttcctcattccatctgcccagtctctggtggtctcttgttctcagggagtactgccagagggtgctgaggaagcctgcgcaggactgctccgcatacacgctgtccttcgacaccacagtcttcatcatagagagcacacgccagcgagtggcggtggaggccacactggagaacaggggcgagaacgcctacagcacggtcctaaatatctcgcagtcagcaaacctgcagtttgccagcttgatccagaaggtaagacctcagcgacctgcccagactgcctctgcctggcacagaggaaaaggaaggccaggtgggctcctggctacatgttggaatcacaagaaagctggatgcagtggctcatgcctgtaatcctagcactttgggaggctgaggtgggaggatcacttgagcccaggagtttgaggccagcctgggcaacatagtgagaccccatctctacaaaaatatataaagtaattaaataaaaaaaaaaatcacaggagagctttaaaaagcctgcccccagactcctcctctggagatcctaactgatttgctctggggttgggcctggcatcgggaggcttttaaagctccctcagtgacttcagtgtgcagccagggctgagaaccaccggcactaggggagtctgagccctttgggaacacagggaggaatacccttcagcccgactcctgggccctggttaggggcacacacaccacgcatgtgccaccagccatccacacgttctaccaacagtgcaccctgcaggcttgctcggaaggtccttctgacaagaatcagaaccggttcttccccaggttaaaacttctgatcactcccagctgctgtcagaacaaactccaggctcctcattgtggcattcaaggcccatctcacccacctcctgccacttctcctctaactgtgccacgggccaccttgttcccagcacgccctgctggttcccaccatggcccccacctgggactcctctctcctctgcccaacaggctcctgctcccacttggtgaccatccacatattgcctactcacggcgtccagcgctgtgctagcacttggcatgcatttaacccttgcagcaacctcagacatagcagtagtggtggtagtggtggtggtggtgtccccattttacagaggaggaaactgaggcatagggaggggttaaggcctgcccaggaccacacagctggtgagccgcagagcggaattcccaccccacagctggcgcctgagcctgcgctatgtgacaaagcatagtcctcagccctgctctctggggtatctttcccaaagctctccaaggccacaggcggccctccagcccgcatagcatctggtacagcccttcatgtgctctgaagaaacatcagtctccaagtgctggcctcttgaaacccttgactcccaggtggcaagagccctgtcttagccatgtctgtgtccagagctgggcacatagaaggccctcaagacaagtttgttgagtaaactcagacatcaatgtcatgtgtgggtgttgcgggggtcctagggccctcagacacagcctctgtcctcgaggatctcagtgtcaatgtggaacccagtgtgccaggcaagacaggtgccaggccagtctgtcctctccaccccagaaccactgcccagcacccctccccaagtgccccccccttgcttgccacacacacaggagcagttcctatagccaggaggggaagctgagtggagggaggccaccccaggaaagcgaggagctgcctactcgggtacccccttcctcctcagtgggctcccccatcctcaaacagacctcaaggcctatctgcagccacagttccttctgtcaggcccaggcctgggccccaatcccactccctctccactgcccagagtgacagcccaggctgatgatgaagagcccacctgatggtctctcgaagtcccctcctgtccagggacttgtgtctgtctggatttcaggtatacggagggaatcaagccccacaccagcatccgccttcccctgcttccctggcccagacttcacaaggccagtctcatgcttgctcctaatcctggggagggaatcatggagatagtttctgtggctcagaagagcttttggaaatgagtggaggtaaagagaagtgggagacatgttctgtgaagtgctgtgtccccacacatagcaggtggggtgcagagttagcctggagcctacctccttcacaggtgccaccacccatccccaacccaggaaacgctcatggctgtgaggtcagcattcctctcctctctctccccaacatccagccaaggggaactctagtagagaaagcacccctctcagccaaatgcagatgtgttagtctgatcacacactttttgcacacacatgcaaaaacacagcagcctacatatttgtcctgggaaatgcacatgctctgtgtacatgcagcaggtacatgcacacacatgcactgacacgcagacacacacagagtctccacagacacatgctcacatccacacgggtgcatgcatgcccagagacatacacagccatgtgcccaggtaatgcccaacagtgcagagaacacagcagggacaaataatcatcataactgtagctgccacatacgagtgatgacaataggcagggcatgggataggcgctgcatttatgtgcatcgcgtcatgtaatcctcataacaactagatgaggtagttactgtcatccccatttaacaggtgagcaaaatgagacgcatacatgagcccccgccatcctccccaccgcctctgagtgtgtcccgccccgtgtcatgccaagtaccaggaaccaagccacaccctggcctctggggcctctggggtctcagacatcagaagggctgtggtccgggctttcatatgggtatcaggggctgaggcggcccctgcagagtggggtgcaggctgggggtgagggagcctcgagacctggtcccaggccccacctaactgctgccatgatgtctgccacccacctccaggaggactcagacggtagcattgagtgtgtgaacgaggagaggaggctccagaagcaagtctgcaacgtcagctatcccttcttccgggccaaggccaaggttgagactggggacaatgtgggggagggtcagggtgggcactgggaggcacaggtagtttggggagggcggcaagagcaacaagagtgaacacagaagaccagggagggatgggaggcctgaggtggcttttatttgtcttttctcccacaaaattacattcaagtgaccaaatgagccagccatccccatgctagcagcccatcctttaactcagagagaattcctaccactcccagccactagtctgccacctgcccttagccagtcccactgttctgcagcctcacaagtttttcaaatttctggcctctgccactgtgctgtgtatgaggagggatggggagagaaactaccatttcgtgagtacctaccacccaactgtgcttaaaagctcatgtgaatagagggtgggtatgtgaagggagaagcaaagtagctgggaaagggagggagacgccagattgcagggagtgtttggacatcagccctgggcagcaggcagccatagaaggttctggagtaggagacctaattgaggccaagctgcgtggacttgggaatcagagaggagctgtggcaggagccagtaggcggcagcagtgctcccaggagcagggtctgcacagctggggaaagagaaagaaatgggagtggggatgagggctccttagcaaagcacctccctggtgagatataagtcaaaggtgtggtttctgggttgaggcaccgacaaacccaggagctctggagtggggatggagcaggacatagcccaggcttccccacccacgcccagccactcctgcagagaaggggccgctgaggtctcctgggaaacctcgtgagggtgagaccagggagcgcatcaggggtctgtgcaaagcctcagtaatgcccccaggtggggcagggaggaggcgaggagggtcgcatgtttccccaccgcggggcgaagggcaaggggagtatcagggcccaggtcagcagtgtggcagaagcgctgccagacaaggggcggatgccttgttggcctgctgggtggccactggccctcatccctctctgggccatctcctccctgccacacacaaagaagaggtggacaaggcagtcctaccaaacgtttctggcccccacatcctgtggtgcatggcgatggccatcggcccttcctgccatcaaggacccctaccctaaaaaccctgcagacagagtctggagctggacttgctgctttctggttgccttttgctaaaaacaaaagaagaggaagagggaggggggctggctcagccccgagaaaccccattgtgggagctgttgtctttggctgtgtccccacagcagccctgaagctcagctcatgttctgtagcacctggtcctccctttcccagcctgttcccagccagcagctccccaacccccagcaagctccctctccccaagccagcagggggctgtggggagtgggctgtggggagtgggcggggctggtcccagcaatgcccagacatgcgactgcttccttgcaggtggctttccgtcttgattttgagttcagcaaatccatcttcctacaccacctggagatcgagctcgctgcaggcaggtcagggccgtgcctgctccttctccccaaagcttgctattccggggcccagctctctggctgctagcaactgctcctcccgacactgagtccgctgccccacgccctgtcccccactgccccaaccttgagtggaggcagtggggtggggaggtgggccggcatccgttgcaggtgtgggccaacctgctgccccctgtgttgccaccactcttcattctttggatgataaataataatgtcagccctttacttttagacagccctgtatacagcagtaattcacaaaccctatggttataaagcattgtacaggcaaaaatctcagtcctcacagaggccccttaagatcatcaaagcaggggttattccacacaccatcttccaagttaagaaaagagaggctcagagagggtgagtgaatttcccagggacacacagcagtaaattgtgcagctggaagctgaacactactcgtcctattccccatccagggctcttcctgtcctagtcacctctctcccctttttctatttttaagaggccttttcttactctatgtgggtcttcctgtctatctgtctgtctgtctcccaggcctctcagaggtagcttgctatgtgttgaccccatgaatcactttgtgtcagtagtaaatacacttctcttttttgcagaattacctctgtgtggggaaggacagagggattgtgtccactctggagccttataaatggcaaaaatccttagctaagaaataaataccccaggcaaaccgaacactaacattccagcacacacacgtgcaggtcagaggtcacataagcgctggggactcatacccgacacgtgctcgcgtcccagctacagttaaatgaattgtgcatcctggtagaattctcacacaccacgtggcaaacttggcgaggcctcccttgctctctgccctgctctaagaaagcccagtcccgtcttcacaggagaaatgagcgcgcttgcagagcagtgtctctggcacagctgtggggggtgtctgagaattaggtgtgtgtaggagggggctctggaggcacatctgtgtgtgttgggtctcccttttctaaccaaacccctatcctggggtaaggcttccaaagggaatcaaactcagtctatataacaagcaagaactgtacatttttatgtctaaaatgatttgccccggtagttcatggtgctcagatataaagggaggcacactggacagaacccccccggaagatgtctctgaatttcactcccagccttcttgtggcagcagagtgcccctggccgccctgtaggagctgcccccggtcagtccagggataaatgaatgactctactgtgaattcctcaccatccctcctccgtgggcacagcctttgccacaggtgtcatctcccacagcccctgagtccagcaggcagcaggattggcccgcctgacagacggggcatctgggtgagggaggcaaacaggctggggtccagtccgtgccaggccaggcacaggcctcccaggtccagcccagagccctcccctgactccacctaaaggggcagcaggtagagctagtgtcatccatccctgcttctggcccttcctctcctaggagatgcctcaggttccctgtctggcctgtctggtgcccatcagccccagataagccagtgtgctccttccacagtctgcctcagacccttcccgctgcctgtgctggctgagccccttcctgaccttgccgcctggctctccttgcagtgacagtaatgagcgggacagcaccaaggaagacaacgtggcccccttacgcttccacctcaaatacgaggctgacgtcctcttcaccaggtgggccgggctccgggggccccaggagagggaaggcatggggaatgggaggagggaggcctaagggggggcatcctctgatgggccctaatagggccagaccccagcactaagggactatggatggagccaagagtgtccctggtgggtcagagagtgcagcacccccatccaatgtggggaggggatatcaaattagaggaaggaggagacacaggcccggccctggggagctcccagcaggggcaagaagggagggtgggggcagtgggaggcgtccacccctggcataggcaacaagtggatgcatggtctgtagagaatttaaaaacagaaataatatctatcgtaagtcaatctgctttttgttatcatattatgccagcacatctaaacaatgtcagtgggaaaagactcttccccaaaggacagactgctcccacccccacccccttggcatgctactggcccccaatctgatggaggaaacagcccctgtcctctgagagctcatgggcagatggagaagtcagggcagaacagcagatacggagaggaagctcaggccctcccacgccagccatccctagagggtggaagggagcacagtggcatggtcactccgaaaagtagctacactcctaggcagagacgctggggcagggatgagataactggctcttctgactcacgcccacccactcaggaggcagacattgctcacccatggcagcgctgattcctgcaaaggctcagaatccttccaacatgacactcactcccagccgacacaagcgggaacctgtttttcgtggcccgggggaggccggcacatgccctctccctctttcattcatctgtccatccagccagccctgactgagctcacgacagccctgtcctctgtctccgcaggagcagcagcctgagccactacgaggtcaagctcaacagctcgctggagagatacgatggtatcgggcctcccttcagctgcatcttcagggtgaggctggaggggagccgggtagagggggaaggacgggatctgagcacccccatcctggaggggaggaatgtggaatcatcgctagtgcccggagtccagcctcaaccctgccacccacccactgtgcgactttagtcaagtcacttctcctctctgggcctctcagtcttcttttgaaaaacaactggactgcagtgggggatgtatgggtgaagatagggtgtggttgcctaaaattcttaaattttttttaaacagtggtttaaacacactagggtttactctctcccataaaagaagcccagagttggcagcttcacaaagtcattcaggagtgggtcttctattccaccatcctcagcgtgaacttaccagcctccagttcacctcacagtacaagatggctgcagctccagccatcaccttctcattccaggcagcaggaaggaggaaggggagaagagcatgctccctccttattaagggacctccctggcagtcccttactcttccagtgacctctctttatccagaatgttgtgactgagccataagggaggctgggaaatgtggccttttgtctcggttctgccactaaggaaagtgggagaacgagagttaggaggcaatttggcagcctctgctatagtgggccccgatagctccctcagccctgaacagctgtaagttcatcagcttctcttaggctgtgtgaaagctgagggcaagctgacagctggatactggacttcagacacgctgagccctacatggcttgttcaagagaggcctagtaagctgcccagggtcacacagctcataggtggtggtgggcccaggattagattcctggtctttctggttccaaagccctgcttggaatcactgctgtcctggcactgaatgtggcactgctagaatgtgaacaatcacgcactccttatttagtaataaatagcgagtttaattaattaaattaattgttaattaatgattccctctcatgatgtattcattgctgtcaccatcttcacccctggcctcaacaaaatccccaccccaggcaagaagagttgaaaatgcaggtggcccctgctctccggcctcaggatccccactgacttgtcttcagcttccagccacccatcccctctcagggctttcttgcacttgtccatgcagtccccggccacaatttgacagagcttaggagcttccatggtgaaaacaccaggggtcttgagtgggcctttttcccaggcctgatgggggaattgccacccccaggggctggttggcccctgtggaccttgttttccacccccctcaactgactgtactgacacctccctgtctctggccacagatccagaacttgggcttgttccccatccacgggatgatgatgaagatcaccattcccatcgccaccaggagcggcaaccgcctactgaagctgagggacttcctcacggacgaggtagtgatggccttgggagccggctaggggaggggaccagaaggagacagacactccccctacgtgtgtccccaggttcccagaccccagctcccttctcccaggaccacggctagaggaggagaaaagaaacctctctgggatcctgcgtctgccagagctggttgtgaggctgtgtatgtgtgtgtgtgtccatgtcctttatgtaggcgaacacgtcctgtaacatctggggcaatagcactgagtaccggcccaccccagtggaggaagacttgcgtcgtgctccacagctggtgagtgtcccccagaccgagagccacagtggttggggttagaggcgtgccgccggtgctctgcgggccatttccctcccgacccaatagcttgccaataagagcttactgagcacctgtatgtacccagccccaaaccaagaaaaaaactgaaggaggaaaagacttcttggcctgtgtgagtcccccgtctcacagggagtgggacaaacacacagagtgagtgtctgagaagccaaggtcacagcctgtggtgtgccaggcaaacgagcagaaaggggtggggagagtggacttgcacctgggccaagcgggccagtaggatacagagaggcagagggaaggggaagaaaacagacgcagccagaacaccagaacacacacgtggcttgtattggagacatttggctgcgtcagctggggcctcctgccctagagatggaatgcagaccagcttcaatttccagagccctcccaaaacacctgctcatttccagtttgcattctcagggttgcctctgcctccagataccagtttctcaccctgcttccactgttcttcccccagacaacaatcttccctgttttagttttacttcccccagacaagtacctcccacaaagcacttactgagggtagtgggctttgccaaagatttaggctgggttggggttggggtgggcagcacggcagcaacactagtaactttcacctaataaattctaattgtttgaagatttgtttgggtttcccattaacgttagtttctccacttaatccttatattataaatgatcttgaggtattactctaactaagacctccagggcaatggtaaatagatatgatgatgacagaataatcaggattaccttaatcatgattacttaaaggaatttatttttattttgattgttaaatatgatcattgccctaggcttcacacatgaggggatttcaaaatcattaggcgtccgccttccagtcctgatttggctccttctaacttcttttggtttgctaatcttaaaaaaaatctttaaagggcaaccattattcctcagctaataatgtaaacaaaactgcattaggccgtgcacggtggctcatgcctgtaatcccagcactttgggaggccgaggcaggtggatcgtgaagtcaggagcttgaggtcaggagctcgagaccagcctggccagcatagtgaaacctcatctctactaaacatacaaaaatcagccgggtgtggtggtgggcgtctgtagtcccagcgactcgggctgggcaagagaatctcttgaacctgggaggcagacgttgcaatgagccaagttggcgccactgtactccagcctgggcaacagagcaagactctgtctcaaaaaaaaaaaaaaaaaaaaaaggactgtattgacatggttacattcccaggactcttagtcatttaagaatggactacatggttggtatcattgcttacaaaagtgtcttgaacttgatgggcttatgttgagaagtaaaatttaatttttaatttttaccttttaattccatttttccacaaactttttgaagtccctttgagaggagcgagcaggagcattgtcatggtggagaaggagtctctggtgacattttcccagccatttttctgctaaagctttgattaactttctcacaacactgtcataataaccagatgttctcattctttggccctccagaaagtcaacaagcaaaatgttctgagcattccgaaaaactgttaccataacctttgctcttgactgatctgtgtttgctttgactggaccacatccacctcttggtagccattgctttttttgtgctttgtcttcaggatggtactggcaaagccatcttttatccgttataattatttgaagaaatgcttcaggatcttgatgtcacttgtttaaaatttccattgaaagttctgctcttttctgcagctgatctgggtgcaacagattgggcacccgtcaagcggaaattttgctcaactttaatttttcaatcagaatgatgtaaactaagccaactgagctgtctatagtgttggctaatggttctgctgttaattgtcaggcttcttcagtgagggcctgaacaagattttttttttcctcacaaattgatatgaatgatctgctgctgcaagctccatcttcagtgtcctctaatcccttttcttttcttttcttttctttcttttcttttcttttcttttgagacagagtctggctcggtcacccagctggagtgcagtggcacgatctcggctcactgcgacctccgcctcccgggttcaagtgattctcctgcctcagcctcccaagtagttgggactacaggcgcgtgccaccacggctggctaattttttgtatttttttaatagagacggggtttcactgtgttagccaggatggtctcgatctcctgaccttgtgatccgcctgccttggcctcccaaagtgctgagattacaggcgtgagccaccatgcccagccctctagtccttcttaaaacaagttatccatttgcaaactgctgatttctttgtgatatcatccccatcaactttttataaagcatcagtgatttcactgttctttcactcaagtttcaccataaatttgatgtttgtttttgcttcaattttagcagaattcatgttgctcagataggggctcttttcaaactgatgtcttatctttcttagtgcctcaaactagatcctgttcacataggttacaacaagttaatacgagtttattttggggcaaaaaaagttttggaatccatgcataatttttccataatacacattttccatgaactttatgaagaccccttttatctgattcaggaagttccctgggagtttttatcatgaacagaagttggacttcctaaaatactttttctgcatctgttgcagcgatcatagaattttttaccttaatgtgtttatatggtgataggaaacatttatagattccctaatgttgaacaaaagttctgtccctggaatatatccaggccggtcacaatgtacagcttcaagtggagcatcagatataccatccttcatttgtccttcagtcatcccctggcagacgcaatgcacatgtcccccactcccaactttctctttgtcccctgtcctctgcccctgcccccaggagcagagccccagtcgttcaagcagtgttgctgccccctgctcccctagcccagcagctcagccctgagacccatcttctctttcagaatcacagcaactctgatgtcgtctccatcaactgcaatatacggctggtccccaaccaggaaatcaatttccatctactggggaacctgtggttgaggtccctaaaagcagtaagtagagcccctgggctgggctggaaggaagaagggaaagggggcggctgttgggatgtcttccacctggggctgcctggggaggggacgggaagaaaagcttccaagccagcttctgacgagccctctgattgcacagctcaagtacaaatccatgaaaatcatggtcaacgcagccttgcagaggcagttccacagccccttcatcttccgtgaggaggatcccagccgccaggtgagcccctgggagccctgcagaactgggcttaggccggacagcttgggaaagggttggccgtgctcctctatagagttttcctacaacccctggctgcatgtcccagcaggagagaatcaggcagacctgtgggctgttagggcagccgctgaaaagagggaaaaaagcaagacaaagcctcaggggcaacactagggaaggtccagaggtctggtgtgaactgaatttgtgaagaccaaaggatgggagatgcctcggtatcagcctctgttagttgcgtaaaagcagattgttacagattacactggcttcatccagggtccaggaaaggagtgagactctgtgagacccaacgagaagtgaggtcttaaagaaaagcccattcctggaagaagtggcaaaggaagaaaaaagaaaagaaataaatttgtaaaagaaagcaagcaagcaaagcccagtcctgtggaaatagacagggcagccgggcgtgggacgctgctgccctccactggccacaccccagaaatgccagcttgggctccaggcaaacattcctattacagaggcggagtaagctcccaacaccaccccagggagatgctggagagcaaagaggcggggtcaggaagcatcccttataaaacaatccaacaaaaaccaatcacagccagggcagggggatgccaggcagaggggtatcaggatccacctaaggagcttttttgtttgttcattcatttggcatttgttgggtgtgtctcctacggcttgggccccaaaggggaaacagagataaattaggcagacagggaaacagtgacaataaatgggtgagtgcagtctgggggtgagcacaggcccggaggggagcgattccgagcgagggacatccccggaaagctttctggagactgtttgaaccgaatcttgaaagatgctgcaatgttcccagcatccaagagagggaggtgtggtacaggcacccccgctcccccacacataccctgctcacacacacagagagagagagagagaacccttcttctcacattgatgcttgtcttttaggtgacttttccttcttccacccccactcaaccccccaaaaaattcctctatactctctggatgcctcactcccttttttttttttttgagacggagtcttgctctgtcacccaggctagagtgcgttggcaggatctcggctcactgccagctccacctcccaggttcatgccattctcctgcctcagcctcccgggtagcaggtattacaggcgcccgccactacgcctggctaattttttttttttttttttagtagagacagggtttcaccgtgttagccaggatggtctcgatctcctgacctcatgatctgcccgcctcggcttcccaaagtgctgggattacaggcatgagccaccgtgcccggccatgcctcatttctcttttagaaatccagcaaccccaaaattaagcccctgtatgctgggctgtgtgctaggtgctggcgctggggaggcagagccaggtgcccgccttgagggacagaaagagcacacataagggccctgccatttgctggcccccagctgtgtgctgaacatggtgacagacctctcaacactgtgaggcactgtccccacccccatctctcaggtatgcacaccgaggcatgtgagatgaggcaggagggacagtgacttgcctcaagttgaacagtgagtcagtggccaaaggagggctctgtctgctgttgcaggtggtccattcactccacatggctctgtctgctgttgcaggtggtccattcactccacgtgttagctgagctcctgctacattcccggcacggctccaggttctgaggatagagcagggacaaaacagacaaagcccccactctcctacagctgacattccaggcaggcaataaacataaatataaacgttatcaactggtgataagggctacccagaaaaaggcacacatctaagggtggagtgccagggggtgctgttttatacaggggagttgggaaaagcctctccaataaagtgacatcagacagagaccatgaggaagacaggagtgtctcgtggctgcgtgagggaaacccttgcaggcagagggaatagcaatgcctacagcaggcacgccatggcatgcatgctggaggccaggtggctgaaagctggagtaaagcaagagggagcaggaggtgaggtcagcaagacaggtgggacccgagaggggagggccttgcaggccagggccaggactgcactttttactttgagcttgagcagagcagagcagagcataagcctgccttcctcgttagaaggatccctctagttgctatgctaagaacaaactgcagaggggaggcagtcgggcagcgctgtagtctccagaggagatgtgagggcactcaggcccaggaggtgggagtggtggccacattccaggtgtttccaaggtagaatggacagactttgctgctgggctccgtgtgggtgtgagagttagggtcagtgatggatacatggcttctggcctgagcagcgcggagggatagtgctgccatttgcttaggtgagaaagagctggaaagagcaggcttcgggggctggggtgttaagagcttggttaggggcctgttacagttgccaggcaggccaggagacagtcggtgtgagcctggaattcagcggagaatccaggcggacgacagaaatgtgagagcagtcggcgtgtagacggtgatagccacaggactgagggagctggcctgggcttactttctgaccttcacgccctggccacttttgcctttgggacaccttcctccataggaaaaaagtatttaaaattatggtttataaccatgttgatacaaagattaaaaaatgttatccaagctggattctattccattttttcctctaattttaaaagaaatgtaaacattttcatgggctcctaaaagtgttatgggccttggcaccatgactactgtgactcgtgggaaagtcagccctgagttcacccaggaagtgactctagaaaaagaagaggtgcaaggactgaaccgtgggagacactgacctttagaagtgcgggaggcgatgcggaggcagcaaagggagaaggagtagcccatgtggtgggaggaggatccagggagtggcgggggcctgaggccaaaggcagcaagtgtctcaaggaggcaggatcacttgggccactgaacccagtgtcggctgttcaggcagtggtcgtcctgaggccttggctggcctgtccacccatccctctggtatccccctgaggaagaggatgcagctcccccaccaggtgccagctgtctccaccctcctgcccctcccagactgccaccccagccccagaagagtaatgctgttggcccggcccccctccccttgcagatcgtgtttgagatctccaagcaagaggactggcaggtccccatctggatcattgtaggcagcaccctggggggcctcctactgctggccctgctggtcctggcactgtggaaggtgagggccctggcaggggagggaaggagcagcatcctggctggtgggcccaggctccagcccctggaacttcgtggccgctgccacgttctcctctccaggggagctggcaccccacccctcgccatagcagacacactggttagggccaacagacggcactcagactatggctctaacctgtttgtggatgcctttgagaacctgatgaaaactaaggttcctattattagagaaaaaaaaaaaaagcaagtacaaacaactgcacaaaatttctcccacaatgtcaagctgttaacaaacctcccgaagtccatctctgtctctgaagctctggttacaaacccctggtctcagcctcctcctgttacagatgaaggaggcccagagagggatgttggctggggctggtcacacagcaagatgggcactagtatgacttcttgcatgcagcccatggtctcatccactgtgttccagtccacagaggcagttctggaggagggggtgctcagaatgagctgggggtactcaaggaagccctgagggaggaatcccaaggaaaggtagtggagggaaagctggggcaggccttgcccaccctgtcctcctctgagacgtctccctttgcctcctcacagctcggcttctttagaagtgccaggcgcaggagggagcctggtctggaccccacccccaaagtgctggagtgaggctccagaggagactttgagttgatgggggccaggacaccagtccaggtagtgttgagacccaggcctgtggccccaccgagctggagcggagaggaagccagctggctttgcacttgacctcatctcccgagcaatggcgcctgctccctccagaatggaactcaagctggttttaagtggaactgccctactgggagactgggacacctttaacacagacccctagggatttaaagggacacccctacacacacccaggcccacgccaaggcctccctcaggctctgtggagggcatttgctgccccagctactaaggtgctaggaattcgtaatcatccccatcctccagagaaacccagggaggaagactgtaaatacgaacccaatctgcacactccaggcctctagttccagaaggatccaagacaaaacagatctgaattctgcccttttctctcacccatcccacccctccattggctcccaagtcacacccactcccttccccatagataggcccctggggctcccgaagaatgaacccaagagcaagggcttgatggtgacagctgcaagccagggatgaagaaagactctgagatgtggagactgatggccaggcaagtgggaccaggatactggacgctgtcctgagatgagaggtagccgggctctgcacccacgtgcattcacattgaccgcaactcacacattcccccaccagctgcagccccttgctctcagctgccaaccctcccgggtcacttttgttcccaggtacctcatgggaagcatgtggatgacacaatccctggggctgtgcattcccacgtcttcttgctgcagcctgcccctagacatggacgcaccggcctggctgcagctgggcagcaggggtaggggtagggagcctcccctccctgtatcaccccctccctacacacacacacacacacacacacacacacacacacacacacacacacacacacacacactgcctcccatccttccctcatgcccgccagtgcacagggaagggcttggccagcgctgttgaggggtcccctctggaatgcactgaataaagcacgtgcaaggactcccggagcctgtgcagccttggtggcaaatatctcatctgccggcccccaggacaagtggtatgaccagtgataatgccccaaggacaaggggcgtgcctggcgcccagtggagtaatttatgccttagtcttgttttgaggtagaaatgcaagggggacacatgaaaggcatcagtccccctgtgcatagtacgacctttactgtcgtatttttgaaaaattaaaaatacagtgtttaaaaacaaccaagcactgacatcccattctgtgggcagagcatatcacagtgagccatactcccctttgaaggagaggaagtagaatgagggagttccttgcttcctcccccctacctctacatgtcagaagggactcatccaccatttgctgcccacaacatgccctcctagtggctgcctggcctccgtgtgacgtctccagtggtggagcgctccctctcccaagatcacccttccatctatggccagtgtggacggttaggacctaaatgtttcactgtagcttctgcccttggttccagctcttccctctcacgcctcccagacttctccaggccggtttcattgttaaccgtcttacactctgacatcagccaaggcgtctccattctgttcttgtgccattcatgtcttggattcccagtaagtagaaccttggaaataatttgatcttgtttttgcataaatgaggacactcagaaccaggaagagccctaggctcccacagcaaaaccaaaactaaacccaggactgctatttcccaagccagattctgttattcgagcccagccttagaagggcttgatgtggagcaaaaggtgaaaatggtgaaactaaaatttgagtatcaaaacccattgccttctaatagaatcagaaggaaatgttgctaaatcatattccatttccgtcatcactcttatgaatggggtaacctggctaaatgagaattaatgaacccacactcataagttttcattgacttagcaccaagtcgtccatcaaatatcatcagatctgagaatgctcttatggatatctgatttttagaggctggcattcatatttttaaaaactgccacctgtgaccacactgcaggccaaacagaatgtacctgctggtcagatgcagcccagaggtcactgaattgcaacctctggactctcggtcagaggcaagcagcccttattccagaac

SEQ ID NO: 13764 - DNA, 44821 bp, Human
  misc_feature (1)...(44821): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggctcggccctcgaggcacagtcaccttcccttccccccgccattccgcccacccccctcactcagccacagagcagccgccgcgctcctcagccgccccgaaatctaaaggggtccgtctccggcaccactaccaaatggccgagcctccctggccggctgcgcagcccgcccattggtcccttcccccccccgccgccactgccattggctgttgcccggagaccctcggcggcgattggctcgggccgctgccgctcgtccatggggccgcagatcccgcctccacggcgatcaggttagtgtgcgccgcgggtgctgggggctcgagaaccgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgagcatttgccaaaaatatctctgtcggtccattctcctactttgtgtgtgtgtgtgtgtgtgtgcgcgctggggggaggcacttttttttggggggggcgcccgggaggtgcgggtttgggggtcggactgcaagcgaattggcaaggctggggggttgcaatgccatccgagcatgttccggctgccgccgccgctgcccttggtgtgtgactacctgtgcgtgtgctcccgcgtgtgcgagtgtgggtgcgagagtgtgcgtgcgagtgtgcacccatcgggggccggcgggcgcacgcgtttgggtcggagagaatgaggcgaaatcaccctcggagatcgctgctcccgtgactccgtctggggggaagattaacgagggaggaggaggagaggggctgcctcctggatttaacaacaaaaaaagggggttttacattttataaatgtatccccccttccgcccccctcccgcgcctcccccctccctttctctcgctcgctcgctcgcacacacaataagtttggggcttcgcgagtccggtttagtttctgataaatgtgggccgaggcccccggggagagcgcgtggggagggggctgcagcggagttgggaatggctggagtttaaagtgcgtcttcatttctttgcagtgatgaggcgagagacgggggagccatatttgtaactttgtagtgttcgtgaacgcgccctttctctccctccctccctttctctgcctcccttcctctcctcctctttctccctcactctttccaccccaccttcgggccagatgctgatgtttcttcctttccttccgaagggaggataaattagaaggagggggagggattttcgaacgtgctaaggcacagataatccccgcgtctccctgcctccagcgatcgctggtgcaagttgcccaaaggctacgtcccggtgccccctcgccccagctccttccggcttccccaagatgccagcctttgggccctggtgccccccagctcgaacccccggcccgtctttctcagtgctgggcttgtcggcagccattcggcgcctgcttaataaatgggcacgggaaactttgtcaggacgcgagctgcccggagctggcgcccgtggtgggtactggctgggtccacgtttatgcgggcatggcaaacacgcagctctaggatgggagtttgcccgctagccgccgttattgattgggcagcggcgggagcacggccggaggaaacttacacgggtgggaatcgcgaggctcgagcgaaagcttacccctgaggagggggaaggtgagggtgggtgactcgaacgctggtttttatttctgcctccctctcgctttcaaacctgagtgttttcggcgagttggcggctctggggcggagaccctggccagctcccctcttggccccttggggggaccggggacgcgctggcgggaggacgcccccagtctcggtggcccgagctccatggagttgggagtttgggcagcaccgtgcgctggcctgtcgcccctctagcccgttaaacccgaatcccggcgaaggcaggcctcgcttcctcttttccctagttcctcccccaaacctgagtgagacttttgaaaacaagatcctttttgtctaccccctccccgccttaacgcagctgtggactggagacgtgcgagtgccttatggcgcgcagggcggggagggggcggccgcgggagaggagggggcgccgccggtggaggccggagtttccgcgcactatttgcgggcggtttgcctctctccggccgctttcgtcccggccgggacccggcgcctagcgtttgggggctgggtgtggtgatgggggagggggccggggcgcggtcttcccgcgtactttccggaagccccctgcgcggagggggaagggcgccaagcgcggggccggggtcgccgcgggtgggtgcgggggcgcggctggcctggcgaacccgaccgacgctgccggccccccgggagcaagcaggaaagcgggtcgaaccggctctttaaacttccacgagtgtgtgtgtgtgttggggaggggagcgcaccgcgccgtactgggagcgatttctcacgcttcgccccctcgcctcccagcctcgcggcccacacgcctgccccctgcctggaggcggggtggggcgcgggtggcggaggagggggcactttctgcacatttgcgggggagggggagaaagctagcgaaagagggacaaaagggttgggggaggaggaactgtatttttttaaacgttcttaagacaaatggctcccggagcgcgccccctgcgcccctccccgccgcgctgcccctgggccccccacacacccaccttcggcacctctcccaactgggctccgggagctggtggccatgccgcgacgccgaaataggacgagcagccatgtttcccggggctcgcgccgcacgccccgcccctcctccccggcgcggggcgcagggctcggaatgcgggctccgggctccatgtggcgcggggcgctggcaggcgggcggcgggggtgcagtacgcgcggggccggccttgtggctttctaggctggttttgagttccaggtgttttatttatttatttttatttatttattttttttaacggctaggcccactcggggctgagcccgaagggcgccgaggcgttactggggggcaggagccgcctccagggccctgcgcgcctgtggcacgactgccgggcgccgggctgccattttgtcaccgtggctgttgtcgctgtggggggcggggggagcggagtcttgcgccgtcaccccgacggcctcccgcgcggaggaggcagggggagccggctttggggacccccagttgtgctatgagccccgatgggggtttccgccccgcgccaacggcctgaggctgtgctggagagtcacggcggccgcggcgccgggaggacgacgatcctctgtgcaaatgccccccccacgcgctccctgcctcccccgccctcctctccggggtttcgccgttcctcctgcaggcgctcagacgtagttaaatgtggccttaaggactaaccgatcgctctggtgtttgctctttcggcggaagtgatagagtaaggggaacattaaacatgaggttcttttggcgggggtgaggggtgtcgcgcacgcgactctagtggccctgactgaagccaaggacagcagcctgttccccgggagggaagagttgtcgatccgttggggaaacgccctcccgggctgggctctccgggaaggtaggtcgagctccgtgtttcaggtggatgttgcagcgccctgcaggctaggggaaccctcctcctcggtctaaacctgctccttcccccttttatttttgcctgggagaaggcagctacaatagtaatgagatcctaaagcgaaagagagggatgaaggtttgcttttgaaaaaagtaaaccgcctttctccggatgttgacttaggagccaggcaattcgtcgcgtcgggtcctccgatgctggcatctctgagaattttaaaaagccgatataggtgctggttaagcacctcacgagctgaactctggtatctgtgcagaaactaactttcatggcagtgtccagcagaggctgccttggaagccagcttttactttgacctttggaatacatcgcatgatgttttccaggctgacttactgcctaattgggttcaagtagcatgatattaactacagtttatgcaagccaaccaggaactcgcaggcagaaaattgagcctgagttcccctgtggtcatagtcagttgagttctgctgctgatagtagtttcgagtctgaggggctccatgatgaagatgggcttaggaattacacagacctgggtttgaattcctcctgccacaaggaggtaggatacgtttacctgcccttgtgaccttgggctggtgagcttaacctacctttttgaagctttgtttcttcacctgtaaaacggaataatcctatttaatcagtaaatgatgacaaaattggtttgatatggccctcagtatatgctgtctatatgacagttttagtctcggagacatatcagggtgcttccaggcattactttgagctcctccatggtttaggataataacaatattagctagtgcttacatagcaaccacgctgtgtctggcacatttcttaagtggattacatgtatcaactaatttagtccccacaacagcactatgaggtaggtattattattatcatcgtcattgtgcatatggaaattgaggcatacaggggttatcatgtgaccagtgagtggcagaaccaggattcaaactcagccagtctgcatactcaacctctacactctactgcctcctttgaaacaccctttttttcttaagatactgtaaggaagagctttttcttctccagctttggagtggtgccaccgtagaaagagaatgagttttctattattgaagacgctgaaatgaagagtggatagcatcctggttggagatattagagggccaggaggttcaggaccaggggctgtggattatcattttatgaagccttgcactgagtttgctttagcacatcacagtgggttaggttgaagtggatctggcctttaaggtgctgggggacacattttgagtaaggagaagacaagcaggagctgctcaggcagtctgcatctgcagccaaaaaaactcaacataactggcatgtctttagtatctgggacatagtatgctcatagcacctcatggatcatctcacttaatcatcccagcaactctttaagggtaggccaagcagtgcaatgccacccctgttgtgaggatgaatcatctgatttttggagaggttgagcaactggtaggtggcacagccgggttctcgcactgcaaaaccacaggcccctttggtggacagagattccgaggattggatagtccattgggtccatggcccattaccagaatcatgtgagaggcatgtaaaatgcagattcctgggctccaccccaatcacaggagtaccacagcaatcaccaaactataactgagctcccaatttttgtacagtcatgagctaagaattatttgtacatataaacgttgcagtcaatttgatggtatggaacactctttgaatcccaatgacttgaaatgttattctcccaaaaaataagaaatccacttgtctcgttaacagatctcgttacaaaaaaaaaattgtactcaatatattctgaactttatcaataaaagaattgtggaaatgtgttagatttttctcttgttataaaagtccctatgtagtgttcttaattttggctcttgataaagtttactatctgccccctttgcagaagaggtttgctgaaaaggtggttcagtagattggagggtgggcccccgggatctagtgttttgctttgtttaagcaaatggcaagccatatatttgggtggtactctcagggtctttttaagtccttttatgtgttctgtgccctgtaagtaattggtgcctagtggaaatcagcctcaacccaggaacctccataggaagagaaattatccttgttactggtttagtatgaagcacttctcgtctagagttctgtatagccagctgaaattcttcgttgtgtactcagaacatgtcaaagccttctgtgtatcttgtagttgaatggtcactcttaggttctagatgtcatctcagagatagaaagagctttgggttgcaacggttagagctttgaggcttgaaccaaaggcggggcagctgtgcacccagtggctcacatcagcctttcagagcccagatctttgaaaatgacagataatcctggaatctctagtttttggcctgctgcttttctaccatgcgtgtttcctggggaatgaaccagcagcatagtggctttgagtttcagaagtttttccctctagcgtcttgtgcctgagctaatgaacggaaggaatggttataaaattggccaggtcaaggggaggaggagataaattcaaggggacaaatcctagtccccataacagcagcctgtgttatgacagcacaccacagccccaattccctctttcctgctgctgctgcaccaccagcctctcaaggtggcttactctagacttacacagtgggccatctttctttttttttttctttccccatagcagtatgagacttgtttccttttttatttatttattttataatttttgtagagacggggttttgccgtgttgcccaggctggtctcaaactcctggactcaagtgatctgcccaccttggcatcccaaagcgctgggattacaggtgtgagccagcgtgcctggcccccttcttcaataccattggaaagacatctgcttgagctttcagagctgtccatcccagagcttgggtccaaattaattacatcacattgaaataaaaaacttcctggaggctgggtgcagtcgtcacgcctgtaatcccagcactttgggaggccgaggcgggtggatcacgaggtcaggagatcaagaccatcctggctaacacggtgaaaccccgtctctagtaaaaatacaaaaaattagccgggcatggtggcgggtgcctgtggtcccagctattcgggaggctgaggcaggagaatgccgtgaacccgggaggcagaacttgcagtgagcagagatcgtgccactgcactccggcctgggggacaaagcgagactccgtctcaaaaaaaaaaaaaaaaaaaaaacttcctggaaattgtgtaggatactctttagacatctcatgcctttgctattttggtgcagtcacttaggaaaggagcagggagcttgttggtgattgggccccggcccaatgaacgtggcccaattgtctggcctgaattctaacttagtttaagaggaggctcatagctctggtgtctagagaggcattcctttagaaatgtttgccaccagcatccctcctctttgttttggcagtccatcccttactctagctagttctctggtctcctaggaactaccctctcccagtcccccagcaccactgccttcaagtagagaaacatggacctgactctgaatcttctatagctttgaaatagaattatacaacaaatgataaatacccaacaatgatgttttcattaaagagatggagtctggcagggacagagatttgtgaaggcatctgttattcagaacttctcatttaataaaatttgttgaaactagatgagcaaagcaccatggccctgagccaccttctcagacatggaagcagcctccttgtctagaactagttgtcctgatgatatacagactctaaggaagataaaagtccctttattctaccacaccaagccctgtcctgggcctgctgggccacaccctgcaacccagtgctttccctcagatttattttgttttagctccacagctgccccctgaattcattcagctactgtttcctttaccaaaacttgctccaggcagcagatctaaaagatcagcttacttactactccactgttatttactctaatgtggattaaagtcagcactgtttttcccagaggtatttacatttggagattctggtttggtgaggaaattaccagagaactattaaagacttggatgctcttctcggctttgctattaagtaagttggacaagttgtttggcttctttgagcctctgttttctccattctaaaattctaaaatgggagtgttgaattagatcagtggctttcgaactttctgctcctagtagtgagaaatacattttactccactccctggtatgtacacgcattcctgtgttttgtgaaaacctgacaccatgctcctccctcactacatgtaaaacacttttattcattaaaaagaaaactgactggcttggacctacaaattagtttcattatttgttaatgtttgaaagccattaaaagatgaatattaaggtttctttatactcaatacttgtagttttgtttgggggaatgagaggatgcccttggtacctttgtgaggcctctccactgagggtcaatcatgacttctgttttaaaccagcccatcccatcttctccagctgctctccttatgtcttgcttctctcccctccaaccttctcagcataaggactcaatcctaggctcctaccccagacgggtgccttccaacgttcctggtgccagtggccccccatcagccatgttcccccagccccttctccacactcttgtcacccagggccccatccttcagtgcattgcacactttgcatgctgggtcagggaagattgtggagagaggacagtgcacctggtttcccccacatagactgcgtgggggtatgtcctgcttccgccacttccaactgtggcacttgggcacgcccctctcagggcaccttccctttttgtctccgcaaaatgaggttgtaatagtgcctgccgcactgtctggcacacagtaagctctcaagaaatgttagctgttgttgccgttagaacaccatagctagaataccatacctggcattcacttaagaaaaaaaaaaaccaacttagggccaggcgcagtggctcacgcctgtacttccagcactttgggaggccaagacaggcagagcacctgaggccaggagttcaagaacaggctggccttgtctctactaaaaatacaaaaaaaaaaaatcagccgggtgtcgtggcaggtgcctgtaattccagctactctggaggctgaggcaggagaatcgcttgaacctgggagacggaggttgcagtgtgagccgatatcgtgccactgcattccagcctgggcaacgagcgaaactcggtctcaaaaaaacccaacttacattatccgcagacacattacatacaaaagtaaccattttctttcaatgggaaaggaggtttagaagctagagattcaaagttaccaggagttactttttcccactaggaattcactacagtcctgacattggactctaggtagtttctactgagggtaagtgactcgtccctcttctgggcaactctttttcttactgccctcagcagctatttcaggcctccaccccttccctcccggccaggacgtcctcttcacagaaaatggaaacctcctggtttcttaagtagttgtgaggctgaacctgccttaatccctcccagttcagtggtcttcttgtcttgtccatccctccctcagttcccttgttcctcctgggcacctagccactcctgtcctttggattcttctccagctggggatgcttctcccatcttaaagcaaagactctaattgatcccgtgttgcgctgtagttactgcccatcccactcttctccctactccctaaactttctgaattgtctatcttctccatcctgtcacctctcttactccaccacgtgaagtctggtttgcttcctaaatagtgccaagaatcccaacagccttcatttcttatcttgcatgatgtctcagtggcgggattcagcattctttttttttttttttttttcccagacagagtctcactctgtggcccatgttggagtgcgcagtggcttgatctcagctcactgcaacctcgacctcctgggttcaagcgattctcgtgcctcagcctcccgagtagctgggattacaggtgtccaccaccacgcccggataacttttttatttttagtagagaaggggtttcaccatgttggctaggctgatctcgaactcctgacctcaagtgatctgcctgcctcggcctcccaaagtgctgggattacaggcgtgagccactgcgcccggctgggattcagcattcttgactttatgatagatgctctccctttctctggtatatcttctacggctctagtcactgctcagtttctggtgtcctgttgctctcctgtttagccatgaagtattgacttagtcaaacttgggcgctgggcattcttatcctgtattctctccagttggaaatttgtccttcctcactgacagctgcaggtactgcgtgctgctctctgaggtttgaagtttactgcttgagtaagcttgagacccacctgatgtctccacctgggtgctccaaaagtgccctactcttaagtccaaagggaacccatgtcctctgtcccttgcccaccactgcccacacacacacactcatgatcctctttccatccatcatcatcacaagtcttgtctgtttaaaacatgctctgttgcttgccactgatctccctgtatcatagtctagtcttcttgaagccatgctgtgaccttcaactagaatgatcttatcaaaacacacatgtaatgtcaccccatacttaaaattcaccattgttcctaggataaagtcccaaatctttaataagaccaacaaggtgctgcatggtctggccacttcccgtcatctgttcccttgccccactctctctgggcctccctggctgcctctcattcctgcaaacctgtgccacactgagattgccactgtatccagttagcatctagtcatctttaccatctccagcctcctccgtcaggtttagatctagttcttttgccagaaaactcttacagaacttttccctcagagtgcttcagtttgtaactacatattccagattatgagtgtttaattagcatctctgtccccttgcctaatgggtgcactgcacgatttgagggacttgcttttgctcatcattgtggtcttcagagctccacactgtgcctggcacatggtaagcattctagaagtactgatggagtgaaggatctgtggtacttataccttcttgtcactttcatcacctaccggttggtacatcaagcacgaagccactgaaacgaagcgcacaccttcacacccgcacccccacgcccgctggtgtgactttctgatggagttgctctgggtgggtgatgcacacttcttaggtcgctggtcatcatgtttttctcattatcacatcccttatcagtaaacaatttgaacctgagccccagtatgtctaccttgcagttatggattattcacatacactacctataaatatggacattataaaatgtaacgccaaaaatataaattaaaaaggatacatttaaacatctaaaaagtcctgaaattcttgcatcccagtggattggcttgggcagtccacataagagactactgttctaattaattgctcgttttattttaaattcagttactaaagttcactctgtaaaagaaacgctcataccttcctagacactgcttgttaagatctctccagctctagtgtgtgatgagtaggggtaggggacattcacagtctccctttaatacaataagctagcttgcccgagatccttggtgaatcaaggctccactgccgtgtgtcagcttggtgctctttgtttaggctgtgtggacagatccaccaaagtcccctccagtcacccctggggtcccacagaggtaaacccccgggttctctctgcccatgtcctgagaggccaggaagtagctacgataaggattccatcagccatagactcagggtgggtgggaaggtggctttctcctagttatcttggagtggggaacaagtaagaggcaggatgtgtgggctggaagggcagagacagaggtgcacagtgaagcttgaaagagagaggcccgcagagtgtgtttgctgagagatttcagcaaagttgtgctggaactctgcagccagcagtgcccagtgctgggtttctggattctgctgcctcctgtagaattcgtgagaactatgtgtgtatgcatgtgcgtgtgcagggggtgatagggtggaggcaagggcctgtcattctcaatttagaggaattactttcagatttcttcagggaccatgcatctggaggagggactcatcttcaatttatgtaaccaactgtcaccttagccattggcttcatgggcaggcctaagtggtgtaactgaatggacgggtgaggggagtccactgatatggcctgtgtgcccagcatcgggaatgagacaaggagttgtataaatgctatgtaagtatttttgtagcaaatttaatttcttgaatccagtccttgcatcctgggctgggtaggagagaagagagtggttatagtggatggtggtgcctggctcctgtggtggagctggagtgatggagcatagcacatacactgcagggaagaaggtgtgtggttagtaaagccgatttcaaccccagctgtggatcagaactgccaggggagcatctgaagcaatacccaggctctgcctgaactgaatcagtctctgagggtggtgccccagtctgtgtatttttagaaagctctaaaggggactctaaagcacagttgggaaccaccccatggagcagggtgcagagcttcacagcaggtaggaagaagtaactaagtggaaactagaggaaaatggagcagagaaaccaggaaataggaaagaaggatgcaggatttaatctgctggggttcagggatccgctccttgacctgccccccacatccccaccaccatgggattgttcacacaaccacgttctgctcatcacacttggaatttttcatttacgtgtatctcaggatgctgctcctgggagtgtcaagtgggcattaccgatcaagactggacttggcccatccttcatgtccagctcttgagaggccgtggaccttttgtaaaagggcgggggcccaggcgcagacccaggcaatcaggtacagtgggcagtagtgcttgagaactgctgagcctgaggatgttggcaggtcacctcactgagcctcagttgccacatctgtgaaacggtgaataacctgcttcccagagcttgttgttagcacggaaagaaatatcgtttatgccaggtatgggttgtagacggaccctgaaggttagattctacccgtcagggcttgaatgagctgtttggtcagcggtgggggtggggtggagtcagcccctctccagaaggtgcttgctggggtgggagcaagtctgagaagagctgtctcggcctgccccaggaggaggcctcgcctggagctgtgaagcggaggggaggggcagggaggctctgggcaaaggagagactcccccccccccgttttctgtggaggtggggcgggaggaataccagccaagctgcaggcatccccttgccccgggcctcttctggggtgggggctgtcgcgctggctcacctttcccatagcagttgctccgtgaccctagccttcttgcctttaaactcccctctggctgcagaagtctgggccagcctctcccagtcctttatctttcattcatacagctcctgagaggtccccttttctgggaagccctcctcaactcactggaagaaagggagcaaactgtgtccacctaggtgacataaaggtaaaagtcctggggacttccagggcacgcagcagcgttcgcctctcagccaagtccaatagcactcacttaggtgtgcatctgtggctttctctctgtctggtcagtgctcctttatatgtccataccccctgccagagggcagcattgagggtgtacagagcccagtgtgactctcctgcagctggggacatagaagagctctgtgacgatggcagatgtggttctccagcctcttgcctggctgccagtgggagtagcctgtctgttctggcacagggggctgttccatatggagggtcagaaactggccttcacagccacccaggcgttccttccacttctgcacgtcttcctttccccatgaagatttgggtgtaccctggttgtggtctctgaagactgggcaggcctgtactttgtgaagctttcagctgtctctggtaggcctgatgaagcctatctgcagaggttggcctgaagccataatgagcagttctgttctttttagcccttgtctagtttatggctctgttgcagacatgcctttctgtgtcttggttaaaagtactggtgtgtctttgcatttaggtgtggtctgtgagtctgggaaagcttctagaggagagccctccagggttgctctttggggtgggagtagtgggagcggaaatggaacgctgactgccctcttaaagccagaagggtacttcattcagggcaggcagttggcatgtgtaggcactcaggagtcttccttcagtttcagcggccggtgttcatcatcaggagtggcagggttggatatgggagtgagaatgtgcctctgagattgaccagtggccatagactccagcaagatgtgcatcttggtctgagaggcacccactgtaccagaaaccagacttgtatcgaccaatggcttattagccccaggaggcttattactgccacaaatgtccctgatggtgagcagcacttggccactactgtctgatgttaaccagagttatgggggtggtttctgcaaatacacaatactgtggaggggttatgtggcttacccagaggtgcccagatagcaaatgaaggtgtaagattggaatccctgtctttctggttgacccttggcttggctaatcattcattcattcattccacacacattgatgaatgccgactctgtactgggttctgttctaggaactagacagacacatcacctatgctgctcttgtggggcttctgttccgctgggggagacagtcagtagtaagccttcaagcaaaggcatggctgctggtgtgatgagtgccatgaagacccataaggctgcgttaaaggagatgggtggtccaggaaggcctctctgaggaggtggcatttgagcactcaagtgccttacactggacttctgaccccatgagctggaacttaggatatctgatctagaagtacctctagaagtcctcttcccaataaacaagctaaggcccagtgagcttaaggtgtgaattcatggggtgattcatgggaaagatgaaattaaacccaagaaggacaagtataatagccggccactgctctgctcacaccagccttgggctccagccctctgccttttcatcccagaatgtgttttattatcttcaagactcagccctttgaaagatttagactgccaaattgcatttattaacaataatacatttattttctcatggctgggtgtggggagggggtagaaattttaaacacatttgtgacggttgatcagccctccaggtaaggcaacggctgactgcctggagctggtgtttttcctgcctaggcggagacaccgcccaattttgtaccaccagctgccgtcactgtcagagtggaatttccattggtgtttctgaaatagcagtgtttcctggaggacccccatttgtactttctggattccatctggacctggtttagggggttagatgcttttgaatgggggctggagagaccctactgatgcctctgaccagagatggtgaggcaggactcacagggcccccagggtttattttagggagagagaagcccacagttaaatcagaggtcacaaatacagcagcagaccccacctctcccaaggaccagactgagctataattggccaataatttcatctaaaagcaggaatcctacatcaatttgaaaggagcttctggctgaagtaagactttattaattagcctgttaggaaaatagtttcccagtattatgagggctggataatttcatgcccactgtttttcttgaagcttctcaaaggcagacacagccgcgtgcagcggctcacgcctacaatctcagcacgttgggaggtcgaggcaggtggatcacgaggccaggagatcgagaccatcctggccaacatggtgaaaccccatctctacaaaaatacaaaaattaattgggcgtggtggtgggcgcctgtaatcccagctactcaggaggctgaggcaggagaatcagaggttgcagtgaaccgagattgtgccactacactccagcctggccacagagcgagactcagaaaacaagggaagacactagattttcatttttgtactaaatagaaaaagtaatatctttttaaaaatgtgttttgtttgtttttaactgtttgttcatgccaatgtgccaggcaccatatttattctttaatctatacagaaatgctgctggatgaatggaattatgctcactctgccaatgagggaaccaaggctcagaaaggttaagtaaccaacctaaggtcaggtagtactgaggagctgtgcttggatacaaaaccaggtcatccaacctggaatcttagctttgacccccaaccttctcccggcaactttgatgataatatggaaataccttagactcttgacttgactttactttctcttctctgttataaaatctgctacatttcttttcctgggaaagcgaaatagattatgccaaaagttctgatttttaaaaatgttttattgtgggccgggcgcagtggctcatgcctgtaatcccaggactttgggaggccgaggtgggtggatcatgaagtcaggagatcaagaccatcctggccaacacagtgaaaccccatgtctactaaaaatacaaaaattaactgggcttggtggtgcacgcctgtaatcccagctactcaggaggctgaggcaggagaatcccttgaacctgggaggcggaggttgtagtgagccgagattgtgccactgcactccagcctggcaacagagcaagactccgtctcaaaaaaaaaaaaaaaaaaaagtttgtgaaatagagcacataaaaccaaacaatatgtgtgagatttaatgatttttgtcctattttttttctatttattatttaatactttcaggggtatcctagtaaaagcgactttccatgtgcctgcctgtgcctttctgtgccagggtcttaagaaatgtgtgtgggtttcctctgtggctctgacactccatcaaacaccagggcttgtgcacgcaggtgagaagcatacccaggtgcctcagagatattgaagagggtctggaatgtgggagagaggcaaatggctttccaataaaagtaggctaagacataattaggggcttaggtgctgctttaaaaaataagtagcagtgtattccagactcctctaagaaaagagaattgctcattgtggaacaggcatggcaatgcagtgcctttgcctggaacaccttgctgctgccatcactaagacccattctgggacaagaggaggcttaccccttattgagtatctgccatgagctttgtgtggtccttgcttgctaggtacttggcaagcattatcttttttaccttttaaaacacccctgaggtgtaggtaaggccacccatttcctgacagagattggcctacaaaggtcagatggcttccggggcacactgagcggcccttgtgtgtcggaatgttcccttctgtttgtcccttccaggctggacactttgggagcagaagtcaaagacacctttatcattgtaccctcagcacctggtgtagtgcctgggatttagtagttctgaggagcgtgtattgaatgaatggaggttaagtaacttagacattagatagtaggactctgggctgggcacaatggctcacgtctgtaatcccagcactttgggaggccaaggtgggtggatcacctgaggtcaggagttcgagaccagcctgaccaacatggtgaaaccccgtctctaccaaaaatataaaaaattagccgggcatgatggcacatacctgtaatcccagctacttgggaggctgaggcaggagaatcacttgaacctgggaggtggaagttgcgctgagccgagatggcgtcactgcccgccagcctgggcgagaagaacaaaattccgtctcaaataaataaataagataataggactctgaggctgtatgactgccaccctgtaggtcagaaatgggatctgattccagctcttatccgtaagctaggtgaatgcaaactgacatgcccaagcttattgatattgcaaaattatttattacacaaaagattggaagcaacccagatactcatcaataagagactggttaagaaaaatgatgacacactatgtagttgcaaagaagaaacgaagagggtttttatgtactcttacacaaactccatgaaaaaaaggcaaggcaatgattagtataatatgctaggtttttaataaaagagagaagaaataagattctgaatttgcttgtatgtgtgtgaacattctagagagatgcttagcaggtggtatagttgactgggcagacagaggataagataggagggagagttaactgtatatcttatatattttggttttaaaaccatgagaatgaatgtgttagtcaaaaaattgaaaaggagaaaaaaaaagaggtgaccttgaaccagcgagtccactgacctgtgtgttagcctccctatccgtatggtgaggcagttggaccagattgagactccttagtctgaagtggaatgttgtgaatattgtatttctcaggctttcatggacttttccaggagatcctgaccttgtgctagggtaatctgcagtcccttccgttggtagcctggcctggccctctcaggatgtttgagaaaggttgggggcacagagagcaaggagccttccccagaggagtcaggccttgttcctgtccccattcctcagagtttatcctctgagcacacacctctggtgtgactcagttggttcttcctccaaagtgaaggattacagtgaagagagactgttctggagcattctggcaaagtgctacagtttaataggaaggaaaaaaatggcagaacattttccgggttatttttaatgcttttcagttctgcaaacatttattgaaagctaagtgcaaggcagtgtgggggaatcagttgcataatacctcacctctgctttctggggtgcaaagtcttgggtaagaaacatgcttataaaatttatcatagtaacctctaggacagcctggcttacccatgatctcattgggtcccatggagacaggtgggattggtagggactcgtcccattttacaggtgaagaaactgaatctcagtgaagtcttgtccaaagccacacagtttgtaagcagtaaagcctgaaaccaaaccagatcttccgactacttctcatgtgtccaaacccccataatcaaaacattctcccataggagatgtccggggtgtagattaggcccatttctacctggaaacatggggcaagcacaatcctgattaaagcttcttctccttcacttttttcctttgcttttttttttttttttcttcttcttcttcctttaaggcagagcaaggtaactcttaggcttatggccagatctcaggtcttaactactttcctgtggtctaagcaattcttcttgcattgcctgtgaaacccactatcctaccaccagttgcatgtggaatgtcccctgtgggtaaaggtgtgtaacctacagcagccttctctccaccccaatctcatgctgccacctcctttccttcccttccacaaattctctcgtacccacctggcttcctagctgttccccaataaggccaagcatgccacccactcaggatctttgccctggcttttccttctttctgtctggaaggccctcctagttgttgacttggccttacgtctctgctgaaagctcactttggataggccttcctggttaccctctctaaagtagtgtcccttgtcactattgcttttctgtccttttctttcttttttttttttttttttttttgagacggagtctcgctgtgtcgcccaggctggagcttcgcctccctggttcacgccattctcctgcctcagcctccggagtagctgggactacaggtgcccgccaccacacctggctaattttttgtatttttagtagagtcggggtttcaccgtgttagccagaatggtcttgatctcctgacctcatgatccgccagcctcggcctcccaaagtgctgggattacaggcgtgagccaccgcgcccggtgcctttctgtccttttttttttttctttgcagcattcatacacattatatacatgtgtatacatttattggtttattctttggctcccctgctagaatgtagatctgtgagacaggcacctagttttgtttaccacggtatctttaacacctagcatagtacctggcatggcatgtagtaaatactctgtacggactgttgaatgattgtatcgggcctgcatcctaaagcaagtaatgcttaagaagaaagaatcaaatcatagcattttaagaggggaaaagactcagagctctctttgcagggctttatcatacaatattattaattcatctaataagcatccagcactctttatgtatgaagctctttgcccacggtcacttacagccttgtgattcatacagggacaggaagctcccaagttttcagagcagcccattattttgtgagacagccataatgatctagagaccttcttacaaagtacactggggagaaagctgtctctttatgattcctgcactctgatcttagttcttgaaccactggaaaacacaataaacgtacatgacattccttcaaataagtggagagagatagtgatcatggtctcccctaccctcaagcctaaacatcactagttccttcaattgttcttctagtatcccagttttcagatgccttcctaccctggttgccttcctcaaatttgttctttaaattttggaatttcaggtctagtcctgtcagtgcagagtgttttgggaccctgaccaaggagccctggtccatcccacgtgttcctatcagcacagccttcgatggctcatctgtgttggctgccatggtagaagcctccttcatgagcctctgatgaagactaaaatcattaagttcctttttacattgtctcgagtcatgtggaccctccctgactctcttcatagttttttggtttggggtttgtttttgttttttagcattttgagattaaagcagccatagacttgtgaacaacaatgaactcaacctgcactctttttaaaaaacaacaagtgtaggtaaggttctaccaccaaacccagatgaagaggatggaactctggaagttcagcaatacctgccaagcctccaactcctttcttccctcatcgtgtctttctctgtctgtgtctgtctctccctctccccttccttccagcagcccctcagttccccatagtttccttgctttccctcattccatttcttttattaatcctccttccaattagaaatatggagttaacatatactgctagcatttcttgcacttccttcactaataatttttgccatacctgtgtatttcacagatttaaggaagctgcacatttcacacttgtctaagggagaaataactaatgttaaattgcttcttatgtgtagcccctggctaatttgttttgtggccttggatagaaaaaactttcagccccagccttaggttcttctgcatgattggttcccatttctgcccaaatcagcgatttcccattggtggttggacaacagggcttcagtgccgaggcggcgtttgctctgcttctgtcattgctgatgctgctgtcattttgcatagaggtggcagggaaggaggccaaggtcgaggtttcttctgtgaggccatttagctttccctgcctcttctccacttgcagctctgcatggatgtgtggaaggtggtggtggggagagcaggggctgagctcaggtctgggctcttcctaacagctaattttattttccacctttctttcctcttgcttcaaggaggatggagagtcctgtgactttgagggtgtgggccctaagtttggagtcttgagagaatggcctaaggttcgattctacagtggggtaactgtgtagccttgggtgagtcacagagttagtttccacccagcttcatcaattgctagggaagttggattagatacagtagttccccaaaagtggcattgatggggtcctttagttctttgaagcattttttaaaagctatctgaaaatggggcagacgcttacaccacggctgtgggatgcgtcctggcctctgagtctgattggcatgttttcttagatgggttatgctgggggctggaataggcagaaactttgaattgccagctcctgggtctctgaatagtaacactggagaaatgaattaacttctattttgctgacagttcctccactcggggtccatcccggactccaaggcagaaaccctgggctgctccctgaagactccagtgggatttcctaagcagacagctcccgcagtccacaagcggtcccagccaagctgggcttcaatctcccaatctgatttcagcagccagaattaaccgtatctgtcagctgggacagttgatttttctaagagtggttttagtggggagctttgcctcagaaagtgaataaagggttagccttctgtaatctagattattctccagagccattccccacccacaccccacccctcccctagcctgtttggccattcagcaagcatttactgaaagccagcccctctggggagggcactagggtgacactgagacctcagaccttagcaaggctgtgttgggggagagataggaggaagaatgactggccttcagcagcattcagggccctggtggacaggggcaggttgcctgggagggacagaaggggtaaaatttccattgtctatgaggggagaagcactttgtaaaccgtaacatgcaatgccaagtgatgtcattatttttgctgcacatcagggaggctagcagagggctgagatgggaggaagcacaggggttttgccagggagcactgatgggtgggggtctgggaatcgtactctggatttgcacttgatccctgtggccattaaaagcttttggacaggggagtaatgagacatgatgtgatgtgatcaaagcagcgtcttaggaagattgagcaggatttaccctctttgctctctaggccttggtcttcattctctgtggcttttctgttgcatgggtgcagtgctgtggttctgtaataagatcaccaagaacggctgtggtttgtgttttgaatcactgaattgtcagctcatggatctgagtagtgatgggtgatcctggtctctcctctcctcccaccccaggcatcttggaggccactcaatgacctgtgagaggatagacatcagatgggacaatgctggactcccacattcagaacccagcacccggggcctctggggggtgtttttatatcctgatgtgtggtttttaaaaacttgttgtaattaattttacaaattgatatagttgtacttattttgggggtgctgatatgttttaagagattagatgattgagtttcccatttcacttattacccagggtaactgccccatgtcccagatttccttcctggcatccctcagtgatgaatcctgggccccttgacccatgaaattggccacgttctttccggaacagtgactgagtttgaatgtggggtgggcactcaggctcaaagtgtatgtaccgagagaattttgaaactagagggaccttatttctgcactcaggctctattgtccagtgtatggactagaggactaggagaagcccagagagtggtagtgacttcccgaaggtcacacagcaagttagcggcaaggcggaccaaagcccaggtcatcagagtgcctgacaagcattctgtgcactacaccttggtgcatcttggccccttttccttctcttccctggttactgttcacacaccacctgctgggactctgcttccagtgcctacctcttcagtcctccagcacctacctcttcagtcttccagcatccactgaaggtaggaggggaacaaccatgtagaaagagtcgagtctgcggctgggtgtggtggctcatgcctgtaatcccaacactttgggaggtggagacaggtggatcacatgaggtcaggagttcaagaccagcctggccaacatggtgaaaccccgtctctactgaacatacaaaattagccaggtgtgatggtgggcgcctgtaatcccagcactttgggaggcggaggcaggtggatcacatgaggtcaggagttgaagaccagcctgaccaacatggtgaaaccctgtctctcctgaaaatacaaaatcagccagacgtggtggtgggcgcctgtaattccagctacttgagaagctgaggcaagagaatcgcttgaatctgggtggcagaggttgcagtgagccgagatcacgccactgcacgccagcttaggtgacaagaacgaaactgtctcaaaataaaaagagttgagtctgtaagattttcactgggtcgtgtaccctgccagttctaaaaccttcatctccccttttccacactgcagctcccatcccccagcaaagctagacccaaaacccctccttcccttcttcagaccccaaaacagttcctgctcctctgtgaacacttttaagagctatacacgctcttaaaccagacaggcctgggctagaggctgggcagtcagggaaggcttcctgcgggaggtagaactgacaggtccttgatgtggagtctataccagctggaaggtaggaaggaggtttaagggggaggaagcaaaggaacaatatcagggaggggcccagctaggattcaccagctaaacaggcccatttggcaagcccaaaactcaggtcctgcagccaccccagcctgcggagtactgccctgagtctgtgtttctggctggaggaacatctgcggtggaaccagctcctctgctttggtgaagcagaaacccaagtccctctcacacccgcgggaggagacagaggaagccggttccaggcggtgcaggagcaagtcacagggtttatgttaatgcgggccctccccgcgccggcggcttagcctatgagccggggccctggcagacagcttaattaccgctgcagcgcgcctcagcttgtgttccttggctccctaaaataataaggatggcgtcaccgacttccccgggccatgtgctccccgcctgccttcagagctctattgtaggaaacaaacaacaaaaaaaatcagagacgtggatgcttttttcttggggagattttttgtttgttttaaagtaataggggactctgcccctagttaaggttttaaaagatcttctagaggtgtggagatctgggtctactactgttgaggctgcagaatagcctcctgttagcagaaacttgaaagctacacgagtgatctgttaattccatggtcttccactggggatgtgagttctgatgcctggtggtggtgtgtgctgcagggaaacgaatcgcccagctcacagtgactctggccccaactttggaccttgcttcttcctctgaaaaaagagaactgacctacaccagagttttgcagactgtaggtcacgttacacatattttgttctaagtaacataagaaagtaattgcaagtgttaagttttgttttcagttgtgtatgcctatacacacacaaaaacgtgtgtactgagccacggtgtaaaatgtagaaagccactggcctaggagatccctaaggcccttctagctttcaaaatgtctaactttctgtcagagctttcacttttccccaacatggaacctgactgatttctgcaggttttgccacactggctgttcagcaaaaccatcgattttatggttaaaacaacaaaatcacaagcatctatcaccccagtctaaaaccttggtgtctcagacagtttggccttctagctgaaatgggatctgcaacaggggatggcccatttaaaagctgacctatttaaaacccacgagcaccaaaaaacacagggtcaatttgatatgagtcttctcttgtgtgcaaagactggaacctgaaaaccaaattggtcagggactgacaaggttgaaaccaaagctacaaatatgtattgaattcttgctccgtgaaggaaaagaaaatcaagggtggtcagggttagtgtgaaaaacaaaacaaggtgtggatgtaaaaatccaaaggggtcggttttaagcacaccattcctggttccccaacaggttaagaggcctcgtatttactataaggaagccgtacagacagcttagttgactcaaatctgctaacctgccctttgtttccattcttgtgccttgactgtacgcaacagtaaagatagccatggaaaaaggggaaggcaagtggctttttccaagctggggatgctccaagtacattcttatttaatccaaccctaggtgatggacattatagtcactaaaggaaacggaagctcagaaaggtaagctgggctaaaaagaagaaaaattgaacttgagccagttctctcggactcgagagcctgccttctgtccacctttccatgttgcctcaggaagtactagaaaaagaaggagcagttcttactctaagcttccttctctctggtcctgtccttcaaagggctctgtttcaggcccaaactgtccactttaatcagggccagcttcacaggcatgtgacccgtgcagcacgcacttggtttaatgcgctgctgtcactgtcttggaattcttaatttttaagcaaggggctccgtgtttttcattttatgctgggccctctaagccagtcctggcttttgatatagtgtatctcctccgttggtccttctgggtccccctcatctgcctttagcatgcctgttctatctggtagaggcatttgaagaatgcaccctggcccggccccagtcctgctacctggcacactggactggagttgtttactggtggctgtctcctcccagccggccaccacacctcttgctggcaaggaccccgaccttggcttactgtttcttccgtgtctcctcagccaacagtgtcgcaggtgtgccccatgtggagagggctggagacctgcatgcagagcactgggtcattcaggtcagggggagtgtgcacagctgacctgcctctcaggggcttatgcttgtcttgggcacaagaaagactccaaaaaaccactggtgtttataaaagatagggttcattcaacatttattcgtcatactgttgaatacgtttcatgacagtttgactcacctctatattcccagcacctaatgttatacctggcgcaataaacaggacatttgttaagcagttgctctggtctccgctccctggtaggctgattacggaggacagtccctgacctctaggaggatcggatgcttaatacacgagtaaatgattcatgcagcagctgcccttggtgccccaggatgcacagagctgggttggagaaggcttcctgggaaggggaactggatttgtagggtaagagtgagagattgggggtgctgaggttggataaagaggagggagctccaagaatggagaaccttggaggtcatgtgtaggaacttgaatttttcccaaggcagtgagaagccaggaatgttttccaggctggagtttactctttataggttaaacagatctcatcatcccctttctacagaggcagaagcctgaggcctgggggagagagctgagatcatggagccagttgggtcgagccctctaggtcgaggcctgttcccagtaatccaggctgcctcttgaccacttccatcctcacagtcatagagacctggtgtggaggcaaaagcaggcttgaagtgactcgaggtgacagtgaccagtgctgcaacgttgggaacagaggggaaaggccaaatttgagagatctgtaaagacaagatttcagttttaaacaacaaattgttccttagagtaataacgtatttgtgtttatcatggaattttcaggtcccattggtgaaaaatgactgacaggtctttgctttggggacaagtttttcaggaagtacaggacccccagcaatctgacatcttgggaaccttcattgcctcctcactgacctctcttatgaatatgagggctccttttaggtgttcacttgaggaatgaagcattgggtcctgtgtaggtttctctttggggtgttggaaaagcttctgatacaagcagagtaatttcagttccactaggtagggtaaccacatttggatatttttaaatggtcagtggaattgggaaaaagtctacaaaagtacaaattttcagtttaattttaactttgcgcttcactcacacccaggacttggcaggggaagtgggccttggttttttttttttctttttaaagcagaacacaccctgggtggaaaagggatgttctctttgcatggaagggttagaaccaagtacagaggaaatgggttggtattgtagcaagagttcaggggtgggtctaggctttgaaactagagcactaggaaagtgtggccctcatggaggcaggcagggaagggaatgggatgtctttcacaggcagctgttgggctgacatttttgttttgtcctgtttggtgcatttcagatacttcacagctcacctgctgctctcactgggacccctcttcatctcatgacaaagcagtgggtctttcccccatgtggtttgggctttttggtggtatcagcaacctcaggtctaagccctgtcccctccttcccctctgtgatctcaccctgcatggtgctgaaaccaaccagggaggaaatgcagaaacagtggggattctgaagacaccacctttaaaacgatggggatttcccaagggagtggaagcaacctcttgctatttggggaagagcagggtcccaggcccctctctgtatccttgccccctcctgcagcgtcatctgagccagggcagggttaggctctgtgctttggttgctaaggatgtgtaaccagagcagagacctctaggggtggtgcccacctggctggtggaacagttagaagaggagctgaaaagaaacagttacagctgtaggggcgggaaggtgtgatccctttccttacccgtcgtaagagtcatggccaacacttataacaaaagaaaggctaacaaaagaagagcgtaacaaatttatttaatcaaagttgtaagtgacatgagaaccttcagagaagaagaaccaaagacccagggaaactgcctatttttatacttaggtttgatgaagaatagacagccatgaagaaatgggactggacaaaggggtgtaggctgagagggaacccagcaaggcctgtctgttcagattctttgtggcctctctgtgtagcattccttcctcctagatatggggcaggacttccctggcatgagggtcttcaagggagaagggacaggagagagtaacctttctcggctttgctttgggagagaggaattctagtttctgtgacccgccttggggaagagaagttctggattctgtgacttctggggagagagggtgagagacaggagggcaagagaaattcacagagcttgcttctgaggccttccaatctcctttagttcaaagtacccagcacgccaaagccccttacatttgggtattgtgttctgagccccagcacagccaagaacttgtagaattgacttgggggtctggggagagtcccaagaagccaacaggggcccctcctcatcttgtggctaacactagccacctgagtgcagtagacacccaccctcctgtgaccttcttttgggattttaggataagcagttcggacgtgcctttaaaacggagagaacacaccccaaggagtggttatggggattaaacgagactgtgtatgaagcacctagagtgtgcctagcgagtgcttgagaaagatatgacgattatttttaatcaaagcattaatagtgattgcttgagtattgtcctccagaggagcagccaccagttttggtgttgtggtaggagccagggactggcctcgtcagggctccgaaacctatgtctatctgtagcattcctaggcagcctaccccagcagcagccccttgggctgtgggcaggggtggcaggcagcactgttcctctccaggaaggagaccgacttcctggacgaattccctgggctccccagcactgctctctgaggccctcctctcctcggccaacggcagtaaggagaagccattgacccgtctagaaaaaccgcatgtctgcagtctttgagggtagactggaatctcttctcatatttgccttgctttggtggagcttcaagaattcccaggccttccaaggaaaccaattactaaagaagactgtgggccacgtgactccagtgtttactgcaaacgaaggagatggctcccctcccccaacacagttactctccctccatctgcactggccccctaaggcctggcttcctggctctgcgatgctttcctgccctagggcagaaggcctcacaggatttattcccaggcactcttgccatgaccttgagaaggtggcttgacctggacatctggatctcagggactgagggggtgggaaaggactgagcctccccctcccagacccaacaggaaggtgggctttggtgaccatttcctaggctgagagctccttagctccaggagagggctgcgctccctggttctcctgctctgtgggctgtgctagatgaaacccacaaattgctgctgtcccgggcggagtggcatgcctccacccaccagtgaagaatgaaggcagggcagttgcagggccctgcaggactctgagatccagatgtgtaccccagtgctcccctgctctgcccactggcaagagggggctgaggaggggcatagcaggcctcatgtggactctgtttccacctcctttcccccatatctctacttggcccagagatgcctgagtaagaggggcacctagtcattctgggcccagaaagaagaagctaggcatgttggcctgctcaaaggagcaggagcagccctggacagggacaggttagaaagcctggctgcttatccaagagaagaaaaggccctgaggggcaggagcaaccctttgaacaatgctggactgctgttgagaaggaaggcttgtgccatgtgacccattggtgagaaatcagggcctgtgcatggaagttccagggagggaggcaacaaatccagttgacattggtaagtgtttcctggcacctgcagggagcttgggctgctgtgtcctgggctgaagggactctttgagataccaggtgtgggcagggatcacatttaaggtgtcttccagtccagagaggccgggtttcccagaagctggctgctctggggcaggaaggagaactctgggccagctgcctggagggccacacaccgggtctcctttgcttactcccagggtcatttcatgcctgcgacctggttacttttcctcggcctgtctttctaccttcttcattagaacctgcagtttcaccttcagctaagtctacctcttaacaaccctgtgagagggtggctttttattcgttctttctacctcattagaaataaaggatttaggacccaaattgtgggtaagggagctgagtggggaaaaagacagggccacagaggtgcctccaagcacagactttgagacagatctcagcatttcattatgggcccatcctaagtttgtgggtttccattctccttccacgtctatgctggaccgtgaagagcaaagtctagagctgtgctatccaatatagtagttacctgtgtctgtttacacttaaattaattgaaattaaatagaattaaaagctctattccttagtctcactggccgcactccgtggccacatgtgactagtggcccctgtcttgaacagtacagaccgtttccgtccttgaaggaagttctgttggacagtgctgggctagaggtgggagagctggaggagcccctggtctgctgcgcctgcctcaggacaggccacatgggtactgccatgtgaatgccagctacagcggcaggctctgctgtgatggcaggagtgggtgaaagcaactgggcatgtgggggtcttgtgggggcattggggtggcggggcaaggcccagaagtccctaacaatgctgtggctggtgcatgtgggttttgggagaatgcgagagcagggttggaatgagaccaccaaccttgcagaggcagcagggcttactgggtttgtcttctgcggtacagccaaggcccctgtctggagtggccccctggttctgcagctcggctcaccacaggcctcctctcacccagatgttgaaaaggcagaaaagtcagggtgggcaaatccatcctgtggtcgttggcagcacagtgatccggaaagctagaagaagtgacggagtgactgactgcttcctgcgtctgtctccctgttctctgaggagtcctctaacaccctccccctgcttcagccccattcctcagccccgctcacacggtcgggccttctttcaggtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaaggtaaatagagtggagtctgtgtgtgctgggaggcgggggtggggagtgggaagggttattacctatgtttagaaagagtaattgaagggaaagccgggtgcttgcaccaacatgccagacaattgcctgagactgctttcccttcttgcccgtctggggaaagccgggcagctctgagccggtagccttcattttaaaagctgtttctgctttttctttccctgccttatttagcttgaactaagcgataacagagtctcagggggcctggaagtattggcagaaaagtgtccgaacctcacgcatctaaatttaagtggcaacaaaattaaagacctcagcacaatagagccactggtaagtcattcggaccctcccctccctgcaggggtaggaggtgggaggaattggcatcagcaaatactacttttgcatttgtccttttcccacttaatttttttgactctcatgatgtgctatgagatagaattgagctattgtttctgctgagtccatagagaaactgaggcccagagaagttaaataccttgaccaaggtcacagacagaatgggcagctattgtacgggtagcgtagaaccctagtttcaatttctggtctcctgcttttccactcagtttctgctcagctttggaaacctgagctgtaatgtcttcaggttcagggcatggcttgttgcccctttttgggaagggaggagcaatccaagaattaaactggccctggaggtggactccagttttctccttgggtcgctggcccctgaactgtgagaaatgagtcagtcctgacatagaaccctggaatgactgagagccgtgtggtgtgagagcctcgtgcaggcaggccttcctcaacgtggtgtggagaagagtgacccctggtcaccagtccttgttgcgatagtgaacaggctctcaggggcctgggtagcatttctggctcctctgctcatccttgtagagatagacatcccctaagcttcactgatttaccagccagaaaggggcaggtcatgttcagaacaacactttctataattaccaggatctgattcgctgtattcctttgattttaaggaaatcagctgtaagatgtgtcactgaaaacaactcttttggaataggaaatactaccacatgaagtaaatacacctgttgtgaatatacatataagagtcacctcataaggccgggcgtggtatctcacacctttaatcccagcactttgagagggcaaggcaggtggatcacctgaggtcaagagtttgagaccagcctggccaacatggtgacaccccatctgtactaaaaatacaaaaattagcccggcgtggtggcacacgcctgtagtcccagccactcgggaggccgaggcaggagaatctcttgaacctggaaggcagaggttgcaatgagctgagatcgcgtcactgcactccagcctgggtgacagagtgagactctgtctccaaaaaaaaaaaaaaaaaaaaaaaagcagcagcagcagcacctcaggcatcttagaatcagggaaaggccaggaggacaattggccacgtttgccaaatttcccttctgggtttataggggaggttgggtatccctcagattgggctggagttttcagggtttctgtcccaaaaggcactccttgctctccatggatgctcacgggacttgctggtggccagtgtggcagaagaggacactggcatttcttttccaagctctttacctgtccatcgatggcattggggccaactagtagaatgtgcttcccacagaacttcttttcaggcctttcactggtctcctaggaaaaagccaaactattttgatctgtctggaagtcttgattttataatgtcattacaaaaggaaaaagtctttgaagttctgtatatgggtgaggtatggggattgagtatataaaatccttgtaaaacattgtgattcagtcaccattaggggtcaggcactcaggcacgttcatgttcacactctccactgccccctgcccagatcacacgtgtctcagtgctttctccgcccctgcttgtcagtgtgtgttgccttaccgtcctggggcgggaagctgcttttggtagcaggtgctgggcttgcccacacagaccactgtcaagacttcctccctgcccttggcttctgctgagaatgacccaggtctcaactgcaaggtcatagagagagcaacctagctcccgacattgactccaaggagcaatggtttcactcccttgttagacctggccacctttggaatggggactcagcctgggatgggatttttttgtacctggtgcctcaaaggtgggtgaggtgggaagtcaaaatgtagctcagttacttgcaagcagtatgacccttcacttcctgggcctcagtttcctctaccatcaaacagggataacattggctagaacccgtctggtgtaaagctttgacagagcacatcgtgtcaaataccatggacagaattggggtcctccattgctttttctcttgtccttttttgacaggcaatattcaaagagtaagagcacaggtctgaagttgggctgcctgatgaattaccaaatcctgtgccctccatttccacatatgtgaaattaactaataattatttctaccttacaggggttgtgagataaagtgactcagtacatgaagtgccatgttaaccgcccttatcatcatcattatcagatgcagaaggagttagtttgttagttcaagttgacttttggtttccctctggctccttagtctcagggagaggcagtaaacctcttggctcatgcaccaagaaagccccaggctaatttcaagtcaatcactgttaagacagaagctgtaattgcagaataaaagtgttaacattggataaggcttcaaagatcctccagtccaaccccccattttccagatggagacgccgaggcccacaaactgcaggtgatatgtctgggcaaacactgtggctaagcagagccaaatccaagcttccttatcacctggaagtcatggtctgcgcatgctatctcatggcatccttgcctgtttgctagggctgttcctccaccttcctcccacaaatcacttactgttggcttcatttttccgcttgcagaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatggtgggtgacagggtgcggcccagggctgcaggggcccagctgaggccttggggctcgtccttggctttgcagaggtgggtgggctgggtgttgggaggcccccacccagctactgaaggctggctgtctgtctggtagctaccaccttccaaagctatggaggggagtagggctgtctgctttgttttccatagtccctaatctgtctcattggttgacttccctaaaagaacaaagcatgagtcccatgctcatggaaatatcctgagattctccaactgcataataactcctttaaaaccatccaactgaatccccacttcaatttttgtcccttttccaaagcccccagggagtgggattctacagtctttctgtagtgtgacccgcacttagacactctcccagggagggagggaggggatagagagagaagagtgtgtggcctgaggacccctctttcccatctaggtattcagtagtggagaggaggtccagagctagaggggttgtggggccccctggtggttgcagcctacagccccacacctaggggcacaggctcaggtgctcaggagccccaggtgctcagaagtggaggactgcaggccacttgttgggttccctggcagtgtggtgtgtagtcgaggcctacaggaaggaaggagggaaaagaagggagtcctgttccctccccttctcccttgccaccagcacagtgcagctttcccatgcatcttcgtggccagataaagttgagaatggagacacttgcctgattaattaattcagatacaggattttggttttctttgttcaattgggagtgttttgcaagatactcagagaccatgtttgccttggtggggatcttgtgatatggcagaaaggagccaaaactggcagtcccgggaccaggtcccctaggcccagctcaactagtgactcgatgcgtgaccttgaacaagtcagttctctctgtgcctcagatctctcacctttaacctgaggagtttgatttgatcttgccgctttcccgggccctggaacctgttgctgtgctctgacaatttcctggtggtctcggtgtgagaggcctccagaaggggcctttcacatgcataacacttgtgaggggggcttatctttggcacaacttcaggatgtgtttaattatgtcagcactgttttcatgagagttagtgtgttccatctttggacttaggtgggtgtgggagggtcatgagccccacactgaagacgctacaaggggcctgtgctgtgtggggggcggagccagctcaccactagttctgtttccgttccccatttcgattgcacagaggaggagtatgatgaagatgctcaggtagtggaagacgaggaggacgaggatgaggaggaggaaggtgaagaggaggacgtgagtggagaggaggaggtaaggaggctgggctgggcagggccaccgtctgcccctttgaggcagtcccactgactgcctctgtgatcagtcttggcagccccggagccctggttaggaaagtcgctccccgatgggtagtgaagtgagtccatttcagagcctttcactgggctgtttctggggagacaagacttgcagtaagctctggggaggctggattagaagaggggaagaggattttagaggcagggactgaacctgctggggtaagcctggccgttgtttctatgtgaagaagtacagaatgcatggccccattttctgctttttgctttcatatgctaattaagatattcattgagcacttaaactgtgctagggaaaaccaaagtctgccttgaactgataggtagcaggataacactgctggatcccaaatcagagagtgacactatggaaatagagcaccaggagttggccattttcctaaagagattggctggttcccagttttttaacaagatctgtgagggggtgagtcccagctctaccactcgcaagctgtgtgtccccagacaatttacctgacctttctgagcctatttcttcatctgtaaaatagggatcatgatagctttctcacagggttgttaagaggataaagtgaagtgtaagtaaaatgcttaaggacagtgtctgacaaggggtaagtgtctgactgcttattgtaggcgttcacaccctcctccaggttcctggcactgtgttgggttttgtgtttgtgtgttctgagtctctctgtagcagagtcattttctatgacttgctcagaattctaaatcaactcttgctaattgcaaaagttagaactagagagttttaaagtgacaatagcatggacaaggcgcctgtgtcccctcccaactccccccgcagtttcctgtctccctcaatggaggatgcagacacatccgcttgccacacggactcactcagatagtgtcttccagttccagccagccggcccaggcttgagagacacaggccaatgacaatagaatcgcggaggccaggcgcggtggctcacgcctgtaatcctagcactttgggaggccgaggcgggcggatcacttgaggtcaggagatcgagaccagcctaggcaacatggcgagactccatctctactaaaaatataaaaattagccaggcatgttgatggatgcctataattccagctacacaggaggctggggcacgcgaatcgcttgaacctgggaggcagaggttgcagtgagccgagatggcaccgctgcattccagcctgggcaatagagcgagactcagttaaaaaaaaaaaaaaaagctggccagatgagcttggtttctgtttagttgtgctgctggctttgccttctccctaggtctagactcttaggctcatctctaaagaatattgtattttaaaaataaagtcttagtaaaacaggttcccctagaacagggcagtaagttgtattggctaatagctgttacatcttcctcttcctgtcacaggagtgctgcatgtgaggtttgggggggtggggatgggggagggttgtggattttgttttttgttttttgttttttaaataatctcactgaccatctgcatatttccagctttcagtaaaggagagcttatacatgcaaaaaaaaaccagaaccttagcaaacagactgatgagggaactctttggtgacattttaaaagaatgtttcccttgacaaaaaagaagtctgtcaccaagttcttttaaacttcaggaaccaggtttaacaagcagagattcaacttgcatatactttcaggagcagaggaaagcaagggccctgtgttgagaaagaaagtcatacaccttgctgaatctcaagccggttgggaatgatgtcctcagggggtcttgaatttatcttccccaacccttccaggtggtccaagtttgcaagctagggaaggggctgggtcaggtgacgttgaacttgcccacagaatctggatttgcttaaactggggtcttctcttgaagccaaaactagattgaggacagatgcaagaaaggatggcctactttgcacgtcagggagtctgctcgggaacttgttctcctcagagaacgtgcagactggagagctgcctgccttacagggacttcagatcagagttcttaacctgggtcctggaatccataaccccctgaaactgcttgcaaatattataaatgatacggacattttctggagaaggagttcaaagctttctgcagatttcccaatgagtccttgatctgaaataaattaagaacctctgctttacattcctcccgagatgtcaagtcttggtgggggctctgagaggctgggggtgaccccggcctttttgtgctctgtgtggcttcctcagcatgtcccaaggcagggcatttctaatgttctggtgtctgtcctttctcctaggaggatgaagaaggttataacgatggagaggtagatgacgaggaagatgaagaagagcttggtggtatggcagcctttttactctcagctggtagcagcctggccctttcactttggccttagattgcttagactcagaggcccctggcagtgggcaggacactcctgtcagaggcctcagattccccttccagctgtgcagatgtcttgcctcggtttccaaggatggcacagcttgctagtcatgggtcccctgacttctcactgggtgggttgagttaaagaggtgggattaataactaatctaaatgccgctttcttacttttccagaagaagaaaggggtcagaagcgaaaacgagaacctgaagatgagggagaagatgatgactaagtggaataacctattttgaaaaattcctattgtgatttgactgtttttacccatatcccctctcccccccccctccaatcctgccccctgaaacttatttttttctgattgtaacgttgctgtgggaacgagaggggaagagtgtactgggggttgcggggggagggatggcgggtgggggtggaataaaatactatttttactgccactctttatttttttcccctactttttctttgtgtccggtttttgtccctgtaaatgcgatagctaagtacacactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaatttttttggggatggcttctttgagtccaacaggccattgatcttttcaagatgcattccagatgaactgctaggtgagggggaagcttcatttttgttacctgatagaatagcttttcttatgagatatatataatgtgatactatgtttggatatttttggtcttaaagcaagactcagtggtgtatcttcattaaaagcttcctttaaaaaagttacagagttactaaaaaaacaagtacccaaacaatcaagttgggccaaccttggaaccttgttttgaatatctttcattgttttgtttgtcgtattgtaaaaagaatgtatggttgaaaactcaggaatgtttataaaacaaattatttcacaaacccagaggtttacatatggtgttttattttgttactttacttaacagtattataatcatttccctgtttctttaattttcaaaagcatgtatcttaaatggctacatagtagtccatcaactatattctgatttacttaattctaaccaaatggttagatgttttcattatgtccagcttacccctgtagtggatattgttatattactacttatttatactttttgtggagttcttagtacaaactcttagaagtagtagagtcattggaccaaaagctaaaaacatttatgaggctcatgtacaaggttccatgttttccagaagagttcagccaatttactgtggttgtttatacacgtacacatatactcattcttatgtattcattctatacagccttgaacccacaacaagccctagttccttacaatgtcttatagttgttgtgtgattccagcagtgtaaagtgtttccaga
